United States Patent 9,328,346 (POLYCOMB-ASSOCIATED NON-CODING RNAS) - sequence listing, part 53

SEQ ID NO: 9634 - RNA, 43382 nt, Mus musculus
ggauaggcauaacaugaaagaaauagaggauggauuugaucuguuguugcuacacguggaagugaaaugacuccagcagaaccuugguugcaacggauuccaccuauugugagagcgguaugccaucugggggcugaggggcggcuguugggcugggugucugcucuguacucgaaugcuuuuguucaaagaaucccauuguaagauccauccauuugaucuugacagaguaagugugggaacauccuucgugugguaaaucacuuggaaccuguggcaccuagggacggaaauagaggaccagagaacuauaucagaugucccucuaagagugcuacaaagucagcaugacuuguggggggagaagggauucuguggcucucagucauucuauccguuugugcccugacagcauucuccuagaugucagaaacgcuguuaucccuacagcuuugaguagucaguuccugccugugcagguucgaacuggggccagauggccgcugggaauaugcccggacuuguccaacaacccugugcaucugggauccagagauaaggaagagaaggagccugggaguuagcucuuggagaggaggagggaacagauuggacaagcagagcauccuguggaaagcugaacuagcccacccacguggugccugggcaaguccgggccuguguaaaaagcaauuuggcacuguguaugggggcuuucaguccagccucgucaccagugcgacugaguuucauuugaucacuugcugcuggaagccgagcccgggacagugauauuuugauccggccucaccccaaacacuggccaaggcccagacagcugcaagaacuggcagggugaaaggagaagggaccugccagagacuaggcugggaaaacaggcuguaagaucucauuuugacagguuuuggcagcgcuggccaauuucaucuagggcaguaagagguaguaaauuguggaacucgcuguccagguaaaguuucugucccccuugacucaccauaccuuucauccaaccuaugaugcauacugaauauuugcccucuaucaccaaguuugaaguacuaagccauauagaggcuguucucccuggagccuuaagagacucauccugaguguaggacgacaaccaauacugcacaagaugagcuuuaaacauacaagcaaaacucucugaaguugucauuguaaggaccauaucaacuagagcuagagaaagacagauauggguuugcuuguuuuugucuguuugcuugcuuguuuguauguuuuuggacaccuuuugaguguuugauuuuucaccagagguacugagggaagauuugucucagguuucuuugggaccugauacaaucccauguagauaaggcuggauugaaugauacuuauuagcugaggaggauuuuaauuuccgaccucccugccucuaacuccuaaugcuuuacauauaggucuguguucauuaugcccagcugacugugguucaauccuaacaccuuugccugcuagagagcaaaaguauuucuauucagaucucauuccaccauauagugacugugugaccuuggagaaaaggaauauuucucccucucugagcuucauuuuacuacaagcagcaguugaguuaauaauaguaccaacaucaucgaguuauugugagaaugaacugaaauaauccauguaaaauacuugaacacgcuuagcacagugcaaaauaagcacucaauaaauguuagccgugauuauuuaagauagauuauguagcacagauaggauuucaacagguggaauaaggagagaagacauuuuaaauagagaaaacauagguaauggccugacagcaaggaacucagagcacagagccugagaaaggagcaauaguuauauuggauguuuuaguauaauuagggaaaaguacaaguuagauugaugagaaaaaaacacaagacuggaugcuugagguucuguuuauuagacagaaucauagagcugcugugaguuucuuuuuccccauucauucauucauucacuuuacaucccaauugcugcugaauugaagaaaaagucagaucuauacuucagguaaaugugaauaaacugggcuugaguaggaaaaaugcaaaguggacaaaucaaaaguacacaaagcccuggaccugacgugguggcuaugagaagagaaaggagacaacguaauguguagaucaagucauauaaacuuuguucagaaauuggaaguugaugauuugcauggaguuuaagaauggaaagauggagggucucucuaaggguuagguuauacuuugaaagagcuccuaauuuuaucccuucucucuggguagaguuaaagacagauguuuuuaaaucuuggguagacuuaccugcuguuuggaauccuaaaugcauugugugcucagcauuuucuugcugcauuaguauucacugguuguauacaacaaagagauguuucuucuguccaccuauggaaucaugaguaagccuggaaauuaaaauuuccucaugcuucuguuuuccugaaaaaugggaaauaacucccacuuauugaaaggauuaaaaaugguaaucccuguaaaagaccuagcccaaugcuugaugaauaccaggcuuuugugagucauauguuucuuuuuacaacaacugacuucaccuuuaaacauccaucucaucucugacuguacauuucuagaggaaaagucuucauuguucucugaaagaacccaucaucuggggugggcaggugggggaauccuggccuguuggaaguucuuuccuuugucuggcugcauucauuaugucucugacuuguauucagauguucuaauagaguuugcugggguuacuuacagcaacuggccucuccuuucuaaaaguucagagaucuggaaauaagagaccaaauuuccuucacauuuuguucucugguaaaagagcugguuucuuccauuucuuggcuggcuugauauuaaauaaaugugagucugagguuuugaauuauacaaaaguuaagugguaauaccuucagagagauggcagucacugcaaaaaaaaaaaaaaaaaaaaaaaaacaaaacaccaaaacaaaacaaaaaacaaaaacaaaacccaugaugggauaaugugacaagauucuuuauaauguauuauuuccuucaauuguuuaauugcaccauuucuucguagagaguguauaaagaaaaugaaaccuacucaagauuguuuggucuguaugugucugagucauaacuuuaagccacauuuuucaucuaauucacuuuuuuucuucauuuucuacagcuguuuguauauaaaaugauggccagguaggcuaauucugacacuagagaggaagauaaucauuuaauuguccuguaccaguuauuaugucuuugaaaucuuucaguaagagaaaccagggagaaaaauaacuagacccaagagaaaaacaaagaguaacuccguguaaaaaccuccgcaaggccauauagccuuucuuuacauagauggcugccugaucuauucccugcagugaaguccuuauucagagcugaagccugugaaccagaggcuaguuuuucaccguuuccuuuagaaaacgggcuccaccuguauauucuccccuaagguucuuaaugggaagaguacuggccaguuuuaucaucauucuuuacacuagacagacucuuaacaaauaaauaugagagaugcaaggaucgcucuagucugccuuagauuagaauuaacuauauauauauauauauauauauauauauauauauauuugguguuuuucuagaccuguucucuuauagaugaugauaauuuuuuuguuuuuuguuuuuuguuuuuuuucauuccaguguggcuuucucucuuuugacuaaguucuaacagaauuuggagcuucacaaacaauuaucaacugagugguuagugacuagccauucacccuggagaagcuaaagcuacucuauauaagugucccugagagacaacaacccacacugaaaaagugaagugguuuccauguagugaaugauggaaucaaacaguaaaaugucauuauuuccaggagguuguuagucacuauugugacuaagccagaaagagugggcaguacuauuucccuuucacgaacuaccuuucccugaaccagucuacccuuuggaauuuuuccgcuugagagauuacugagccaacauucugcugugggaguaagaggggaagagaagcuggauccuugguaacagagucaguggacacucagcauaaagguggccugcuucuuuguuuaugggaaguagacaaugaacuaaguaacuuugaggaauucuuuugguucuuuuaguuccaaauuucugacuuggaucccaaggguuggggugaucuugauacacccuuguagaauuucaugccuauauaguccaaucaguucuaauguauauuuuauccacuuguggaaaaggagaaaaaaacauaaugaaaacauauugugaguacugaguugccuguuauuaaggaggucaaauagagauagaagguaguuuccucuaaacaauaaaaagaugaggcuauuaugaccuuuugugugggauuuuucaaaaucugaaauuauuucugaaaaauguuucacagaggauaauuauauaugaaauaauaaguuuauuuuuauuggauauuuuuauaaugccaacucuuucaacuccugcacuuugucuucuucaugggcauuuuucacauuuucuuuuauguaugguuuuuaguuagcauacaaaacauugaguuuccuugugacauuuuauaaguguauaucaaucuuucuuauuuauguucaccuccaauuacccuucccuguuucuugggcauggcuuuaaacuggaggugaaacuacuuuagccauggaacaucauuuucuacaaacaggccucaaucucugggcugauuuuucccagucuuauuguaugauuuuugccuuggguuguguuacaugugccuucuggcuugccccacuauuucuguaguauauuuuauucccugguuuugugagggagagauggcauauuugauuguuguuggguaaaaaggacugacagauucaaggugacagauucaauucuucuagauagcuugcuagucugaacagaguagaaauaauaugaugcaaggccaaacaaugggaagggaaaucagaaauuagaacacacuuucugagucaugcacauaaagaaaucauauuauaauuucaauuguuuucugggacacuccgccaaauuuccuugguuaacuaaugaaacucuacuuugagcacuguauggguagauuguugcucguggcacaauuccaugcugucuuaugguagucaauacacaaagcagugacucauuuaggguucaguaacaauagagcaaaucagaggcuuugaauaauggcucaauauugacuugaucuguggcuuuucuccacuacucuuugcuccucugcuugggaugggacacuaacagucagagcagcuguucacaugugaagcacagucuggaguuuccagagcacuuucacacacauugucucauuuuuuucccuugaacauaauccaaaguaguuucugugccuuuucuuuuacuugggaugacaguuucagcagaaauaaaaagaguauuuuccccuuaaaaucaaacugggauugacuguucguaauuucauuaaugcuuucauuaaucauaccuuuauaugguuuuauagguuuuggccuuuucuucuggucaauuuacaguuuucuacguuguauuuguccuuuugaaaaauuggugucuguuugugugguagcugugugugcaggcacacauucugaaauuuagcucauauuauuacuguuugucuuuagauaaguagauguggccccauucaaguauuaauucuaccucuacagugacaacugccuugaaaaagaacuauauauuucuaccuaccucagaugggacaucaccucuugcugugugcacuggaauaaaagacaaaggaaacaggugagucuuuaauuauauacaacucccuuuuauuuuccugaaguugauaucauuaauagaugaaauucuacaccuacuaaauaggaaaagaaaccaaugaagaacuacaauaggcaaccauguucucucuauuauuuuuaucccaggcauauauuuuaacacuuuuaggcauaaaaagacaauuaaauuucuaaauauguguuccaagagucaaaucucuucauuaggcuuucaugauaaauccauugcucuagucacugagcuauuuugcugaaugaaauuuuacuucuaugcaaacccaaaacaaaucaacauauuauaacccuuuugcccaugccuguaucaaaacaucauuacuauaacaauauuagaaggagcuagagaaaauacccaaggagcuaaaggggucgacaacccuauaggaagaucaacaauauaaacuacccagaacugugucucuaguugcauauguagcagaggauggccuaguaggccaucaaugggaggagagguccuuggucuugugaagaucauauacccuaguacaggggaaugccagggccaggaagcaggaguugguggguuggggagcagggcgcggggggaggguauaggggauuuucaggauagcauuugaaauguaaaugaagaacauaucuaauaaaaaugaaaaaaagaaguucuuuuuaucauuuacucaaacaauaaauacguauuuagugccuacuguguaacagacacuguuuuaaauauuuuggacggaguaguaaacauaauagguauaaugacuucauagugauugaaguauaguuugagaaaaaauaggagaaauguuaauaagaaaaccauuauguauuaagaaggucauaaguacuauggagaauaaugaaaugaaaagggauggaaugauuagggaaauuccaguuuaaaauagcggccagagaacccuaauuaagaagaugguauaauaauaaagagcugaagaaguagagaaguaaucuaauguuugggagaaagauuccuggcuugagacagugugguggccuucuaccaaaaauaucccugcuuaauuugaagaauagcaaugagaccacuaugggugcaaugaauggaguaggggaagaacagaaaagcauauggcuagagauaacaggaaaauuagguagccagauuauguaaaguaccaccagccauuaaaaggacuucagauuucuuauuaguaaaagagaaaaccaaugaaagaguugaaaacgaugucauuuaauguuuuaaaggauccauucuccuauauucugcuucuucaucucucauauuauaaaaaaaauguuccucugacuaaggaacaauaagaauucccuuuuauuggcugugacuuauauucgagaaacacagaaagcuuaagaaacuugugcauccacacugcuauuuagaauagcuggacgugagaaucaguggauaaacuguauaaguuccagaaguucaggucagacuuugacgaauuauaucugagacucauuagugguacccagauaccaauauauauuggagcuuccaaaauauaacaagaaauaaagaccacuggucugaaguguuuaaccuaagcaaacuucucaugaugacuguguagcuugagucagcaaugaguaugaauguugcuuuuggcagagcuguaccugggaccauucacucuaaguaaaagaagauauaaaacuucacaaagagugaucuagaaaggugauaugaugcuugauaauauggaaauaggaaaaugauaagugaaagcugugguagaaauggaucugggccagaccagaaaagagaaaacugaaagacaguauuuaacuguuugcagcaacaucugaacugcaggccaaacaucuggaauugaugagugcacuauacauauuagaaagcgggguuuuuaaaggaaagauuuauucucaaggccaagcugagcaacugcuuugauuugugacaaaccugugcacauggguggugauugagcuugcaggagaggaauggguagggcaugggccagcugcuaucuuuauugcccuuuuuuaaucucaggacuucuguacugcccaggcaaagcaaauagccuaaagucuugaguucuuaauuuagacuugucauccuacaaguucuacccauccgagauagagagaccaugcuucaugccacaggcauuucugcaaguugagaagaccaacagccacaaaggguggccagaagcagcugcacacccagcagcaugagugccuuacauccagaagaaauuuagccagcaucauuuauucagggcacagugagcuaauguugagauuauuauuaaugccuacgucauuccuuuucucuuuccugccugccugcauucacucucuucuaaguuaauuucuggggaacaaagacaaugggaacagguucagagauggugcaaaugacagggauaggacaaguaaagaagcacugucaccuuuguaguuguugcuccagccuuacuggauauguguauguauguacacauacuugauaaaguauuaaugcagcaauauaacauuaaguauaugcauguguucauacacaucaguugccaaguuuggcuaaaaaguagaaugaaauaaaucaguuggaucauaguagccuuaaauuuuauuuuaauuuuggagcuaacuuuggcaauauucacuagaaaaauaugggauauuuccaauauuaaaaaaaaugacagucaucuuaauccaaaaaucugaaacauaauucauauaacauaaacuuuaccauuucaaguauacaacuuuaugcuuuuuaauauauucacaaacuccugccauguaauuccaggucauuuucauugugcauugaucagucauugucuccuccucccaggcuaugacaaauaauaaaucugccuuugugucuguggauugucaauuuugggcauuucauguaaauaaaaucacauuauugcccuuuccugucuagcuaugucucuuaaucauaauaaagauugauuauacauuauagcauacauuauguauuucauuccuuuuucuagauaaauccuacuuuauuuuacagacacacuaaguucuauuuaucaacuuuauuuaugaguugauuauuucuguuaucaugaguaugcuccuaggagcauuuauguacaaaguuugugugaacauguguuuucaccucuuggcauauauauuuaggaaucuauauuuaggaauaauugcuauaucauauaauaacucaauucuucacuuuuugaagaacugauuaaucauuuucuaaaaauuugcacuauuuuagacucucagcaccacuguaugaaauccucguugucuacaucuuccaugacaguugucuauccauauuuaagaaaaauauauugcuacaauguauaacgaaacauuuaauuguggucuucauuugcauuccuacugagcauacguucauguguuuauuggucacuuguacuccuucuuucagaaauguuuguuuaaaaucugagagaaguuaggccaaauuucccuucuugguucucuccuucacccuuuaaccaucagucaaauuuuacccauggauauuuucuauaccacaguuugggaauaugugacuauacagaauuucagaucccagaucacauuaccuguggcaagaauuccauuuaagucuagugggaagauacagaaacucugucuagcuccuccauugggggcccuguguuccauccaauagaugacugugagcacccacuucuguauuugccaggcacuggcauagccucacaaaagacagcuauaucaggguccugucagcaaaaucuugcuggcauaugcgauugugucuguguuugguggcugacuaugguacgaguccccaggagggguagucucugaauggcccauccuuuugucucagcuccaaacuuugucucuguaacuccuuccauggguauuuuauucccuauucuaggggggaaugaaguauccauguguuggucuuccuucuugauuuucuuguguuuugcaaauuguaucuuaagaaaguacccaaggggcugaaggaaucugcaacccuguagguagaacaacaauaugaacuaaccaguacccccagagcucgugucucuagcugcauauguagcagaagauggccuagucagccaucacugggaagagaggccccuugguauugcaaacuuauaugccccaguacaggguaaugccagggccaagaagugggaguggguggguaagggaacagaguggguggggaggguauaggggaccuuugggauagcauuugaaauguaaaugaagaaaauaucuaauaaaagaaaaaagaaaaaaaauacagaaacucugagcaugugauuugccaugaaagagggaaucuauugugcuacauaugacaugguaauuuuagucaaauacacuuacuguuacuuuucagaagaugaugaaauaaaacaugguauucaaagcccuuucucaaguccauuuuccaguaaguuauagcuuuauuuuugaacauaaaccuggugcuagaaacugugggagaucuagggagagauccuggacuuuauggaacaggcaaacaagagucaguaaaggguuuugagguaaagagcuacaggcaauaagagcuuuuuaaagccccuuaucucuguuccaucuauucaucuggcuaaaggguagaguaggugguucugagugaugagaacaucagagauuauauuugaggguuuugagguauuccugauggggucaguacuuuccuuugggcuugaauaucacauccugacacuccuuccuccuuuuaaaucuuuacauaucaaagagaugagcuagucugagacagugaagucauggguuagagagucaaaggaagaaaauuaccuaaagcuccuggcuaggaguaaaaagaccuucggccucucuacauuuggccugagguucuaggcaaacuaaaauucacugaugacuccuuugguguuagcuagaugguuauaucuaaugaacugucagcuauguucaucuaaucuaugaggucaguaucuagauucuauucacguuaaaacaugcacacauaucaagucagaaaaggaccauguacauuguuuuacauuugcaguguuucuuacucaggucuguauuuggugacuaauaaggucagaauguuugguauauacuuuccuacaguuaucagacuggcagaaauaaggccuucaaacugaggauuuccucuuagaugcccccuaugugcucuguggacaauggagggccuuccugacaaucugguugguucacaagugaguccugagauucucaagucagcaacuacuggagcccaaccacaauaauccaaaagucauagagauuucugaaaaauggcuucugacccauagaagggaaaguagccugaucuucaguagaaggcacgccuggcauugguaccauuucauguguuaaagagccugugguggaagguacugucagggacacugguggugggcaugauugagaugccacuggaagcugaggcacgaaggguacucacugcaacacaucauauuuucacuaaaagucauggguguuccuggaauaccaggcuuuccuaauggcguugugugggacccucuuacaaaucaucuucucuggcuacaagaaagaugcucccugaggaggaggggucuguagggagcaguaucacccacuauaaucacguaguagcaaaaugcauuaugauucuccuuuacucauauuuacugcaugacucaacagaccaaaauaauaaauaauaauaauaggccuucaauuuuuuucagauucugagaauagugaugaaugcuugcuguucugugauuguaagcggugugcacccuuuuuccagaaaacaaucauaucgaaagcuaacagcaacuucucauauuuuagagguguuuggucaacagacuaccagggucucaguuucuuagcuuccuacuccauguugaccauaguccaauuguacuuugggacuccagagguucagaaucacuucagaucugagaggaggcacuuucuuagucucauaaugaugcuuugagaaaacaaaaguuuugaauuuuugaauacuaaauuucaacacaccuuaucuucccaccauaaucuaagaucacaaaaacuuagaucuauaguguuugaucaaagcaauuuuaaaugacaugcuuuaacaucucuuaugaaaaaaaucauauaaacuaggagcaaaaaugugauguccuauauugggagguguaugacauuagaugacagugaaaacauauaaugacagaaacuagaauggcaacuaccugugggaaggggucauauuugcugugaaaggaauacaggggagccugaguaggucauguaaaggcucuauaucuuaccuggacaguauuuccugucccaaaccauagauuuugucuacugcauuuaggcuuugcucaauguugaucuuuauauuuuuauucuuuauacuuuuauucuuuauacuuuuauuuuuauauauucuuuauacuuuuauuccuuuguuacuauucaaggcauaggugauagauauguauucucaacacuuaauuauucuuucuuuacuuuuaccauaaauuagcaccugcuguagggcacugcuauucauaggguauaaggucucauauuauccaugaguuuauuuauugcuuauuaggcaguuuuuucuguauauccaggauucucuagaacaguccauuguacauguuuucuuuaauaaaaguuucuuaaauuuaaauugaacaucaauuuaguuuauguuuuggauaccauuuuaauaaaaaggagggacaaagaaacucuguguuauuuauuauguccugguauguguauuugguaggaagccuaccugggaaauaguuuuguaccaagguuaaugagagacauuaagguucaugcaauuuaaugccuauuggguaaacuagcguuuggaaaccaaacugaaaauagggucucacauaugccuccuggacagcagcuuccacaaaauucuaggugcuuauguuaagaauuuaucucuaaaggaggucugcuuugggaacucuaucaauguuuuccuguuuucugggaaagaaaacuauacagcaaaaauuuucuuaguuauucuaugcuggauuuguugccauaauacugaauucccuuauuagugaagguuaugagaugaauaguuuuuccuuuaauaacaaggagagagagagagagagcaaaagccuugucuucugagugugacaauuugacaacagaggagaaaguguguccauuuuguuuaaauuguagacauuauagaccaccuucuauugauugaagaaauggggaaaaguuaagagaaaaguuauacuucagcaaaacuggcagccagaacaucuuacccuauuucuauugguagccuuggaggagaugauugggguaacaucauccucccuuauaauuagaaauauacauuaaggacuuuccguagguggagaacccacaugaaauagucuuguauaagauuaggaaggagugacaaaaaugucgcuggcaacacauccauucauggugaucuuaaaaacacccaccugcaccaucacacuggacuguaccacuagggcauccagaacaagccccacccuaacaguggggggaggcacagccagauucacagcacugagagucucaaccagcuaagcugaacuucaaauuagaugccuccugccccugcccucagcugcccaggccccagcauggagaugaaugaccugcacaacaggcucagcaccucugaggugugcauuagccacuuauagcagcagucuauacucuuucaaguaugcaaguuuugacuucacuacuugccauagccuguccccacugucugaucuagugcuuaacuucaacccuagaggcugccuugaccugaggaggcaucucacugguucugugcuugugugugcccuaccccucacugcugggucccaggacccagacucagguaggagggaggacaggugccuuggucgcucuggggcacuuuauauguugugaaauuaaaccuguuguaaguauauuuguuugaauuaacuuaaguauuguaauauuauuuguugaauguaguaauuagauauuuaugaauuucugacauccaaaaacuaaaaaguucauaaguaaaaaaaaaaaaaaaaaaaaaaaaaaaaaaaaaagggcucccaauggaggagcuagagaaagaacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaacuuuauaugccccaguacaggggaacgccagggccaaaaagggggaguggguggguaggggaguggggguggguggguaugggggacuuuugguauagcauuggaaauguaaaugagcuaaauaccuaauaaaaaauggaaaaaaauuguguuuauauaagacuaucuaucuucauaccuaucuuuuuaguuuguauaguucuucaaagucuucaugaggacuugaagaaacauaacacauucaguccucucaagcuaccugguguagggaggaucacaauguaaaauuuccucgguuuaaguaacugaagucauuaggaauccaugcaagacuguaaguugaaauggaaugacccagucaaaguaaucagauccuuuggcaaagaaaaaaucauguuucaacuuuuucauccacaaauaaggauuauauuuuccacauugcuuacgucagaaaacuauugaaaauauugacaaauaaaguaaguguaaaggugguuuuuaagagcuuuucacauauuuuauuguagucaguagaaggaagccaauggguuuucuaauuuauuuauuaauuuuucccaguaaagcuccugauaucaaaccacaagcugaaaaacuuguuugucccauugccuuaguucucuuaucuguaaaaugaaauuaauaauaauuugugacaucuuuuuggagaauggaaugcauugccacauagaaagcauuuagaagaguuauuaacaguacucaaaaacuuuugccugcuuuagguuggcuuuuguggccauuuucacuagaacacacaguaaagaaaacagaaaugccacaucucaggcaagccacuacuuuaaaaucauucuuuaagauaacuaguaauuauuuuuguacccacaguuuuuuucaucauggauugucaagagaaugaguaccgggaccaaugggggcgcugugucaccugccaacaauguggcccuggacaggagcucucgaagguaaaacuuuuuaaucaguacuuuaaaaaaaaguaugcauuuguguguguguguguguguguguguguguauuaugaaaggaguaaagaagguuuaaagagaaaaagaucugagaaaagccaauauuaguaauacagucaaucacagcuaugacaguucagcagauauaaugaaaugcaaauaauaugcaauaauauucauuguucacaagaagugaggcaaucagacucauauguuagggaaccucaugaagaaauauuucaguacagaucucuaaacuuguugcguuaaagaaaucuguuaaacaaagcaagguauacuuaauuugauuaaaaaucaugguauacuaugguaagaaugaagcccuguuguaaaauugcauggaaguuccucaaguaauuaagaauaggcauuuuuagagaaguuggcagguuagagaucuuaugaugcaacucagugaaagaaaacaggauaguacaggauaaucucuauccuugcaauagacaguagcuguaaauggacuuauuaagccaagugagaucucuguggggaagcagacaagaguggcugugaacuggugccuagcugcacaaauuggcucuggugagguaauuggaaaccgcagggaggcacuuuacagcacacacacucagcagcacugcaguaacaguuagcucauaaccaaggacuggauagcaauugcagaugaagccuuggaacuaaagcuuaguucucacagcagggcucugguugagguuaagcccaacuugcaggacaaagccuacaccuccuuucccuuccccauauaccagcaugguggcgcagccugaggaaaaacuugccacaaaaccuggguggcuccaggggcugaaaugugauaguacaguugacagccucuuuuaucccaaguuuguagcuguacucaaugggaacccacagcaagggaucccacccuggcuucuccagcacagugaugucaaaccacacagaguaucaagaagggaauugagaacuacacugcucaucucacugcagcucugccaaauacucaauccaaaguguuuauuaucuaaucucuaugggacaauacauacacaaaaucaggcuuuacagcuuucuacuggaauaagaaacaaaucgcaucuuccccauuagugcaauuugcuagaggaaaguuuugaauggaaaagaaagaauucaaaacccauuccaagaggaaagaaauagugacugauaugauuuuucuaaaauccaaagugcuuuuauuauacuuugucuuuuuugcugcugucaauguguucuuucuuuuuuuuuuaauuagauauuuucuuucuuuauguuucaaauguuauccucuuuccuaguuuccccuucaaaaauucccuaucccuuccacaccacugcuccccaacccacccacucccacuuccuggcccaggcauucccuuauacaggggcauagaaucuucacaggaccuagggccagcucccauugaugaccaacuaggccauccucugcugcauaugcagcuagagccaugagucccaccauguguuuucuuugauuggugguuuagucccagggagcucuagggaguacugguuaguucauauugcuguucuucucgucaauguuuuugauaauuuuuauguuuucuuuucauuuuuaagcauuaauucuugaauaaauacucugaaaguaucucaaauuaggucauacagugcuuaguuugcacaacuguuuugcaugcuuuuuaacccauuacacuauuauauacucuauaguaucuuuuuccuacauacaacccauguacuuuguuuuacuaauuuccacuuccuuuucaauuuuacuuccuugccccucuucuuucacuuaacucuaucccuccaaaacuuuaaaaaugguuaaacuauuagacacuaacaguaucccaauucuuuccucccaauaucuuuccucaacucaauauucuuccaguugaucuaacauuaauuccuauguuuaucacauucugucugcuuguaaucuugguaaugcuucacuauacauaauauuauucuuauauauuaaucuuccaauaguuuuuagaauaaaaagaucacuguuaauuggcuagaaggacauuuuuguaggcauuuuauccagcaauuguaguugauucuacaccugauauuugguuguacuagggaccuuuaguacaugacuagggguauaaacucuaaacuauacauauaaauucuaucacuugaauaaugaaaguauuuugacuacaagaaaaacuaauaaaauaacccagaugcaaaaaucuaaacagaauagaacaagaaagaugacaaaucaaggaagaaugauguuauccccaugaaaaauauaguacugguacacagugagagucaauuagacaaaaucucagaaaaauacaguuguuuaauaaaagaagaaagaaauaaaacccugaauaaacucaagaagacuaaaacuaaacaguugaauguaauaaguaaguuacucuagcauacaaaaacuagaauucaaugaagaaacagcaauauaaaaaauggaaaauuuuaguuauauaaaagucagcaugcucccuauucuaaggaagaugaaguauccacacuucugucuuccuucuucuugaguucguguguuuuccaaauuguaucugggcuauucuaaguuucugggcuaauauucacuuaucagugagugcauaucaugugaauacuuugauuggauuaccucacucaggaugauacccuccagauccauccauuugccuagggcccccaauggaggagcuagagaaaguacccaaggagcugaaggggucugcaacccuauagauggaacaacaauaugaacuagccaguaccccggagcucuugacucuagcugcauauguagcagaagauggccuaguuggccaucauugggaagagaggccucuuggucuuacaaauuuuauaugccccaguacaaggaagcaccaggaccaaaaagugggacugggucaguaggagagcaggguggggggaggguauggggacuuucaggauagcauuugaaauguaaaugaagaaaauaucuaauaaaacuuugggaaaaaaagcagcaugcaaaauaaacccaauugaaagccuaaauaauacaauagaucauguggaagaaagaauucuagagacagaugaacagaaacacuaaagauaucaacaaagauaaaauaaugagaaaauauaacuaaaacauagaguucuaugggacaccaugcaaagacugauuuugucccauggcacaacucuuguaccuaagacucagggaacaccauagaaggugucagaaaauuuguaagugccagaggaccaggaagccugcuguaagauugugucuuuuagaaaugacagugaagcuacagccacagcaccucaguaauauggcugccuagacacaucuugaagagugacaaugaaaauagcacgcaaaggcaggaaggagagaucucauagggcuccaccucaaaacuaagaacuacaagcaacuuaggacuucugagagaaagagaauuugacuuacugaaggaugaaccccuuaauuguuuguucaagaccaaguggucaacacugaaaugguaaacauaaaaacuaugcuaaguggacucagaaagcugucuuuauuuaaaaaaucaaacuuucaaaaucuagacuaacaggguggcuauccaggcucaggaaacaugucagucaaaauaucuguuuacagaucuuucguaaguacaaaacaugauagauagauagauagauagauagauagauagauagauagauagauagcacuaaaguaaaaagggcaaaucuaucagaauucuaauggauuuuugaagagacaccuuaaaagucuggagagcaugcaaugauguauuucaagagcugaaagacaaugauugggaauucaguuacuauugaauaaacugaugaaaugacccuuaccaaguaugguuaaaugcaagguuucaucauagauaugagaguacagcuugagguaucuggaaucauccaaagaagggaaagaaaauaauggacugaacauagcaagcagacugaacuuggugaucagagaagaggcugggaagcaaaagaggaagacaaagagagcaugaauaaaggaggacaggacaaaggaaaggagagagagagagagagagagagagagagagagagagagagagauaggaugccaguauggauucagaaauguuaacagguauuugggauagugaaggagccucuaggcccucaugcuauuuagcauguuaauagcaccacagauagcauuuuguccaugcagacagugaucaggaaaugguugccuucauagaagggaaccagcuucauaaguuaccacagaauacuggcuuuuguauaaucaccaguauuuuuaccugacaacuaaauccaaaauaguuauauugaggaaauagcucuguugauaaaguguuugcuucacaugcaugagaagcaaaguguagaccccuagcacccaugcaaaaaaagcaauauccacacaugacagcauguuccuguaaucuuauacuaaagagauacagcugaaagagucacugaaagagugguuuaguugccagcuuaucugguugaauuuuugaacuccagauucaaugagaguuuuugccucaaaacauuaguucaagaagcuauugugaauggugcauacuuuacauguguuucugcauucacgugcauacaaucagagauuacaaacaaauaacuuauuaauauacuuuaauugaaagagcaagaaaagggcaaaccccaaaucaguagauaggaagaacuaaucuuuuucaaggaagaaauuaagaaaauggaaaaaaaaugauaacaauaaaacaaagcaaguaauuaaugaaacaaagaguugguucuuuaaaaagauaaaaucaaaagucauuuuaaaaaaccauucuagagaaacagagagaaaacucaaauaucaaaauugcaaaugaaaggacauauuuuacagaagaucccaaugacauucaaaacagccuucaaaacauucaugaagacaucuaaaaaagugaaugaaucaauaaacacaugaaagaccaaaauuaaaccaugguagauuaaacaacuuuaacaguccuaaacugugcaaugugauuagagguuuuuaauaauaguaauaauaauaauaaugauaauaauaaccucacaacuaaaaaguucuaggaugaggauucaagucuaacaacccuucaagguagaaacaacaccaguauuucuccaaguauuucauaaagcagaaagauaaaguaaacauagauagagaauuuuucauuagcacauguguauuagcuacuuuucuauugcuaugauaaaaggcaacaaccaaggcaacuuauagaagaaagcauuuaauugggcuuauuauugcagaggcuuggaguccauguuuaugggacaaaggcaugguuacuggagcagcuaaaagcucacaucuuaaaaaucccaauagagaggaaaagagcucuggagauacugagcaaaaggguuuuggagcucccaagaucaucccaguggcauaccuccuauaacaaaagcacagccaccuuuuaauucucaaacaauuccaccaauggggagggaucaaauauucaaauguaguacccaaugggggucauucuuauuuaauuugccauagcaugcaaacagaacuuaucuaucuaucuaucuaucuaucuaucuaucuaucuaucuaucuaucuaucuaucuauuuauugggguuuuucuagacaguguuucucuguauagcccuggcuguccuggaacucacucuguagaccaggcuggccucaaacucagaaauccaccugcauuugccucccaagugcugagauuaaaggcgugcgccaccacugcccagcaacagaaccuuauaaaauuaauuuaauucacaacaaaaaguacacucauggacaaauuguuuuuuuuuuuuuaauucagagauguggaaaugguccaacauauucaaaucaacaaacauaauuuaguccauauauagaauuaaagauauaaauuauauaauuguuucaauugaguuguuaaugcuuugacaacucuaacaucccuuccuaauaaaagucauaauagaaagcuagggauugaaagaaaauagcucaauguguuaaaagcuacauacaacaaaccuaaaaccaacaucauccuaaauggaaaacaaucccaggcauuuccacuaagauuagaaacaagauaagccucccuuucuccacucauacucaauagagaaagaagacgacucugggagaugcugguaugcugguugauuuuaugucaacuugauaugaguuaaagucauuuuggaaaugagaaaaugucccccaaaauuagccuuugggcaagagaguaguacauuuccuucuuuucuuuuuucaagaauccucaaaaaacaauuuuaacugcaccaaauuucuguaccuuuuacauuuucuauuauuaaaauuuuuauuaguuauuuuauuuauuuacauuauaaauuuuaucccccuucccguuuuccccuccgaaaaaccucuauccucccccuccucccugcuucuaugacugugcucccccacccacccacuccagccucaucacccuagcuagcauucaccuacacuagggcaucaagcauucacaggacuaauguccaugccucccacugaugccagauaaggccauccucugauuacauauacggcuggugguuuagucccugggagcucugggcggugggguauggcugguugauauauauauauauauauauauaucgauauaucgauauaucaauauaaguauauauaucaauauaucgauauaucaauauaucaauauauauauauauaguuguucuuccuaugggguugcaaaccccuucagcuccuucagucuuuccacuaacucguccauugggaucgccaugcucaguccaaugguugaugaaugauugauaucagaauacucagauuauuugaaugauauagguuaauggucucagguuacacacacacacacacacacacacacacacacacacacacacacacacacacacacauuaggaugaaaaggccccaauaagaaaaccaguaugcagcaauccuacauggcuucugcuuuaguuucugucucuagauuccuggcacgacuuccuuggaugauggacugugauguaaacacuguaagcuugaaauaaacccuuucuuuccuaaguugcuuuuggucauaauauuuuaccacaucaauagaaauguuuuuaagacagauggaaagacugcugauacucacaaaugagaaaacaauauuuugaaaauggcuauaguaccaaaaaagccuacauggucaauauaauuccuuucaaaauaucaaugccacucuucacaaaagcacagaagauaaauaaauucaugugguaacacagacgacccugaauagugccaucaauucugggaaaaagaagaaugaaagauaccuauuacaacaauguggaaacacaucauuuucaauuguacuccggaaccauaguaauaaaaagcacuggacuggcaaaaagaacacauguauggaucugugcaucagaauauaggacccagauauaaguccacacugcuacaaccaaauaugauuuuucauaauacuacuuuagaaucacucuuuaaaaaagguaaccucaccaagaaauguuucuggccaagcuagauauccacuuaugaaauaaucuagguccacauaaaaccaaaccagcacauaugcauaccacaaaagucaugaagcagagacaaggcaaaagagcuagcuuuacauuaggaaaaaaucauuuucucgaaguuuccaaaaagacuuuucuuugcaucuuaugauaaaacuggguaaugcauuucuguauagaagggugacuaugaauguauguuuggcacacaagaauaauuccaucaagguuugcuaaacaaauaaagcaagcauuuuugagccuggucaucauacuaccuagaaugaaaugaacaauugauuauuaagggaggccaaugauguuuggauaagaagcuaacaacauccaagacaacauuucuguucaguuaccuuuauucaauuuuauauuucacucaugaauuauaaauaacccuguaaacaaauuauugcagaagauuaacaguaauuccuugggauauuuucuacaaguauaauuugugaacuaaauacaauuuuaauauucuugaaauauauaaauagauaucacauuuguacauuuuuuaguaauuuccauuacaauugcauguauuuuaaauaauguauaaaauucccaugacacaaaagucaaacccaaaaaugaauaaugcauauuucuaucaucuguuaccuuuaugcuuucuucuauaauauuaauuacuaauuuaugaagcuuuaagauuuuuuuuuacuuuucaaauauuugacagggauguauacuaaccugugaacucuuucuuaguacaauguuuauuguucaacuucuacucaaguaaaguacuugaguagacaaauguuauaaaauaaaguauuuuuaauacuuuauauaauaaauauauuaaaaucagaaauguuuuuaaauuuuauucaacgucacuauuuuguauguacuuuuuaauacauuuucucuuauuauguuuauuugauaauaugguaaugaauucuuaaaguuaaaauaguauauguuuuuagcauaaaccauucuugauuauguuuuucaguuaauuguucuugcauguuauacaaacaacuuuuaaaaagaaauaacuauacuuacuccauggucagcauugaaauuuugugucagcaucaugaaagcaugauaaaauuaagauaaauguuuccugauuauaaaacugauuagcagcaaaagcauuuggaaaccugaaucauuuaaaaaacgaaacucuuuugccuccuaacuaugaaagaugauucucaacaagacuuguaaaugauaauuugcauguuuuuaauucuuaggaaaugauucauucaucagugaaagaaauggcugggggguggcaaugugauaguaucugauuuuuuucuacaaugcucauuucugccuuuuaauugcuuugcuuagaugauuuaaauuuaagauugcuauugauugacacuuuaagccugaaggcuguuguuuuacuguugggcucuccauuccuauucuuuucuuugucuuuucuugccuuucuguugguuauacaaaguuguauuuuaaaacuucauauugauauauuugugccaauuuuacuguauuuauuuguauuguuugcuuagcuguucuaaauacuaaaauacacacauguaacuuuuuaguaucugcugguuucaacuuuuuucccauuaugaguauagaaacauccauuuaagugccuuuacuuucccaauaucuuagucaguguucuacugcuauuaagaguuaccaugaccccaaaacucuuguaaaaauuuuuaauuggggcuuacauacaguuucagagguuuagucuauuaucagcaugagaagaagauggcaugguacuagagaaguagcuuuaaacuucuauauccagauccauagucaccaugaagagagaguaacucuuggacuggcuugggcuuuugaaacaucaauguccacuuccucagugacacacuuccuccaacaagaccacaccuacuccaacaaugcaauaucuccuauuccuuuucauauagugccacuuucugauaacuaaacauugaaauaaaugagcguaugguagccauucuuacuugugccauuucacccaauguauguauauaauuggcauagauaucagaugugguauuauguuauaaucaccacauaggauuuauacaauuugugaaaagaaaguuuaucauuucaaagauuuuuuaauuuuacaaauuaaaauaugauuacaugauuuucuucuccuuuccuccguacaaucauuaccauguauucucccauuguacugguguguucuucucuaggcaagacuauuucucccauucugagcauuuuuuuaguugaccaaagcucuuuguguaugguuaaagucuccuggguuuccccauuaacuuuaacauguccaugcugcuguucuugaucagcucauguuuaagagguauucacguugguaagauuauggguguauuuccgacauuacuaggauacacaaucucacagaaaacuugcucauucuuaggcccuaauauucuuuucucaauauucacugaguuuuagguacgggagugguuuuguagauguauccacuggggauggacaucacaacacugcaguuaauuaaucgugguuuucuguaaugguuuccuguagcaaagauaauuuuauuaaauaagguguaaugacagaauuauuacucuauuguggguauaaagacauuauacagaaggugguuagagacauuggugguuuaguaaagugguaguuguaaguuauuagauccaaguucugugacugcacuagcucuagguaguugaaaagguucccuguaccugacaugguuucccuuuuguugagcaggucuuaauugaaauuagaaaguuguuggcuagcacauaugugugugugcgccacugcuguaccuauuaggcuuauugugccaagguggucauuguugugguucauagacaucauagcuggguagaccaccaaucaaagaaaacacauggugggacucuuggcucuagcugcauauguagcagaggauggccuaguuggucauuaaugggaggagaggcccuugguccagugaagguucuaugucccaguguaggggaaugccagggccaggaaugggaguggguggguuggugagcagggggaagggggagggaauaggggauuuuuaauaaaaaaagaaguuauuagaacaaaaacaaaaaggaauuccuuugcuuccuuuggaaguuuguuuuuuuuuuuuuuuuuuuuuaguauuguaaaaacuauuccuugugggcaagguauucaaguuaauucuagcaccagcuccuauaaacccuauccuugaagugcauaguguguauagaaauauagacuuacuuucuacuuuugaggacaaucacuguugacagcaauaggcuauuuguuuuggggagucucuuggacaacccugagcaaaaguucaaaagaguuucucaugccuguucuuuacauuuuuguuagauugucuuuggcucuuagaggaagcauuuucaauccagauaggaaauauacaugaauauaauaaauaguuaauuguaugauuccuuaugaccuuuucagacaugcuuguuguuauuuuauccuccccauucuaauuucauuucccuuucccuucaauaauuugaaccucucugucccauuucccugaucacaucauuuggacccugcugguucccucuguucugaucuugagccaauuuucuuaauacuauuugugggccgcuuuuccucuuuauuucuugagcuuuucacauaucuuggauauuaauauuuuucauauguauagcuggcaaagauucuuauucuuugggaauaaucuucaugggauuguuucuuuaguugugaagaugccuuuuaguuuuaugauuucuacuuuuuaauucuaugagaccaauuauuacccacaauaccuuagcaagugagacacuauuuagaaaguccauuccuacauucauuuuauguagaguacuuuguauauuuuccucuaaccauugacauuucaaauuuaggucuuggcuucauuuguauuuagauuuugucaaagguaauagauacaguucugauacauuucucuuauauguagacauccucuuuuacuggcaccauuuguugaauauguuguauuuucaccagugugugguuuuggcaucuuugcagaguauuagauggauguagcuauauauacuugugucucaaucaucaguuuuguuucauuggucaauauguuuauuuuugugccauuaucauuguauucauuacuugucccgguaauacauuuugaaacuggaauggguuuugcccccuagagucuuaagguuccaugugaauuuuacaauaguucauuucuuuucuauuucuguaaagaaugagauggggauuuugauugugauugcauuaaaacucuaaauggcuuuuuaagagaacacucauuuucacaauauuaauucuaccaaucaauaagcaugauuuauguuuuuacuuucuagugucuuuaucccuuucuuuagagguuuaaaggucuuucaucucuuugguuugguuuacuccugggcauuuaacuuucuuugagacuauugcgaaugagaggcuguccaggagcucuuucucuauacguguuuuggcugguggugguagugcuggaucccauuuuuacuuguuucuacaagccuucuggggaauaucugcaauuucuaacauauaaucucaugucaguugccaauagagauaguuuaauuuauugcucccaauuaguaucucuuuaauuugcuuuuuaaugccuuaaguuuccuggcuggugcuuacaguauugaaaaggagugggaguaaaagcucaguuuuuauaaauuaguuuuauaauuccaacauuuuucaccuuuuacaagcuaccaguuuugaucauuucuuucugauugaaaauuuuuaguagcuaccauuuuauagugugucuaccaggcaacaugggcguuuuauguuaccugaagaauaucuuuuuuuuuccccuucuuucuuaaguugaaguuucacagaauauuacaauuugcauauggcgguuauguacucucaacaucuuaaaaauauggcuuaagaaauuuuucaaaguuucagacaaauacucacugucauuucagugauuguuguuuuagaguuaaugucauacugaauauuuucaaaucugaccuucgccaagaaguuucauuauauacacauacacauaaacauaaucuccaguacacauaaacacacguacacauauguguauauagauagauagauauagauagauagaugugugugugugugugugugugugucugaguauaucgggauuccaugugugggguauauaaauacaugucuguuguggggguguuuuucaacccaugccccuguugguaaaaauaacaacucugagacucaaauauauuuacaaauuucuagacuauauagcuaugcauguucccuagcuccugaguuaauaucuuauuuauucaaauuuaaguucugccacuuggcuuguuucuucuguccgguuccaugagucuccucuuucauauuacagggugcauucuucucuuucucuagcccagaauucaauaagucuacuggauguucuacuuucuauuuccugucuaagcuuauagacaaaucaccauuuuauugauaacuccugcaucuauacaguacauaagagauucuuucuauacacauguguguauuugaugauauuuggugauuauuuuuccaaaucuaugaaaauuuagcuuuuguuucuuugacuauuuucugacacacauuuuauuuguuuugauuucaugugguuuugguaguuuuauuucuuugucugcuuaauuauccccaaaauucuccagucauuuucuuguuuuugucuauuuuagucuaauuguccuguuauuugaacuguauuccuucuauuguuuuaucuucagguucagugauuuuccuaauuuucuaguaaucagcacagccagugaauuuuguucauuuauuuaguuauuuuuauaacuucuguuuggcucuuaaaaacaauuucuuugagcugaauuuaguuacuuucagcucuaaugccagcauucugaaggcagaagcaaaaugacuucaaccuugaagccagauuggggcuacaugaugagcuccaggucaaauaauacuauagagaugcugucuuaaaaauccaaauuugcccccaaaaaauuccauucauguucugugauauuuuaauuuaccucauauuuaaauguauuuuauaauuguuugucaaugaauuuuuggagugcuuuaaaauccuuguuaaauaaucccaauaauugauucaucuagcuugugguaucugcugauugucuuuguacuggcuaguuuugugucaacuuaaaacagcuggauuuaucauagagcaagagcuucaguugaggaaaugccuccaugagauccaacuguaaggcauuuucucaauuagugaucaagggggaaaggccccuuaugggugggaccaucucugagcugguagucuuggguucuauaagagagcaggcugagcaagccaggggaagcaagccaguaaagaacauuccuccauggcuucuacaucagcuccugcuuccugaccugcuuggguuccaguucugacuuucuuugaugaugaacagcaguauggaaguauaagcugaauaaacccuuuccuccacaacuuguuucuuggucaugauaauuugugcaggaauagaaacccugacuaagacagucuuuuuuucguuaaucugauuuucuuguuaucauggguguuuuauuaugucugauguuguguuucauuaugucugacauuuuuuucaggagacucagagucccacuacaaccuuccauuuagaaagcuguguuaacauacagauucuagccuucuuugugcauaucauuuugaaagacuaauuuucuguaucccuggggcauuauuuggucaauauugcuuuuuaguacuauuugauauuuggaaagauguuuccugagauauuuuucuauuuaucucaugugaauuaaagaagucucucaguuuuagagauuaagaaaauuucuacaacuauagucauuguaggaugcugccugcuuguauacacucaacuauacagccuuaaguaguaguauucuuaguuccacaagauuaagagacuaagccuggguaaauguaucaauaucucuguugcucaugucuccuaaaacauaguaucucugugcauauugaagucuuaugagcuagcauacucuuuugacacaaacauuucucacuuuuaagauagggaugauaaugcaaucuuagaaguuuuauggugaauaaacauguauaaaaguuccugaaugcagggacguuuuuuacucugauacuuuuaaucauucagucauaauauccauggcagaaucauaauuauauauuaguugcucaauaaauauuauauaaauuaaucaguaaaaucaaggaaaauucugaacaaccaguaaaauuguuauuuaauuaucagugaauauuggcuaacuuccaucauugucuuucuagugagugaguuaauagggaaucaugucauguucuucugauaccaguggucuacuuauuauuucagaauacauaacaauauguaguguuacuuguuugaauuacuauguacuaggcaugaugauaacaacagcacuugguuuuaccuaacauccuuggauaucuagucuuacucucuuggugcuccaagcaguacuggguaugguuuccauucccuggaguggaucugaaaucaaaccagauauuuguugguuacuccuacaagcuuugggccaccauugccuuagcauaucucacagguaggauaccauuuuagauuaaaaaguuuguaccuggguugcuguucuuauuucuccuuugguaguauacagagcacauucugauaccaagaacacuaguccuuauggguaaaggcuuuccauaggcaaaugguagaguucuccauguuuagugauuuguguagauauugucuucaggaauuaggccuugucaucaguuuguggauaaaacuuauagucuuugccacagccuggguuguuugaggguucccaugugacccauuuuaacucaauuaaauauaacccaguuuugcuacugcagacuuaauuuggcaacaagauauguucaguugggggaucuaucucccccauuauuuggcuaauuuauuuagauuuccucuuucauguauggauauaaaccucuacuguaucaaguuuccaaacuagacucaaauaacccuuaauuuuaguuguuucucccaaccuuucccucagcuuuuucucuucuucccuacccugcuugaacuucuccaauaccccaucgguccauucauaacuauauauucuaauguuccuuucuauccaucuccuuuuuggauuauagcucaauuauaauuggcuuagcagccaauauccacauauuagcaaauguauaccauauugguccuucuggguuuagguuaccuuacucaggauguuuuuuguuuuuuguuuuuuuucugguuccaucugcuuaucuacccauacauuuuuaacaggugaguaauauuucauugugaaaauguuccacauuuucuuuccauucaucuguugaaggacaucuuaguuguuuccaaucucuaguuauuacuaacagagcaucaaugaacauuuuugaaucuguuaggauaaaucaucuuuuggguauauguccaagagugguauagcaggaucuugauguauauugauucccaucuuucaaaggaagcaccacauugauuucuauaguaagagagcuaaaauuaucuucacagaacauuuacuccaaucucuucagauguuccguucucuuguguacagaaagaauggguuggagguaauagcuguaguauuauugcacugauacaagaucugaagcaaaagucagauagaucuauuuuccaguggauauuaaaacauuuuuaucaugaccuagacuaaaaagucaauuuucaucaauaccuaacguauacuaacauguguguuaccugggaaaguuuuaguuagaacaguagguccuaacuauucuuuaauaccagauacuugcuagcauauacuauuugauauacuguaaacuugggcuuucuuauaugcuuuaugccuaauaaugaucaguuaucauguaugacuugugccauaugaugaaaccgaaguguauuauuucuuggggagaaauguucucuuuuacaugauuuuccuaucauguaagcacaguaugaagccuuucuugaaugagaugccccauuguggguaauaauguaggccccaauccucauuaagucucuaauaggcagagugugaguaagaaauaaacuaaaauuugguguuuuuuuuuccauaguguaaucuuguuuauuuugauugaugcacuuagcuuuacaucauuuuauaccacuauucuauuuaguuacauuucaguuuucagugcugguuacagcugauaaauuuauguaaugacaaguuuaaugaaaccuguaguuugaaaaauagugucuugcugggcgugguggaacacgccuuuaaucccagcacuugggaggcagaggcaggcaaauuucugaguucgaggccagccuggucuacagagugaguuacaggacagccaggacuacacagagaacccugucucaaaaaaaaaaaaaaaaaaaaaaaaaaaaaaaaaaaaaaaaaaaaaagaaaagaaaaaaaaagaaagaaagaaagaaagaaagagaaaaauaguaucuuacaguauauucacuuaagucauaacagaucgucuccccaagcucuuaugaaccccuucuauauuucaggauugugguuauggagaagguggagaugcacacugcauagucugcccuccccgaaaguauaaaagcacuuggggacaucacagaugucagacaugcaucacuugugcugucaucaaucggguccagaaggccaacugcacaaauaccucuaaugcuaucuguggagacugucugcccagguaagccuacuaaacugcauaagucguucugggaauuuuuaacauucuuagaugcccuuuauuauccuaccucuuaaacccuaguaaaaguauucuaaggaucaguuucaugcucuaguuaagcuccaugaauggagaaucuguaucuuucuaacuggaucuaucuauacaaagaauccaggaauuuucgaacaccuaugagcaccuagaagcuuuuuaaucacacugauauucugccuaaaauuuaaaauaaaugucauguuauauuacacaggaaucaugaagaaguuggcaucauauaacuguuugccugucucaugaccuuagcuccucuuugggccauaggauauggauaauuaagagaaaagauggacugaaucacacuuggcagagaucucaugaggguuggcacuccugcuaagaaaggacucauagacacuccuuaucaucucaggaagggcuguuacaagucaacugcuuguucaucacucugccauuccuuucugcucugaucacagguucuaccgaaagacacgcauugggggccugcaggaccaagaaugcaucccauguacaaagcagacuccuucuuccgagguucaguguguguaucuuuuuuucucucccuucuuccccaaaccuguauuagucaacaaaaucaguaaacuucuuuauccuuguaggaggaaaacauuccuuggcacucauuccuuuggcauauuaaacagaggcagccacguaugauuaaaugccaacuuuucagcauucagauucauuggaccuguuucccuuuucuuaaaaaaaaauguuucuaaugagaaaacauuuguauucauacuuugugagcugccugacuagguuugauggauuaaugaaugauacaauguauuuuaaaaauaacauuucuacacuuaauugcuauuagagucaauauugcuauuagagucaacauacauagcauauggaaauccuuaacucuuggacuacuauagaagcugaaaaaacagcuagaauuaauuucuaccugugucacuagacauuuacuuaguuucuaguguucuaaauuuuugucuaucuucucacauacucuugaaauuacagguguuuuccuuaaaaaauaugacauacaaaauagacauugaaaauaaauauaaauauaaaagauaaaauccuauauuaucugagauucuuggauaauuaaucucaaaauuuuguauauauccuucagguuuuuuuuaaacaacaggcauaauaaacuucccuguagauucuuucugaauuuccuguacuauccuucacagaaauaaacacuuuucuuaaauuuuaagaagcuuucuacaaucccaugcuucuuuucauaagauaaagggcuuuuucuaucgcaggacuaugauugcuaggccagguagugucuuguuccuuaucacagaaagaagugguuaagauguaucagcucuuaacugacucagucugaaaguaacaaacauuguuucuauuaaaaguacauugguauuuuguguacauugaugguuuuacuguaaggguguauacagaaugcagugaauucauuggcauauuucucugccuuauucuccacugcuauuuaaaugcuuguauuacuucauauguacucauauucuuagacaauauuugcuauugcuuugugguuuacaucauuuucuauaaaggucauaagcuauccuuucuucacuuuguuuuucucuacuggguuauuuauauuaaucaaugaaaggucuuuuaugacgucuuagaaaaucacgauuuacugauccaguguucacugaugagcauuuuaauuuuauaauauuuguuuuuaggcuauauuacuaaacauagcaugagugaagcacaauauggcaucuuuugguuagugaugcuaauuuauaccaugcauguaacauaugaucucugcuucauuuuauuauaauuuuaccuauuuuuaaauacaaagauaggaaaccugaugcagauggccuaaaggagaagauuuggccuacagaacauuagggcccuugucauaaugacaguuaacuguccacuuugaccaaccuuacccauugcuuuguuguuguuguucuacagguaccuuccaguugagcuuagugaagguagaugcacacacuguucccccuagggaagccacacuuguugcacuggugggaagucugcuagugguauuugcucuggccuuccuuggacucuucuuccuuuauugcaagcagaucuucaacagacauugucaaugcaguaaguauaucuauuuaauauuucacaugaaucaggaguaagacggggcuuuuuauuuuauuguuaaaagaggaauuuuucuaaaaaaaaaaaaaaaggaauuuuucugagacugcaugauaaugggccuuccuugccacauuggaaaaucccagcaaugaugcucuguuguucuaugggaacuauuuagcaugcuauaaaaaauauagaaagucaaaggggcuggagucuaccuagaaauucaauggacauguuuauuagguuuuaaggguucauggaacacuuuucuuuaugggaaaucacuugguaaaggaaacucaagaccgagcacucaagucuauuauuaaaucauagccuaacucaaauuucaguuuacuuauuuuuaaucuucaaaaugaaauaugggauugaauauguuguuucuuuuauauauauuuacauauauuacuuauacauuaauauagcauuaguauguacauauauacaaauagauucugaaacauacgaggugaagaagauuuagcuauaccuaaaacaugaauaauagaaguugaugagguuuucaguaaauguugucaacauaguaaccucccaaaucuggauaacugaaagcauaguguuuaaucaaaauucuuauacacauucuugaaauguguaauuuuagcucacuuauaggugcucugguucucuaggaggggaagaggagcucuggccccaaguuccucucacucacucccuauuuugugcgcaauaagaggugaaacuuauagaggagaaaguggggaaaagccuugaagauauggggaagauaggggaaaaauuccugaacagaacagcaauggcuugugcuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcguggauguggagaaagaggaacacuccuucauuguuggugggacugcaggcuuguacaaccacucuggaaaucagucuggcgguuccucagaaaauuggacauaguacuaccggaggauccagcaauaccucuccugggcauauauccagaagaugccccaacugguaagaaggacacaugcuccacuauguucauagcagccuuauuuauaauagccagaagcugaaaagaacccagaugccccucaacagaggaauggauacacaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauauccaagauauaagauacaauuuccuaaacacaugaaacucaagaaaaaugaagacugaaguguggacacuaugccccuccuuagaagugggaacaaaacacccuuggaaggaguuacagagacaaaguuuggagcugagaugaaaggauggaccauguagagacugccauauccagggauccaccccauaaucagcauccaaacgcugacaccauugcauauacuagcaagauuuuaucgaaaggacccagauguagcugucucuuaugagacuaugccggggccuagcaaacacagaaguagaugcucacagucaccuaauggauggaucacagggcucccaauggaggagcuagagaaaguagccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaaauuuauaugccccaguacaggggaacgccagggccaaaaagggggaguggguggguaggggaguggggguggguggguaugggggacuuuugguauagcauuggaaauguaaaugagcuaaauaccuaauaaaaaauuaaaaacaaaacaaaacaaaacaacaacaaaaaaaaagagguaaacuguugaaaagagacccugacucaguggcuuucugcuucauguugcaggagauucguugcaauaugaggcugaaaagacaguggaggaggauucucuuuuccccguaccaccuggccaggagaccaguccugaauuuccagcuaaugagggcaucuuggagaucaaaccacuuaacuccauccuggaugaugacugcagcuccacucgcggcuuccccacccaggaguccuuuaccauggccuccugugccucagagagccauucucaauggguccauaccccaauugaauguacagagcuggaccugcaaaaguuuuccagcucuauccccucuacuggaccugaaaccuugagagagaacacagcugaacacucaggagacaggcuggagcucuauguaccuuuugaaguucccagccuuuaauucuaccaaggugaacuagaaagguaggacuaaaggacuggaaggcauggacuagccucacaaaauuuccaaccuggguucuguuguuccauaggguuuggacuaaagaauagcaggaaacuagguccgauagagguuggagaagcacuaaauuuugagcuaaguuuacacugaacuucuaggacaagaauugucuagagaucaggcagguugacaugaggcuaauauauuuaucuugacucuacuagcaacuagucauauucaauuuucuccuuucaaguguauaagcagcacaacacuguagagauauguggcuccauauucagagaaauaccaguucaugauuagcuuuauacacuugugcaaaucauuuuauucuuucagagacauagucuucagcucauaaguuuucuugaggaaugaaugaaagcauauacacauguccuuuauagugccuacaugguaggccuuuuuuuuuuccuuuuccugugcucacucagucacaaauuagaaauuccuuuuauaucaucuacauaucauucugaauuuuguaacuucaccccucugugguaggcaaauaagaaauauauuuuuaaacaagcagcaauugagcaacagagaugaaaagugauuugcuuaaaaucacagaacaacccaaucucagaauuagacuagaacccaggauuagcagucccauuauagaacucauucaacuccaucacugaauuugaaauauauauguauguaucucaauauaugugucauacacauaugugguauauguauguguguauauauacauacacauauauaauggaauaguuuugaggaaaaaaaaacacacauaaaaccugaaaguuuuucauguuauauucuuaauauaaacugucaugugugaucaaguguaaaaaauuuucacuuaugauuuuaugccaaauaguuaaaauguuuuuuagcauuuuuggauuuugaaacuuuuaauuuuggauaaaggaugcccaaucuauuucuucauuaaaaauuauguaguucuugaguucacaaguguaaaaagcauaauuguaucucauucuuacuuauggguucugguucuguucugacuccucugccuugcgcgagaacugaagauaacauuugucuggaaaacacuacuuuuuuuuuugguacauggugcuuauaacaacucacuauuugaaaaacaauaucuuacuaguuugaaauaggagagauuugucauuucuauagccaggugauauauuucugcuauuguguccuaaaucuuugcuggucuaaucauuaaccuuuagagaaaaggaaaaggaggguggugaugagcuugcaucccuggauucuaauuguucugcucuuuuucuaggucucuuucacucuuagcaaccuugccauugcuuguugcuggacuuuccugcucuucuuuuacucaacaaaaguagcaagagccugggaugugggucccacaauaaccagcguucaaaaauggggucuucagagccccauucuaagagagaacuaagucuccagugacugaccuugaacacuuuuuguuuuauuauucuagucuggggauccagauuccauagccaugggacugcugggccuguucuuucucuuuaauuaauuauagaaguggggggaguaacaaugaaugagguggaguuugccugccuguauauguuucaugccuauauuuuugagaaguagaccuaaaaaauggaguauacaguauaaauauuggcaucugccuaccauauugaagagaaugaaauacuuucccuuuuagcuauuuucuuugaccccccccuacgucuacacacacauaaacauguacauggagugaagggauauugaggaagguaucauggggaggccugaagccuggauuuuauaacucauauccuagacuucuguaaaaaugauaguugucaagccaguauauuucuuagacucuucauucuuagagacaggcuaucaguacucucugguggggauucaaaucagugucuucuagauuuuucuaaauuguuguuucuugaaugucuuugcauuuuucuuacuccaauauucuuaccuuuucccccuuccagucaaguccugacugugauguuucugaggugcagaaguaguacccuguggagcuacagggaccauuuggugcuuucuuggcuuagagaauagucagucuauuucucuuaagccugaaucuucaguuuuacaugcgucuaagcaugaauugaaacauuuuucuucuucuuuuuuuuuuuccagaauaugucagacaugacccucaggacuuagauguggcuaucauguguuggcuuuaaguauccugguauguucaaaaugagccacuaggauugaugcccauuucguuauagugguucaaguuuugacagggcgaaguggucaacugaguaaagcaacugaaccuuuuuugcuuagguguaauauauaauauccuggaggcuagugugacuuagguuauuaaaaacaaauucaagaugcacacaauuauucugggucaaagagguaaagauggacuaaagcugugggugcuguacuuuauauuauucacauuauaguuguucucucugugacucacuauauaaacuuugauauaggcagugcagggguugcucagugaaauaggggggcauacaaaaguuagaaugcuuucuucagucauuucccuucauuugacacuuaacuaaggacauggcugcauacaaguauuccuccaauaucaagguggcagaagcaggaguaaugaaauuuggaagcaagcuuaccuuacauuguaagacucuuucucaaaaacacaagguacaggaauuuagauaguguuggaauacuugcauuuggcaugaacaaggucuuauuuuugauccuagcaaaaggaagaaagguggagaaagggggaaaggagggaaguaaagaaggaaauaaaacauuuccaacaccaagaaauacaccagaccccauaguaggcuaagugcugcugaggcuguaguggaguuuuccauuggaaaauaucacauguguucaucuuauauuagguuuucuugccuuuagcucuuaaacacuguuuacaauauuuuuucuucuuauuucuugguucccuagacucauagcacucugugagucugcuggaagguuugauggauguucauagagcuguguuucugaguuuuagcauaacacauaaaggaauuuugauaugggucuccugggccuuaucuaaucuuugagguucuguauuccucuaccccaagcaaaaagccaggcuacaguuugaucuuucaggacccuacaguacaguacguuucugagucaauuuucccuuuccuaugucugggcuccccaagcaaucacccaccagaccuccaaagauacccacagcauuuuucaaguuagcuaagugaggcugugaagggucccucaagguaugaguauuucuuuugacaugucaguuagaugccuacuuuacuguccguuugguucuuuuugaaaauucauuuugccuuuagcuuuuaccuguacaucucaagagcagagacaaacaagaaucuccuuggagacucuauuauuccuuuuuaucucugaaucuuuaugaagcuuaugcagcuaguuucuauccuacuagcaauugguagguuagguaaaauguagacuuccucaccaggacuuauccuuaagagagagugcucgcuacaagauucuguuaaaugugucuuuaauuacagcucauccacaaacacugauuaagggccuuaaggucaaacugcugauaagaguguuaaaacaacaagagaaaaaauacuaaaaggucccauuguacuuggcaggggauuagaagcaauugaaucacaacacuguaccagacaaccuggucuccuguaagcauuaucaaaugugucugagccaagguuuagaccuuggucuuugguacuuuuuuucugggacagcuuaugcuuaucucaccaacuuuaauuagccauaucuauacuucuggugaagaagaacuagcacuaaaucugagguggauucagcuugaguagguuccagcuguagaaaggucacuaugugcuuggcaaugcuucaaucucaaguccauuacugcuucuuagugaaaaggacuaugaugauaaaacagcaaaaacaaugugauuaaaugacccaggcacccugcuucacugugccuauacauaacaaggucguuauacauccaugccaagaaucgccuugguuccaguuuucuugaacaguuggaguuaauaacuaaaauaaggugaaguuuuauuuugcuuugcuuucuuugguuucuuggguagaaucaaagaaaaggaugauguuuuguuuuuucuuuauaauugauauuugaccuuggcuuacuucauauuugcauauuugaucaaguaguguccuuauaaagugggaccacuuugagcacuaugcuuuuaugugucuucucuuugaagaauucaugagacauguauauaacauaacucugggccuggacagcaauuguguuuuacauauuugagcuagcaacagaaaauauuuguguacaggggauagagguaggcguuuaguggaggugagucaggccucaggguucacuuuauuucccccacuuauaucacuggaauauugaaagguuguauguaguaugggagaucaacuuucuucccuaaggucguuaauauuagaguaaguaaaaaugucaacacuacaccucucuucccaauagaccuggcacagccucauaccccucauucaauuuauuaccgacgucuuugauguuuuguauuuaauguaggcagguuuuaauuauuguuuuccuuuaaaugaacuauuuauagagauuuuguuaaauuuugagccauaugcaugaguggauacugacaaguugugucugauuuaugauaaucugcaaacaauucauauuaaucaauaaacagaaguacguacaaau

SEQ ID NO: 9635 - RNA, 638 nt, Mus musculus
agcuuuuguuuugcuuucgacuacugaaacccuagcugccuuuucaucuuuucauuucuaacaccacacacagggugaggggcgggcaggaggaggugcaggggcgagaaccuggaaccagggacucuccugggcgugcuguugcuccucagucucugggcucccaaaagccuuccuugcaaugugcaacaagcuccccuacucucagccaaagggaguuuaccucugugcaaacuggcuggcagagcuggggguguaggggagaggguuggccagaaagccugccuagucagcuccuggagaggggacccaggaggggguaaggguagaggggaagaggacaaaggcagccguaguccuaccggacacuuuccuugcuuccucugagucucccgcagcuuuuagaaacuucaccgaagaggaaagggcagcuccugggcggcggcuucgaagccgccgcucugcaacaggcguuggcugucgcugggcuggggcuggcguggugcgucccuuaagcuucuguauggcacuggaguggcuagcucagucuuuuccccucugaugcccucucagccuccagguuugcuccggacccucugguucucccagcaggcuggcuccuagggaucuccgagggg

SEQ ID NO: 9636 - RNA, 12708 nt, Mus musculus
cagaaacaucuugauuguuugccaggaugagguaggggugaaaguuggucccggcaggggugguuuuuuuguuguuguuuguuuguuuuaacuuuuucuuuuuuuucuuuuucuuucuuucuuuuuuuuuuuuuuuuuuuuuuugguuacaguagcugacuccuacccauuccccgccuacuacccaccccaggagccucuacugaucaaggacauuuucaguacuugccaccaaguagcuuagcaacuucaaaguuguagugguuuugggaaguuaguggagugaagcucucccacuugauaggagaugaaagagagaauaauugugcaggaccuguggggagacaauacaaagguuugaggauuugaaggagauggaagcuggcuaugaagcucagggaacuaguaaggcaaggacggcaguagacaaggggaucagguucuucaacuugaagucggaggccuuuuucuuggggacacgaggaauggcacuucagagccacuucuggugaacugguucugucaagcgcugcuagucucagcugcuuucagaugguccuaguugggcgcguuuuggauccacagugcuccgcuuugcuccgcaguggcgcugguggugggauagccuacucucagcugggugcgguuagguucgguugggaucgacugggcgccauuggucucggcagcgcuuggcugaacgccgaugcguucgacuucguuugucugggcucggcuagguguggcucugugccgcaggccaccgcuggcugcguucagauagguucagcugugcgcugcugggcucggcugcauucggcugugauccgacuagguucggcggugcccgcugggcucggcuacguucggcuacacucggcugugauccgacuagguucgguggugcacggcugggcucggcugcguucggcuuugcaccgacuagcuucggcuguucgccucugggcucggcugcguucggcugugucaggcugugaucagacuagguucgguggugagcggcugggcucggcugcguucggcugugagccgacuagguucgguagugcgcugcugggcucggcuguguucggcuagguucggcugugcaccucuggguucugcuacguucggcuggaagccucugggcucgauuguguuuggcugugcaccgcuggguucggcuaaguucggcugugcauugcugggcuuggcugaacgcuacugggcuccgcuaaguuuagcaggagccucugggcuccauugggcucggcuucauucggcuagguuugguugugugccuacuagguucggcugggcgccucugagcgccauuguauuccgcugugcguugccgggcucugcuguguccggcuagguucggcugugcaccucugggcucugcuagguuuggcugggagccucuggacucgauuguguuuggcuguguaccgcuagguuccgcuaaguucggcuaaguucagcuagguucggcugaaugccacuuggcucggcuaaguuuggcuggggccucugggcucgauuggguucggcugagcaucacggggcucgauuggguucagcugagcaucacugggcuccauuggguucggcugggaguuugcuggagccuggggcaccgcugggcgagccggcgcuucuagccugcacucucagugggcguggaaggcggagcgcccccuagcgaaacugcguccccaaacagugagcaaauaggcucgcgcucgagccucggaggcuaccggagcaccggaacucggcugggcgccgcagcagccagccucaggcgccggcggugacgccgucuuaacgcgaccgcgcgcugaccagccccggucuccacgucucagguuucgcagagacgcaugggaggggagcaguuggagguuuaucaagauggcggaagcggaggacucuccgggagaacaggaggcagcggcauccaagccccuggugaguuaagaggacaguggcagaagggacugagggcgaggcagagcucccgggaagcgagucgggaaggcuucgggaucagagagccagagcuucuuggcuuugcaggcccuuggcgucuacaaccagcugacacuacaccuggucuuugaguuagcugcaucucccuuccauucgcuggccuucugugccuuucugagacucuccgcugucuguccacacucuagggguucuuugacagugaguuaaaugccgagcuuggagugguuucugaaguauccucuaucgcugucauuuaucacgacuugucaccagucauugugaaguacuacacaaguaaugaaacugcuucucacaggacguugucguuuuauugguuguaaccggaaccuuuacuugcccggugggugacucaaagcagcuaauuauuauuugcaggugcuugcuauccccuucaugacacauaugucacuaagagccaccaauacugcuuuaagaacacuggcuucacaguuaaccccaugugagcuagagugcauucgcacugaagcuuuugugaguuugagcauuucguuucagugaaggguguuuuugacucuuaaacugaaaagaagguaccugccuuuaaaauggcauaacuucuaugaagugccuaauacagucaugaguggaggaguauaaggaagucguuguuacgcccugucguucuucuucccaaacaguauuugcuuauauacuguuugcucaguaacugcuuucauuucuuuuguuuuaaauuggcagcguaacagagaacugaacugagaggcaagggaacuugguucaagucccagcucuucugcuuacuagcucuauuuguucaucucuucagcaaaaauauuucucgagcaucuagaguguuccaggcagucuuuuaggcaccaggaaugaaacuguaaaggaggauauugaaucuggggcuggagcucagcgggaaagagagugcauuacauacguaagacccuuucgguccaaucuccagcacugaagggauaaggucauuugggccaucuuauggaucaguugugacccugaguaaagucucucuaaacccaaguuuagacguucggaaaaugaugaagcucaccacagaauagugaaaauauguaaacuaaugcaaacauuaugccuccugccacauaguuacagguuaccuagcuguucuuaguuucccuuuacuccagacuguuccccguucuguaaugccugugauguguuuaaguacgugugcaaguuuguacgcaugcacgcaugcauguguagacagggcuuacuguguuaacuaggaguguuuaggaauuaguuguauugcccaaugucuguugagcuacuuuuaguuacuacgcaaaaccuuaaauagccaggcccaacucuagaaaauggugauguuucugagacauuuugcaguuguaagcuuaauuuucuuucccccaaucuuuucucaguuugcaggguugucugaugugucaauuucucaggacauucccauagaaggggagauuaccauccccuccagagcucgugcucaagaacaugacagcuccacacugaaugaauccauucgucggaccauuguaaguuagacgaguugagagaccacuucaguguuaugggagcgaauaggcacuaauacuuugaaauacuuuuguuugguucuuugauuuuuuuuuaaauauauuucuucuacugaaauguaagagucccccuaugacugaguuguuaguguucuuggcaaacaggggccuucauggugcuuugaucagcacaggacauggaguuauuuuuguuuuucagaugcgagaucuaaaagcugugggaaggaaauuuaugcauguuuuauauccaaggaagaguaaugcacuguuaagagacugugaguauaugagguuuuugaggauuucuuucaaaccauugauaguuuauugguucugcuuuauaaagcaaaggaaaaaguaauaaggcggaugcugcuguuuugcaggacuaaacaguucuguaaaugaaauuguuggcagaaguuuagaacagaauuucagaaguugagaggccuggcucaucauauuaaguucaccaauaaacaugaacguagaaccugcucacaguugaauuugcuaaugugauuuggcugucguuaggaauccaaggugauugagauucucucuaggcccugacaucacaggcagaauaucuuacuugaauauuguguccauguggagaacagauuguccauagcucuuaaugugcuagaauggggauuaggaaaugaagaaaggguaauuuaugacacgugaaaauaacaaaccuuaaaggauauaugaaguaagggagggaaacagaaagguugggaaggcuuagguaaaccuugcugcuaggauucugaguggaagguaaguaauuagguaaagauagaaaauauggcauauugguuucuuagcaucuugucuuuccucucauuguaggggaccuguggggcccauugauacuuugugugacacuugcauuguaaguauuuauacuucuuccucacuggagccuguuuuuguuuaguuuuguuuuaaugggcuuuccagaauuaaggaaaaaauugacuaggccuuuagggcgucuucuauuuuuuuuaauuuauuuauuaagaaagaaaagauaagaguuguaguauguagcccacacuauccuggaacuuucuguguagcccaggcuggccucaaacuugugcuucuccugcuccaacuucugaguccuaguauuucaaguaugcaccaccacaccauaacuuaaaauuuauauuuauuguauacucauuuagauuauaauguaguuucacuuucuuguucuuuuaauaaucacaucaaggaaacugguucugugccuugaaaggauauguguuaagagcucuugaaaaaauauauauauugcugaguuuuaaaagauuaaccuuagagcauauguaguuucacuacacuuauuuucagagacaacuguaggccuaaaaugaacucacgugacaugucuagugauaguacuagcaucaguauugggucccuugccucccagcuuaguucauauucuugccaccugaccauacucaagugauagggguuccagagaacagauuccagcacauucucuguacccagugcuccggacuuggaauagaacacacacagccguagaauacaaacgccugcacauacuaucaggcaguguaaccggguaagacuuaauauauaacaucuuuauccuauguaauaugagguuauggacuuuuuuauuauuuuucaggaaaaacauacugagucuaaguauucuaaguucagaauucaaaacauuuuacaucuauuaaauuuuuagaugcagaauauuuaagugacaguucaguauuuacucagcuucaaggcaaagguuuuuagaaauuuuauauguguuuauguguguauguguguauuauauauguaugugcguguguguguauauauauauauauauauauauauauauauauauauauacugauuuuuaaaaaucagcaacgaaauaaguuuaaagaguauuucugcuauuaagcauucgcucuaaaaccuuagugcacgaauuagaaauucauagcugagcaugcugccuguaacccuggcacuuaagaagcugaggcaagaagaugacagguuagaggcuuagccuaggccacacaacuagaccuuguuuaaaaaaaaaaaaaagaagcaagcaaacagaccaucauucagauuugcuaacagcuagaaaguaaccuaagcccugagaauacugaucugauaacuggaaaacccuuacuguccugccagcuacaccugacgguauuguuggaauggaggucaggugugaaaaaaugucacuuuucacauaacuacagcucccucuuuguuuugcuugggaauguaaccucgugccucguacaugcuagguagacacuaccacugagauaauccucagcacacaaguacauucuuuucuucugacucgaguuuucugacuccaucaucccaggguugggauuaucacccaagccaucuucauaaaugcagaguccuaggugaagcccuccaacuuagaaguacugucaagcuagauguaaagcuagucuccauguauuaugaacaacaauaaagucucaugcuugggagcuauguucggcccuuaaguucaauaacuuccgcuuggacagagagcuuuuaguaagccaguuaaacacucuagaaaggucaaagugcaacacuccuuauagucuucaggcauuuggguuuuuaaauaaggaaccuugccaguucuguuaguguuuuccuuauacaaaguacacauuacagaacagauuauguacugauuucagacgagauacguuaccgcaguaugaugagaaugcaugccuuucucgcuuuguguaaaagguuauguaguuuucauacuguuuucuuaggauguuacagaaaaguuccauugaugggaagaaugauggcggaggcccagaauucgcagaaguauuuguuaucaucugguuuggagcaguuaccaucacgcugaauuccaaacuucuuggcggaaacauguggguauucauauguaccuuuuuccugcuugcuagguagcacgugggagauguuaggaaaacagugcuauuuugcuuuuuuuuuuuuuuuaagaaaaauugacuuaaggaccaaauaaaaaguuucuuuaaaacucaauugaaaugaauuuuaaaguucacugauaagcuucagcuuuucucuuuaaauuuugaacuuauaggcaaaauuauucugaggcauacauuuggggcauaugguacaacacauucucagauuggucucuuaacuagaauagacuaagagcuauauuauagggucagugggauaccucgaagaauuagaguagauuguuugauauuagaaaauugacauuuauggggacuaacgaagggaacaggaagagaauagagaaaaugaaaguaugcgauaacaggagacuagacccaugaaauuaccauuaggauaaagguauagauaggcuagcaggaaggaggcaguaguguauagaaugucuauaagacaucugugcaaugagcuaugucuuauacuacucagugacacuucugaucuguggauguguguuugcaguucuuuuuuucagagucucuguguauuaggguacugcauucuuccuuugaacaucgcaaugcugaucugccgcuugcugcuuuuggcuggacagggaccaauaaacuucaugauucggcuuuuuguaguguuguugauguucgcuugguccguggugggugaguaacagaacauaaaacaaccaagauaaaacaaagacacgaguuaaagauaaagagcugauuuggaacaaggaaauucugcugucaaaugaaaguaguaugcauagacucuucuguccuacauaaguauuaaagguaaucauauccacauuuugugagcugccuaucugaacucugaagaugugcagagucaccagguaugguguuguauacuuauaaucccagcuacuuuggagacuugaggcaagaaguuugcaaguucaaggccagccuggacaacuagauccuaucucagaaugaaaacuuuauaacaaggcugggaauauaguacuccucauaguagagugcuuacuuaguuagcauuuauggacccugggcucaagccucugcaccacagaacaaaagaaaauaaacaaaaagauguauauaaccacauuuuuugagacagaaucucugugucacucagauuagccuugaacccaugauccuccugccuuugccucuuaaauuguugggcuacuggccugcaccacucuguccagcauauaggaguuuucuuaaugaguaagaugaguaggcuuuuauuggguggauagaaugauagcacguuaaagagaacugauagguugcaggccuauaguccccauagucccaggggacagguagcagcaggaguauuaugaguucaaagucaacuuuggcuacaugguagggucaaggccagugguucaagcaucaagaccuuguuuggaaaaagaaugccaauaacagcaguaacaaacagaccccuuucccccauuaacucauaaaaaugaagcaguaugagacauuuagcauaggagcagauaaacuuacucacauuuaaaccugcuaagcauaacucugucuuucuagaauagauuaagacacuugcuuaagaaggauuuguaccaaauuagccaaaaccuuuugaagcuuuaguauaugaaagaagcuaccccugggcuguuguaaguuuauaaguuuacccugcuuauguguguuggaaccuaggaccuuguccaugcuuagcaaguacugagauacacacuucugcccuauaacugaacuuguauuauucucugaggagccacuaauaaaacggaacuuuuaguguacuucuauaaucuagauuaugccaaugacauuggaauuuaguaaauauuguaguucugauaauaggaccauacuaaauacuccuuuuuguuuucuuuagcaucuacagcauuccuugcugacagccagccuccaaacagaaaagcccuggcaguguauccugucuuuuuauucuacuuugucaucaguuggaugauacucacguucacgccaugagucaggauacacacauucaacaccaaugaacugaaggcucaccugaaagauaaugguuaucaacaacaacaacuucucccacucuuguacaauuguugggguauuaaaagggggccacaugccacuguugucauuuauauaagaaacugauauuugcaaggcuguccuuuuccucuuaauguuauucuuuucaaauacuuguacaucccauagauaguaacaugccuccuuaaggcaugaugaagcuauucgugugacccagugacucgagcaaguggauccacucuacagauuacagaguuggugaccaucuucagcuuggagaagauuuguucaggugcagcucuuaaacacauugccuuaugacuauuagaauaugccucuuuucauaaauaacagucuguauccauugauuuucuuuucucccccaaacucgagaaggcaacagcaagagguuaggaacgagguuuguagaugugggaagagaaaacguguuaacuaguuucagauuuugaucagagguaccgcuguacuugguuugucguuuguuuuuaagcaaauaacaucuaaggaauccgcuuuuaaaauauuuuuguauacuuacuuuucugucacguguaacagaggcuccgcuuacauucuaguuuuuaaccuuucauacagugacagcagucaaacaugcaacucuaacugaagugcuugaugguuuaaugcuugagcuuuccuaaguaguagaggaucagaaaucgagguuuaugguuuguagugcauauugucauguggguaccuuccuuuaagguauagcuuggcuauugcguauuuaaaagaaucuauuuuguacaacccagccucagauuagaaagaaaggcuacaucagaagcgugcauuuaaccaaauggacauagagaucuaguguucugaagacuggauaauggaagaaugcguacauacaugaugaaggguuaguugaguuuauagcugcugccuuuccauagugggcucagcaggguuuuuuuguuuuuguuuguuuguuuugauuauauauggaggaauuuuuuuuuuuggaguugggggcuagggaauaacaauuuuuuuguguguuuuagacuuuauuuguaaagcuaauuagcuucccuuuagauauguacauuuugcacaugugcaucuaccuguccucucagauauuuacgcacaagagugaaggcuuuucagggaacagaacaucuagggcaggcugauuuucagcuaaacaggacuccuguaagauaguaagcaccgaugccuucuguaugugucauauugaacucuaauagaugaagauuaggagucagagaacauucauuguaaauaugcacuuacuuguaaagauagaaaugucuuauuccauguguuuuaucauagaauugaaauauuuauugauuuuuguauuuaaagacuaccuucauauaaauauauaacucuaaaaacauaauuuuucucauucucaaaguaaccaaaugagcaacacuaggccaaauggguucaugggaugaguuacaaagcauugcugaguuuauccucucugucccaaccuuacuuaccuaaugguuuggagauauagauuugaauucauuguaauuuauguuuuaaauuauaaaccuuguaaggauaaaucugguauuucaaucuugaaaacuuuaaaacuaacccuaauauuugaaauuugucauaaaauaucauuucuuuccuguaucgaaaauuuuaaacuuucccuucaaauaucuucccuaaguuguuucauaauaugcccaaguaauuauaauaacaaaguaaccauacuucucaaauuuagucuuuacuggauuuuacucaggugaaacauuuccucugaaauuccuaaggccacaagccguaaggguuuuggaggguuaaacacguuggauauaaggcagcuugauccuguguguguuaaucuguugcccuugggugauuugcugaaugguuuuuauauggcuuaaaaggggaauuuaggacugaggcuguaguucagugauagagcauuagccaggcaugcacagcacucuagguucaauccugggcauugccaaaaaaaaaagguggauaaacuggaggccuaauuucuuuuuuucuggaauuaaaugaucagaggauauaaauauuuuaauauaugcaaaaaaucuguugcuuucuaugacaaaugaaguccugacucuggaaguuguaaucuagcuuuuccugguucgcuacaaaggcacaugguugacuguagaaaugaggccuggaagggcagaagcgcccagggaaggaccuccuguucuaagauggugcaguuucaugcugcuggugaguuugaagcuuuuuugcagacugcgcauggcuauuguagccgacuccgacgaucaccugcugcuuccacaucucagaccaugacacuguuuuacauggcuuagcaauaggaagaguagagacuugauuuaauugggcuucagauuacaaaaucucuagugaugacaaugucuuugaauguuuuauauguuuauaaucagauauugagguguguguguguguguguguguguguguguguguguguguguguguuugguuuggcuucaaaguuauguaaguugaauuugaucuuuucauugugggaucuuucuuuucguugggcaaaguuacguggcaugagacuaaugauaagcuguugacucucuuuuauaaauaguacccucaaaaaugugauuagaagacuacuaagccuauacuuggagauauaaucugcugacuuacugcauuuuagcugccugcuuauuccuggagaugaaaaugaaauuuuguugguugauauuuuuggguaccaucaagucguguuaguaugguuugaacacugaagugaucuuuaacuagacuguugguuucuaugaugguuggauggaaguaaauaaauguaugaauguugauggauccauguauguaaauuagagguccuccucuagauucugugugcuuuuguuauaaauauagaacugacagggacaauaauuuaugauuauuaauaacuaacaguuauugggcauuuacuguauaccaauuuacuauucuaauuuuaaaagaacuuuuguaaugcuuuauuaaaguccacuuuaccaugaaaauucauccuuucaagguguacaauucagcaguccuuacuaucuuuacggaauuacgcaagcagcaccacuauuuaauuugagaaugucuguaucacugugcagagaaacaagccacuccuguucucucugcaccuccagucccuguggacuaccagucugcuuucuauccaucuuggccagguacuauucucaaugccugguuccuccacucuucaacagaaagugcuacaauucucauuuuacaguagaaaauuuaggcacagaaauguaauugcccaagaucauguauugaugcaugcaagugaauugaugguaagaacacauuagaugaaaugcaguuuguauuacacucuuaggcacauagaaugagcacauuccuucccagaguaugcccccucuuacucaccuuugcauccuggaacugauuggacguagauaugucuuuuuuuuuuuuccagaguaaugaccucuggcaucugagcacacaaagcaggcagacuuaaaaagacagguuuacggcccuuacuccucauugacccccccccccguuuccucucuucacacacacacaaucaauuuuuccuuaagcuugaagagucaaacuacuacuuaaaaaucuuccauuucacguuuaccacuuaggguacugggucuauuucuaagacuuaagauuaaagucauucaaguacugaaugccuuucuauucggauagaugugaugagaauaaagacuuugccuuaauaaagcuuguuccuuucuggucuuugguacucuacucuaguccuggucuuuccuaugagcaauaaaccugugcaaagaaaccuggaaaaugguuuguggauguuauaugugccaauaaauccauuagaaagagauaaau

SEQ ID NO: 9637 - RNA, 433 nt, Mus musculus
gagcuuaagagaugccgcugaaggggaaaagugguucuggagagggagggaaaggaagugcagccucugggagugacaguucugacaagaaaucuugggguccuaaaggugguggcaaugcaguaaaggucagacacauucugugugagaaacaugggaaaaucauggaagccauggaaaaguuaaagucucggaugagauucagugaaguggccacacaauauagugaagauaaagccagacaagagggugacuuggguuggaugaccagaggauccaugguggggccauuucaagaagcagcguuugccgugccuauagugggauggauaagcuuguguuugcagacccaccaguuaagacaaaauuuggauaucauauuauuaugguugaagggagaaaauaaaaucacaugaaagacugaaaaaaaaaa

SEQ ID NO: 9638 - RNA, 12964 nt, Mus musculus
aaggagcaggguuggccuugugcucgccugagcaggagaguagaaagcucagcggcagcggagggagucuaugcgcgcuggacagcaguggggggugugugugauucgcacugacugcagacacucgggcucaaucgccggggauuaaggacuuggcgaccgggcugccgggcuacccggccgaggcuucagaggugcaaaucgacgggacugauuugcucggcagggccguacuagccuuuuaaguauacugagaagggccggugcuaaaguagaagcugucgugggacgcgccggcgcggagucccacuguggcccggaggaacggaguccguguuagggggacccagucgggagccuggggaccgagcucgcauuguugggagacaacccgccucuucuucccagaggcgucaaucccaggacggucgaggcgucggggcagccacugagcgcucuucagggagacccgaucggggagaggacuugcagucucaaacaaucugggagagccgagcggaauccggcgggaucacucgggggcggcgagcccccgucgcgccucgugcggcggagaggccagggaagaaaguccucggaggccgcagcccaugcgcggguuggggacgccugcccagugaguccuccuggccagccgggcgaaggagagcgaccccgaggccagcgggaggggagugcuucaaggccggcggcugcggaggaugggcgccugaguggcuccgagcgcugcgcggcacgggcaggcgaggcgagcuuugcugaggaggcgcuaggggauccugaagugcauucugccccggggaaaauggcccggccugggcagcguuggcucagcaaguggcuuguggcuauggucgugcugacgcugugccggcuugccacgccguuggccaagaaccuggagcccguguccuggagcucucuuaacccuaagugaguaacuuaucuacucuggucccugggggugggaggcacuucuucggggugaggucgugcacccccaagugcgugggggggguuguccguaggaggugcggcgcccuauuuuauaucuggccuuuucuaguguuuucuugcgggcagucgggguagggugcggaaggguggggugggggcacuuagcugcguuucgauccuucgguuuggcccuacucucaaguccggaucgcgucuguuggucacaccaggcagauauagaaugucugggcgcuccagagcgcacccgagagcugggugggggcgaguaagcagcccacuccagggccucugggaacguggugguuuucacucacagccacuccaggggugagaucgaccugagcaagggaccaggccagaacacagguuccucauuugcuuaggugucagggcggcucaggaccuagcgccccggggcgaguggcagcaucuguauaucuucuccagcuucucccauuuucauuugucuuucuucccugucuguuugccucccugucuuucucuuugccgucucuucuugcacacuccccccccccccccauuucucucugccggggagguagaaaggcgggcgcugcuuccaggcucacaaaggcggcggguggagaagggcggaguggaagaggguuuguuugagaaggggguucgauccagugcccgucggggguccaguugagcuaggcaccagagcuucuagagcuaucagggcugagaaugguaguggagccagcgagggagguggguggggaacgugugauuccuguccaggcagguccaacccccccccccccaaggacuggagagccaugcuuagauuucuccuaugguuggggguagugauauaaaggaggcccuuuucuuucuucuccuucuccuuccuaacucugcccccucccaucucuaaacaacacacaccuuucagggcgguggcucagugguuucugggcuguugguggggaguagcuuaggcuguugugaccucuggaccuuuuucucuuuuggcaucuaggacucaccguggaacucaggguuguaaucucucuucucauuuucuggcaguccaguuguggacaacacaguuaguggaaaccugggagggggagggggaggcgcuugaccuguucccagauuccuguuucuggaauuuccuccuguccacucuugugggcucucugcuaacuuccuagguucuugccugccuuagccccucgagucccagggaugaaagugagagaagaggucuucuuguuuucuccuuggguuaagguaggaucccauuacugauccuuggcuaaaguagggucaggauagagguuuuugccucuguacaaggaaaggggcugacuggccaggauuucuaccuuacucagaagccuguuuggucaccgugccuucacugcuggggcucaaaugguuugggggaacccucuagacuguuaagcccaugggaagagcuugugaagugcccaguucuucgauguaagggugaaggcuggaagugcucuuuagcuaggggacuugcaaucccccuaggguagccugucccaggagcucaugggagugaccuaauugcucucuugggucuagauaccgugcagcuccgcagcuggagaagagcccuccugcagaguugagguugcugggagaaacaggaucccugggagcgccccucuuuauguguucucugccuuuagagucacagagcaguuuccaagcuugagggcuguguccccucugcucucuauccaguccacgucaagcugaggacagguguccuggggauuuggagaggacugacuuuggacucaaguagaaccugccuagauucuaucccauaauugagcagauucugggaacaguuuagacugauccuggugguucccagaccccauuucaccgaugcucaggggucuggaaugcagucuaugucuguguuuguuggcacagggugcagggcaggaggacaggaccaaggcacugcccucagcuccaggggcugccugugccaccgcacccaacccucaggcugccccggcuuuuuaaauaaauacugucucucucugcuuccguguguccugucgaguucucccucucaggccgacauuguugccugcucacacccugugaguggaacucaccucucucucucucucucucucucucucucucucucucucucucucuccagccaggcucgccugcucucccucuuucucacacucccucucacucuuagucacucucugccucuuuuucucaaguccuuuuguuucucgcacaugcccgugcucucccucgcaggcucauuuucucuuaucccuccccucuuccucuccuggcuuuugguccccucuccucagcccugucaggagcuggcaccccucccucuaaaaaucucccagugccuauaaacccugcuuaauugcuuccuccuagggaaaaaaaaucaaaauaaagaagugauggggucugcuucuagguuccagggcgcacgcagccccggcucuagggagcuggaagggccggcugaagacugcccgucuuaccuaucuccugaacugcugcuaaggggcugucugggugguagucccugggcgauaagaacuucugcuuccugggccccuccugucagauuugccccaagaguagagggugggaagauggguuugguccuuuugggguuugguggaaagcagagugagcauguugggggggccuggggaggggccaugggcagccacuucccccagcugccuccccuuggggaacuuggggcagccagugugagcuucacacuugaguccucagccaaguccagcugcugcaccucagccucucagucccauucugacccuauacugcuccccacucagguuccccccccaccuccaaggagcaggaauguguuucagaucacauuacaaaccuucccuacaaggagggugggcugggggcucaguuuggcauucaggacccuugacccccauccagcuuggguggggcagcugcagaccccaacccaugcuugccuguuacaagcuaaaggguuggccccagccccucacagcuguucuagcucaguccuggggaggccagcccaagggacuucuuuccagaggggcuggggaccuggcuauucuauuuuaugucuaauuggccacaggugaaagaaagccugggcgcccuaaagguuccuguucucugaccccacccaggggagcaaggcaaaggccagaagagccugcgagggagcugagguggggacugaguugggguucucuuucuucuuuggggcucuuggagcccucacuugccauacuagcuuaggugcaugagggugcccaggccuuggauccugcuugcugggaagcacugauuucugggguuagggcuauguauggggucacugggccaacaaggagacugcugauugucaugggaacaacagguuugggggauaguucacaugauuauaagggcaugugaagugggggucuucugagacuaugaaagucccuucuuccugguaugaucugguggugguggugguuggggucagggugccagcaagccagaagcauacucauucucagcuugcuacuucuaaaugauaccgugcuuggcaugcuaaguaauaggcagguaguaccuugcuacuuacaaugcauucucauauaugaucucaucgggugcucccaacagcccugggaaguaggcaauggccccauuuuccagaggaggaggcauaugugcagaaaggggaaaugucuugucuaaggucagccgguuacuuauugagucgggcagaggcacaacugugccgugugccauucuuuccauaccauccugcugcaggggacaggaauucaaaguaggguuugaaccagaccucugcugucccuggguucuccccucucaccucccaggcgggccugcaucggccugaugacucagguccugccuguuugggauaaguaguguuccagcuucuucauucaacucuccgaggcuuagcucugagggcacccugcacaggugaccuagccuaacucacugacuggcacucugccccucccagcucugaguagcuccuuugguuccucucugggccaggaaugucuuccucuuaggaacucuagggaaaacauggcagggggugugguuaagccccaguagacuagcucuggucaggugggacgaagaggcgggcagaguuuguguaggugaggagagugacuuccucuaggacucuucuggcuugccugccuccgacagagcugugugugugccagggcccagcugcuguuccugcccacccacgccugggcgggcacugcugggacacgccaggccugcuccugcugccucgggggcuggguggagcugggggagugaaagaggagccuuuaauuucggggcuccccacccuagcugggaugagagcagacuugaguucuggcuuggggucugucccucacuaguauugccauccuggggugagaacaggccugguagugguggggucaccaaaccaaaccaaaauuguggcuggagucuucuaccacauuuagacuugcauggcuggaaagcaggcuccccccuuaaaccucugguagagcccgaggaaaagguugaagggaaggaagacaaugggccuggugggacaagaagagcuuucuaagcagaagugucccacuguaagcucuucccuguaggcgacauacagaaagguagagaggggcucaucuggacuaaggagcagauggaagagcuauuucuagucuuucugggccguggaggcuacuguccccagacccuaugggcuuucugaacuucagagugguaacucuaaugagaaagucuauggggaaagacaagcuagggaagaugggagaggccaggccacaagacuggagcugaaauaguucuagcugccuucugaaagucuuuuuacucccugggguggcucccuggggucccagggcuaucagaggcuagggagggaaggccucagguugccauggugaccugcuuuaggcuuccugcagggccaugucaauccccuuauuuucuagaaaagggcuuugucuggggguggcccuaggaaggaaagcuuggcuugaugggguggggacaguccuuucugaaagguggugccuaaagacuuuaaguuagaagcuuccuccuccucuccucccacucauaacuuggugagaaaggaaggagauagguauggugccccuaaaaggaucacuaacacugugccugguuuuggggcuucacuuucacuggcuauacccccaacccuagugaucccauauacuuucuuggacuuccucaugguacuucugaggaaguuuuccugagugaaaauuuaccaguuaggggaagaugcuaagaaagcgugggauuggggucagggaugcaggccucauuauacuccuuucccuuccacacuuuaggagaaggugaguuuucuucugccggcugcuaugcaaaugagcugaugaauauuuaugaagucuguucacugagguuggagacacucugagggguguugggggcaauaguccuuucuucucccccuccccccaccaugcagacaucuguuuccucaaugugucuggguucaaacuagaaccccaaguagcuaaaagccguguucaguccuggggcucuggagucugggugggugguggcaauggaagaguauacucgagcagacauauuucucuggugaggaaguuggggcccagugguuaggaaguaaaccagucugucucccauguucauguccucuauguagcuacagcucuauguuguuguggggugcaacggucuaaguagcagacacuguugaggcucuguuaaagcccaagggguuugagaagccuuccucaaugggaauagaucucugaucacucauuucuucacauuaagggccuggguuccuuugagcucugaaauguuagaaaugcucugcucucgcuaccuggggaggaccaggggaaagugaaaaaaagugccgugagaauuauacaaccuuuggugaaacuugugggcuuuguauggccaaagggaugaggguauuucaucuguaauguuuccuuggacccccaugcccuguuugcuuacuuucugucugcugcagagcuguagaguuagaguccaaacgacaaagcaccccuuucuggcuuugagccucugguacaucaagauggcaccucugagcuuggagcgucacagugacacggaagaaaggcuguuuuguuuuguucuuuuuuuuucuaucugcuucagcuacuuagauucucuccucugcuaggaagaugucagaacaagggcacauauuugacagugugaaggaaggcuucagcccggagcuuugagugcgccuucacugauugucccuacuguguugggggccucagcaaauggaacgacauugcgguagccugugaccugggauucuauaccaacacccagaauggcacucuucauuuuauccuuccuguggguuaccuuuagucccucaugguuccuccugucggaggacccaccaccaggcagaagaaucccacgcugcuaguuauggccuuggggaauuuaccuguagcccuagaucucuuucccaccuccucugauacuuucuacucuugccugcgcaggcuguuugagucaucagccagccuggguuuugucuuccccacugcuguccacaguugcugacucggcccugacauuuuucucguucaccugguauccacccucauucugagcuuugaagccauuuuagaacaucacaguauccucguccgaugagccaucuuuucccucuugaugucucucaucguaugaaguagcauccucaccuguaaccuacagauagccuggaggugucuguggcugaagugugggcuguuuacuuuuuugggaccaaaccagacaaucaaguccauggcagucaaguuguaucuucucuuucuagagcuugccuaagaaaccacagaacuuaaugucggugucugaucgccugccucuuggcagacuguuucaaaggauucaaucuuauugagugccuacugucuucuaggugcuuaucccacccaauccuaggguuaugggcacuaguuuauaagugaagaaacggaaguuuagagagcuugucccagacuauggagcuaggaagcgccuagcuuuggaaugugaguccaccaugugcucuuucuccuggcucucagcuucugccugagcaagcugagaaauggccggcggagcuucaugucuuuacucugcuugccagguuagccggugaagccuggcucaagguauuuagucaucuccucuugggaucuguaguagcugcaguggaggagcaagaggucagauuccagccgcaugggauuccugaggucuugucuuacacgaguuugugcucuucugguaggagcacccuuuccuuccuucccggagucaaagugaaagacagcucaaguuuggggauuucagcucuuguucugggauggguacauuauucaccagaauaagacuguagagcugucccuaaccacagaugguggccaucggcuccuggcuccauugccuguuucuaucuccccauaaugcccaagauuagcaagauggggggcaggcuccaggcagguugagcuccccuagccuuuggcugggagcugcgggggugguggcuaagacaugugugggcuugcgcucucucucucucucucucucgcucucucucucucucucucucucugugugugugugugugugugugugugugugugugugugugugugugugucagucaguagcaguggccuuugaaggaaugugaauguguuggggaguauggggaacagggcaccaccuccagguagccugggccugacacauggguaccuggcccauuuggccacgucagccccccugcggaaaugccccauuaggacaaagggcuccccuagccaggcauugccccacccugccaagcaccgaaagccuggcagccuugccuaugggccaccccuuccacacccugcuggcaguaugguucucucuccccacccccagcccaaggauagaggaagggcagaaggucgauuugauagcuccacccgguaggacuagccuggccuucacugucauagcaccugguccugagauagccagagcucccaaccuugacauugaccauuuucuuucuucugggcagguuccuaagugggaagggcuuggugaucuacccgaagauuggagacaagcuggacaucaucugcccccgagcagaagcagggcggcccuacgaguacuacaagcuguaccuggugcggccagagcaggcggcugcuugcagcacugugcuugaucccaauguacuggucacuugcaacaagccacaccaggaaauccgcuucaccaucaaguuccaagaguucagccccaacuacaugggccuggaauucaaaaaguaccacgauuacuacauuacaugugaguccacacccagcugucaccagcucuuucgcugggcuucgcucugccuuccugcagccucccugcuucugagugaugccgugcuagcacgugcacaccuuacagugcugccugaucugauuccagccugcccuuagaauucuguccccagcauucagaacccggcagcuugccucgacuccagggcacagaugggaaaggcugccuauccauguggcuuucucuuccuuucuugagaauggcagaguuggcggaauccuuggagcccagccagcuuuacugccuuauuuucccccuguagagggugggauaggguggugggucuaaggccccaggaagugaauagggcucagugauagugugugacuaacauccaugaggcccuggcucacucucuuuagccacuaacccuccuccucuggucccucaaagaagugcaugggcaccuugccuccgaucacacaaggaguugauggguuuuagccuggcuugccucacacuucuguaggauuccucccagucuaggacaaaggccuucuaaugguaccaguuccauuuguuuuggucugagcagcaucucccauuaagaagguauaccucaguguuguccccaagaccaaggccuggccacaaggagugccauaagcagaggggcucaguaugggccuggcuggcuuucuuacuuccuauggggagggagguagaagggcuuggggaaaggaggugcagagcucgacugcugaucguuugaucauuguucuuggcucucucuugauucugucaaagaaagaaagagagaaagagagagagagggagaaagggagggagggaggaagggaggaaaagagaaaagaaaaaguaaacugaaaacuccaguuucugauuucucuggccuuuuccuacagcaacguccaaugggagcuuggagggacuggagaaccgggagggaggugugugucgcacccgcacuaugaagaucguuaugaagguugggcaaggugagugccugcccaauagccaugguggcaguugccugggguauguugguaguggggaaguagucacagcguuagaggggcugagcucuaauauucaggccauucuuagcccaccuaagggaguugaggacacccaugcuggcagaguccucccucugaucugucuucucuuggcccucagauccaaaugcugugacacccgagcaguugacuaccagccggccaagcaaggagucagacaacacugucaagacagccacacaggcuccuggucggggaucccagggugacucugacggcaagcaugguaagggaauaucgcuauucugcagaggguauuucucaggcguccccuccauccuguaucugaagaagucccugcugccugccuccugccugagacaugauguaucucucuggggaauguggggcgccaggcaggaacccagagaguuucuuuggauccaagguggcauuguuugcugccacaauguugacugcaauggucuccugacugaccguugcuucccuccccuuuccucagagacugugaaccaggaagagaagaguggcccaggugcagguggcgguggcagcggggacucugacagcuucuucaacuccaagguagcauuguucgcagccgucggcgccggcugugucaucuuccugcucaucaucaucuucuugacaguccuacuacucaagcuccgcaagcgccaucgcaagcauacacagcagcgggcggcugcccucucgcucaguacccuagccagccccaaaggggguagugguacagcgggcaccgagcccagcgacaucaucauccccuuacggacuacagagaacaacuacugcccccacuaugagaaggugaguggggacuacgggcauccugucuacaucguccaggagaugcccccucagagcccggcgaacaucuacuacaagguuugaaggcccagcauggccucaggccccacaggacacauggccuggaucggccgcucucuucucccccacaccccugcccuugccagcugugcccaccuuuguauuuaguuuuguaguuucuuggcuuuuauaauccccuuuuucuugcccccugggcuucggaggggggugcuugugcccccaauccccaugcucuugugccuucccccucuggccaggccucugggcuccgugggggugcccuuucuaggagggcaggguuggacacugacggacugcaggcagggagguagcccccuggcccugcccccuccucaucccuucacccauccccaggacugcucguccacuaucaucacuguuuuuaaugcuuuuguguugauuuuuuuuaaagcugucaacucauuuucaucuguuuuuuuuuuuuugagaaaaaaaaaugggaaaauguacaaggcagccccuucccaggcuuucugagccuggccugacccagucuaagagggccuggggcaggauguggccagccaggaaacauaggauggcauuucuuuuauagacuccuuaguaguucaggggagugggggaggguaggccagggcuauuucugcccaccgaggagagaagagcgccacccuccuuuuuggacccucaugagacaaugcuguuccuagcagugggguagugacuaccacccuucuaccaaaaaaaaaaaaaaaucccuuccuugugggauucuugggcaucuccugccuccuucacucucacgguaauuaaugucuuaauuggcuguugccuggggaacaggagagcugcugcaggcagaugaccucaugggggguggagggaggugaggugcccagguggcuauuugcccugcagagcugggaguuccccccaccaccaccacccuguucucuccuuaucuuuggcaucuuugguucaagguggagaucuuaagcggguguaaggccaggcggccugcuccuucccuggguucuaguacaaagcacacacaccccccacucacucaauauggcucccacuguccccccaccccaccccccgccccgaguuuggagcuggggccuggaaagaggaagaggcugcuuggggcugggccagccugcagugcacuuugaccccagcuccuuggcagcacggcugcuaacagacugccacucaacugugccucgcaggcacucccagggcugccauggaaggagcugggccuuacaccacccaccuccacacugccuccuggccagcugcccaccccggugccaggugggagagggagcaaaacagccagccccuuccagguggcagucggaagggauuuuuguuuuugauucuguugccauuuguguaaauacuagucuuuuuuggaagaaauaauguaaagauguuuuguauaaacucugaauuauuuucuuguugcuuuuuucuuagaaaaaaaaugagaacuaaaaaaaaaaaaaaaaauuaaccacauggag

SEQ ID NO: 9639 - RNA, 5542 nt, Mus musculus
caugugaaccugugcugccuguaaugaacgaucaucucuugcauagacaagccugguuuugugaggaacagcaccagauuucacuguaaacaccuucuguuugccucaaacaccagguuuugaaaauguggcguuucuacugcaacccugaagaucugcuucagacuucauauccccagacaaaccauagcauguaacauaggaugugauauaguaagguaauuaacucucacguuagaauuaaucagaaucuucgcauuuuauuuuauuaaaaacaacaacaacaacaacaacaacggaaaggaagguggcaaauguuuaacauuuguuaaugcgguuacaguucucgcagcuguuuuuuuuuuuuuuuuuuuuuuuuuuuuuuuuuuuuuuuuuuuguuccccugaaaaaucacagcguuucgaacgaaaugacgcuuuugagcccaccccaauucacagagggcagcagccacccccgccacaucaagggggcggacgcgcgcugacgucacaacuacuuccgccgccgcaguccccgccugcccuagugcucuuuagcgggggaggagccgagacccggagcagcagcaguggugguggccgcguccggagguccgacagcucugcagcuccgagcgcgcgacuagccagaaaggugaguaagaggcggccuggggcaguagcccgggcuggugggcgagugcugcagggugggcacggggagaaauccggugaccccuuugcggguucgucucgggagcgggguggggcagaggggacuugaccacacgccgaggccuauggccucuucggggacugcaucccuagcugcccagccccugccgcgugggccucgggccaaauggccuucauggcuguuugagagggaacuggugaucgcggcccucugccacuccuaccugucucuccuugcagugcucuuggccucuuugcagagcauucuauggccuuucuuccucccauuuuacugcuguuuugucgaaugacacauggcuaagauuuuagguacagauaugugcccaagaaaagaauuauuagaagauaaacaauauucuaaggguaaaccaggguuucuacaugcccuuuucuuucuuuugcccugccacauugauuucccuuugcccuuugagcugauaacguauuccugucucuuauuaugacauugcacccccuccucugugucgcacgcacgcgcgugcgugcgcauacgcauuuacacgggcacgcgcaaacaggcgcgcgugcgcgcucgcgcgcacacacacacacacacacacacacacacacacacgcacacacacacacacacacacacacacagaaaccuccuuugcagucuggucccugucccuacauccucaagguuccagggagcuccgccucugcgcaugcguacgccaacaggcaagcacacacccucucacacaccuucuaguuccuucucuccccuccaccuaccucuuaccucuagaaucuucccucuucuccugcucugacccuaauaccucucccccuccuccugcucuggcucgcauaccucuagaaucuuccccauccuccugcucugacccgcuccuuugaaagccuccuccuucucucccccucccucucucccccucucucucucccccccucucucuuccucucucucuccccucucccccucccucuccuccccucucgcuccucucucaucucccuuccucucucccucucuaccucuuccgucucccuccccucucuccucucucccccucccugucccucuuucuuuuucucccccucccucccugucucagaaauggccucccuugucugugucugcuagcuacauacacacauguaaagccaucuucaucuuuguaucacuugccauguguauguguacacacaggaagcuagcugccuuauacacuucuccaaugucccuuucucccuuucucuguugcacacugaacccucauauggaaauccucuggggacacuaacccccuuuccugcuugcuauauuaaugcaugccaacauucguugguugcuggucuccguguuccagcgucacauacauauacauccuccgugcuugcuucuguccauuguuggcuccuuucuggagugacucuuuccucugcuccuuacugauccccgcacacguccuggaccgugcuaaugcacauaaaugcaggcuucccucuauaguugcagcugccacacuuaaugggagcagugacccuccccuuucuuacagccuuccucucuaaagccauccugcccauuccugugacuuuuacacccacaugcacccaccccuacagauaucccugcauugcaggauugcuggcccccuagucaccugucucucuucugacaaacacuggcacucacgcauacacagugaacuauauuuucaauuccauccuaaauuguauuauucccuaguagaugaaauucucagaaaaugacucccccccaacacaaaauccucccagcuggcuuuacucuucccauaacuccauagcguaccuaccuaaguagucagucaccucuugccccacccccacccuucuacuacacugucuuauucuccacucucugguuuucuugugaagccagucuuguaaucauuuugcaaacauuaaacauguguuccagguccacaccagucacuggaaugcuaccucaggccuuagaagacagugaaacuaauuugaaagggucccugucagucuguuaccugccuccugaaggaaaaauagaccuccuuguucuguaguucugaacugggagcaagaacccuuacaccugcauccaagcucuguuggaagcucugaaucagagccaugggucagggaccuagcaagccuguucggcccagagcagcaggaggguaucagucagguacaggcaggaguuauggaaggaggcaugcuucugucaguuucaggccauccaugagccaccaggaaaggauugccagccagaggaggacaacagccgaagucccaaugcacagaucaacugccaaucaaagcaagaggagccggucaccauuugccagcacacgucgucgcugggaugacagcgagagcucgggagccagccuggcuguugagagugaggauuauuccagguauccuccaagagaguacagggccucggggagccgaagaggauuggcuuauggacacauugacacuguaguggcucgugauagugaggaggagggggcugggccuguugaccgacugccagugagagggaaagcuggcaaguuuaaggaugaucccgagaagggggcaaggucuucccgcuuuacuaguguuaaccaugaugcgaaggaagaguguggcaagguagaaucacccccugcagcgaggugcucggcucgcagagcugagcucucgaagcagaauggcuccucggccucucagauuucuucugcugaaggcagggcagcugcaaaagguaacaacagcuuggagagggagaggcagaauuuaccagcucguccuagcagggcuccugugaguauuuguggugguggggaaaacaccccaaagagugccgaggaaccgguggugagacccaaaguccggaauguggcgacuccaaacugcaugaaacccaaaguguuuuuugauacugaugaugaugaugauguaccacacaguacuuccagguggcgggaugcugccgaugcugaggaggcucaugccgagggccuagccagaagaggccgaggugaggcugccagcagcucagagccaagguaugcugaagaccaggaugccaggagugaacaagcgaaggcagacaaagugccaagacggcggcgaaccauggcagacccugacuucugggcauacaccgacgauuacuaccgauacuacgaggaagauucugacagcgacaaagaguggauggcugcccugcgcaggaaguaccgaagccgagagcaaccccaguccuccagcggagaaagcugggagcuucugccaggaaaggaagaacuggaacgucagcaagccggagcugggagccucgccagugcuggcagcaauggcagugguuauccugaagaaguacaagacccaucucuucaggaggaagaacaggccucucuggaagaaggagaaaucccuuggcuucgcuacaaugagaaugaaagcagcagcgagggugauaaugagucuacccaugagcucauacagccugggauguucaugcuggauggaaacaacaaccuggaagaugacuccagcgugagcgaagaccucgaaguggacuggagccuguuugauggguuugccgauggcuugggaguggccgaagccaucuccuacguggauccucaguuccucaccuacauggcucuggaagagcgucuggcccaggcaauggagacggcccuggcacacuuggagucucucgccguugaugucgaaguggccaacccaccagcaagcaaggagagcauugaugcccuuccugagauccuggucaccgaagaucauggugcagugggccaggaaaugugcuguccuaucugcugcagcgaauaugugaagggggagguggcaacugagcuaccaugccaccacuauuuccacaagcccugcguguccaucuggcuucagaagucuggcaccugcccagugugccgcugcauguucccucccccgcucuaaaagccaaggcucgucguaacagucagccugguuacauucccuguccgaaacccacaauacuacaggagcccuuguucuaaacuuacaaugaaaccagucagucaauuagacuaaaguuguugauuccuugugauuauuuccaugugaaaaugguuguguacaaugacauuuaaaaaaaaucauccucucguuuagaagguagaaagggggaaaggaaacuuucuaaaugcugcuugagauugcaguaagaacauacauuuucuaaccugaaaguugaaacaaaucccacuuguucuguagacugugucucucuuaccuguugcugucaggguuaccuaucugcuaaacuaugucggaaagacaaaauuacuuuuguugcaugucauggguuaauguuccuguauuugcagugguguaaaagcuuauuaaaguucuucuuuugcuuugacacagaacaauggcaucauuuggauuuuugucugaaaucgugauaccagguaacuccaaauugaucccuugcauuugcaacaaaaguauuguguuucaguguucucaccuguagaaaacuaguuuucacuagaaaugcucaucagaacaccaaaaaaaaaccaucuuuaauaggaauaagguguauaauugcuuguuguacagaaaugguugacuaaagagagagaaacaaagcgugggaaauuuaaaaaaaaaacccacagagaaacaaugguaaaaaaugaauccaaaguguacgggugagcaaguacaaaucaccuuugagaaaacagaaacugucagaaugggugaaaaauaaaaauaaauaaauaaauaaaaaaggucu

SEQ ID NO: 9640 - RNA, 25279 nt, Mus musculus
uauguucaggggcgcuuggauguggcccgggaaagacgccgccgcgcugacuaucugcugcugcugcugcugcugggcucccaggcagagcgacaaaccuugcgccgauucggagcgggcgcagcgauggcgacugucccuggcgucccugcucuucuucaccgugcugcucgcugaccaucuguggcugugcgcgggggcccggccccgggccagggagcugagcagcgccaugcggccgcccuggggggccggccgcgagcggcagccgguaccuccucgcgcggugcugccgccgccgccgccgucgccuggcgagcccagcgcguccucgggcaccugcggcccgcgauacagcaaccugaccaaagccgccccugcagccggcuccgggccggucugcaacggcgucccagagcccaccgggcuggacgcagcuugcaccaaauuggaaucuuugcagagacuuuucgaaccgaccaccccggcucccccucugcggcccccugacuccccuucccgugccccggaguuccccuccgccaaaaaaaacuugcucaaaggccacuuucggaacuucacucucuccuuuugcgacaccuacacagucugggacuugcugcuuggcauggaccgccccgacagccuggacugcaguuuggacacccugcugggggaucuacuggccguaguggccagcccgggcucugggaccugggaggcauguagcaauugcauagaggcauaccagcgacuggaucgacaugcucaggaaaaauaugaugaguucgaccucgugcugcauaaauacuuacaggcagaagaguacucuauccgguccugcacgaaaggcugcaagguagggauuggugaccuacgccacaauagcugccuggccagagguaguuucugugucagugggaccagaaaaaaauaaaggucucccucuccaccccccaccccccccuacggcucccaccauucccaguguaguacugugucacccuguaccccucccuagagagggagcuacagagauagauucaggucaacuucugugaguuuaagguucgaacauuuuaaggcuggagccuccugguacacugcuuccuguaugagggggaaguggggcccuuggcuggcaaagugguagcaggagagucuguguuccccagucuccuguuuggcucugaaccccacuccuggacuagaauuagcccugggacuggcuguggaaagauuaggggguguucaaaagacagggggaagaauauuugacugccuaauccucauccuuuaguuccugccaauugaugaaaggccaggccacgccuggugacaggguacacugaccacacuguugaccuuauaugaccugagauugcuggccagauccuaaguaggggaguccagggaugccugucuucucauaaggagggaaccuguaggcuucagucuucugaggaaagaaggcugggaaagcagggcuuaucagcucuuggaagggccauggaagguuggugcauuacaaaacucgcagugcuccagggugaugauaggaaaaccuggcuuucuggcugcuagggaugggcgucuagacgaaauuagagaguagguaacuguaaaagggaccuuccuaggaaagaauugaguguugagaaauuucuugacccucaguaggguugcucuguauaauaauagguagguggggcuauacacauuuuagggccugaaucuacuucccuguuuuuccugccuggccagguggccugcuuugggggcaaagaaaaaacagcaaggucaaaaggucaagugacaaugagaccagguagaugucacacuuucuggagcucggggcuguaggcuagagugagacaguuaccuccugguguagaacaucucccuucaaggccuugagaaaggguggcaagugccucuuuccagcaagcauugcuccuguggacuugugcaagguucugcuguugucuauggccccguugggaauuugugguggaggaguggggaggaaagggguagcucguccacccugacuucacuuucuccuucucccuuuuccuauucucguaaccuagcagucuccucccgccucacucagccucagcugacucacugcuucacucacacuaccaaaugagauauuccacuucuuaaagguguacagacagagagacaaacacauccagccaugcaccguuagcaagacucuggacgaaguccuacagaggaacggagagguugucacuuucauaaacagugcuguggaagcaggcgccaugucacaugcaucucccuguggugucagagacaugcaaucacaugaagaaagacacauuuugccauacagagguagagguacauacucuaauugccugucaaggaugcacguccucagugagagcagagggcuccuagcagacagaauaaaggcuaucuauauuuugugguuccccucuccaagcccauggccacaacuguucuuuugucagucuccagaaugaaugaaaaccauggcacaacuuuucuauggggguuuucuccacguuauagucagauccaggcuccuucugaccccacacuaaaucucucacauugauugcugauagagagcaguuugaugucugggaaggcagagguucucucggcuucuggaggucuuaucucaucuguugagggcuuguuagcaguuugcucucaggcauguuuucuuugccuccucuaagcuuucauuuccucauuuguaaaacaggaaaaauauccuuucccugcccaaguucugaguguuuugugagcuggaaguggggaugcaugauggguagcauuuugugguaggaauuuuacaccuggcauaaauuacuauuuagggguuucagucguucguguguauguuaugagagcacaacuaucuagauugccuccauuuuacagauacgggaacugagauacaucggggaauaccauuuggccucagcaaaugagcaggaauucugguacuagagcucagucuccucaugcuaacccuuugcuuuugcuguggccuccucucaaguuccccagguccuuucuccucucucuuucucugcgucucucuccagcagcaagugggcucuccugcucuuauugucuaaugccugcagacaagcugugccagcuucucggucuccuccugugguuucuaccucuuccagagcuuucuccuucaacugagguccaaagcccaauuuucccuaagucuuuaauccaguuuucugaugccaugaaagagacaggcaauccugagccccuucuucaugacacccugucuccucauucacuuaccucaccuugucacagcccuucuuuacccacacuaagccuaaggcccucccccugagcucagagcucccccgucuugccccuaccccaaguaggauccuguggagauaauaucccacacccagaauccucauaagugagacccugaaguccuaugcuaagaugaggagguuuucucugucuguaaaucaacucuggagcuggguucuagagucaggugacccccaaucccagggucuuuguucugagugccucaaucagauccuucugguguggcccuaggaacccuguucucugccucugugaugucugccccuguuuugggccacacagagccccaggaaucauaccuguccucacugcugccugugacaccucccaauuuaguaccagcugcaacauuuucuuaaugugcgacugacuuccucucgcauagcagagagauguagcuaacuugggccaaugcccauccccauacuggccucuccuaggucuaagggccacaccccauccuucccuuaauucccuaugauuaccccucaacacacacacacacacacacacacacacacacacacacacacacacacacacaaucuuucccuuagcugugcucagaguuaccagacaaauaauuccccucccagaugucauccgccuaaucuugccgugucccugcccacugcuggcugcuucucccaccucugccucuuucuucucucaauucagaacacucggggugaggagaaugagggcacgggagcaaacuccggcuucuuuucucaccgcuauuccucuaagaccaagaggcccaagaggagggacguugucagcucuugcaguagccauuagcuacacuaaucagcuaguucaaagaaggaugggauagugcugauccacucccgacugucuggcacccaccugguagccuguggguuugaugcagggacgaaucaacugaugagguggagaaggaggcuggaaccuaaauucccuggagagaguuaaaggaguuggacuuggagaagaggagacucaggaaaauauggccucagauuucacaccucaaaaagguuguccuuguauaaaauauguaugucuugauuggcuccaagggacuucauaggaagucuuacauucuaaccuaaauuuuucacuucauuaccagugugaccuugaacuguaugaacuccaagccuccgagccucacuuuuuaaaucugugaaauggggcucggcaaucagaagaaaaaaaaaaaaagcccuaugaauucaguauuaaugagaagucuguacagcaucaaggcuuagcaaaaucagagguccucccuccaucuuuucuuugcaaagaaggaacagacugccucagagcuucuguccccuggaaguaucuggccuaacacaaguggacugcugggugaaaaugccacgcagaugagucuaggacuguauuggcauggaagaaggaacugaagcaggugaccucaggggucugcuugaguucuucagcagcagcauuggcuagggaaggagguuuggccucaaugcccucacgcagugagagggugggggcugccagagacaguagcucacuuucugcccauaccuacuggggcccugcucuuccuccacuccggcuggcagcuguuucugccucacugccuucucuccucccaccugucacagcuuuccugccacacaggacucucaggcuauaacacuggagaugacggguacuaagagccaggggcuugaagagucccuuguugaacauuaguucuuguugucacucagauguucucucugguccagaagucuuaaaagcuagaaagggugcucuggucccuguuuggaggcagaggcagaggaaagcuggcaguaagcagccuccuaggaaucauagcaaaacuggcccugggggggggggggguggagcggggccuccagguccauagcaguucaucuccucaccacuaaggacuguaugcauguuguucuagggaaggucggugccccagaauccaagaguaggcacagagaagaggcaaugcuuauagcuccgacaaggacauaugaauuaaagcugggagggaccaagcagucaguugcugaaauauaccucuccagagccuuacccacucccacuccaccagcucccauguuccuccuacauuguagcucaugcccacauucccauccauauuucgaugagcaccaauuagacaguguuuuaucacccuagacccuucccaaagcacaucccucacucucuaacccucauuuauguauuuacacaccucuguuccuccuagcauuuccuucugaucuuccuggccugacuacuuccugucccacuuugcuccucuccuacaguugaauguucccaugccacucucccaucugccuccaacuucccaaccuuccugaccuuuauugcagaucucaccccuucucugccaugccugccucaccuccuugguaccauacuccuugcccuuaacaccuccaugcccccucacaguauacucacuucaugccuugguuuucuuucauguuuugaucuucucuucuuuugccccuuucccccucuccccuccucucuuucuaugaccuuucuuccuccuuuucuacauuuuuccccaguccacucaggguagauauaugcaugagugcauucacacacacucauauacauagauacacagacauacaucucccagucuucagggcuacuucucauccuucccacaagaagguggccugacuacuauagucaccauagcaacaggaaccuccaggaaggauguauugguaucucuugaagauaggguugagggaaugaagagagaggaaaggagcccagcaaucucccacccaauauucuggcuggaagugucugcugaacauaguagaggugguggugaggaaagauaagaaguggguggggccaagaucaaaagagagccaaggauccauggguacaucaaaaggcuggagguacucccaagcuaugugaauaugugcuggugccuucugcagacaauaguaccucagggaaagaguacacacaucuacucuucucgguguaguuggggauguaggcaacaccuaagacucgggggucagggguugucuuuguaaaacuuuucucaaggcaguucuuuugugaucccuguuucaauacuauuuaccuguggugugugucugcagauuagagcuagccugacccucugcuccucucagucaugugacauuccagaugcagguauuuguugaguacuaggagccaccucuccuucuggggacuauauacaaucugggggcccacaaacacaguucuccaacaauggucagguaggacucuggaaaauggcuaugucuuaauuccugugguuacagguguacaggucagaaucuaugugaggaaugacaaaccagucuuguccauggacauaagagagagagcucagagaagccugaauuuaugagacccugaaucagguaguguuuuagagggaagagcaaggguaccaagugggcuaggcuuaggggagggugagaaugaguuacuacaaaggagaagguugacacagccaaagcucuugaucaaauggauucuggaaaugggaucuggaaucuaagccacaaguuucugggccaaaagacgaguccagcuggcucuaaagaagaaagggauaagaaaaggaaggcaaaaaauaaaauaaaguacaagcuuuugaguaucuaggaggugugucuguguuggaggguauauacauccaugaacuuaaucuugucaaugaucauagcaggaaaguaccauuauuauccccacuuuacaaauguaacaguugagguucagcaagaggaaaugacuucccuaaguuacauagggcagggagcugggaugcagacaugccuuuguuuuuucuccagugcacagauguauagaagauguuaauauucucugccagaugcuggaggcaaugcccugguggcuaugaauacacuggugagaaguuaggcuggcuagaggagaggcucaguagagccuauuggaaacuuagggaaaccucuggaguagcucagauucaaggaggacucaccggcauccucuuuguucaagauacauguuucuuguccuugagauccagugauagauuuuccccucccuuggcagucauuaacugcuuauaguucuucaugauagguuauccaaucccaagugcucagcuuuaaacacauaaacauaucaacaacauuaaaugaacuuagcagauuucuuuauguguauguaugcaugugugugacaaugauaaucaaagaagucaugaauuugagcaggaauaaagggugacaugggagggguuauagagggaaaguggggaguagaagugauguaaauauagaaauucucaaaauauuaaauuaaaauuugauuuuuaaaaagaugcaguaacaaucacugagguauccauccucuugggacagagacaggaagauggaaauaagaggauugcuccuuccuuuucugcaggcuuagaagagaagaguugagucccacuugucuugagaaaggguauuucuguuaucuucucaacucccauauaugaagguaucagccaggguaggaaaggagaaggugcccuauacaggccuaaugccugccugagcuccaacccacccacagcucacacugguagcugguagaaccaaaaggaaaaacaaaugcagugagacauuguuguguaaaagucagauaaggccuggccuggaauugggauguccaguucccaugccaagauuuuguugaguccccagucuuagaugccuggucuucuccuuagaaacagaaaggaagaggcagccuauaauguucugucugagagaagggcaugucagaggugugaauguuacccauguuuuccugucuuacuugguuugaaucagacagcaugucuacccagcuuauuugugaaagaugaaguauaucuguucagucaguguucaaauuaauucuucaaaaaugcuauaggcucaaaaucuuuuuaaaaauauuuuccuugauuguuaaaaaauguggccuuugagaacuuuuggaaacuagaaauguguuagagaaaaggggacuagaggcauuuggguucuuuucauugucaugaaguauacagaacuuacguuuuaauuguauaauucagaggcauuggguacuguacuggcugguuuugugugucaacuugaaacagcuggaguuaucgcagaaaaaggagcuucaguugaggaaaugccuccaugagauccaacuguaaggcauuuucucaauuagugaucaagggggaaaggccccuugugggugggaccaucucugggcugguagucuuggguucuauaagagaucaagcugagcaagccagaggaagcaagccaguaaagaacaucccuccauggccucugcaucagcuccugcuuccugaccugcuugacugccaguccugacuuccuuuggugaugaaugguaguguggaaguauaagcugaauaaacccuuuccuccccaacuugcuucuuggucaugauguuugugcaggaauagcaaccaugacuaagacaggcacauuuuuauuucauuacuauuucuaaaauauuuucauccucccaaacagaaauuucuaccugcuaaacaauaauuccccauuuccucuucacucuuuccccuggcaaccagaaaucuacuuuauaucucuuuuaacgugauuguucuagguaacacaagcaaguggaguuagacaauauuugucauuuugugugacuuauuauauuuuguaugcuguauauaugcuuuacauauuacauauaaauuauauauacauaaacauauaugaugcuuuuaaguuucauucauguuuuaacauuuuucaguauuucauuucuucuuauggaugaauaauaguccguuaugugcauaugccacauuuuguuuauccauuaauuucuuaguagauauuugaacuauucuaccuuuuggcuauugugaagaauguugcuauuaacccuguucuaccaauauuuguuugaguacuuguuuucacuucuucugaauaugauuaggaaaggaauuacuugguuauaugauaauuccaugcugaaauauuaugaacuuguuugucuuagacagggucuugcuauguagccuagacuaucauugaacucaagcuccaccuagcucagccucaagugcugauauuacaggcgugcaccauuguggccagcuuaugcuuaacuuucugaguaauugccucucaauucucuauaacagcuguggcauuuuacauuccauucuuaaauuuugcacucugaacuauuuuccauacauaccagcagugaacugagcaaggauccaaaucuccacaucuuugcuaacacuuguuauuuucuggguucuuuugaugauaauacccguguugaugcaaccacaugguuuccuaaugauuuauuauaggucuuuuuaaauugcuuguacucugaguaccuuuccauguacuuaaaaauucauaagcuccauccuuuaugacauucugucacaaguuacauaauugauuuaacgggccauguacuguuagauauuuagaugacugucaacuuuuuacuauuagaaauaaucccauggugacuaucuuuguucaucaauuuauaucagaucuaugauuuuuuuuuacucuuaaaagaguaucucagucauucuuccuuauuccuguacuuugcugagguuuuuggaucacaaaugauacguacuuauuuuccaaucuaauaguauaaagacuuacaaagacaauguuaauaauccugcucagucuuuccuaguuccacugcccuaagguccuggauguuaacaauuuuguguguauucucuucccuguaagcuuacauaaacgucuacacaaaaugacucuuucuuuguuuugcauacaaauggaagcauaaacauccauucuguagaaugaaguuuggaacuagacuuacagaaucacaguauuaaccuuuuuaaugcuacuggcguacauuacuaaaucucuuucaaauuacuagauuauucuaguuuauacccacaacaaaaauguaaggcuaauuuacuugaaaaauggucuagccuuagcuucucauugacauuccuuuggucaguaauuuguuuuuguucuuuauaagccacuugcagggcucguuuguaaauuguuaguuccuguuuucuguuuuuauuaaugcuuuguuuguuccccuuucauggauuagugauguuagccuuuucugaucacacguguggcagacuugcagagcuugcuguuugaaucuuagagcugaaaggagagaaugagaaggaaagguaugauucuaguugugucguacacuuuaccuuacuuaauucuuacaccugccuugugauguguauccauaauuguccccguauuccaguggacaagacagucucagaggagucaaauggagucaucagcacauagaguugaagcuggaaauuauguuuuggcagacagcacugcuacucaaucggugcuagugcgcauaaagagaaagcuuucuccuuuuguuuuagaggcaucauuuacagagaggugaggguaguuucuuuuuuuaaagggacauagcuugucuaucaggaaaggguugucggggaggucaacaaucuugccugugcuuuuauuaccagcacgggcacaccuuggaguuugacugcaggucgguuugaguuuaagauguuugaccccaucuuccuaccauccaugcuacuuacuuaaacagccaucuucucagcucagggaagaaauaagcacuuggcucagagucagguggcaaaauaguggccacaacuccuuuguagugauauguccaaguuuacacagcuccuuauuggcagaggcagcuuugacuaccuauccaucuguuguagcagaggcuacuugauaaagagcauuugugaggaaugcuguguggaaggggcaguuaugugggguauauagcaugccacuuuuuccuggucucuggcauuggagucuuccaguauauggcuucuucagaaucccagaaacucccaaaagaugggacuugggacaugaaaacuuaugccuuagggccauuaaaacguuucuauuagaauuagcuucuagcccugcucuaauugugcauugugugggguggggaguagagagggaaagggaaucuuugggaauuuauuuugcuuuuuguucauuuguuuauuggucugcaauucuggggcauaaacuuugggucuugcauugaccaggcaagugcuauaccauugaacuacaucuccaaucugaacagaaugcuuugauaagggaauggaaaugaucauuuguagugucuaguaugcaaauguucuuucccuugcccccacuuacaaggcaaacucuacuucccugugaagugagaugaauagauugauuuuggaaaaaucauucuucucuauacaagccuagaaaucucuccucaaacuggccugaaauuacagcaaaaggaaauuugguugaguaacaugguuugauagugguggcaaacugaagggacuguccccagggugauaugauugguauauaaaaacuugggcauuaaagcucaagcuuuguauauuauauauuauauauauauauuauauauguuuauauauuacauacagguaauacugacuucagauucuacuuugaaaucuaucugcucuguagaauaguuguugugacauucauugcauuacauuuuuuuuacauuuuaagaugauauguauuugugucugugggggguuauacaugcaacaguacacagggccaacaucugggacucaguucucuucuucuaccaaguggauggaucaugaagauugaacucaucucaugaggcuugaaggcaagcauccucacugcugagccaucuuguagcauucaauauauucuuuaaucucacuuggaaccccacuuuuuucaccuucaaaacuaagaaauagggucauuaugaggcuugaaggauauaaugcauccugauuucuuauaauguccuugugguagaagaugcucaagaaaugcuaacugccauuaugauuaucgugggcuauaagccucggauaaguuguuuaaacucuuugguccucucuguccuuaucuguaaagauuuguaucucccucagggggugauuauggggaaucaaugaguuaauaaaugucaggauuaaaugcuuagaauagagccuggcauauaguaagcacuuaauaaaugguagcuauuuucucaucuuaauuagauguguuuaguccaaaugauugcuuaauacccaauugaaauucucaacacugagguacguugcugaggaggaagagaagguaauguuuugaagagggguaaagugucuagggugagggugggaauuggaagcuaaaagcaacuggagauauuuuaguaagugcauaaagaccuguuuagguggcugagguaggaggucgugaaugagacaaggacucaaaaaaguccuugauuuacauuauagccaaggaauagcaguagucaccuuuuaucaggucucuguucaucccagccugucaucuaccuagaggaggaaggagaggcagcagaagggaguugguuuugguuuucagugaucuaagugaugacugacuguggcuuucuguaaaaaaaaaaaacaaaaaacaaaaacaaaaaagcaacaaccacaacaaaacccaguugugccauggagaguguguauaacuccgaagaagccauaguugcugugucuuuccuguggugaccagcacaaccacugugcagaaaagaucuagaagcuuccuuccucccauccuagcuucucucuuugucuauaagguugacuccuuguuugcucuuuugguuguuguuuuuuuuuuuuuuuucaugccccgugaaacacuuuauuuauuuuuuaauuuuuuaaauuuuaauuagguauuuucuucauuuacauuuccaaugcuaccccaaaagucccccauacccucccccccacuccccuacccacccacucccacuucuuggcccuggcguuccccuguacugaggcagauaaagucugcaagaccgaugggccucuuuugguuuguuaagugcaccuggauggcgccucuagcccagacacuggugauggauuagcugaccuagggccucuggggcaaggccauauggacugaaucuagcaauguuagucauaucaagucuuagauguuuuguuuuguuuuuuauuagguuccugacugcagaugaguuucuauuuauuuuucauuuuaucaaaguaaugcauauucauaauuuucaguuaaguucauauuauacauaugcacaugcauauaugucuucuuuccucauuaauucugauuugccaccacauuauuaaauguuaugacaauauuaauaauacuugauuuuucuagguucauguacacauauaaaaggagaagaguccaccaugcacauauauauaaauauaaaugcuugucauuaaaacaguagcucuauaucucacccuugagcucacucuugagugcuaaguacauuggauuugucugacuguuuugggguuuuuuguuuguuuuuguuuuuugcuaauauuuacuuucacauuucuaaauggcacaucacuaugcuauugccuguuuuuuuuuuccucuuuuaaauauuuauugacuuuuuaaaaaaaucuaguuagaggaagauuuagcuuucuuacuauugguagcaccauaagugcacacacauguccccucucuucaucuauccaauauuggcauauccaaauuucugauccuaaacguuuaacuuauuuauauuguuaauuuuauaacuauuguuuacaucuagcaauauuagauugugugauuaacauuuuaguccuuggucaacuugcuuucugggaguuaaaaauggccucucauuuccccuuugcuuggcuuucuuugaaauuuugcgaacaucccaccaaauucuucauucacuguagaaguccaugaagauauauuuauaagucauuauuuucauuucuuuucuugggaaagugcuucacauuguucaauuugggcuagcuacugagaaccagguuuucuuuucuuuuuuuuauuuauuuauuuuuauuggauauuuccuuuauuuacauuucaaauguuauccccuuuccugguucccccucugaaaaacacccucccucgauccccuccccucucccccugcucaccaacccacccacuccuccuuucugucccuggcacccccacacauacuggggcauagagccuucauaggacaaagggccucucauuccauugaugucccacaaggccauccucugcugcauaugcagcuggagccaugagucccaucaugugugcucuuuuguugguggguuagucccuaggagcucuggggguacuggcuaguucauauuguuguuccuccuauggggcuucaaaccccuucagcuccuugcguccuuucucuagcuucuucauuggggauucuaugcucaguccaauggauggaugugagcauccaucucuguauuugugaggcacuggcagagccucucaggagagagcuauaucaggcuccugucagcaagcacuuguuggcauccacaacagugccuggguuuggagauucuaaaagggauggauccccaggugagucagucucuagaugguaauuuauucagucucuacuccacacuuugucucuguaacuccuuccauggguguuuuguuucccccuucuaagauggauagaaguauccacgcuauggucuuccuucuucuugaauuuuaugugguuugugaauuguaucuuggguauuucacgcuucugggcauuagcccagaagcugagaaccugguuuucaaguacuuggcaaacaccuuuuugugcauaccucuucuagucuguaucaagagacccugugagcccugaaaagauugcacaucuaaguaagauaugaugaucucuguccucaaagagccuaaagucauagggauagucaauuugugcagaggucuuuggaaagcuugaacucaaucccgggacuuugaaucaggccaccucuuugguccuacacuugaggcaagcuucccccuuaucucaggcuacauuaacagaaacaguuucuaggacaggagggaugaaguucuacuuaauuuugugucaauaaacucauauuuggggacucuguuguguaaaauaaaacagaggcuuuugugacugugaacaacagagaacuauaaauuacauccauugaaauagguggaaaaccuagggauguuugauuucguggaagcucuguguacacauacuuagcucuaccuuucuuggcuugcauucccuuuucaaauuacuagucuuguuucuuucccugcugcuccacugaaacuguucucacagugaggagacugugucuuaauuauccaagccaauguguucucaacuacguaaauccuuaucagcugacugcacccccucccaaucuuugacauuuucuccucucuuaguuuacagacugccauucucuuccuuuuucuccucuaauugcucuagagguuugucgcaaggccuggugcaugcuaggcaaauguucuaccucugagcuauaccccuagcucuucucccauuucuuaaaccacucauccauccaucuucaucucauuucuuuccuccaccugacuuaaauucaguuaguauugucucaggaaucuauuguugagcccuuugucucauccccuggcuucuauauugcuuuaucaccuggagugagcuagauugcacugucauaacaaguaaccacaaaacaucagagguuuaacacaacagaugauuauuucuugccaugauucauauccaagacagguccucagggauaagacaucucuucagaaugaucacuguauagggaagagggaucaucuaucucaacuuugcuuccacaguuagaagcagaagaaagacuaugauaaaacauaugucggcccuuaaaguuucuccucagaaguaaacuguaucacuucaagucauguugaugaccaugccuaacuuuaaagaggaaaagaugguccuacuccuaaugacuagacccuuaagucuccaugacuuggagaccuuuaucuuuuuauuauguuuuuaguugauguuuuuuugagacagaaucuuaugaagcccagauuuuucuuaaauuugucacauagacaagcuugaacuugcagcaauuccuccuuguucugccuccuaacugagugcuaggaucauuggcauguucuaccauaucagguucagauccuccuuuagagcugaggccauuaguccaucugcauccuugacauuuccaucuagcagauccacauauaccucaaagucaacaugaccccaguugaauuugucuucauccucagaaacacucuucuccauauuucuuaccuuaauaaaugacacuagcuagggcuagugguguaugacuuggauccuagaaguuaggaaguauagggaagaggaucaaaggacuucaaggccaaucuuggcuacauagugaguuugagggcagccuagucuacaugaggguagccuggucuucaugagacccugucucaaaacaacaacaacacauuaaaaauaauaugaaauugguauucaucuuaaaacccaagcugccagucuagaaccuauccuagaccccucuguucugacuguuuuucaccucuuuacguaauccuguuggcuuuaccucauuaacaucucuucucacauccacuccuuccucucauuuugccccccucagucaagucucucucucucucucucucucucucucucucucucucucucucucucucucucucccucucccccucucucccucucucccucucucccucucucccucucccucuccccccccucacacacacacacaggaaacuuacuauuguaucuuaacagucauucauuuaguguguauuagucaaguggguacuauugcuaagcuuaguauuaagagaguuuccuacucucauaaaauagauuuauccauuauuaccuucagauuauuucaauacucauauucuuuuucuccucucaaauuauaaauucugucacuacugccuuaguugaggccuucauacuaucuuauucagauuguugcaauaauauagcucaucucccugccuccagucuuaguaccaacgcuccauccuccacacuugcagacaaaagcuugaaaaaacuagucacaaaagugauaagcaaucucuccccaaacccccuaagacagagucacacuaaauuaccagacuggcucagauuuguaauacucuugccucaacuuaccaagcagcagguauuagagaccugccccagcaggcuagccauagacaucucuaaauaagcaguucugucgagcucauuaaaaacucucuuuugugguggagaugguacuucuagccccgcagagucuugaaguaccagggugggagggauaccuagggggcccuccgcccucucagaggagagggugagggggggacggaggaaggauugugagagugacugggaguggggcagugagugggauguaaagugaauaaauaaagaauaauaauaagcaaauuuuaaaaagaagaguucuccauugccuaugagaagaauccuaguuucucuccauaucuaaagcaucaugauauggucauguacuuccugcacagcacauguuccuucauaaccuccuguucacacccucuaauuacacugaacuaccuacauugucuaaguccaucauuauuuccuacuuccagguuauuaugccugcugauuccguugccugaagaguacuuuauucucucucuauuucacccaccgagcuucuacccaccccccccuuuuucaagcccuaacuuaaaauuuccccacauggaaauauuuucuguccuucagccuugaaaacacagucaauauuucuucccuuuaucccaccauggugccaaguacaugugacuucacccugaaguucauacuaauugauucacaugguuguuucccuuguucaagacaugaucuugaacauccucuguaucuguagcuccuaacauagugucaagcacucugguauuuagaguguguucuuugcauuuacaaaaaugaaugaggagacuagauucagagaggucuacaaauucauaacaguuggcccgaggaacacgauugugaauguaauauaugguccagaagagcuaguaagauacaugaguaaagucacagaacggcauuuauuucagcuccaaagaggaaagaacuuccuuaaucacuagaguugucugaagcugugggcugcccuaugagaggaugagcuuucuauaacaguguuuacaauuagaagcuggauggugcuuugcugggcuguuggggcagauaacaugguggagugaugagucucacaguccuuuccauucuggauuaguuaugaauuuaccuccucugcucaucuaauuuggcaucuaucaucuaggcuccuuuagaacugucccuggauuaugaauacuacuucucuauuagucuacccuuggccagacugggcauaucuagccuuugaacagauggucuaggaggcuuguacauaugaggacccuccagaauggacuagcuucaggucugcacccaugucuccagucaucuccuguaccuuuccuucaggccauaacaggccacuuugacucauaacuucucauacuaagaaguaagacagcuguugcuuauagacccuuaaguagagcccugccauuugcccuguaaugccucuaaucugauucugacuuuaccaaugccaggagacuauugcuaucugcagaauuacauucauguucugaugcagaccuuauucuguucugacccaacuguuggagaccaggguagaaaaagagcacuuucuccugcccaguagaguaccucacauaauucgaggauugcuacuagauacugggcaagaaggcaucaaguuaguugcuaagguuccucucacaucuccaacucugucaauguacucccuuucuauggaccucaguuucccuaugaguaaaaacugggguuagguugguaacuuguauacuguggcuuuuguaacuuuggucugaagcucacccccaccccuuugcuuccacaagcauugcagcugcagcuccuggccaggggucccauggguaccuuaagaagauaagcagccaugaagaaagggucuguagggaagauuuggauggggaaacagacccuugggagagaagugaguuagaaaucagaaaggaaacuguuugcuuccugguuggaaaauaacugaagcuuucccucuggaggguuuuccagccccaaaccuaggagcugccauuagcccucucucuaacccuucuggccccacguccugacuuuagggugugacuguacauuuacacggcccucugugaagucacacauuucuuucuggaggaauguaggacuaaaauguccuggccagggcuauaagccaauaagcuaaggaugaggcuggcugggucauucuaguccucccuaaacugacaauugcagagcccaggaggggaagguauccccuuugucucaucccuccuauuugagggguguucuguugcucagcugggaggaggggugagacagccuuccuagcuuccuuuuuggguuaauugguguucccucuaguuauucccuguuucccuccccucccaguucccauagcaacugggcuguagcagccagaacuugauugagaccugugguggcccuacugagguggggaaaggagggcacugguaguucaagguuucccugccaccuccuagucaccaucccugcucccucagguaucuaggaugauuccacucagugaccagggaauaauggaaagggcuuuucugacaaggcuucaguucaaagauucugaaacugucaaauaugcuguguucuucucagugcucuucucuuauccaggccccuggugucuggccccuaguuuuggguuuucugauaggguuuuucaauaggaagacacuuggagcuggaauuaugaaaccagguuuccagguccuuucuuugccaauauuuuaugagguuauacucaaguucuucucccccuuuuaggccucaguuucuccaucuauauaaugguaaaaauugacauucucaacccuggcugcaugcugaaaauugccugaggacauuuuccaauugcagaugugugggauucugccugcagagauccugacguuuuggucugagugccaugugaaccagacagguuuaauuuaaaaaaaaaaaaaaaaaaaaacucccuagugguucugguauacagccagaguuaaaaaucugagagcaaaagaucuucacaggucuccaacccucccuuuccugguucuaagauauuuccucccccuccuccaaugcucacuuccagcaaucccuccuggccccuucuuuuucuuuagaagagugcccaagccuccugccaccgcuaccaugcuggugagagaggacaagguaaacggggcuucagagucuaaggugggcuuauugccaggugguagcacuaugacccauacuaucucucgaaagaggccccaggccaccuuaaagcauaugggccagcaguggcucagcuggccagcuguggggcuuaggaauuagauuaccucugagcucacugugccucuucugcuucuauuccccucauuagcuucuugccuguuccugccucaccacccacaggccugguguccuccccaggcaaucugcucacccacuuguugccauggugacuccaacuggggguguggggacugaaggggggucggcuaauuaaggagaaaggccauacuccuacugucaggccaccccuucucccuccccccaccucucagaugaagggagugcccagacucuauacuuuguuacugggcuaauugcaaaugccuucgaggagagcaggccugucacuggggacuccuuuagaagcaggagcaugggacugaaagagcuaaggagacucucucaggucccugugagucccagcuccacugaugaccacagaguagggggcugauuacacaguuuggggagagagugacauggguucuugguccaugcugcaaaaaugggauuuguggcuauggacagagacacaucuuggcacuuaagggcccagaguauggaggguggcucuuaggugcuaggggcccuuggcucuggagauauuacuuucuugucugccucacuccugcuucuccuccccucugucuaaucuuuuugauccuccuuucauagugcuucuuucucguuuauucuugucccuguuuauccauccucauguugucuuguuuccaucuuuucuuacucccuuucuuaaucauccuauauaccccuauguuuuaucaccuccuuccuuacacagcuucucuuuuauuaccuauaccacugcagcuuccucuuacacccuacacaccucucuuaccacccuuuuuuaccccuccagcuuuccuucccugccucuucccuugccuguuuuuucuacucuucuuuggucccauuauccuuccuuaggauguaucccuagauacauuucaucuuaguuguuucaccuuuggcaauuuguauaaauaaaaaugaagaagugugccuuacccaugugugcaaagauauucaauggagcacuuuuaucagggucacaaugcagaaggcacucaaaugucaugaacaagaguuuagucuccuuuccaugccauccauacgaagcaauuuuuuucucuuagucuauguguucuugcucaucucuacauuuuugccuaaacuauugccucauuagugcauccuaucuauaaaaauccuucuuuaugcccaauguugcugggguuguuugcuuguuuguuuguuugagacaggagcucauguaucuuuggcuggccucaaacucacuauguagacaaagauaauuuugaacuuuugguccuucuaucuuuaccucccaaaugugaggauuacaagcauacccaguuuuacagugcuagggauugaauacaggauagaauuauaagugugugccccacaccuagcucauggcaugcuggguauugaaccuauagcuuuauggaugcuaugcaaggacucuacuacuugaaucacauucauaguacauaaacucaacugcuaucucaucauugaaaauuuuuucaguuuacuauuaacacuaaugaaccacaauucagcccuuccuauggaauaagugucauagguucaaguuaaguaugucuacucaugaaacuggaauuuucaugagagaaaggggccugucuucauauacguucagucauaugauuuuuaagauguauauuguacugagcacacagugguuaguagaaaagcccaugagcuuauauguaguucacaguuuaguggagugggcagaaacuaaagcaaggaugcagacaaaguagcaucuguggugaagaaacaguugcagauaauugggggcuguguccucugacgggaguagugaaagagacacgguagaagugauauuuaaucuuagcccugaaagauguaaagggcccauuuauaaccaaggugggguaaagaacauuccaggccaggugguuacaugugcaaaggcccggagguagagagaaguagggcacauucaagaaaaagaaagaaaaccucugcuuugugcagcaugaugagcuugaagagagauagaaaaugagguuggagaaagaugggcagaguugugcagggcuuugaaaucuguacuuaaacacuaggcuuuuagucaaaugcaucuaagagcuugaagcaagggagugauauaauuugcuaacagcuuggguccacgcuuauucucaugcaauagauuagagcaaaaguagaggugggaaacaucugucauccaggugagggauuaugcugcccuucaccaagggggcauuugacuaaugcuggggacauucuuuucaugucauaaugugggagaggagacauuguuauugguaucuaagguguggaggccagggaugcuacucgguauccuacaauguacagcacaaccccuacgacagaauuaucugucccuaagugacuuaaguuuucugagaaaccauagacucaaggagagacaagguauggagcaagggagcuuucucucuagacccagugcuggguugggagugggcuagacgaagaaaaaaaaaggauacuagcaaagugaagccacaaagaaugauuccacgagcaguacaguagcagugucagagauaucgguuccauaccagggcugagccaacaagacagagcuuggauuaagaagggcucaaagacacauguggugccuggaaaggcagauuccaguuuuuauuaaagauaagccucacauuuguauugcccuuuagaguucacaaaacauuuucauaugugccaugcuauuuaauccacaauaguccagugaguuagaacaugaauuauucucaucuccuucuugagguaguacaugaauuauucucaucgucuggaacuuagaagcucugcaccaucaacaaaggcaguguuuaucaacugagauuugccucauuacauaucgguaaccucggauacacgucuuugagccauguguaaaacgauagaguuggaugaagugauugguaaaguuccuuccauucugacacaggauuaauuuuguaauuuugaccaauaauucuaaaucucagaugaugguagauuagagaacucaagaguacuggcuuugagauggguagacaccucugacaacgccuccuccaaaugcuggggucaaguuggcuuggcuccauagagagacacaggaagcuuuguuacacaaggcacuggcuaacgcuguuuccuugccuccacaggcugucuacaaggccuggcuguguucagaauacuucagugugacccagcaggaaugccagaacugggugcccugcaagcaauacugccuggaggugcagacccggugccccuuuauccucccugacaaugaagaaaugguguauggaggccucccuggcuuuaucuguacagguaaagucagggcacuggggaagagggggagaugaaagagcuuaggggcauggagacaggaaggacaucaauggaagacaggucagaucaggaagucaguggcaaaggaguuggcacucagguccccagguugggugggauagggccaaauggaacaggacaaaaagaccagaguggccauaucuacucagaacaugaugagcuacuaguuacucuggagaaacuggugacaucccuggaaggaaggaacgagagcagaagaugugagggcugguggggagaguuucuugaguagugcuaccugagccucagcuuugugcaucccuuuuacagcuaagguagagccuucaacucccuagagcacccuccccccaacacaccuuccuuauccguuggcaggguugauggauacuucaccaaagcggccggaaaccaagugcugugaugugcagugggucuccugugagucggagaagaagaaguucaaggacucugagcccccuaaaacccaccaccagcaauuccaccacuccuauuuucaccacuaccaccaucaguaccaccacuaccauccccgccaugaacccccaagccgagucagcaacaagcccucccugcugccggucucugggggcucccgccucagucccagcaggauccggcucuguguccuuguucuuauacuccuccauaccguaguguccuucuccagcagccagaguggugggggacugggacuggagacacugccugcccuagaggaggggcugacacaggaagagugac

SEQ ID NO: 9641 - RNA, 425343 nt, Mus musculus
cacggcuggaggcccgaguggaacggcagggggcggggcagccaggccuggcgggcccgugguugggcgucccggccgccccuugaggcauggggcgggguaggugaggaccuccucccucauucccucucuggccgcgccgccccucucgcccgccccuccuccucccuuucccaccccucggaguggagcugcacaugcggcugcucccuguucugucccgcccagccaccgucgcucaggaacgggucccugcagcccccagccgauggcaggacaguagucgccugucaggggucgugaaggacugaggcagaggcagaggcucccgggccucagauagugguugucucuggaggccaugggcuacccagagguagagcgcagggaaccccugccugcggcagcgccaagggagcggggcagccagggcugcggcugucgcggggccccugcucgggcgggcgaagggaacagcugccggcucuuccuggguuucuuuggccucucgcuggcccuccaccugcugacgcugugcugcuaccuagaguugcgguccgaauugcggcgggaacggggaaccgagucccgccucgguggcccgggugcuccuggcaccucuggcacccuaagcagcccugggagccucgacccggugggucccaucacccgccaccuggggcagccguccuuucaacagcagccuuuggaaccgggagaagauccacuccccccugacucccaggaccggcaccaggugagucaccuaggaggggcggcggccuuggaggcccccuccccugcucgguugggcgggggccugggccucagggcucaggggacucugccacucagagccaaguuccagggcaggagcugggagugggccggagugcuggggagagguuguccaggucagguuguucucgguuccugccuuggcucauccagacccucuccggucccguggaguuggaaagcccagccugcacgcgccgcccccggggaggugugggcugcuuagcgaaaaguuggccugccuugcacccauccgggcgcggaggugccugcgccgcccccguggccgucuaacggcgagcagcuuggccccucgugcccccuggugaguuucucugcccguggugcuuguuucuucgugucccgagcugaugccagcacuagcaggcuccucuuuggaguuggagcuguaaacagcuguacuaacuguuccacgcccguugaaacaacuuuuaaccauacuuucagcgcuggauucuugugcgcugaccaggaccugagcuuuuuucacacuuaccugcaacuugagacggauucucuucugcguucuaguuaggaucagcgccccugaggaauucugguagaaauaugccgucuugcuagacaacuucugaacagcaauuuaaaaaaucuauggaaauaaaacucacccuuugcaugccgguucugacacucuuguagauggaguugggugcagugggugugaagaguuuucauuauugcugccuuuggaacaggaaguuggauuuuuguuuuguuuugauaaucuuuagaggguuuguaucucuuuuagcaaaccauuaucguaguuguuuuucuuacucguuauuccagcaaauuuaguguacuugauauuaagucuuccugugguuuccauagcugucucacacuugaaucuuaggcagaacauccaagaaucuuuuugaggugguuaaagauuaauggugaauuuguaacuucuggagaaaacgacacuuuguguaaguaagcuacuugaggugagacauggaagccuucuguacuuggugcuauacccauaguuauugucacaacucuuuaaacauuauuuguguugcuuugacuuuccaaguuguacacuuuagaggugucacauucauaauaauacucuagugucagaacacacacuuucucuucuuuuccuuucucucucugugucucucuuccuuccuuucuuucuuaacaaugugcuuuguaaaauugcuucagaccuaaaaugucuuucaaagacacucaaauuuauauaacugcguaucaaagaagagaaucaguagacgggcuucucauacuugaaauuuuaaacaccggggcuaaaugacaaugaauuaggacucugggucuuuuauuuacuaccccccuccaggauccuaguagagguacuuagcagcugcaccuugauauucucucucucucucucucucucucucucucucucucucuguauguacacacacacacacacacacacacacacacacacacucacucaaaagaaaucaggaaauuacucaaaugguggucaaggauuuuuggcaaucaggauggacagagcgcugguuagagauugugggacagcaguauacuagagcuucugugauggcaugggacucucacagcuuugcaauggccuuuaguugcuuacaucagauguagcaaaaauacuuauguguuucagcacagcuucuuaucugcuauccuuuagucuauuuuagucuauggggcagucaaagcaaugauaccaguucuuuacauucauuagcauuaauuggaauuuauguuuuccagauuuguaagguaccuccugaaucuauuuuauugauuccuuuggagaacauacaggccucaagggagaaguaaguggcccaagauauccuagcuugagucaaaacuaggaugaaggugcucugccauccuccaguuuaguacacaguccuccauaauauagugucuacugagaaacuuuguuuuugaggggggcgaugaagggacaacagguugaaacuccauaguaggcuuuuuacaaaaugagaggcucagaucugugucacuuuguucugcucuaacuaauuuugaccagacuaaguuuaaucacauauuccuuauucaucuugaauuucacuuucaggagaauuuuagcccacugaagacauuuuaucccagauucaacuaauuuguuuuggugauauuagccuuagcauauacacaaacaaacaaacaaauauauaaaugaaugaguaaauaaauaaaggaaaaguugauuggcuaauugauuuacauugcugugcuauaucuuggguaacauuucuagugcccugcugcacccucugcugguuuuucggugacauuuaaucguagguaguaucugcugacagucaaaauucuaaguugugcugacagauucugauucauaaauaaggaagugaauaaccuugugggacuuggccauguaggucuuauuuuauauuuuaguuuuucaacauaagcagauguuguuacagcaaaccuuguaugcagaggacuagaaacaaagccagcaucuuccaguggguacuauacuuggguuuccuaccaacauauuuagaaagaguaaagggaaacugaugcaacuaaacuguggugagcccaacaaucaguggcuuuucauuaugaguggucagacauguauuuaggcaaggaaaaagguauucauacuuaugagaugguuggacugugggcucuuaaucaugacucaaggaaagacuccagaagucauugaagguuugucuguaccauacuggaauuaaacaaacaaacaaacaaacaaacaaacaaagcaggauauggaaagaauucaggacacaaaguaggaauauaagcaauucucugcaagggagauuuuggaaagguagggacaugguuucauaaaaacugagagguugacauuagcguuucuggaaucaggggcugucucccucagcugaaggaguagcugcauauggauacuuagugaagauaaguuugauggcuagagaugcaccaguagugucugauuuugacaacaaauaauucaaaacauugaaaaucacuggauaacacuguagagaagaaggucuggucaugauuaugucucucaaaugucaaaaacauggcggaaaaaucucagcaacgugucaacaacaaaacaaaccuuuuuuuuccaugaagaagaucagaugugauuuuuucccuacaaucagaaagaaaauucugaugacuguuacuaaaaaaaaaaaaaaaaucuuauagccaauugauaagucuccagaaacccaauugaauugaucaaaaguggggauuuucuaguugucauuuuuccaaucuggagaacuagagagaagugggggagggagggggggaggaucaaagaucagagucuuccaaaucaggagagagaugaguaacauuguugguauaauuuaauaaucuaagcucaauaaauaaaaauuucucuguggcagauacaguguuaaguaucagaugcuggagagauggcucagagguuaagaucacugguugcucuuccagaggaccuggguucaauucccagcacccacauggcagcucagaacuuccuacaacuccaguuccaggggaucuaacaacaucacacagacaaguauuagaugucuuuuaauguugguaaaaguucuguugagagagauagaggugguaucucaucaacuaaacuacaagcagaucaauaggaauuuauucaggacuguuugagauauuugagauauuuucuuaauuauuugaggugauaucauagaagacagcuuuaaugaucaacauaaaucuuuggguauaacuagcucuguuauuagaauaccaaguuuugauacuccuaauaacuaagaaucauucugggugauucauggcgaacauaagcgaucccacaaauuguguauauggaaucuagauaaaaauaggcuuucaugaguuuaaaugcagacuuuacagugucuuauuuaagucuucugaagaauggcuaucauaauaucacucucauuuuuauucccacuaauuuuacuccuggaagucgccaaccauauucucuuugggaauuauucugucguuguuacugagguucaucuuaauaaucuccuuucuuuaccuuaaagcuccucagaaaucuacuuucuucaugauucccaacauaucacuaguuauagcuagguagaaauauaguuguugaauuaaauuauuuugggacuuagguaacguuuauauaaaacaaagccauuuuauagaacaggucugcuucucucugguccugcuaagucugugaacugucaguuaugcuuagguaaguaaauaguugguauguuucgcugguuuugaaaauaauugggaagugagguggaaaugaggaagccuaacugugugaucuaucuccgaguuucaugccuuuccucuaagaugguacuaaauuguuuuuguaauauauuguuugaaguuucauaugcuguuaggucucauccuucucucuuagaucuugugaagaaaaaacaaaaacaaaaaaaagaacugcaaucuauccguaacuauguuauagagaagaucucuuuauaccagagaauuucugaagcaaauuuaauuccuaagagcgguaccaaaccuugugccucugacugcagcuguuguagcgaaccaucuuugucugauuccucuguaaauacccagugcuuagucucucauuuccauucuuuuucuuuacauuuuauugacauaaaacacacauacagaaacacaugcacuucaugauugugccauuuggugaaauauuacaaaguaaggacacuuauguugcuugcaccuaggugaaaaaauaaaauauuuuaccauucugcaaauccuuaauuguguccaucuuuaucgcuaaaugauccucacucuccaaagauaauaacugucuucacuucuauuaucagaaauaauuuuguucauuugaacuguacauaaauggaaucagauagauguauuuuuuugagucuugugguuuuuuguuagcacuauauuugugauaaccauacuguugcaaggagaauuuuaaaaauuuauaucuuuguguguucuguuguugaaauacaucauaauuuauaaauuccuuaucaugauaauaacuauguaugauauuuccaguucgaaguuauuaugaauaauguuucagauauuuuuauacaaguccacuuauuagaauuuccauugacuauuuaucuaggauuaguuucuguguaauggagaauacauauuuugaaguuauugaugauuuucuaaguuaucgacaauuuguuucucaccagcaaugaaugagaaguacugucauucuggugaguggguuuguagugaaauuuucuguuuguaugugauauugggaaucaaacccaagccuucagguucucuaggcaaguagucuacccgugacuuacauccuuaauuuuaucucaaaggauuuuaaaggauucuucacugaagacugaugagguuguacuccuuaucaugugcuauuaucaauuuaggcaucuucaugaaguacuuauccaucuauuuauaucuguaucuauaucuaaaucuaaucuaugccuguauguagauguuuauauaauauauauuugccuauuuuccuguccacuuacacuguuuuuacaaauuucuuauauaauuaaaaauccguuauuuuuauuuuuaauuauguguaugugugcuugugucuaugugggaguaugugagugcagagaauagaauucccaggagcuggaguugugagcccccugacaugggugcuuccaaguccucuuccgaagcaacaagcucucucaacuauugagccauuucucuagcccuaaaagucuuuauauacauuggaaauuacuucuuaugcuuugaaaaacaguuucaaauuuguggccuacuuuuauaauaucuuuugaugaacagaaggcuuuaauuuuaaugugucaacuuuuucuuucauggauaguguuuuuguaauccguuuaagaaguauuuuuccagggcugaagagaugucucagugaguuugguuccaugcacccacuauuagacagcccauaaccaccuaacuuccucucugaugaagcucucuuuuacacacacacaaacacacacacacacacacacacacacacacacacacacacacaccccacaaacacaaaacaagccuuuuuuuaaaaaaaguauuuucucacuuugaaaucauuagacaugcucuuccauuaucauuucgaaguuuuguauuugugccauuugcaguuagaauugcuagccaccugggauugauuuuguguaugguagagauauagaggucaggcccuauauuuuuccauguaaguauccaacugaucuuguccuauuuauuauauggauuuuuuuauacuuuucuacauucuuacuuuuucauccauccauuguuuauauacacucaaaauuguuccugaguuguuuauucuauucuguugaucuguuucucaucagucuauuuucuguugcuagaacaaaauaauugaggcuugguacuugaaagugaaagagauuacuuaggucauuuuggagauucaaaaacauccauucagcuugagugagaguacccuuggcuagauagcaaaaugguggagaaagacaaagagacuacaugcagaaaagggaaaauuuguauggguuggccucauuucagagcaacuuaccccuuugagaacuaauguacucuguaagaaaaggauguguaccuucugaaggcaguacccucagugaugaaauuaccuugcauuuagccuuaccucuuaaaaguucuaccauaucaacagugccacacaggguuaagcaucccucacaugaauccuugguauacaaaaccacaguagggccauagcauaccaguacuaacaguguuaguuacugaacccuguaauaagcucuugauaucugggaaagcaaguccuuccaacuuggccuuuuaaaaccaccuuggauacucuuagcauuaacauuuucacauguauuuuaggauuggcuuuuuauguaccucaagaaaagggaaaccucuuagaauucuuauugugauuacauugaauuuaaaaauuguauuaguuaagauuucuuuucuauugcugagauaaaacauuaugaccaagaguuuaacugagcuuccaguuccagaggguguuuaugacaaaaggaugaaagccugaagggguggcuguagacagagcuagaacagcaccaagagcucacauuuggauguuacagaacacaauaggaauggggaagucuuuugaaaccucaagcccucccuacagugacacaccaccuccaagaaguccauagcuccaaguccuuccccaagaguuccagcaacuggugaacagacaugagcccaugggggaacaugcucauucaaauaaaaaaaaucaacuuaggaaaaaaaaucacagcauccaauucaggaacaucauauauucuuccaugucuuuaauucuugcucauuuuccuacugauauuuuuuaauguuuauauagaguuuuuccaagguguuuuuuaugccauuguauaugauagcuaugauggagguuguguuucaccauguagauuccacuuuagaaaggcaggauuuaugcccuccccccacccccccaccccccccccccccgaguaccaagaguaccaucaaaagacagaguucaccugagaauugucuucugaggcaaacuuuucaccaaggaaagaccuccuuccuugacugccugcaucuaaugacuaaucacuguagagcuauaaaucacuuccccuuucuucuaaauuaggaaaacauugaagagucauauauaagccauacuaguucaagagcucaauauaaauuuaguuagggcaauuuggggauugacuuuuuccuugucuugcacauauguggauccccaaagcacuaucuauaaaaaguccugcauguuaauauaagccuuucaguugacuugguaggaauuccaauguaagucuauauaauuaaaaaaaauuuugugauuauaacauuauuacaucauuuccccuucaaaccauccauccaaauucucucauguagcuucccuuguucauuuucuucuuuuuuuuguuuaauguuuuuuuucuuuuuuuuuaauuagguauuuuccucguuuacauuuucaaugcuaucccaaaagucccccauacccacccccccaauccccuacccacccacucccccuuuuuggcccugggguuccccuguacuggggcauauaaaguuugcaaguccaaugggccucucuuugcagugauggccgacuaggccaucuuuugauacauaugcagcuagagacaagagcucugggguacugguuaguucauauuguuguuccaccuauagaguucccuuuagcuccuuggguaauuucucuagcuccuccauugggggcccugugauccauccaauagcugacugugagcauccacuuauguguuugcuaggccccagcauagucucacaagagacagcuauaucuggauccuuucagcaaaaucuugcuaguguaugcaauggugucagcguuugaaagcugauuaugggauggaucccugcauauggcaaucacuagaugguccauccuuucgucacagcuccaaauuuugucucuguaacuccuuccauggguguuuuguucccauuucuaagaaggggaaaguguccacacuuuggucuucguucuucuugaauuucaugcguuuggcaaauuguaucuuauaccuuggguauccuacguuucugggcuaauauccacuuaucagugaguacauauugugugaguuccuuugugauuguguuaccucacucaggaugaugcccuccagguccauccauuuggcuaggaauuucauaaauucauuuuuuaauagcugaguaguacuccauuguguaaauguaccacauuuucuguauccauuccucuguugaggggcaucuggguucuuuccagcuucuggcuauuaccaauaaggcuacuaugaacauaguggagcauguguccuucuuaccgguugggacaucuucuggauauaugcccaggagagguauugcuggauccucugguaguacuauguccaauuuucugaggaaccgccagacugauuuccagagugguuguacaagcuugcaaucccaccaacaauggaggaguguuccucuuucuccacauccucgccagcaucugcugucaccugaauuuuugauguuagccauucugacuggagugagguggaaucucaggguuguuuugauuugcauuucccugaugauuaaggauguugaacauuuuuucaggugcuucucagccauucgguauuccucaggugagaauucuuuguucagcucugagccccauuuuuaaugggguuauuugauuuucuggaguccaccuucuugaguucuuuauauauauuggauauuaguccccuauccgauuugggauagauaaagauccuuucccaaucuguugguggccuuuuugucuuauugacggugucuuuugcuuugcagaagcuuugcaauuuuaugaggucccauuuaucgauucuugaucuuacagcaaaagccauuacuguucuauucaggaauuuuuccccuguaccuauaucuucgaggcuuuucccuacuuucuccucuauaaguuucagugucucugguuuuauguggaguuccuuaauccacuuagauuugaccuuaguaugaccucuauuuaaaaauugcuuuaaguuuaacuuuaauugcuuuuugcuaggaggagcuagagaaauuacccaaggagcuaaagggaacugcaacccuauagguggaacaacaauaugaacuaaccaguacccgggagcucuugucuuuagcugcauauguaucaaaagauggccuaguuggccaucacugcaaagagaggcccauuggacuugcaaacuuuauaugccccaguacaggggaaccccagggccaaaaagggggaguggguggguaggggauuggggggguggguaugggggaccuuuggaauagcauugaaaauguaaacgaggaaaauaccuaauaaaaaaaauaaaacaaacaaacaaaaaaacaaauguaguuuaauuuugcauaugaaguuuguauccaaagauuugauaaacucacuuauuuauccuaauaauuuauuugcauguucuuuuggauuuuucacaugucuacuaaaguguucauggaaaauguuuuaaaaauguuauuuuuuuccuuuuuaaucuagauagcuuaaaaguuuuccucugaccuaagagcaugcaccacagccuggaccuaggucuucucacacauauguagcagauguacagcuuggucuucauguggguccagaacaacuggagugggggcuaucccaaaagcuguuaccaaaaagcuguuaucccaaaaguugagcugccuugucuggccucggugggagaggaugcaccuagccuuauggagacuugaagugucagggugggaggauacccuggagggccccacccacucagaggagaaggggaggggggaauggagggaagaauugugggagggagugacuaggagggggcagugagcauaagguaaacugaauaagaaaaauaauuaaauuaaauuuuaaaaaguuuucuuuguguuggucaauuauuccuggguauggggccugcccuggaguguaguugauauacccaaugacuguccaugggagaaaccugacuuucccucugcccccagcuuucaguugcaaauagauucuugguugguugagguugggauccagaguucaccuuacucucucauuauggggauccugucuagcuugaaccuguucaggucuugugaaugcuuucacauucuuggaguucauuccuguuacuguaccauuccuguuuugucugcaagagacauuuuuuuucuuggagucaucuaucuaucuauccucucuggcucuuacuauguuuccuuuuguuuauuugacuugauuuucucuuuuuguuguuuucuuaguuuuacacauauggauacacagcucacgagagagagagagagagagagagagagagagagagagagagagagagagagagagagagagaacaugaaguuuggggggaaagguguggagaaucugggagaaguugggagagggagaaagaauaugaucaaaauauauuauauaaaaaacuuuaaaaguaaaaaaguuuccuuuauuauaaugucuagaaauuuccagauaauauugaguggaaguaaguaauaggcaucguuguucacuacugaucagagcaaaaauuuuauuuuuacuguuugucauagguuauauuauuauuguuaguuuaaaagauaucaguuuuaaacuuuuaguuuucaaagguuuuuaaauaacaucaggaaugacaucauuguaucacgguuuucuuuuauauguuaaacuagucacaagauuuuucccuccuuauucuguuaauguggucugaagcuaaccguacacccuuaggauaaaaccucuuuaguuccaguguaccauucaguucauauaugucuagaauuauuuuacuaaccuuucauuuaaaauccuugaucuuuauuuaugagcaagaugagcauguaauuuucuuucauuaucaaguuuggauaucaagguuauucuauguuguuauuauaauuguguuuauuuuauuuguuccuuacaaccauuuauauaacauugauaauauuuuucccuuagcuguuuggaagaauucaugaagucauuuuacccuaggggagguuaaauuguguuugauauccuaauaaacauagggcuuucagacaauagcuaacaaaauaauaaaauacuuagaaauacauuuaaucaagagaaucagagaccagaacauuaaaaucuauaaaacaaugaugaaagaaguugaagacugcagaaauaaaugagaauagguuccauauauguguaucagaagaaucaaaauuggugaaauguccauacuauccaaagaaaacugccaauucaaugaaaaccccaauauuccaauaacacaagccagguaugaugucucauaacuauaauucuagcucgugggaggcuaaugcagaaggguugucaguucaaggguagccuugauggugagaucuuaucucaaaaaacaaaacaaaacaaaauaaucagugacauguuauagaauuagcaauugugaaauuuauagggaaccacaagauaucucaaucgauuucuauuaucaauuguauaucuuauuuuuguacuacaugacuguuuugccauaugcuuguuugcuuuuuaaugaauggcauaauguauaauguuauuaauuaugacauauauuauauaaaauauuugugcuauaugcguaauauaauauaauauauaaugauaauguguuauuuauauuguauuuaauauuaaaauaauauuguauaauacauacacacacauauauggcuucaguugcuuuuaucuuuauuaaaauaggauuuauguuucuggaaauuggccucagauacuaacauuccuaugucaucuuaauccaacacgauacugagaucauuggaaacuggcuuucuguccaaauagaaguugauuuaucauuuauuuaaaauauuguuauaguuuagaaccuaaaaguugguaauuuuuccuggguucuuucuagaugggucauaaauuacaguuuuuucuuuuucuccacugacucccaaguucggccuuuuaauaguaugacauauuauguaaauaucauaugaacuuuuguauaguuuucuuggcaggaaaugucguucaaauugcuaauuuguccguuacuaaaaacauaagcaacucaucauauuuauagauauuuaugcauuaucaccuuuguaacauguaccaagggguacaccaauguggagauacaacuguugacccaguuagagagaguuccugcagucauggaauucugagucaggugaauaggcuagaacaagucaacuugaugaugaagcaguaggguuaaucuuacagcuuggaguaucuggaacacaugguaauuuggaacaaaaaagaugaacaccuggcucaaacuuuugaaaucaagggacauuuucuugaugaagcaccuucugaguuuaaaacugaaaaaaaaagucauuagcuggauaauuuuauuuccaguaauaggagcugauuaugcaaagucuuggaggugagagagaacauggcauauucaagggauggaaaaucuaauauuuauaaagccaucguuaugaguccauuaugguacuggcauaagguagacauuauggaucaauggaacagaauugagaacccuuauauuauaaccaacugauuuuuuacaagcauaaaagacaguucaccaaaguacaagauucccuauugaaauuaaggugcuaggaaaaucagguacccacauuuuuuaaaggggugaacuuaaaaaaauaggcuuaaugaccuugauagacauuucucaaaaacaaaacaaaacaaauagaugcacaauaucuauaugaaaguaacuauaggaauaucacuacuaaccauggacugcaaauuaaaaucgccaucaaagcuaccuccccccauuacgaaucacuaauaucaacaacacagacuaaagauaagaaauguuggaagauguugaggagaggggacucauuucacacaccaccaggggacuauguauacauaugccauaauaucaaauuaugggaguguuucaaaaauuuuaaagaguucacauaugauucaggaguccugcuucugaguauauguuauaguuugaauaugaaaugccccccauagacuuauguguuugaauacuuggucuccagcugguagagcuguuuugggaaggguuguggaaccuuuaagauguggagacuugcuggaagaaaggagucaccagacaggcuuugagguuuuacaguccagcucugucccucacuuacucucugcuucuguacugaggauucaguguguggagccagccuccugcugccagcagcugcuaugccuuccccgccuuguugccuuguguucccuugaacucuaauccgaaguaaacuuuuccccuucuaaacgugcuucuugucagguauuuugucacaccauaaagaaaaauaccuuguacugcauguauccaacagaaaugaaauaugucuuuggaagaggcaucugggcucuggaacauuauuugcaggagcuaacaaauggaaauaaccuauguaguacucggcucaggugaugaugaacagguacaaaauguguuacggccagguaaggcuguaugaguggucagaguucucagacacaggaggcagggggaucucaaguucaaggccagccuggagcauagagcaaaacccuacuugaaagcaaacacacaaaacagcccacaaaauuaaauagaaaaugaaaaaaaaccccgaaaaucacaaaaaugaaauccuguuauuuguaauagaauaaacacagcuggaaauuauuauuaaaugaaauaaaucaggcagagaacggagaucucacucacauguagaacaacaaguuaauuguauacaagguaagaauaaaaagguguuacuagaugguggggaauagguaggugaggguugaggaggagugaggaaaaauaauugaucaaugaguauuagauuacagauauauggaaaaggaugaucugcuaugcuguugcagaguagaaugaccauagauaaaguauguuucaaaagcuauaaaaaaagauuuuguguaggggcucacagacacugaaguggcaauuauggagcaugcauggaucugcucuagguccccugcauauaugguauaguuauuagcuugguguuuugggggguccuaacaguggaaauggcccuugucuccugggaccuuucauuuuccuacuggguugacuuguccagcuuuaauaugacaggaggugucuagucuuuuuguaacuucuuaugccaugcuugguucauaucccuggaagacuugcuuuuuucugaagggaaagggacgaugaguggaucuguggaagagggcagauaagggguggggacugggaagaguggagugaggggagacugcaauugggaaguauuguuaugagggagaaucaauaaagauuuuaaaguuuuuuuuucacuagaauaauccuugcuugauuagauagauguguuuaaccugauuuaaucacuaugccuuagauacucugguuuaguuuuauucucauauauaucuugccucuuagauacagucuacagugcauucauguguuaaaacauuauacagugugcuaauaauauguauauguuuuauguuuuaaucuaucaauuuaaaaaguuuaaaaagccaugagucaaauuaaauaaaaaagugaauguugguauaugcaacacaccauaccccugaauuuacuuuuaaauaaccuuaguuuaaaaugcuagaacaacacuuuuagaagaaaacagaaaaaaauuaugaccuucauauugagcaaauauuucuuagacauggaaccaaaaacauagucaaacaacaacacacagaagugaauuguauuuggaaaaauguuuuucuaaagaagccuuugaaaauaugaaaagaaacaugagaguaggggaaaauguuuccaaaauaggccucuugaaaugugaugaauaagaagacaaaguagagaaaagaugcauacauuuuuaucaaagacgaugcacaaauguccaaaauacacaaaaauaugcucaacacuguuaccauagaaaugcaucauuuuauaccuauuagaauggccauaaugaaaaagguaauaaacaauggagguauagagaaugggaacacuaauauauugcuggugggcauguuaaaugauauaguagucuugaaaaaugguuuuccacuccuuuaauaaguuaauauagaauuacuuauugcauaaugacccaauucuacuuguaugcuugugcccaaaagaauugaaaacgucuguucacacaaaaaccucuacaggaaugcucaaaguaagugguauucauaauuuucauuucaaaccaaaugucugaugaauaaagaaauguggcaaaaauucuaauagaauguauuucagccauaaagaggaaugaaguuugaauauguuacaacaugguaggauuucaaaaauaugguaagugaaaagagccagucacaaaggcccacaucauauugcauaauucuauuuguaugaaauauccagaauaaacaaauauguggagaaaaacugagauuagugaguaucuguggugaguaguaggacugaagauccacuaacuauggacaugagggcacuuauugugggaaagaaaagauuucaaaacugauuuuuacuaugacuaggguaggaguaguggugcuuuaaagaaaaugaagcaagagauaucaugaaauuacacaguucaauacaauuccuacaaaaauaagugaauucuauggugcgugaauuauaucuugaugcauuuguuauucuuuaaaaaaaucauaaaguaaauguguaagagauguuaguuguuucagagugauauuuaucuucauaugaagggaaucuucaagccuguucauugcaaaugcuuaaaacuuuuuccauaauaggugacuucaggauucuaacccagaauuaaacucaaccagaagcaucagggaugucaggccauucauuuuuaauuggaaggacuguacuggccauuuuguugugcacuucagaguaagaaucuuuaauuugugggacuauaaaugaguuaguguagauagaugcuagcaugcacaaauagccaucugugguuugaauaucucccucuaagacccacguugaaauuuaauuagcauugcaagaguauuaaguagugggaccuuuaaguggugauuagucaaugaggccccaugaauaaaugcuauuauagaaaugcaucagcagucaugggaguagacccccaauuaauauccaucuguguuauauucucaaucaaucaucuaucuuccaguaucauuucagccuucagaauugugagaaacaaaacaaaguucuuucuuuucucuguuuguuuguuucuuugaaacaggguugcgugcagcccaggucggccucaaacuuguuugguagcugaggagaaaguguugacuacuauccaagcuaucgcuucuauucuuacaugcuaggguuauaggcauguaccaccaugccuggcuuaauacauuuauuuacuuuaugaauuacccaauuucugguauucuguuacagcagcacaaaacagacugagauaaggccuagcuaauuacuuacacuacagugggcaguaauuaauucuggcucacaauuguuaucucuuguuuccucuucugcccuguccauuacucacucccuuugccucuaugccucuaugacuuuuauucuuacuuuuucugauagagauaggggaaauauucucagauucugcuuagacucuuuuuuuuuagacuucuagguuuaauauauaucauucagaugaaugugaaugccauuuuaaccaguguaaaguguuggagaacuuuuuaaaaaccuaccuguguguggccacagcuuaucccacaucuucagacucuuuggaguguaucuauggcuucuucgauaauacugaugcucaucuccauuugggaaucacugcucuaaagggagaaaauaaaaacgagagugugagugacauaagcguugaucgccuuccuagcuucaguuccuuuauuguuggcuauuacacuuuugccacuuuuguuacuaguccuaccuuugaugaucacugaugcaagaguuugugugguagugaaugcuuaaugagcacaccauuuagaaaauuagcuaaugauugugugucuuuugggaagagaggaauuagacuucaguugucaucuccgcagccagaugcuagggcuaugugcuugcaauaacugagggaaagaguaguucccuguccuuuguggcuuccuagggauuuuccuacugguagccgcugaaaccacuuuaaaauaauaggccgcugaguaauuuuccccauguauauccacuugucaaugggccugcacuucagagaugaagaguaauuuuuauuggagugauaguguauaauauaguuugaaagcagacagccacaaagaaauugauuuucaaaaggagauuacugcucaauuuuauuuugugguuuacagaucuuuagucuuucaaccugccacgccauugaccugcaaggacaaucaaaguuuaaacagcagugugugccuagaagcauuggaugguucuagagcacuuuuaaaaauauuuauuuauaauuauuguugggguggugggcugccauaaugccaugcauauguguagaccagaagaguaucccauaaagucaguucuuuuccuguuaucuugcuccuggggaucaaacucggguaaucaggucuucuugccuagcucuuuagccagcugagccagcucgcuggcccuaaaguccuuuuaauguauaagcuaaguuauuaagguggugaaacagagggcuuuuucuggaaggaauguuacaucuuuauucagacucauggaaaggagaguggcagauuucaggugggcguuuccucaauuuuucggugaguuacuaucaaggauaaaaggcaaugcuugugacaguucuaguucucaaaacugauuuagcuagcagagucaaccaagaaguauaaacuuccuuuguucuuaaugacaucagacaacccuguuaggugccauuaguuucugcauggauuuccagcugccaccucaaauuuaguuagcuaaauugaauucaucuucacucuucccuuccccuaccacacacacuacauuuuagaaaauuaaacugugguuucauucuuucaauaaccgaggcauaaaaucucagaugcauuuuaaccucuccucuucccuauucuacucagacuuagcauuccaguugcuaaaucaauucaucuuuucugguguugauuuacauuguuugugucacaugcaucuaguugcucuguuagaauucugauuguauuugguuuagcuggucuucaaguugccucguccacaucugugauccuuccucagcuuauuuccuguaguauuaauuaugaaccagggaguuguuuuguucucuauugcaacuuuucaugucuccccccccccccaacuaacuaccuuugcucucugcucuguugccuauacagaaaacuucagagucuuuuuuguaaaccuuccugaacuguucugucccacuggucauugcucgcuaucucugugaguucaguuuccuccagagcaaccccacugucacaccucucucauucuugccuuuauucaccuauuuccaaaagcugaaugcucaaccucuucguggagccucaggcucugagagcuuuucucaaaucuuaucuuucugauaaauucauccaucucagcauucuaaauccuucauuugccauuguauugaauuguagauuaucuuguuuccuuaauuaauugaaaaggguuuugaaggcagagacugaaacuuuucuuuauaaauuacagccgguuacacugacuuuuagcagaaaccucuaguuacauauaaauugguuuucucccuuugcauucauaccuucauuguugcgucauuucucuuguuaaaauuuuucuuuugaugauagaauacucuuauauuuaagguaaaauuuaaacauguaaagccuuuucugaucauuuagcccuuaguaauauuuuucuuuauuuugucucaaauuaauuugcauuuaugacaugcuugacacucuauguggcuuuuuaagaguuugaaggguaaaauuaaucccuauuauuagggacaggcuaaaauugggaagggauauuugggucagaggaagcaacaugaucaaagacuuagagacaguagauuguaugcuugggcaaaagccuagaacccaugaauuauuuauuuggucuagaacuaugugccauuuuacaucagcucugugauaguguucuauuguauaauacaaaaucgggguuaauuucucacuuguugacuacucagcuucuguuuucuuuuccauuuucauugugggaagaaaguuggugacuggggaaaucuggguuccuauauuucacaagagaagacaaaacugaugaagaccuuuggagcagggccacaugaaggucaaacuuguauguucucuuugaggacuagcuagacauuuacuuugcuaaauuagcuccuuuaagccacuguugcuaaaguuccuuuccagggggagacauaaacuacauuuacccauccucccaagguuccaacaagaaagugaggcaagaguccaucauaguuuacucuggggaacuaaugaauuuguugagcuucagcacagagcccaaguaggggguuacuuacagggaucuagacaugcuccccccuacuucccaugccuacaaaguguuaccaagcagggaugaaggcuuuccauagucacauagaugauucaccuuugcccccuccagucuucuuuagccucuauauacucuagcccuuccaccaggccaugugaaggugaagaacuaccagagugcuucaguaggauacuuaggugagacucucaugcccuauucccuccauccuuucccccaccugugcguguguucgcguguguaaacuggccgcuagcccaucugggacgaucuuuugcauuuugcaaaaugaugaaacagccaaagauggguguuuggcuuaaaggacagggcaaucacucaagacuccuuguuccaguaaucagcaacucuccggacccuuuauuuccagguccuugugccuuaacaaaacccaggccuaaagucagcuguucuauuugacuuucucaguucuacaggauuggagagaauucuagauuagugggacugcaaauucagugucuaguucuuucucccuuuguacccccaggucuucuuguccccuccuuaucucccugcccccucucccuggcuugcuccuuuuucacagcagcaauuccaugcuuucacuuuggucuauagagccccugcuguguuauauucacuuuauuuucaacugguaaauuuaauuccuauuacaguaaaaaaaaaaaucaagauuggcauuaagaucacucacaaaucccuuuccuucccucacuguuaacuucuacagauggaacccauaccuucuguauuccuuucucaauagaggaaguauguucuucauuucaagaccagaccuuucacuugaacuucagauuccuuucccccccucaucuuuccuuaguacuuuuucauugucaguuucuucuguaucuuuuugguuuucuuuugagacaaaaucguaucaugaaucccaagcugacuuccaacuuucaguccuccugccucagccucugaaauucugagauaauagauaugugccagaaugcucagcuuccccuguaucuuccaucucucucagaagucuuuauuguuuauacaaccaugcuuauguuuuauacuguauguguguauguguguguguaaacuaauuugacccagcauuuuucuuauuuuucaauuuugucauagucuuuauuuuauuuuaauuuaguuuuauuuauguaucuuuucuuaucucauuuaauccuacagguccuuuguguauguauauaguaugguauccaguuuggggcuuuaauuuuuauuuuauuuuauuuuuuagaagauuccucaguaugagaaugagugggucucuguuucuuuuuuaauuauguauuuucuucauuuacauuuccaaugcuaccccaaaagucccccauacccuccccccagucccccacccauccucucccacuucuuggcccuaguguucaccuguacugagguauauaaaguuugcaagaccaaugggccucucuuuccacugauggccgacuaggccaucuucugauacauaugcagcuagagacacgagcucuggggguauugguuaguucauguuguuguucuaccuauaggguugcagaucccuuuagauccuuggguaauuucucuagcuccuccauucggggcccugugauccaucuaauagcugacuguaagcaucuacuucuguguuugcuaggcccuggcauauccucacaagagacagcuauaucaggguccuuucagcaaaaucuugcuaguguaugcaauggugucagcauuuggaggcuaauuaugggauggauccccggauauggcaguuucuagaugguccauccuuucgucucagcuccaaacuuugucucaguaacuccuuccauggguguuuuguucucaauucuaagaaggggcaaaguguccacacuuuggucuucguucuucuugaguuucauguguuuugcaaauucuaucuuauaucuuggguauucuaaguuucugggcuaauauccacuuaucagugaguacauaucaugugaggucuuuugugauuguguuaccucacucaggaugaugcccuccagguccauccauuugucuaggaauuucauaaauucauucuuuuuaauagcugaguaguacuccauuguguaaauguaccacagcuaauuuguuuccauuuucccuuaacaguuaaacuuuaggaaguaacaauguaaucuugcugucuuggcauuuuaggcacucguugauucuucauauccuccuaguuuguuucuguguuuucuuuacuacugagucuguacuuacuagggugacuuuugaguuccauauuguaaaauucagcaggacuuuuugguuuuaauuuuuaaaauuauucuuauugaaauuuuuuuaauauaauauacucuggucauacauuuccccuuccccaacuccucccagauccuccauacauccugcaggcauccaauuccauauccuuucuuucucuuccuauuuuauuuuaaacaauacacuagcaaacaagcaaaauaaacaaagcaagccccccaagcccaagaaacucucauauacgcccacaaaaauggaaaccaaaauauacaagcaaaugacuaagacaaacaaacaaacaacaacacaaaaugucuauaaagauaccauugaguuuguuuuauguugguuauguacugccugacauacagccuaucggaagugugguuaauacacucauugaaacuccauugagaaaauuaaguuuucuuuuuuugcaaguggaugucaguugcagauagcuuuuugguuuuguuucugucacaccagauaauguccagucuuuuaacuuucauuuaaaccuucaauaacagaugcuacaauguaguggugauaaaguuagcucggugauuaauguuucucagugaauauuuauugaaugugagaguuaaauuauauuuuaaauguugaaauugagauauaauucacacauaaaacucaucuauuauaagcauagcauuuauugauuuuaguguauuuacagagcuauauaacugucgccacuaccugauucaggaacauuuucaucacccucaaaaaaacaaaaacccugugucuauuaggagucacuacccaauucagcccuaucagccacaaaucuacuuuaaccacuaaucugcagccuuaauguuuugcuuauuguggauauuuuacauaaauggaauaauauguucucuuuugugugugugucucuuuucaguuuuaauaauuuuaaagguucucccauguuauagcaugcaucaaaauuucauucuuuuuaugccuaaauauuucauuauuauuaaugacaauaauauguauuuacaacauuuuugucuagcuacucauuuauugauggguauuugaauuucuuucugauuugggcuauugugagugaagcugcuauggucagaguuguauaacugauuaaauacuguuuuuacuuguuuuacuuuauuuuucauucuuuuugagaguuucaugcaugcuacgugauuacucugccacugaauuauagccccagcccuaaguaaugcuuaaauucuuugagguauauaccuaugagugaaacucuaggucauauuguaacuauaugcuuaauucuuugaauaagcacuaaauuguuuuuucauaauugcugaaccauuuauauucuuaccaguggcauauaagggcuauaacuuccucuuuuaguuucauuucuauuauuauaaugcaaaacagcuuuaaaggagaaauaauuuauuugacuuacaauuucaagcuauagucuaucaaaguguggaagucaaagcaagagcuaaaagcagcuagucacauccucaguuaagaacagaguuaaugcauucacgccuacugcucagcuuacuuucuccacucuuuuuuuuucuuuuuuuauuagauauuuucuucauuuacauuucaaaugcuauccccaaagcccccuauacccuccccccgcccugcuacccaacccccccacucgugcuuccuggcccuggcauucuccuguacuggggcaucugaucuucacaagacgaagggccucuccucucaaugaugacugacuaggccauccucugcuacauaugcagcuagaaacacgagcucuggggauacugguuaguucauauuguuguuucuucuauaggguugcagaccccuuuagcucuuuggguacuuucucuagccccuucauuaggggcccuguguuccauccaauagaugacugugagcauccacuucuguauuugccaggcacuggcauagccucacaagagacagcuaugucaggguccugucagcaaaaucuuucuggcauaugcaauagugucuggguuuggugguacuuucuccacucuuuuuuuuuuuuuuuuuuuuuguuuuguuuuuuuuuuuucuaauuuccauuucuuuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuauggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguucuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcucccuugucgaagaucaagugaccauagguguguggguucauuucuggaucuucaauucuauuccauuggucuacuugucugucucuauaccaguaccaugcaguuuuuaucacaauugcucuguaguaaagcuuuaggucuggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagauuugaaguuuuuaucauacagaucuuucaccuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuugugcagaauuggaauuagaucuucuuugaaggucugauagaacucugcacuaaacccaucugguccugggcuuuuuuugguugggagacuuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagggcuuuuagauguguugucaagcugcuaguaugugcugucucccguuucuucuuggaggcacucagcgcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauguggcugcccuugcauuuggugcguagauauucagaauugagaguuccucuuggaguauuuuaccuuugaugaguaugaaguguccuuccuugucuuuuuugauaacuuuggguuggaagucgauuuuauccgauauuaaaauggcuacuccagcuuguuucuucaguccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugaauccauugauauuaagagauauuaaggaaaaguaauuguugcucccuuuuauuuuuguuguuagaguuggcauucuguucuuguggcugucuucuuuuugguuuguugaaugauuacuuucuugguuguucuagggcgugauuuccguccuuguauugcuucuugucuguuauuauccuuugaagggcuggauucguugaaagauauugugugaacuugguuuugucguggaauacuuugguuucuccaucuaugguaauugagaguuuggccggguauaguagccugggcuggcauuuguguucuuuuagagucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaugcuucuuguaugaucaugggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcugaugcucgcaucuaugguuccagaucucuuuccuaggguuucuaucuccagcguugccucgcuuuggguuuucuuuauugugucuacuuccccuuuuaguucuaguaugguuuuguucauuuccaucaccuguuuggcuguguuuuccugcuuuucuuuaagagccuguaacucuuuagcagugcucuccuguaaaucuuuaagugacuuaugaaaguccuucuugauguccucuaucaucaucaugagaaauguuuuuaaaucugggucuagauuuucgguuguguuggagugcccaggacuagguggggugggagugcugcguucugaugauggugaguggucuugauuucuguuaguaggauucuuacguuugccuuucgccaucugguaaucucugaagcuagcuguuuuaguugucacuguuaagagcuuguucuucaggugacucuguuagccucuaugagcagaccuggaggguagcacucuccuuaguuucagugggcagaguauucucugcaggcaagcucucuucuugcaaggcagguacccagauaucugguguucgaaccagacuccuggcagaaguuguguuccacucacuagaggucuuaggaucacguguggaauccugugugggcccuugcgggugucaggcgacucagcuggcaagguagccggggcucgaguggaguggaagggguuugugccccagaucaagcccggguagccugcuucccuauguaccgcagucucaaguuccacgcgauuggauugggguaggcgcuguguuccacucaccagaggucuuagggucccguggggagucccgugugggcccuugcggguguugggcaagacucugcugucaagguagcccggggcucgugucucgagucgagcggaagggacuugugccccagaucaggcccggguagccugcuucccuauguaccgcagucucaaguuccgcgcgauuggauuggggcaggcacugugauccacucaccagaggucuuagggucccguggggagucccguguggacccuugcggguguugggcaagacucugcuggcaagguagcccggggcucgagucucgagucgaguggaagggacuugugccccagaucaggcccggguagccugcuucccuauguaccgcagucucaaguuccgcgcgauuggauuggggcaggcacugugauccacucaccagaggucuuagggucccguggggagucccguguggacccuugcggguguugggcaagacucugcuggcaagguagcccggggcucgagucacgagucgagcggaagggacuugugccacuuucuccacucuuaacacaguucagggaacucuguccagggaaugaucccacucacagugggugagucuuuccauccuaauuaaaguaauuuagauuauuccccauagaaguacccauguagacaauauucauuaaaucuuucuuucaggugauuauagauuuugucaagcuggcaacuuaaacuaaccagcauacuuucccacaucuuuguuaacauuuguuaugauauaucuuuuggauuacaaccauccuacuagguguauggugguaucuggcuguuuugguuugcuuuuuccucaagacuaaugauaccagacaucuuuaccuguacacaguauuauuuagaagaaccuguucaaauucuuugcucaucucuaaauuguuacuuguuucuauagugugaacuuuuauaaguucuuaauauauucuguauacuaaacacuuagauuugcaaauguucauuuaauucucugcacauuucauucuuuaaauuucuucuucaugguuuauuuaccaaugaguauuauuuuuuuuuccuaaaucucuggauuuuuuuuucucaaguucucauagaagauccuuuucuucuaauauugugaauguuuauuaucccacaaccagguuauauugucuugguauuucauacacugccugcaugugugaucucuuaauugaacucauauuuuaacuguuaucucuauaugacuagcuuugaggucaagauaucuuuucugugccuuaugcugacugaacucuaggacauuuuuucuuugucucuuuuuggaauuguuccuuuguuuugagaauauaauauaauuaugcuguuuccuccuucuucugucuuccucaagugaccaccccguauaccccuucuugccccuccuucacauucaugaccuuuucuuucauuaauuuuuguuacauguacauguguguauaaauauaucuaaguguaaccugcucaguguuuagaacguuacuuguauguauguuuucagggaugaccauuuggcauaugguuuuccauuaaaaacauuuaagccaggugcaguggugcacaccauuaaucucagcacuuguagacaaaagaagcugguggaucucugugcguuugaagccagucugaucuacauagugaguuccaggucagccugucucaaaacacacuaaauuuuucauauaauauauuuuggucauauuuuccuccuucccaaguccuccuagagccuccucgcuuuucugcacacccaacguuacuuuuucucuuuaucccucuccauuucucucuuucaacccccaaacaccaaaauaaaauaaaaccacaaaaauaaaaaucaggacaaacaaggaaaaugaaaaaaacaaagccaaacaaagccaaaacaaaauaaacaagauagaaagaaaaaaacaaaaacaaaaaaccuagaacauuccguggaguauguucuguguugggcaacuacucuuggacacagggccuaccuugcugugugguugaauaaugguguccuuaucuuuucagugucacgaggcccuauucauuguugauuuuagugccugugcuguugguagagaacaauuuuaugugaugcauuuuucagggcugggaacugaaaaacagggcuuugcaccugcuaagcaagcacucugucacccacuaaauauucaguccucaguucaauuuuuauuggaaaugcucucagaaucuaauaggaaacuuaaaaucaauuuaucauaaauuacauucauguaucccccaccuuaaugcuacuucuauucuguucauuugagugaguagcaccccagcuaccuacuucuccaagccagcaaugugcuaauugcuuuggauuauuucuucuugcacuuccuuaccugcaguauaaugucuauuagaauagauucuaccuuuuuaauguucccucaauauauuauccuauuuuagugcccuucacuucagauauuaccaugucaguuugcuuuuucaccucaaguuucaaucuacauaaugaaaaaaauccuugacucuucuuagccaggucugaaacuguaaugauuucaaugauaacggcucccauagguauauuugaauacuugguccccaguugguagauguguuugagaaauauuaggaguuguggcuguauuggcagagguaugucauuggggguaugauuugagauaucaaaauaacauaccaagccuacuuagcuuguucuguuuccuguuuauggauuuggcuuagaagcucucagccacugcuucagaaacaugucuaccugccugacuccaugcuccaccaugguggucauggacuuacccucagaaacuguaagcaccaaugaacccuuuucuauaauuugcuuuguuauggugucucuucacagugaaaaguaaguaagacauaaauaggugcuuuugaugugcuccuauugaauccaaugcuuaauaaugguguuaaauuauaauacaugcuagucuauaacuguuauuuagcuuaccugccuucuccauaaaauaaaguauuucuguaguaguccuuguuuuauaugacuuuacaguuauagugucuguggcaaauuauaaacacaguaguuacucaaacuugacuaucacuuauuucugauauuaucuuuuuugaaagauaggagaguaaaauaauuuauuauucaucuuuggccauacuaaaacucaagaaaaauauuuuuauugcuaauauaacuuuggguuaucauagauguuuauugagagaauucuguucuuagcaggaccuugaccucuguggacaaaugaagaugaauuauauauacuccucuggauaugcagucuuuccuccuuaugcuccggugguguguugcaagauuuuggccuuguaauuagugggacaagaauugaaaaggcaggacaguagacuuuuaaaauagcaauauuuuaagcauugucucaggaagcuacauaaaaguugagcugaaagagugucaagaggucaucuugucaagcuacuuuaccuuuaagcgggcaaauucuaaaggauucauggcaaauggucaggcaggagcuccuaauuacucauugcaaagaauacucauugugaaagggaagaaagggcauaaagaaaugaaauaaaaguuuaagguaaugaauaugcuaauuccccugaguugaucauuauucaauuuguacuugaaugaaaaaacccacauugcacuugcacuuauguucugugugguaauaagaaagaauuuaaaagaauauacauuaaaaugcaacuauuaaucuaggcauuuggaaagcugaggcaacagaauggccuaggcuaacugggaauacauugaaguuucuaguccagucugaaccauuuuacaagauccugucucaagaaaauaggcucauauauuugagugcuugguuaccaguuagaaguguuugggaaagauuaggaaauguagccuuguuggaaaagguauguuacugggagugggcuuugagguuucaaaagcccugaucaggcccauugucucucucucugccugcuucuggaucaggauguaaagcucccagcuacuguuccagugccaugccugucugcuuccugccaugauuauggacuaacccucuaaaacuguaccaagcccccaauuaaguucuuucuuuuauaagagcucucuuggucuugguguaucuucacagcaauagagcagugacuaagcuuuaucuucagguguguguguguguguguguguguguguguguguguguauuaaagaaggcuauguaaagaaaugaauaaagagaaauguucucuauaaaaguguuuaacuuacugaaaaauuacuaaauuauuucucauaaucauucacuuguuaguuuuaaaugucacuuuacacaaccucgaaaccccugugacaagagccucaaugugaaccguguagauaagguaaccuguggggaaugucugcaggugauuauucuugguugacuuaauugaugugaaaagacacagcccauugugggugacuccagucccuaggcaagagguccugagccauauaagaagaaagaaaacuaguuaaacauauauaaaugaguaagcacacaugcauuuauuuucuuugcauuuggauaucauaugaguauuuauuucaagcuccugccaaugugacuuccuuuuuaugguggacuauaacuugaaauugugaacugaaauaagcuauuuccccauaaauuguuuguuggcagaauaucuuauuacagcaacagaaaugaguauguaacacauauucuuuguaucucaccaguaauauaugaggauucugauuucucuacauauuugccaaaaguuauuauaucugucuuuuuuauuguuuuacuugucuuacugaauugaaaguacuagaucauuuugguuuugauuuguauuucccuagagacagaggacauugaucaucuuuucauguuuauuggcuauuuguguaucuuauuuggagacauguauauucaagauuuuuguccauguuugaaucagguuguuuuuguuacuguugauuuauaagaguuaaccauguguuccagacaauaaccaucuaucaaauauaucauuuguaaauauccucucucauccuacagguugcuuucuugcucuguucuuagaauuguuagaugcacuaaaaauuaauuuuaauguaguccacuuuacccauaucuuuuguugccuguccuuuuagacaucauguaaagaagucauuguaaaaucuaaauucagguaagcuguuaguuuuugccuaaaauuuuauaguuuuaugucuauaccauuuugaguaauuuauuuauuuauuuguuauuguaucacuaaaacccagggccuuauacaugguagagaacuuucccuaagcuauaccccuaguuugugucaauuuuuaugaaugguauaagguaaauguacagauaauuucuuuuauucuggauaucuaacuuacauaauaucauuuguuuaaagauuuucuauuccauuggcacccuuaucaaaaucaagugaccacaucugugagggcuaauuucugggcuuucuguuuuauucagagacuugcuuuugaggcuuuguuacauacaguguggcaaucuguggguaguucaacuucucuaguaaaaaccucccaaugauggaaaguuuugauaaaggcagacauuuaaaaauuuuuuucuacuaugucacugguguugaaaucaaugguugauaauacaaaugauaguagucucuucagaugaugaaugacaguaaacuauuucugaaagcuacugaaaaaauuaaauaaaacaacauaaagcauucagcauacaucguguguaagaaaggauucuuauuuaaaauauuccuacuaauaguacccaugaaugaauagaaugauggaugcuuuuaucuccaaauaugagaaacacgguguuguagaucuagagauaccuggacuugaguagcucucagcuguuuguguguguguguguguguguguguguguguagaggagggauacacaaggacugggcacaaacaccuuacuuccucauaaauuguuaagacuggcuugcuuguuucuagcaugcuauaaacacuaaaugagaacuaguguugagaugccaaaggagaaaaugaauuuagggugaaguagaaggaaagcagacauuuggcaggcagcuuuauaguucuaaaggagcaacgucuggaacaccaugaagcacaucaccaggccaaccuaagagauuagagguauuuacauagauuuaaaucuaaucuuccugauuuuucugcaaaguagacauuauccccauuauauagacaaggaagcagacucugagagauuauuagagaauaggugguaaauggcagaaccaagauuuaaaccuagguuuaucuggaccccaaggccuguaaucugaagcaacauagauuuuauuuaguuucuuuguuaaaugucauccuuauugguaaguguaagaauagcuaagacaaauuucagaaucauuugaugguuuuuuuucauuguuauuuuucuggucuguaacuaguaagccuuuaaaaaauuaauauccuguacugcugauuuaacuggcagauuagaguauucaaaacugcuggcaaaguuacuguaagaauguaaauuuucuaaguuauaagccuguguauuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccuaugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggauguguauuuuuuuauaauuugcaguagcaacaguaaaauguaauagcauucuugcuauuuguaguuuguugcauuugacaagauauaugguagaguagguggauggguauggugugagucucugucucugucucaucuccgucucucucucucucucucucucucucucucucucucucucugucucaucucugucucucucugucucucugucccugucucugucucugucucugucucucucucucucucucucucucucucucugugugugugugugugugugugugugugugugugugcauaugacaagaguagaaacaucugagucaagaaaauggaaagguacauuaaaaaugguucccaguuaaaaucauguaauucuagugcuaaaagacagcuguuucuuucacucugcuucuaaguucagccagucauuuuuauaaucccauguuguucguugcaagguaauaagagcagaaaauauagcuaguuuauccaaguuaauaccuuuguauuaccuuuguuauaacuugccacagggagguaucuuucaguacaacugaugccaucuucauagaaaaaguauggaauuguucggauguauuugugggcauguauagugguucagaaagaauuguauuagugguccccugaguacauucggugaagucuaggagaagaguucagacuguagagcugaaaugugugguuuugaauccuuguucagaugcuggcacugugaccuugaaagauuuacuuaagggaacaggcaguagugguugcuuauuucaaaacaaggucuuacucaucauauaguccugaauuccuuuuccuccuacuuuugccuucagagaucugggauuacagcugugucucccuacaccuagcuagguuugagguuuauaugaaaagugugaauaauaacaggauguuuaauucaggguggcaauaagaauaaaauaauacaugaaaagcucuuagaaauguucccagauccuaaaguuuucaguaaaugccagcuauuuuguuugucauuguugauuacuguuauuauuguuauuauuaugugcugagaaauaagcaaagagaauagccaagguuuuuucuuugugcucuugcaaugugaaauauagccuuuucuuugagcuugaagaaaguuguaguccccaucauagagaaauucuuuaaaccaaagaucuggaauuguaugugauugcgacaucuuuauggaaauuugacuucaugaugacguuauuggauuuguguuaauacaagaaaaaaaaagucccuuuugguggggcagucuaaacuaagagcauugcuuuuguaguauggagacugguucuacuuaaauauauguuuuaauuguuggacauuucuacuucccaauuuaggacaaaacaaucucuauauaucauaagauauaggaauaucaaaaggaaauguuggauguuucuucauucauuucuuuuuuuuuuuuuugagauuacgucacacuguguaaggauggcugcucuggaacuugcuguguagaucagguuaacuucuucugcauuccagcuacuggaauuacaagugugcaucacaauacuugguuuauuuauuuaauuguuuguuuauuuaguaagguauuuauugacuaacuauuuugugccagguauuguguauuacgugcugaauauuuuuauuacaaccaagaaaacaaacagcauuucagauccugauguaacuaaugguuucucaguagggauaccaaguauauaagaaaauacauguuuauaugugagugaauaacagaaaagggucuuauuuaauuagaaugaauacacaaagacuuacuaaaggagaauuguuauaaugagagguaagauaagaaaggcauugaagggauggagagauggauuagugguuaagagcacuggcugcucuuccagaggaccaggguucaauucucaacaucuacauggcagcucacaaaugucuuuaauuccaguuuaggagaucgacacucucuuccggcuucugagggcaaaaggcacauaugguguccagacacacaugcagguaacacauugauaacauaaaauauuauuuaaaauaacgaauggaauucagacagggaaguucugaaaaagcaugugugaaagucucaaagcaaagaagaucucuggacgauggaagagcuaccaaaagagcaguguaagugugaagucauaagggggaaagcugugucuuaugagcucgaaagguaggaggaucaaugugcuccugcccacaguggucaggagacuuuaccuauuuuucucagagcaguccuaagacagcaaagaguuugguguguugaagggauaagaaggugucagugugaauggaguccaaugugaauaagccaaggcugauaaugguguuuacuuauugauuguauuaaaaugggaagcugaggguuucaagcacaaaaguaauuagaaaaauagggauuuuuaaaagauaaaaaagauguaauagugugcaugugcagaaggaaaauuaaagagaagccaugcgcaguagcauaugccuuuaacccagcacuugggaggcagaagcagaggcaaguagacuucucaaguuuaaagucuaaccugcucuacauaauuaguuccaggcugaccaggcuuucacaguaagaccuugucuccuaugaacaaauaagugaaugcagaucaacauaaaggcucuuuuauuucuggauuaaaaucauguuagcauugcacuaauguggugugugugugugugugugugugucagagagagagagagagagagagagagagagagagagagagagagagagagagagagagaaugaauaaagggcuuauuuugcauguaacacuucaaaacuuaggcaaccaggaauguaaccuuccauauacucgcaugagaacaguuguggaguaacagacuuggagauuggaagggauguggagauuagguaggauggugcuugccuuuaguccagcacucaggaaacugaggcaggaggaucacaaguucgcagauagucuguaccacagucagugaagcauugacuguaaaguagggacugaggguauaauucaaugguagaagcuaauaaacgccaggcucuggguuugaucucuacccccacccucacaaacaaagggaaaaaaguaaaagaggaguugauggcaucauuaguugaugacaaauuagaaaacauuaaccuuacuauuuucccuuuaaaaaaaucaaucuugcuaucuacuccagauaacuugaacucacugugcaacccuaguuagcuuugaacuugcuuucaguccuucagcauccaccuccugcugaacacuaagcauuucaggccuauuguaccaucccuggcuuggaaguuauuaaucuugauaagaacaguuucagugguacugcaggguucaaacaguuuagauggacguauguguuuguaagcuccugaagauaaucuauggagaaggaauugaugauuuaggagagagaugaugugcugauuagcuuuaugucaacuuggcagaagcuagagucauugaaaagaagagagccuuaauugagaaaaugcauaaaaucuggcuaucggguauuuucuuaauuagugauugaugugggagagcccaguccauuguggguggugccaaacugggaucgauccugguccuggaugcuauaagaaagcacgcugagcaagccaggaggagcaaaccagcaagcagcaccccuccaucagcuccugccucuaggcuccugcccuguuugaguucauguccugacuuucauagauaauaaacagugauguagaaguauauaaaugaaauaaaauaaaucccuuccucuccaaguugcuuuuggucguaacacuugauaacauugauaguaaccauaauuaagaugaaugggauaaccaaaaugauguuugaaugcaagauaaauauaauacagagaaaaaggagaaagcuuauccuuugagaguggggaauagggauuuauguacuauaauagaaaauaaagaugagaaaaguguuuagauuaaacugguagacauaguagugagaagggagugugucugugucugauaacaccauucuuaauagcauaaggggacaggaucaugaggguagagaaggaaaagcagauaauuuucuuguaaagcauuaguugagaaaagucaauuucagacagacaguauuugauaccuauuuguagucugugaucacgaauuuacauaaagcuuuucaacaagauuauaugauuuucuacagcaacauuaggcugcuuuggcauaaauucaggacagaaaaaucucugaauuuauucaguggugagaggauuuguuuuauuauugacagagaggaagagaugaagaaguugcggaaaugcuuauaaagguagaucagugacuaugcugaauaaggaaggaggacauggagggauauugugaaaguggcaucucagugaaauucauuuguugaauaucagacaaagaauugaaaagaguaaaaauuauagaaacaaauauaauauuaauguuaaauaccaaugugccaauagcuauaaaauucuacauaggauagggugacagacaagcaaaucuagaaguuauauaauaucagcugggaauaaaggaugaguagcaaaaaaguuagaagaauaauuaguauaacaaagacauuguuuuagagaagccaaagaauagcuuauaauauuuucacugucuugaauauggcuagacagucuugugaauaucaucauuuuuacuacacuucaagcuuaaauauucccaaugaaaaguagccuuacuguuagaucacuauucuucaccaucuuguauuugauuuuuguuucugacuuuaauggacuccagggaaaaauuuuaggaucaacugcuuauaucuucuaacuguccuaucacagcuauugugaguacacaaaucuaugagagaaaugagauggaaugugcccccaaacuaugagcaaaauaaaccuuccuuccuuaaaaaaaaccaacaacccauuaucuaaauaauguaaaugucuucagauaugugccccuuuucccaacugaaauaaauuuuggcacauggaguggagugaugugaccaauaauccuucaaauuuaucacaaagcaguaggacagugaggaagcugguaacaguacauccauggucaagaagcagggagagaugaaggcuguugcaucuuugccuucuuauucacuccuggauccuggcucaugggauagugucaccagcaguuaagguggguccucacaccuugauuaacuaaaucuggaaacucccucacagacaugaacagagaguugcuuccauggugauucuagauccugucaauaugacaguaaaaucugcauucauguauucaaggcucugaaaggcucuacagucuugggugaccuuuggcuacaugucaucuuguguuuccccaauagcuuugcuuuugucucauuccacaguauggcuuuccauuuuuuuccagagaaggcacgcugaggaauucugguuucccaagacugugcaucuuucuuuuuaaaaaauauuuuucagaucccaucauuaaaucauuucccccccaccuuuugcuuccuacaaaccuuuccauguacuccuccaccgcugccuugcucucuuucaaauucaugaucucuuuuuaauuguugucacacacacauauguaugcacacacacccaaauacauaaauauaacccauuaaaucuguauaauguuacuuguagguauguuuucagggcugaccauuugcuauuagauaaccaguuggugagcucuucccuggggaagacuauuuagccauaugcauuuuuuaguugucuauuguucuuuguauagaauucaggccucuugagcacccucaaccccaauuuacauuaguaugucuauugcugucguccuuguucaguucauguuuaggcugucauguuuuugaggcuuuaugguuauagcuucugauguaacuagaagaugcaaugucaaauucuuuguucuucuggcucuuacaguguuucccccucuucuacaaugaccccugaaccuuagguaagggaauuguauuauagauguaucccuuguaguuuuuuuauagugaucuccaucuauugcaaagagacguuuccucuaugaagggugaggacuacacuuaccugugaguauaaggauaaauauuuagaauguaguuagggauuaugcuggguuaguaggguggugauuguagguuuuuuuccccaagauccaugacuuuaguaguuugggguagucgucuaaguuuucaguauucagaacaguuuuccucagguuauuugaauuuuuaguauuaaauuacacuggaaaccauaaggggcuaaggaaaagaacaaacagauuuugagugaauucacugauaaaaauuagguuuauauuacuuuuuaaaauucuggagugaguuacaguuauauguguaguuacacucauuuuagauauagugauguuuuuagaacugucauaaaacggaccuuauuuuucacaggaacuauauuaccauugucgugugacauugucagucuauauuuaacuuugaaagaaaccaguacuauguuucucauaauggauguaguaaucuaaaauccaccaguaaauauuucacacuuucccuuuauucccaucuuaaucuacauuauuuauuauucauuuauaucuuuugugcuaagcucaagauggcauagaagcccuuaugaaguggcuuugaucucaugauacuccugccuuuguauaagguaccugccuugacuuuuugauuuuccaucugagcauguguguguuguaagauauguguucguuguuuuagugauaucuguucuguguauaaugauuauuuauaauaauuuuuguuuaucauucucugauuauuauugaacauaacuucagauuaccuguuaguagccuuuaaaaacaguuugcuuacuaagucagcaucucauguaguucagguuaauuuggaagucacuguauagaucuccauuuucaacuacugggauuagaagugugugccaccaugcccaguuucuguuagcaacuuuuaaugucuucuguggagaaauguuuccucagguccuuuacucauuuuagaucagguuauuugucuaccauuagguuauuuguauuuuuauaguacauguuagauaauuaacccucaucaaaauacaauuuuugcacuuuaucuccuaaucuacagacuuccaucucauuuucuuggugguaauaaagucaccacacaauaauagcuuuggaccuauaaugauagaagaugacagugguccaggcucugugaaauugagugcagcagcaaaaaggauguaaugauggcaaaaugucaccauggcuugguucuaacggugagagcaauauagcaaugacuaccccucugggagugaggagaccucaguaauucagauuggaaagcuaauccaaaugcugauagacaaggcacuaugucucuuuggccuggaacaucaauucuggugggauggcacaguuuagcuaagaugguagagaggcacaauauuuacuuggcccuggaaaggauguguaugcauguuaccagagccuccagaucccuaggguauaggacaugacauaaacccugcagcuagugagauauaucaaagacucagaggcuuuagaguccaaggucaugcuuuaccuauggauuuauauuaagagaagaacuagggucaauugcucuggugugcuggaggccugaagucccucuuagggauugaguccugccuugguggaggauacaaaucauacaauacacagaaugcuuguacugggagaauggaguugggcuucaacuuggcccuaagggaagcaugcacuuguuguuuggaaugaaggaaaugggaaggauucaugguacacuggcucuacgaauuaagaaagaguaccaucuuggcuggcaauggcuaccagauggguguauuucagugauggcaaagccucuaguugagaggccuuuauggcuacuugccugcagaacauguggucccaagaugguaccauacaguagcagcaugggcuaugagaaguagaauacaguguuaucuccuucucuggggguagcuuaguaucaauacuggguaguuucagaggcuguucuuccaaaugauucuuguuugauuccuagcacccacacggccacucauaacucuuuguagcuccaguuccaggggaucugacaccuacuucuggccuuuaugggcaccaggaacacaagugguacacaagcauauauguagccacaacacacauacacaaauaaaacaaagguaugugugcuuguuuaguauguaugaguacauuccugagacauaugcacaugaaaaaaacgauaaaaccaacuaaaaauacuuacauuguuuuccuuucccuaguagacugaaaaccacaucugggcaaagauuaaauuuugaaggaacaugguaaauugaacauugagcauugaacauugaguaaauaacgcuccucucuauuagcaagauaagcagaagaugguauugcaugacauguucacuuuugagaaacucauccucuaaauagguugcauucaaagaucucaauaugugauccuaaacuucauuauuauagcauuaaagcuagaagccacuuagauaauauuauauaucuacuacauuuuuuaaggugaagaaacuggggccuuuuaaacaauuaucauguuggguuauuuucuucacuguuuucuuuccuuuauauauuuauuuuguauuucagcaucuguguuccaaagagcuaaugguguuuuuacucuaggaccuaagagccaaggucauuuucugaaaaggguggagcugaggaagaguaauucuuugaauguuugaggaacaugagaaacaaaugaaaaauguggcagaaagugagaagaaaacacagcaaaauuaaugagcaaugcucaaugucuagcugcuacuguuuguuuuguggcuuuaccccacaacuagcuaauggauuuaggauuggagaaaagauagaagaaauggucauuggucagaauuuaacuagaugaguuaaaccaucaucacugaaguuauaaauaacaacaacauuuguaaugaaggaagagagcuuaugauuucagcaagucuguaauagaaguaauguacuaggacacuuaagcuagcuaaggaggaagucagaaaaaauguaaauggcaaaguagaggaaagaucagugaacuagccuugauauacugaaagaaugguuguuagucuggaauauugcuauugaggacuacugugcuuauauuggugauuuuggagauugagugguaaauggucaucuaugguugcuuccaguugcgugaggagugagugguagaugcgguauggaaggaagucacuggggaugaggaaauuaaugacucagaguucagcauauuagauaagcuacaccauacuucuauacguuuaucuucucuuucuuuuuuccuuuauuauuuuuuuuuaaauuuaauuuaauguguaugguuguuuugccugccugguguaugucugugcaccacgugugugucuggugcccuuggaggcuagaagaaggcuuuagauccucugagauuggagucacagaugguuguaaaacaucauguggguccuggguauugaaucuauguccucuaaaaaagcaguuacugcucuaaaccacuaagacaucuuuccaacaccaaggacaggaucuuauuaguguucauuagagacaucuaaaugccagcucuaggacagcuauucuaaacuauucagaguuuauccuccaaggaauuuaggagcucuuaggaugaguguauuagauuagauguuaugguaagaaagauguaugaauuuucagucuuuuccugucugcuauucucuuucucucuagacauagucagauuuuuuucuuuuaaaagcucuuuccucuaucuugggauauaacucaguaggaaaauuaaccuuugacccaacuuuaagcuuucuuuaaaacuucucucucaaaucuauuauucuuuucauuguuauaaauauuuauuuauuggaaaugccuaauuuucacugagcaauauuauggggaaaagaguaaucaucauaguauacaacuuuugucacuugggaguauacauacauacauauauacauacauacaucuuauuuuucuuauaguuugaaucauaacugauaauauaagagaacaaaggcuuuaucacacacauacaugcguguaaacacacauuaauauuugugcugggggguagaacucaaggguuuauguauguaggcaaucacucuaccauugagcccuaugaccaauacauuuuuaauuuuguauuuuuaaaguuuuuagcuuacauuuccuguuuucuucauauucuguaaaauguucaaauauuuaacuuuuuauguauuauaaauuucuaaucuguuuucuuauggucagaccuuucaaguaauucacacguuuugcuguuccugauaacaauauauucuacuucaucuuguguucaugcuuuuuuuaaacucuaauucuuuaaaaauauuuuuaugugucucuaugugugcacauggaucuuuguaugugcaucauauuuguguguguguguguguguguguguguguguguguguguguguguguguauugaggccugaaguugauaucugaagucuuccucaaucacucuccaccuuauuggaggucucaguugaauguagaacuaaucuaacuagcaagccugcuuuaaggagcuucugucuccuuucuuagcacuagauuuauggggaggucaccguacucacccagcauuuacauggguucuaacuacacaacuucuuguccucaaucuugaagacaaauauuuaucuauugaaccauguuucuagccccuaauuuuuuuguugagcuguuuuaagagauaaauuccuagaagugagauuagcuggccaaagauuaugaacauuuuccuuccgaugaacuuacugaaagaacuguauaccguuugccuucaugcccuaacacuuuccuuaaguaucuuggaauuugucaucagucaaacaucuuucagagauuacaaaguggcuuccuauuuggaaaaugaaucggcucauucugaauuuuaagaauucuuauaauuuauaagauguaacacuuuguugcaacuaucuucuugaaguucuccugucuugguucaugauaugauauuuaguucucuuucuaccuucgacugauucuguuucuugaaugucugaaaugaagccuucuuuagguuguguucagucccuuccaacaugaauaaacuacaaaccacuuucucugguuccaacuucucccuucuuaaauugacaauaaaguuguuuucauacacuauguucuaauaaugguuuccugucucaucuucuccuugauccuuuccaccucccaacccauccaacuccccaccuucuuucucucucuuaagaacacaaauaggcaaacaaaauagacaaagauaaaacaaaaugaauaaauaaaaaaaaagacacuaaggaagaacaccagaaauguauacauacacacaaacaaacauaugaaauccuuaaaaccucaaaauugaaaaccauauauacaagcaauagaccaguaaaauguuaaaaagggagaaggcaaacaaaauaauauaagauuuuaaaaaccuccacaaauaccuuugcauucauuuuauguuggcuuuguacugcuggccauggggccuccucuuagugugguuuguauacccccagugagauucccuugaagaaaguaaguuuuucuuugugagugaucauuggagauaauaucuugguugagaaugagaacauucucuacugucuaccccggcacugggacccugucugguuuuaucugugcacauucugugcaugugaacacaggcucuguuacuccaugugugcaccugaguucuuuauugcucuaaacauccauugcuuguuuuuguaccauguaucacuguaucuacaaaugaaauaauuuccacucuucaaaucugauaauacuauuugcauuucuagaguuugaagauuauggguagacacaugucggacccuuuugccuuauuccaucuguucugcugguugucauauuauguuaauucuaauuauuuuacaaccucuggguuuuuuucauauuuuuauaugauucuuucauuuaacaaauauuuuuagagaacugucauaugcuuggccccaaggguacaccaggagcacaacaaaaauccuggacauauugaagauauuuuuauugcgggaaacuaugcaagcaugaaaguaacgcaugcagaauauaagauaaaaaguuacauguuaaagaauuggggaaagucaaaacaggguguauauguaugcacaauuaguccaggaaaguaaccaagaaaguaacauuuggucaaagacuuguagguagucagaagagaagcccacagacgggaagagaaugaugguucauuccagauagaagggcuagcgguuuaaagguuuuaagagagagagagagaaaaacaaacaaacaaacaaacaaauaaacaaacaagugcucagaauggacagaguauuuaguguaaaugaaucagaaugagaaaagggaagguaaguggggugggcgucagauguaaagugaaagaaccagaucuuguggagauuuugaugugcugugagugaaauggaaagucauuugggcaaaagauugagcugacuugauuucuuauugauguaacuguagcuucugggucgaagcuagauuguaucaagucaaggguagaggcagaaagcaagugaggaggcaguuagagcaaaugaaaugaugaugaugcuuuggaccagggaugguaguaaugaaagacuguuggauucuacauugaauauuguugcaaugugauauuuaagaggaaagaaggcuaucaaaaaugacuucaaaauuuuggccugaagugaaagaacuaaguuccccccucucuuuauuuugccuuuuuuggagcuagggucuuuggaauucccuuuauguagcccaggcugaucaaagucaugaugcuccuccuacuucagcuuccaagugcuagaucuacagguauaaggcauuuucacccagcugaguuauucaauuacuuuuauguauuuacucuuuuuauaaauccccggaugcuuaauucuguucuacucuguucuguugcaauucuuaauuacuuuuuacccuggcugugucaauauucuugauaaauguucaguggucaaugggaucauccucucccagccucucuccuuaauccaguacauccucaauacagcgaagcacuggucauauauucuuuuuaaaaucuuccacaguuuucaguugcacuuaacuccacaggcagacucuucuacuuugcauuuaaaaccuuucauaauaugagcucaaccuauuuaaccggcuuuauccuuuaugauuuccauauguccuucaaauuaaaauggcuugcugucucucugaaguuaguguuuaucaacaccuccaguuauaaaucaugcuuaguugauauaacauggugguuaggagcauagacucuagcugaacauuccaaguuugaaucaugucucuacaucucauuguguuuugaugcaguuuacgucuaccucucaaauuucaaucagacaaacaaagacaauaguuguguacuucauagaaauguuugggaaauuaaauggguuuauauauacagcauuugaacauugccugacccauguuuaguucucaaaauuguuagcucuuacuguuauuguuauuaauaucauuuucuuuuccuagucucacuguagugccaggcucauguagguaaggacuuuauucuguauacugcucuauuugcaagaccuacaauaguguuuugcagauaaugaacaguuaguaaauaaaugauugcaguuucccuggccugagauucuaguugcugcugccacuucuccacauucuuuuaagaaccuuaugaaccuacaaagcucaucaugaaugacguuuauuccauagaacgcucugguuuuucugauucuuauuccaaacuaaauuuaaccucucauuucucugaauucccgaaauaucuuguauauguuucuuuuacauccuuuacuuuccauugccuuucaucuuagucauuuguaucuaaucuugcuuacuagauauuaaggucuuaaagcacguacugugucuuacucauuuuuuuuauucucugugguguuagcauaaugccuugaacaugguagaugcucaauaaacuuuugcugauugaauugaauugaauucauucuccuauuuauaugcuuagcuuuauaugaauuuuuagauuucuaagucaugcuuccaaaguauuaaaucucucugcaauuuacuucuuagguauccuaaguagucaagcuuagaaagacuauuuauaugcaauugcaaaagaagaaacuuugucucugccaagccuucuucagauggccugaggauuugugccagaucacaaaauuguucuaagucagugaaagggaaaguuuguuaaauaugguaauauacagcugaaauucaguauucuaauaaauauucaccuaaaaacccagauggagaaaaacagcuuuugugcagaugauaaaguguaugguguaaaauauaugcacuuaagcucauguacuuacaggauaagcuccucaaauacuaacucauaauuuauuuacuaaucauuacucuuaaaucaucacuuuuagauuuacagcuaacagcuggggagagguaaauuauaaaugcuaagaaaguucacagaagauaguaggagggagagacugcugacucccaucuaagagacagaaaaauuaaaaaccaggugaagaaccuacagcaguguggaacuaauagccccauagagcuuaccgacgccuugagggcaucagugccuuaugacaauacagugauugauaaauugacguucauaacgauucauaaaagcauuaaauugauacccaccacauuauauugaugagauaagcaguggggauuaaguguucagauuucauccagaagauuaaaguacagauuauauuguauauaaaauaguaaauccuuaucuagcuagcuagauaacucauuccugaguuaagcauaaguuaaauguaaaauuccuacuuuuuaugcauaccuuucuguaccagucccucuaacuagaauugaaaugcaaugcuaaagcagaacgaggcaguaaauccauaaaaaugaauuguucauucacacuacauuuauaacauaggaaauacgauuauagaacagauguugacugauugaaaugcuguaugcucaaucauguuaguguuuauuugauaaggaaugccauuuguuuagcuuugcucauuuauuuagugacuguggucuggaauuugauuagaugcugucuggcuguguaucucuacccaccaaaauccugagucaguauuagcuuacaggagaauggagaaguuacagcuuuuuagcuuugagaaugaaaauaggaagacaguuuugucaauuuaaacaucuuuguuuuucuguauuucacuuauguauugguaucacaacgcagaugugacuaauagucuggcaauaguccuuccuuguuuaacuuuacacugaaaauugcaucuuccuaaaagucuuuuuagugacaaccagggagagagagagaaccaagaauauuuccugaaaugaaaucauuuacagaugauguguuuaugaaucaugggaaagacuaaaaguuaauuguaaagcuacugugauucuaaauaguccuauauuuaaaauaaacuacucaacuaauuuuugaucucccuuggagacagcaaaugucuuuucuguggcagcaagauuacagcaaaugauuucaugggaacauuuauucagaugcuauauuuuauuagcugauaauucuuaugauauacaauguaguauaauaaauauuugaaugaauagauuuagaaagcagguaauuuguaguaagcauuucaaaacauggauuaacuuucauuucuagaaguaguacaucaagcuauuuugugauacauuguaaaaauccuguuucagugaaauaaaaauuaagacuuuacuuauauaaaacauuucagaaagaauuuucuuuacauuuacagaaagauaaauaagauuuuaaacacaccacugaauauuucuguguuuuuuccaucuuuaaaaauauuagaaaaagaguccuuuguuuaucaucaucauuauuuuacaucuauauauuugugcuuguaucugugugugcuuguauaugugagugugugucugucugucucucucucuuucucucucugucucucucucugucucucucugugggguguguauguguguguguguguguguguguguugguauuuugcuaaaauggaaguguggaggucagagaacaacaugagaguuguuucucuucuuccaucauauagguuccaaggauuaaagucaggucauuaggcuugguggaaaacaccuuuacuagcuaagcacucucacuggccuaggaaagaguuuuuagugguugccaauacauaucaaguauuguugaacuuaagccaggccuguugaagugucugucaucccagaacuuaaaaggcugagguagaaagauuguggcuuccagaccaaucuggucuauauaagaaaauaaaucucuggcucaaagaaaacaaaacaaaacaaauuaguauauucucuuaaaaacuacagaguaaaacugaagaaagugcagaagaauaugaauauuauagaaacauaauauuuuaaugcagaauuagaaguuucuucuauaaucucugucuuaggguuuccauuacugugaagagauagcauaaccaaggcaacucuuauaaaggcuaaaauuuaauuggagaugguuuacaguuucagagguguaguccauuauuauccagacaggaagcaugguagcauguagccagacaugguguugaagaaagagcugagaguucuauaucuugauccacaggcaacauaagggaacuaugugucacaaucauccauaacuuuaguugcaggaaacccacuacccucuucuggccucuauggauagaaaccaggcaugcauauaguguacgggcauaaacacaggcaaaauucucauacauauaaaauaaaguuaaaauaauaauaauaaugauaauaaacaacugcauguuaacacaaauaacaucuuaaugacaauaacuauauucuauugcacagcaauaacauuguuaaauucaaugucauuucuuuuucugaaugcuggugagacuauaauguccauuuguauaauuuuauaucuguuaccuuauuccaauucaaagccccagcacuuuucucuacacccacuuuaaaaauaacaauguauuaagguauuuaguaccauaaaauuuauucacuaaagcagcauugcuucaacuaucagauuguuuuauaguggcaacuauggauauccaauuaccccacaccccuuucuuuucucuugagacauaguguugcuauuauacaacccaagcuagcaucacauucacagugugcuggaaacuguccuccauuauaaguucccaagugcuugcaucacuggcaugcaucgucauaauuggcuacuuccacauuucaaaaaauuauauuuaucccagugaguccaaagugauauuucaauugugcuuuugauuuguauuccauaaaugauagugauagaaaucaucuuuucaugcaagaaucucuuugcuuguguucuuuggauaaauuuauauuuaaguccucuaccuguuuuuucaauugaacauuuacuuuuuauuauugggcuauaauuuuggaacuucuaaggauuuuuuuaguuucagcucuuacauucagaucucaucaucaucacuaucaccaccaccaccaccaccaccaccccuuccaucaaucaccacuccuuccaucaacuaccaccaccaccaccaccaccacuaccaccaccaccccuuccaacaaccaccaccaccaccaccacuaccaccauuuugagacaguaucuggcuauguagucuaggguaucauugagcuucucaucuuccucagccucucaauugcuaaaauuauagguguguaucauugugccuagcugcaauccauuauuaaauuuuuauguauuauagugaaggugucuauaauagcuaauuuuuauugucagcuuaaugggguuuagaaucaccauggaaaugucucagaguacaucugugaagguguuuccagaaaaguuugacagaucacagaagacuuacucuacgugugcauggcacuaucccauuggcugggguuccagacugaauaaaaaagagcaagugaccuaaguaccagcaucuguuucucucuauuuccugacugugacuacuauaugaugagcacuuuuggcuucugccuccuugauuuccucacuacaagggacuguauccucaaacuauaccaaaaugaacucuuaagucuuuuugucagguauuuugucacagcaacaagaaaaguaacuaaaauguguccacauucauuguuuugcuacaguuguuugaagauuauuuuucuccuccccaguugaccugguaucuuuguaaaaacauaauugauuguaaaucauauauguguguaucuuuuguggcugauauauacggucccugucuaaaauguauuucuaguuaaaaauagugugugccacgauguauggaugugcacaugaguguagguauuucaaaaugcagagauauuggauucccuggagcuggagauauagguaauugugagccaccaauguaggugucuaggaaccaaaugugaucuucugaacaggcauuaaacacucccaaacacugagccaucucuucagccccuguuuauggauauggauauugauauauggauauagauauauucuucuggcaguagagcacucaauuaccuuguaguuucucuaagguuuauuuuuaaucaugugcauauguguaugcuugugaguauauaucacaugugacuaccccguagaggccggagcucucagauccugaugugagugcuuggaauugaauuuggauuuucuggaagagcaauccacugagcaaucucuugugccuguacuucauaguuuuaaaauuaaaguuuacauguauggguaugugugugcacauaugucuucacuaugugugugccuggugcccauggagaccagaagagggugucagauucucugaaaguggagugacagacaguucucagccacugugugggugcugggauuccaacccugguucucuggaagaucagcuggugcucuuaaucacugugucacuucucuagcccuauuuuuuaguuuuguacucaguuuugauauuggaagcguauauuauuuguuuuguuuuguuuguuuguuucuuggcuuguuuuguuuuguuuucaaaauuguuuuuggaguucugugccucugaacuucaguaugaguuuuaaaauucaacuuauauaaugauucuaacugagauuuuaguugguaguuuugcauuuguagaucaauuaagggguuauugccaucuagauaauauugacuuccacucuaugaacauggguaucuuuauuuaaucuuauuuuacuugccuuauuuaaaaauuauuuuguaccugcuauuaaaagccuauacuucuguuugcaaauguauucuuauggauuuuguuuuauguuugauguuauuauaagugggguugauuuugaugggacuggggauuaaaccuagguucuauuacuugcaaagcaagaagaguuccaucacagaauuucauccacagccauauaauaaccuaaauuuuucauuuucuaauaguucauuacauguauagaaauacagauaauuuuuuuacauuggcauuucggacuugaugaauuacuuuauuagcauugguaauuaaaaaagaaaaacuuuuuauugauucuuugugaguucugcaucaugcaccccaaucucacccagccuccauuccuucauaucuauccucugacuugcaaccuuccccacccccgagaaaauaauaaacaaaaguaaaaaauaagcaaaacaaaaaauaaaauuucacugugaaagcuguaaugucacagugugucccacgcuauacccuuuugaccacacaucuuuacuuaaaauguacauugcaaugggucucgugcaaggugucugguucugcuauaccaucaauauuggguccucaccagaacuccucuuggauaucccguuguuucucuguggagcaucuacagcuuuggaucugcaaguccagccccuucaugugcuccagcaguucauggaugagguagauguugggguggaucagcucaaagcccuggaucugagccugggcgguagcugagcugauuagccugccaguucuccuagacccacaccaccagggugagcccuccaguacugcccuaacuaggucacccagcguuguagucaggaagcagcagggacagcucuccuggucucaugcccuugggccagaguaccugcccccauaccaacugggccagcucuacugugcuguccaggugaguaugggggcugcucucucaaguguugcagcuggugaggaauaggaccagcuuuccugcccucaugaucucagggccagcauccccaccugcugcagauguguagagaugaggaaguagggagggcaucucuucaaaggcuacaccaucucagggcaggcuaacaguggggccagcucuccugugcuuaugcccucuggucuggcucacccacaagugcugcucaggagaggugcuuuagcuggugaagagcagggccaguucucccacacucaugaccccagccagcuuuccugacugccacagguggugagagguaagggaaugaugguaauuuuuuaaaaaaaaaugaauacucauuuuuuauaauacucuugucaucugaaaauagagguaauguuauuucuuuuuuuccaaagugggugcuuauuacuuauuguuauucuuaguuuaauauggagaauagaagucauaagaagacacccuuguaaagggaaauaguaugcucgcucucucucucucucucucucucucucucucuccauuccaaaaguugcuacccuuuccagucccccccucucaaguucuucaccaccuucccuuccccccaccucugaaagaguguccuccaaaccuacucacuuccaccagcauuccucuucccugggccauuaaguuuccacaaguuuaagugaauccucucccacugaggccaugccguacaugugcccagggccaugaaccaguccauguaugcucuuugguugguggcuuagucucugggagcucugaggggucuugguuaguugacaccguugcucuuccuaugggaugguccuccccuucagcuccuuuaguuuuuccucuaacucuuccauauaggucuccaaccucaguucaacgguuggcuguaaguaucugcaugugucucagucagcugcuuguagagccucucagaggacagucaugccagucuccugucugcaugcacaauauggccucaguaauaguaucaggauuuggugugugugaauaggauggaucaaaaguuggguuagucacuguguggccuuucuuucauucucugggcauuuuugucccuguauuuccuuuagacaggauacauaugaugucaacuuugggucuuuccuagaguuauuguucagcuaucugaggaaguuccuuucuauuguuuuguuuuaaagguuucauuuuauuuuguguguggauguuuugccugcaagaauaucugugcaccauuuuaauuuguuaaguuuuuucuuuuaacuaugagaauuuucuuacauugucuugcuguauagcccagauuggcuucaaacuuaugauccuccugcuucaccuuucuaagugcugggcuugcugguguguguuuccaugcccagcuaaggauauuucauguugucaacauuuuaugugauuauuaagauauuguagugguuuaaauagguuuggaaacucauguguuugaaugcuugccccuagggaguugcacugcuaguaggaugugcccuuguuagaggaaguucaucacuguugggugggcuuugaguuuuucuaugcucagguuccacccagugcaagagagacccuccuccuggcugccuguggaagacagucuccuccuggccaccuuucgaucaagauguagaacucugccaggcaugguggcgcaugccuuuaaucucagcacuugggaggcagaggcaggcagaucucugaguucaaggccagccuggucuacaaagugaguuccaggauagccagagcuauacagagaaacccugucucgaaaaaccaaaaaaaaaaaaaaaaauguagaacucugggcucuuuuagcacaucugccuggaugcuaccaugcuucccacaaugauaauaaugaacuaaaccucugaaacuguaagccagccccaauuaaauguuugccuuuauaacauuugccuuaguuauggugucucuucacagcaauagaacccuaacuaaggcagaaguuuauggauuucuucuuuuaucuaugguacauugcauuagcugauuuucugauaguaaaugaacauugcaauccugggauaaauucuacuuggugaugauauauaauuauuuuauguaugguuagauucauuuuuaaaguauucuggugcuggguaugaugccuuacacauguaagcccagaacuucagaaguggagaucagaauugccaauacgauggggccugucugggcuauagagugagaccccaucucaagaaaaacaaacaagccccaaguauuuugaugaggaauuuuuaugaccauauucagaaguaguauuuguuuguguuuuuucuuuauugcuuuuguuugauuugggcauuauauaauaauagaauaaaauaaaaaauguuuuaccaucuuaauauuucuucaaagcguuuaugagccuuaacuguaaucuuuuacuggaauucauuaauaaauccauggucugagccuaggauuuucuuuguuaguacauuuuggauuggaauucaauuucuuucuuaccuucauagcuacccuuauuuuguuuuucuucuuaaauaaacaucacuuuuuguuuuucuaggaaaauuccuacuucauuuugguuauguacauagaguucaaguuauuccuucauagaccuauguguggucaguagcaaugcccucuucuucauuccaaauuuuaauaauuugaguuuuuugcuguauaguuuuucuguuaaauacacuuagaaauuauuuguuucuuuuuucagugauuaauuuguuuuugacaauuacacacacauauaugugugcauacaugugcacacaauguauuuugauuaaucuacucccuuauuauuauauaauuuuaugauguaauauauaauaaauaauaugcauuauuauaauauuaucugacuauuuuaccucuccacuuaucgauugccaucucucuauaauagcaagucuagcauuuuaguuuaguucugugauaucuguuguaaucuuguaguaguauaauaacgacucagaugcucuaccaaguuaccaaaacucuucacauugugcuauacaaucuguuugagcaaagggggaaaaaggcagcuugauccaucuuuaucuuccuuuuacaaguuucuauacccugcuaucaggauuuacuuucacuuauuacugaguaaccuuuggcuuuauuguuuucauuugaggaaaugagaaaacuuuccuucuaaauguuuaucaacaagaaguuauuccuuuuggaaauaguaauugaauucugcuguccugugugaugccagagaugagcucaauauuuggccuaggccucuuucauuuuccuggaaggaagaaaauguggugguccuucacaugugccuggccagcaaguguagcaugaaucugcaguagcuccaucacugacuucaccuuguauacaacguauaaagaaggaaucuugaaaaguaaaaugggaucagugauuagguuucaauaggucauuuguagcccagucugaugaaaguaggccauaaaaugcaguuauaacacuaaugauagcaaaauacucuauauuccacauuccaugcaaguacuguccccuguuacagucuuggaucucacuagcauuccuaacuucaaccaggauauauguuauuuuuuuucugagucauagguugugaaaacuucugaauggaugaaagaauguauuuucaagggaugcgcccuagauagcucaucuuuuucauuaucaauaugagcuuaaggaaauuauucaaccucugaaguucacuuuucacauguaauaaaauauggguagcauaaaagaguugugaaauuuuaauuugauaaugugucuaauacuuaaaaauauacaaguuauuauaaauagucuuugucaaaauauuuucucuucuaagguccaucuggaugauguaaacagaucauuaaaacauucuuagcuguauuugaaaugucaagauugaacuaucugaacuuaaaucuguugacuuuuaguuuauucucugaaacuuuaaagcauuuguauaauguauuuugaacauaucuguccaaugcuacuucccucuuacuaucgcugugcuuucccuugucuccaucccuacuucacaucuuccuuuuuuacuguuauuaauaacuuccuaagucuaagugcuguccauauguguaugccagguguagcuaacuaugugugcucagcugucaaugggucaccauaucaaccucucugacccaaaucugcugacuuuuuaagauuuuuuuaaaacaagagaaguuauuauuaacaaaccauacuuguuuaccccauccuguuauugaaaugucuucugucauacuuugguuucugcccagccccuggcuacacaaucauuuuauuuuucuaccaucucauguaauccugguauguuccagcuaauauuuauacuugcuggaauuggaguagaaucucaacucaaccaaagcauuuauccuaccugaaaaauauucacuugauuggcauaguacuaugauaacagaaagugucucagaagaggggaagaguguuuuagauuauaauaggaaagagauuuacacccgcuuuggugauauuaccaaacuugcuuauagacccaaaggcucuuauaauugaauguauaaagguuauauaucuaauucaguaauuaggauacuagacauuuauugaguuuucauuauaugauaggugcagugauaaaugcuuaccuguaucauuuaguuuaauccucacaacagcuauaaaacuuguuucuguuuuuaucuccaucuuuaaaaaugaguaaauacauguacagauaucaacacauuaagguuuacauagacgacaaauggaagacugagguuucaaacugacaugauucuagcacuacauuccuaaacauaguauaugguguuucuuauguauugugaauguagcuucuacagaauuccagaauguuuguuuuagucuaccaggauggucugaaauauugucuguuuauuauuuucuuaaggcagccuuuucuguuauuugaacaauuaaauaggagcugagaaugauguugaaauaaaaccugauacuguauauauaaacucaaagcaaauaauugucuguaauaugaauacccacuucucacauuaaacauguuauccuuaccaaaaauaaauaaauaaacaugagaguuaaaugacaucauaggucaaagagauguagcaaucuucuaccaaccauuccaguuaaacacugcaaaaugcauucuucuugguaccucauagaauaucuuuaaaaauagaucauauauuaggaugcagagccaguccuaacaaauacagaggaauugaaacaauuuauuuuauucuagcugaccacaauagaacaaaaccagacaucaugaacaagagaaacuacaaaagauauacgaacucaugaaguuugaacagcacacgagcaaaugaugaaugugucaucgaagaaauuaaaaauaaauuugaaacauuucuagaaucaaguuagucacaggauauagaacagucaaguuuauacugacuaggaagcuuucuccuugcuggcuaguuucaagaguacccugucagaggauggccaugugggacaucaaugggaggagaggcccuugguccugugaauucuccaugccccaguguagggaaugccaggacagggaagagggaguaaguggguugguaagcaugggggagggggguggaauaggcgguuuucagaggagaaaccaggaaaagggauaacauuugaaauguaaauuuaaaaauaccuaauuaaaagaaaagaguacccugucaacugugauaaugaccauaguggcaagauaugcacuugggugcaauaguggcagaaauuuuaugugcauaacaugugcuuucugauuggauuuaagggagcuccgugggaggaagcacaugcuuuauauuaaaaauguggcugugguaguuugaagaggaauggccuccauaggcucauauauuugaguauguuagguauuugacagggauuuuuaggagguauggccuguugggguagguguggccuuguugaaugaagugugucacugggugugggcuuuggaguuugcaugcucaagcuaggcacauugcacagugucaugcucuucuuccugcugccugugaauccagaugugguacucugagcuccugcagcacugucucuguaguaugcaauuauccuuuuugccaugcucauaauggacuaaacaucugaaacuaaaauucaucuuuauuaagugcuuuccaucauaagaauucccauggucauagugucucuuuacaguauuagaauagaacauugacuaagacaguggucaaaaagccaaguucauaggccucaggaauuaaccuacuacuauuguuuugcuaaguucucauaguauccaacugccucuaaauucuuauuuccauagcuguagauuagugcaacucuaagaccucaucagaaaaguuucuuugugcagugggugguaguuaaugaagaauaucaaaaguggucaaagugcagaaaauaacuaucaauggaauacucagccacaaauggggcaucuaagucacacaaaauccccaguguacaauguacaaggacaauuguagaagagaggacagaaagauuauaaagcaagaguccagaggagaccugagcaaaacaguguguucuggauaggacaggaccacuguacucaugaacucacaggcucuguaguugguugcacaaaaucaagccagucaccauucaagcaugaagugaguucuugagccuguaccccuaacugaguagauggcuucugugggaggagggucaguuuuauuuaagugugugugacucuacuuaggagacagagacagugucuacauaaugaguuuuaggccagucacagcuaugcagagaaaaccuuucucaaaaacauaaauaaauaaauaaauaaaaaauaagaacacaaagggggagaauuuggguguagggauguguguggugggaguuaaggggaggaguugucagugaauaugaucaaaauacauugcguaaaaauuuuaaagaauaaaauaugcuuuaaaaaagcaaaggaacagaaaugaugauuuaaugauugagaacacuugcugcucuuaaagaagaacuggguuuggauucugacaccaacaacggguggcuuucaacuccucugugggcacaugcauauuugggaacacacgcacgcacgcgcacacacacacacacacacacacacucacacacuuuguauaugcccaguguacuggcuaguuuugugucaacuugacacagcuggaguuaucacagagaaaggagcuucagguaaggaaaugccuccaugagauacacuuguaaggaauuuucucaauuagugaucaagggggaaggccccuugugggugggaccaucucugggcugguagucuugguucuauaagagagcaggcugaguaagccaggggaagcaagccaguaaggaacaucucuccauggcuucugcaucagcuccugcuuucugaccugcuugaguuccaguccugacuuccuuuggugaugaacagcaguauggaaguguaagcugaauaaacccuuucuuucccaauugcuucuuggucaugauguuugugcaggaauagaaacccugacuaagacacccagggaguggcacuauuuggaaguggccuuguuggaguaggugugucacugugugugugggcuuuaagacccuagcugccugaaagccaucuagcugccuucagaugaaaauauagaacucucagcaacuccuguaccaugccugccuggaugcugucaugcucccaccuugaugauaacagacugaacuucugaagucagucccaauuaaauacuguuuuuauaagaguugccucuuauaaaaacauggugucuguucacagcaguaaaacccuaagacagaaguugguaccagggacugggguauugcugugauaagccuggccaugcuuuuauuuggaagaauguggauuugggaauuuuggauuuggaaagcaauggaaucauuuaaguggggcuuacacuaguaggaauacggaagacuuuguuaccgugagugauuugaacuaugcagaccuggcccaagaggugucaguggagaacauuuguguguguguguguguguguguguguguguguguguguguguguguguguuauuuuggugaagaauguggcugccuuuugccauuguccaaagagucugccugaggcuaaagugaaagugaagagauuuggauuaauugcuuugaaaaaaggaagccuggagggugugggggacuuuuggguuagcauuggaaauguaauugaggaaaauacguaauuaaaaaaaaaaaacagccugguauaaagucuguugugugguuacuaaaguucacucuuaugaagagcauuuuaaugaaauguagcaaacugagaaaggaaaaaauacaaaauacauggcucaaguauuaaaggagcacugggaaauagaaucgagcugaauccuauguucugggagauaacagauuaagggagugggacuuuggggcaagaucccacccagcuaaguuuagaucaaggcaugguuguacauaccuuuaaucccaggagacaaacacaagcauauuuaaaccaugauacauauaaauucuaaauuuugauuugagacuauaaucuggaguagucaaugaagauaggaauggaggaaaggaucagugggaggcuuuaaacaaagcucuagagagggguaauaggacccaggugcuacaaagcagacacugaggaaauggguacgggcaaaagaguaauacagggggagaaggaggaaggacagagaaauagcacuaaggauauuugaagaagcuauagguaaacauuuuuaugagcuuauuuaaaaaugcauguuguauuaaccucuggccuucauauucaugcuacacacaugcauuguaccaauauguacagauacacacauccacauacauauaaaacacacacacagagacagacagagagagagagagagagagagagagagagagagagagagagacuccaccagaaaaccuuuuagaucugacuaacauuaacacagugauucuuaaccuucauaaugcugugacccuuuaauacaguucuucaugaucgggugccccccccaaccauagaauuauuuucauugcuacuuuauaacuguaauuuugcuauuguuaugaaucauaauauauaucuaauauguagaauauuuaauacacaacccucaaaggaguuaugacccacagguugagaaacacugcuuuaacaaguugucaguguacaaaguuaacauauaaaacauaguaggcuucuuauauuuauaacaaauauguuuagaaauaaaucagaaaagcaauuucauucacaguugauucaaacaaagaaaauaucuuggaacaaauuuaauaaagaaaguaaacaaccucuauacugaaaacuuuaacauacugaagaaauugaagauaauaccagauaauggaaagaccucccauguucauggauuggaagaguuaauauugugaaaauaucuagacaaccaaaacaccuauagacucaguaugauccccaucaaaaucccuaugccguucuucauggaaauagaaaaauucuuaaaauucauaaauaaaugaccauggagaguuaaagcaauccugagcaaaaagaauaauguuguguuuaucaccauaccugaucucaaguaauauuaucaagucaugguaacaaaccgagcuugguauuagcacagaaacaaaucaauggaguagaauaacggauccagauaugaacucacacagccauaaccaccugauuuuugagaaauauguauacaucauagaaaagacaucuuuuccaacaaaugguacagggaaaacuggauauccacauguagauuaaucaaaguggauccuuauuucaucccauauaacuaucaacucugaaucaagcacugaaacuccgaagcugaaaacauagggguacaaauaaggacuuucccaaaagcguaaaaucacucaggaaauaguaccaacagcugacaaaugggguuaaauguaauuacaaaucuucuggacugaaaaggaaaaagauaauuaagugaacagauagucuauagagugggagaaaaucuuugcacacuacaugucuggcagaugauuaauguuuagaauauacaaagaacaccaaauaugaaacaagaaaucaagcaggcuaaucaguucucaaaagauaaaauacaaauggccaaaauaguacguauucacuuguaaguggauauuagcugcuaggcaaaggauaauuaugcaacaaauccacagacccagaaaggcugaguaacgaggagggcucaaagaagaaugcauggcucucccugggaagggaaaauagaauagauuuuuuguagguguauuuggggcagauggagaugggaacaggaggggucaugcauggggcuauagagggagagauuacuguaggaguuagagggcucaaagacaccauuggaacaugauccacagaaucaacuaagcauggcucauagggguucacaaaaaaugaagggguucaccaaaacaaaaaaaaaucacuggauucuguaugggucagagcucgguccucuacauauacauuaugguuguguaucuugucauucuugugagacuucuaacagugggaguaagugugucucucagucuuuugccugaucuuuggaccccuuuccuccuacuagguugcuucaucaagccuugauaugaggguucgugccuagucuuauuguaaauuguuuuucuauguacaguugauaucccugaggccugcuauucugugaagagaaacagaggaggcuuaggucuggggaggaggggagguagaggguacuggaaggaguagagggagaggaaacugagguuagaugggaggcagagggccggagggaccugaaugagagaggggagggggaaggaaaaaggggguaggaucaaguaucaggggagacaggagaggaucccagagauccaggagaaugaauggaaauaugcagcaauguagggugagggaugggggaaccacuagaaagucccagacaccagggauguaugugggaggcucucaggacucaaugggggugacauuacccgaaaugccaaagggggaugggagauggaaccugaagagaccacccccagcagguagacauggcucccauuugaggcagugggccacccaccaaucuucaaaauuuuugacccagaauuguuccugucuaaaggaaaugcagggacaaaaauggagcagagacugaaggaaaggcugccagugacugacccaacuugggauccaucccaugcauaggcaacaaacccugaaacccugacaauauuacuaaugccauuguccuugaagacagaagcuuagcauggcuguccugagaggcucucccagcagcugacugacugagacagaggcagauacagccaaucauugcacugaggacauggaccucuauggaagaguuaggggaagaacugaaggagcugaaggggauugcaacccuguaagaauuagaacaauaucaacuaacccagaccucucagaacuccuagagacuaagccuacuaccaaagagcauacaugggcugguuugcagcccccaggacauauguagcagaaggcugccuugucuggccucagugggaaaggaugcaccuaauccuguagagacuagauaccacagcgaagggggaugcuggggugagguuggguggggaacacccucucagaggcaaaagauuugaagaggggguuaagaaaucugggaggagaaccuggaagggggcaacauuuggaauguaacuaaauugaauaauuaaauaauaaaagaagaauuauaaaaaaauuaauaaauaaauaaauuaaaaaaugaaguuguucugggagacuucucuuauaguguaugaucacagagaggccucucaacucucuuucuugugcauugauuaauaauaacaauaguaauaaaauaauaacaacaacaaaauauccaaucuaaauagccuucagagaaauaaaaaauaaaguucuaucagaaauucauuaaaauacaacaacaaaugcuggcaaggguggggacaaaaaggaacucauaaacacuuugggugggaauguaaacuaguccaaccucuauggaaguuagcauggagguuccuugagaaucuaaaaauagaugucccauauaacucaacuauuccauguggugauuugaauagguuugcaccccccacccccauaggcucauguguuugaaugcuuggccuauagggaguagcacaauuaggaggugugaccuuguuggaauggguauggccuuguugaaggaagugugucacuguagaggugggcuuugagguaucauauauaagcucaagguggaaucagagucuucuccuggcugccugaagaagauaaucuccucuuagcugccuuuggaucuagauauagaacucuugacuccuccagcaccauggcugccuguacggugcuaugcuucccaccaucaugaugaugauuuaaaccucugaaaccauaagucagucccaauuaaauguuugccucuauaagagauacuuggucauggugucucuucacagcaauggaaacccuaacugagacauucuacuggaauuuguccacggaacuccaagccagcauaucauuugaauaucaacauuuauuguauuacuguuuacuauaacuaaguuacuaaacuaccaacaugucuauuaauaggggaguggguaaauaaaauguggaauauaagugcaauagacauuuuuuucaaccauaaagaacaaagucauacucuuugugcggaaaauggauacagcuagagaucuucuucauauuaaguguacuauuaagacacuucagacaauuucagaaagacaaacauugcacacguucucacaguuuguuccuugaguauauagauacacaaaauucugauaauuuaacauuuuauugaauuaauuuuauuauauuuguuuauuuaugugagugaacacaugcauugcacaaucacacguagaaguuggaacauagcuuuuagcagucaguucucuccuuuuguguggguuccaaguauugaacucaguugaacuaacucaguauuguaggcucaguagcauguauguuugccaacugaacaaucucacugccccccaaaacaaauaaaaaacacccugauacuuuuuaacaauauaaucauggaguguuuauauaagagguauuuagagaucgucuaauuuauuuucucaauguuacagaugaguuauuuaauccugcugaagacagaugaacaagauuuuauaggacuuucugaaauuuuacuuguuuggagccucuagaauaacuguucuacauucuucaaaaaaugcuuucaauauuuaaaauugccuuuuguuauuccucuaaacuuuucucccaugcuaagcacccugagguuuucauuauuauuauuauuccuuuuuaauaugaauuauuuucaggcuggaccauucuggacagccaucuugauacccaguucugauuaauuauuuccuuauuuaaauugcaguaugcaaaacuaacauccauaugcuucauauauugcuuauacagcuuaagucacuuauuaagagauuucucuaguaauguuaguauagacugcugaugcuauagacuguccugcucugugacucuuucucuuucuuaucaucauuauuuuaaacagcagguauaucugaaucauaguucugaacacugauuuaauaauuguuuucuuuagcauggauugcuaaugucaugauuagucuauuuucuuagacacugguuuauuggaaaaaaugagaugggagguaaaauuguauacacauuuuaauucuucuagcuauauugauugauuaaauuacuuuuuaauuuuuuuaaauuuuuuuuccuuauuuuaaaaauauuuuuauuacauauuuuccucaauuacauuuccaaugcuaucccaaaagucccccauacccuggccccacuccccuacccacccauucccucuuuuuggcccugguguuccccuguacuggggcauauaaaguuugcauguccaaugggccucucuuuccaaugaugggcgaauacgccaucuuuugauacauaugcagcuagagucaagagcuccaggguacugguuaguucauaauguuguugcaccuauaggguugcagaucucuuuaacuccuuggacacuuucucuagcuccuccauugggggcccugugagccauccaauagcugacugugagcauccacuuauguguuugcuaggccccggccuagucucacaagagacagcuauaucaggguccuuucagcaaacgcuugcuaguguaugcaaugguaucaucguuuggaggcuaauuaugggauggaucccuggauauggcagucucuagaugguccauccuuuugucucagcuccaaacauugucucuguaacuccuuccauggguguuuuguucccaauucuaagaaggggcaaaguguccacacuuuggucuucguucuucuucaauuucauguguuuugcaaauuguaucuuauaucuuggguauacuaaguuucuggguuaauauccacuuaucagugaguacauaucaugugaguucuuuugugauuguauuaccucacucaggaugaugcccuccagguccaaccauuugccuaagaauuucauaaauucauucuuuuuaauagcugaguaguacuucauuguguaaauguaccacauuuucuguauccauuccucuguugaggagcaucuggguucuuuccagcuucuggcuauuauaaauaaggcugcuaugaacauaguggagcauauguccuucuuaccaguugggacaucuucuggauauaugcccaggagagguauugugggauccuccgguaguacuauguccaauuuucugaggaaccaccagacugauuuccagaaugguuguacaagcuugcaaucccaccaacaauggaggaguguuccucuuucuccacauccuuaccagcaucugcugucaccugaauuuuugaucuuagccauucugacuggugugagauggaauaucaggguuguuuugauuugcauuucucugaugauuaaggaugcugaacauuuuuucaggugcuucucagccauucgguauugcucaggugagaauucuuuguuuagcucugagccccauuuuuuaacgagguuauuugauuuuucuagaguccaccuucuugaguucuuuauauauauuggauauuaguccccuaucugauuuaggauaguuaaagauccuuucccaaucuguugguggucuuuuugucuuauugacggugucuuuugccuugcagaagcuuugcaguuucaugaggacccauuugucaauucucgaucuuacaacacaagccauugauguuccauucaggaauuuuucaccugugcucauaucuucgaggcuuuucccccacuuucuccucuauaaguuucagugucucugguuuuaugugaaguuccuugauccacuuagauuugaccuuagaacaaggagauaggaauggauugauucacauucuucuaaaugauaaccgccaguugagccagcagcauuuguugaaaaugcugucuuucuuccacuggaugguuuuagcucccuugucgaagaucaagugaccaugggcguguggguucauuucugggucuucaauucuauuccauuggucuacuugucugucacuauaccaguaccaugcaguuuuuaucacaauugcucuguaauaaagcuuuaggucaggcauggugauuccaccauagguucuuuuuccuugagaagaguuuuugcuauccuagguuuuuuuguuauuccagaugaauuugcagauugcucuuucuaauucguugaagaauugaguuggaauuuugauggggauugcauugaaucuguagauugcuuuuggcaagauaaccauuuuuacaauguugauucugccaaucuaugagcaugggagaucuuuccaucuucugagaucuucuuuaauuucuuucuucagagacuugaaguucuuaucauacagaucuuucacuuccuuaguuagcgacacgccaaaauauuuuauauuauuugugacuauugagaaggguguucuuucccuaauuuauuucucagccuguuuauucuuuguguagcgaaaggccauugacuuguuugaguuaauuuuauauccagcuacuucaccgaagcuguuuaucagguuuaggaguucucugguggaauuuuuagggucacuuauauauacuaucauaucaucugcaaaaagugauauuuugacuucaucuuuuccaauuuguauccucuugaucuccuuuuguugucgaagugcucuggcuaggacuucaaguacuauguugaauagguaggagaaauugugcagccuugucuagucccugauuuuagugggauugcuuccagcuucucacuauuuucuuugauguuggcuacagguuugcuguagauugcuuuuaucauguuuagguaugggccuugaauuccugaucuuuccaagacuuuuaucaucaauggguguuguaucuuguugaaugcuuuuuccucaucuaacgaguugaucaugugguuuuugucuuugaguuuguuuauauaauggauuacuuugauggauuuccguauauuaaaccaucccugcauccaugaaauaaaaccuacuuggucaggauggaugauugcuuuaauguguucuuggauuugguuagugaaaauuuuauuaaguauuuuugcaucgauauuuauaagggaaauuugucugaaguuuucuaucuuuguuggaucuuucugugguuuagguaucagaguaauuguggcuucacagaaugaguuggguagaguaccuucuacuucuauuuuguggaauaguuugugcagaacuggaauuagaucuucuuugaaugucugauagaacucugcacuaaacccaucugguccugggcuuuuuuuggcugggggacuauuaaugacugcuucuauuucuuuaggggauaugggacuguuuagaugguuaacuugauccugauuuaacuuugguaccuuguaucugucuagaaauuuguccauuucguccagguuuuccaguuuuguugaguauagccuuuuguagaaggaucuaaugguguuuuggauuucuucaggaucuguuguuaugacuccccuuucauuucugauuuuauuaauuaggaugcugucccuguguccucuagugagucuagguaaggguuuaucuaucuuguugguuuucucaaagaaccaacuccucguuugguuaauucuuugaauaguucuucuuguuuccacuugguugauuuugccccugaguuugauuauuuccugcugucuacuccucuuaggugaauuuucuuccuuuuguucuagagcuuuuagauguguugucaagcugcuagugugugcucucucuaguuucuuuuuggagguacucagagcuaugaguuucccucuuagaaaugcuuucauugugucccauagguuuggguauguuguggcuucauuucauuaaacucuaaaaagucuuuaauuucuuucuuuauuccuuccuugaccaagguaucuuugagaagaguguuguucaguuuccacgugaauguuggcuuuccauuauuuauguuguuauugaaaaucagccuuaguccaugguggucugauaggaugcaugggacguuuucaauauuuuuguaucuguugaggccuguuuugugaccaauuauauggucaauuuuggagaaggucccgugaggugcugagaagaaguuauauccuuuuguuuuaggauaaaauguucuguagauaucuguuaaguccauuuguuucauaacuucuguuagguucacugugucccuguuuaguuucuguuuccaugaucugcccauugaugaaagugguguguugaagucucccacuauuauugugugaggugcaauguguucuuuuagcuuuacuaaagugucuuuaaugaauguggcugcccuugcauuuggagcauauauauucauaauuaagaguuccucuuggaggauuuuaccuuugaugaguaugaagugucccuccuugucuuuuuuugauaacuuuggguuggaagucgauuuuauucgauauuugaaaggcuacuccagcuuguuucuucagaccauuugcuuggaaaacuguuuuccagccuuucacucugagguagugucugucuuuuucccugagauggguuuccuguaagcagcagaauguuggguccuguuuguguagccagucuguuagucuaugucuuuuuauuggggaauugaguccauugauauuaagugauauuaaggaaaaguaauuguugcuuccuauuuuuuguuuguuuguuuguuuuuagaguugucauucugucuuugcggcugucuucuuuuugguuuguugagggauuacuuucuuccuuuuucuagggcgugauuuccauccuuuuauuuuuuuuucuguuauuauccuuugaugggcuggauucguggaaagauaaugugugaauaugguuuuguuguggaauacuuggucuccgccuaugguaauugagaguuuggccagguauaguagucugggcaggcauuuguguucucuuagugucuguaaaacaucuguccaggcucuucuggcuuucauagucucuggugaaaagucugguguaauucugauaggccugccuuuauauguuacuugaccuuacuuucuuauugcuuuuaauauucucucuuuauuuauugcauuuguuguucugauuauuauguuucaggaggaauuucuuuucugguccagucuauuuggaguucuguaggcgucuuuuauguucaugggcaugucauucuuuagguuugggaaguuuucuucuauaacuuuguugaagauauuugcucgcccuuuaaguugaaaaucuucauucucaucuacuccuauuaucaguagguuuggucuucucauuguguccuguauuuccuggauguuuugaguuaggaucuuuuugcuuuuuguauuuucuuugauuguugugccgauguucucuauggaaucuucugcaccugagauucucucuuccaucucuuguauucuguugcuggugguuccagauuucuuuccuaggguuucuaucuccgguguugccucacuuuggguuuucuuuauugugucuacuucccuuuuuaugucuuggaugguuuuauucaauuacaucaccuguuuggucguguuuuccugcaauucuuuaaggaauuuuuguguuuccucuuuaaggucuucuaccuguuuagcuguguucuccuguauuucuuuaagugaguuauuaacguccuucuugauguccucuacuaucaucaugagauaugcuuuuaaauccgggucuagcuuuucggguguguuggggugcgcaggucuagguggcgugggagugcuguguucugaagaugaugaguggucuugauuucuguuaguaggauucuuaccuuugccuuucaccaucugguaaucucugaagcuaguuguuauaguugucucugguuagagcuuguuccucaggugaauaaguuagccucuaucagcagaccugggagacuagaucucuccuuaguuucaguggucagaguacucucuucaggcaagcucuccucuugcagggaagguacccagauaucugguguucgaaccugccuccuggcagaaguuguguuccacucaucagaggucuuaggaucccaugggggauccuauguggguccuugagggugucuggagacuccaagggcaaggaacccuggugcuggaguggaccggaagggacuugugccccugaucaggccgaguuaucugcuuccuuaauuaaugcaaucucaggucccgcacgauuggauuggagcagaugcuguguuccacucaucagaggucuuaagaucccacgggggauccuguguggguccuugcgaguguccggagacucugcgggcaaggccccccagugcuggaguggaccggaaggaacuugugauugauuaaauuacaaguaccaacauuuuccacauuuguuauucaaauuuuuuugagguagacuagcuuguaugccauugacaucaaauaagagugcagagcuaaucauuaccugaaaccuaggugaugaaaggcuuuauucuccaaguagugacccucugacucacauaagaaugaccuaauauggaagucaagagcauguuguuuucucacauuaugcucuuuuucuuaauucucagaggaagggagaagguaucuaugaaaggagguguaagagacaggcaagcucaccagagacuguuacagaaaaauaaaaacugcagcauggagacaggaucaguuuuuacuguacuauuguuacuuguccuuuaggaggauuuuuuaguggagaaaucuugaagacuagaggaaacaugcuaaguuaggacuuuaaaugaugucccaauuaucuugucacauuaauggucaaaaugcaaauuaauauuuauauauuuauauauuguuauuuacaaaucuuugcccuugacaaaucucaguucuguagaauauucuccugucugucuauuuccuuauaugugagaucaagauuagaauauagagauuguuuuguagcuuccacauuaucuucuaggggagucuguuucuacuuaguucuuuaaacugcucuuaggacuucauguacuaauuuguguaaauugugcuuaccuuuguucuuuauguccccuacuguauuauaaucuauuucaggucagugucuagcuauauuuuaucuucguuacauccauagcuuaugaauuuuuaaaacuuaaauauucauuacaaucauuuuagugacuuucucuaaguuaugaauuuauauauuuuuugauuguacagugagaauuuuauuuaagcaaauacuugaacaaggaccaaguagaaaaaaaugaaagaacagaacaaaguaaguauaccugacauaagagcugaauuaguaaauguaagaaaugaaaaauuauaugaauacuuuaaaauuuaaguagaaaaguauccgugacuauuuuaagaagugugaggaugaggacugaaggauaugauuucaagauaagugaaaaauggcuuaauuaaggacuguagcgguacuggaaaggaucaaaauuagaaaagagaagacagugagaagucaguguaaaagagcauucaggacauaugacuguaaaaucccuaaugauggcuggguaaguuugugcaugcucguaauucugcacuuuagcagcugagacaggaauaucuugaguucaaagccagcaagacccuuucucaaaaaacaaaacaaaacaaaacaaaauaaaauucgacccugucucagaaaauaaaaaccucaguacuuaauuaguagcagagaaaucacagggaaccauagugguuaagcacacaugucagaguagcugagcucugccacuuucuagguguuugaaauugaucagauuaguuuucuuugccuuucauucccuguuuaagagaaugggauuaauagugccuuucccaggaucuguuccacagaucagaugaggagaugcaugucaguguaaugguguaaacauuuagaaauuagcuguugcaguuucaguuguaucuucaaguuuauuuucaguagggaacugaauuaaguuugauucaauaauuaagugauaauguauguauaacaauuuauaguguuuuccaaucgaguauaucauuuggucccuaugucacuuuaacucaccagaaccauccuuuggugguuugacugguuugggcaucugugcagaagagcuguuagucuagaguuuaaaugguuaagcagccagagaaggagaguugggauuaccaauccucucaccuuuguuguuuuccacccucucauuuccuuuccacaaucauuuuguuuggauagagguaaacuuuagucaaaaugcuuaccagaguaugagacauagucacuuugucuuuucuuccuauuucugucacccacacacaguguuuugagcagcacuaauauggagcaauguuuuagaauuuaugugcggaguguugucuuugagguuuggauuaaaagcaucagugaaaccaaaggaaaguaaucaggcacauaauugagcagguggaacaaauuuguuaacuuugcuuugggaaaacaauaacuguuuuuuaaguauuaaaucaaccuuagguuccaugauccuuaauaagaaugggaacaagggagaugauaaugcauugguuucugaagacaucagagacuguaagccuugcaucuaauaugguugauuccaauugggggaggguguggacaggggaugcuugucauuggcucuucuauaaugcagauguuucuucaagagaaauauuuaucuugugcguguugucaugagauauuuuuaagauaucauaaaacaaggaauuugaaguauaagcucaaaauguaaugugcuacauagaugaacauaauuucuuuuaaguauugaucuuuaaaacugagcuggacaaauauauuuagcauaggauuuuuauuugaaaagauugauuuuucacuuccguucuuuuaaaagaagagacuuaaaacaucagagaaucuuugaauuagaacagacacaaaggucauccaccucacguccuugcugucuuugugaaucagcuuugcuugucaucauccuaaacuugaaaugugucaguaauggagaacuugaccucaccagagauaaugcaugucauuuguaggcugauuuaguuguuauaaaauaucuuucuuauuaaauucuacaggcauaaauugucuuccauaugacggccaaugacuagaacuccccucaauuuucucuaaccccacccucaagccuaagcauguuauuucuacuguuccuuuauugcuuugaaucuguauauuuaugcauccucucaacugugagcuccuugagggcacgggccacaucauaucuucgaaugugucugguauguaaaaggguuuuugaauggagaacaacauaguauucaacuccuucacuguucaagcuacucuuguuuguucucugacuugccugacauuaaauaaauauuuauuaaaugucuuaugguaugagacacugccagcauuuagcuauacagcaguuaaagauauaugggcuucaaguauuagauauaaacaagaaaagggcaaugcaaaacgaggugauuaggaugugguaguauccuauguacauuaggauguauauauuauauaguuuccaauuuuguuguuaaaauaaggaacuauucuaagugugcuuugacuaguacuacuuaacauauauuuuacuuggauucauaucugcuuaaugugguuuuaggugauaauugcuucuaaauacuaguacauuauuguuuaaucauucaguaagaaucuauuuagcuucuaucauguaugaugagcugaaucagguauugaagcuauaacaauuauuagaaauagauacacuaguaagcuaaugaaagaaauucucaaaacaguuuaacuaauuuuguauucuguucucuaacgagacuucuguauuauauguauuugcauauuauacauauacaucuaagcaaaaucaacuuguauuugucuuugcuuaagacaaacacaaaguuuuguuccauacuauaauucugaugugagcugagguguaggaggaugggcugggaagaaaccaacaaacaacagcuucauaugcaguacaucuagaauuugucagcuggaagcaaauacaaaagaugaaggaacagaaguguggaguggcugcucuguuguuaucccauuuaagugguuagaaaggauucagagaaaaauagcaucuguaggaaauggguaaagccauguagacaguuaagagauacagcuauauggagaaaagugugcaaaggucuuaagucuagaauguguucgauguguuuggggaauccugcaacagaagcugugauaagaaaugaaauuugaugucauggugauuuguugaguguucuauuaagucauaauuuucuuuuuuaaauuucuuuuuuauuagauauuuucuuuauuuacauuucaaaugguauucccuuuccuuguuuccccucugaaaaaaacccucccucuaucuccucgccccucccccuacucaccagcccacccacuccagauuccuggcauucccacacacuggggaauagaaccuucacaggaccaagggccucuccucccauugaugacugacuaggccauucucugcuacauaugcagcuggagccgugagucccaucauauguacucuaugguugguggguuagucccugagagcucuugggguacugguugguucauauuguuuuuccuccucugaggcugcagacuccuucagcuccuuggguccuuucucuagcuccuucauuggggacucugugaucaguccaauggaugacugugagcauccacuucuggauuugucagacacuagcagagccucucaggagacagguauaccaggcucuuguccgcaagcacuuuuuagcaucuacaauagugucuggguuagguaacucuauaugggaaggauccccagguuggacagucucugaguggccuuuccuucagucucugcuccacacuuuuuuucuguaacuccucccaaggguauuuuguuccccuuucugaguaagacagaaauauucacacuugguuucuccuucuucuugagcuucauguggucugugaauuguaucuuggguauuccaagcuucugagcuacuauccacuuaucagugagugaauaccauguguguucuuuugugauuggguuaccucacucaggaugauguuuuguaguuccaucaauuugccuaagacuuucauaaauucauuguuuuuaauagcugaguaguacuccauuguguaaauauaccacauuuucggaauucauuccucuguugagguacaucuggguucuuuccagcuucuagcuauuuuagauaaggcugcuaugaacauaguagagcauguguccuuauaaccaguaggagcuaagacgaaaaggaugggccauccagagaguuggagcaucuucuggguauaugcccaggagugguauagcugagucuuccgguaguacuauauccaauuuucugaggaaccgccaaacugauuuccagagugguuguaccagcuugcaaucccaucagcaauggaggaguguucgucuuucuccacauccuugccaacaucugcugucaccugaguuuuugaucuuagccauugugacugguaugagauggaaucucaggguuguuuugauuugcauuucucugaugacuaaggauguugaacaucucuuuuuuuuaguuuuuuuuuaauuagguauuuuccucguuuacacuuucaaugcuaucccaaaggucccccauacccacccacccccaauccccuacccacccacucccccuuuuuggcccuggcguuccccuguacuggggcauauaaaguuugcaaguccaaugggccucucuuugcagugauggccgacuaggccaucuuuugauacauaugcagcuaaagacaagagcucccagguacugguuaguucauauuguuguuccaccuauaggguugcaguucccuuuagcuccuuggguaauuuuucuagcuccuccauugggggccgugugacccauccaauagcugacugugaucauccacuucuguguuuccuaggccccggcauagucucacaagagagagcuauaucuggguccuuucagcaaaaucuugcuaguguaugcaauggugucagcauuuggaagcugauuaugggauggaucccugcauauggcagucacuagaugguccauccuuuugucacagcuccaaauuuugucucuguaacuccuucuauggguguuuuguucccauuucuaagaaaggguaaaguguccacacuuuggucuucguucuucuugaauuucaugcguuuggcaaguuguaucuuauaucuuggguauccuaaguuucugggcuaauauccacuuaucaaugaguacauauugugcgaguuccuuugugauuggguuacuucacucaggaugauacccuccagguccauccauuugccuaggaauuucauaaauucauuuuuuuaauagcugaguaguauuccauuguguaaauguaccacauuuucuguauccauuccucuguugaggggcaucuggguucuuuccagcuucuggcuauuauaaauaaggcugcuaugaacauaguggagcauguguccuucuuaccgguugggacaucuucuggaacauuucuuuagguaugcugcuauaucuacucauuuguauuuugaccuuuguaaaggguuuuaauuuuaauuuguauuccagauuuuauugcauuguauuacagccaauguaguaugcuaaucuuuacaucuaguaauccuaauguuaauguuguaauuuggaccuuuaccauucuucaaauucucauaucuugaaggauuggucucaagcacuauugggaaaugauauaacuuuuugguggugaagccuaguggaaguaaaugaaaugauuaagagaguguccuugaauagauuuuuagaccaauggcuccccacuccuugccagcucccugcugucaugaggugaggagauuuacucuacuguguacaucuggccauaauaaucugccacauuuuaggccuacaaacaguaggguaagcaacaguauguuaaaauuuugaaauuaugagacaaaauuaauauuuucuucuuuuaaauuauuucuuucagguaguuugucugaggaagggaaagaugauuaauauaaguagcuaccccuuuuucauuuaggccauaugcagguuuagucaaugugacuuuguuugcuauauaagucauuaauagaaaucuugaaaagggugaacuucucuuguuuggaaauuaaauuuacauuuaaucuggaaaucauuauuuggaauaugcuuuuugaaauaccacuuuucucagcuucaauggagcagauuaauuuuuauucuuucuguaaguguauuaugaaaaccuaccaaauauauuccuaaaaucaagaaauaaaaacauaacuuuuacuugguaacuuuuaugacaaagaggaagaaaggagcaaaagaacuccaccauuugcuauugguuguuuuguugaacuuugucauucuuggcaacuuggguaagaugaaauaucaauuuguaauuugcauuucccuguuaauacaggaaaaaucuccagaagcuugugagccagcuagccuggcagauguaguggcaaaaaggaaggaaggaagggagggagggagggagggagggagggagggagggagggagggagggagggagggagggaggggaggggaggggaggggagggagggaggaagaaaggaaggaaggaaggaagacaggaaggagggaggaaaggaagacaggaaggaaggaagacaggaaggaaggaagacaggaaagagggaggaauagucccuguuagggacuaugaacaacauuugagauauuucuuagacauuuuuuucucuuguuuugaaaaaaacucugcuccuuucuuaggucaaugcuuugaaggaguuugguuuuuugaguucuucauauacucuggauauuaauccuuugucagauguaaagcuggcaaaaauucugugccauucaguguguuuccucaucacgcuauuaauuguuccuuuggcuuuguagaagcuuuuuaguuuuaugaagucauacuugccaauuguuggccuuaauucucugguaaauggaguccuauucaaaagguccauuguuacgccucuauugcauagguacugucuuuguuuucuucuagcaguuucaguguuucacagucagguugcugauccauuuggaguuuuuguaugagaugauagauauguguauaacuucuuucuucugcaggcagacauccaggguuuucagcacuauuuuuuuaaagaugcuuucuuuugaccaguauauguuuuaggcauaugucaaauauuaaauggcuaaaauuauauguacucauguuuuggucuuuugauuuuguuaauuggucuacaugcuuauuuuuguguugauacuauauuauuuuuauuaaaaugguuccuuaauauauuuuaaggucuagaauuguaguccuucuggaauuguucucuuuugucuguguuauuuuggcuaucuuggguauuuugugguucuauauggauuuaugacaguuuuuuucuauauugugaugagauggguguuuugauuaauaauauauauaaauaguuuuuguaauauggcuauuuuaacaauauuaauucuaccuagcugugagaaaaggaugucuuuccauuuucugguguuuuuuuuuuuuucuauuucuuucuucagaaguuugaacuuuucauuguagaugucuuccacuuccuugguuauguuuauuccuagauguugucuuuucuuuuaggcuauugugaaugggaugcuauccaugaucccugcaucuugguugcugguguauaggaagcuauuuauuuguccuguugauucuauauccugccccauugcugauuuuuuaaaaauaauuucuagagggauaaaaugguaucaaaaagauagcauuuugguucugauagaauuuugggaaucucucacauaugacauaucaucugcaaguagaaagaguuugacuucuuuccguauuugaaucccuuuaguuuucuucuuugucuuacugcucaagcauaauacugaaaggaagugggaguggggauacuggacaucccuuuucuaguuccugacuuugguaggauugcuucaagaugugaucauuuaggaugaugauaucugugggcuucucuuuauauagcuuuuguuaugcugaggacuguucucuguaguccuuuauucucuaggauuuuuaucaugaagacaugauagguuuugucaaggacuuuuuucugccuugaugaucauaugauuuuuuuucuuugugcucauuaauguguuuuauuuacauauauugacuugcauuuguugaagcaucccuguauuuucauggauaaggccaacuuuccuaugguggauaaucauguugaugcauccuuuuuugaguauuuuguuaagcccuuuugaaucuauguucaucagagaucuuguccuguaauuuuuuuguuguguuuuuuuuuuuuauuagcgugacuagcuucauagaagggauuuaggagugcuucuuuuguuucuauuuuuaaaaauaguuuaagaaguauuggcuguaaaucuuuguuguuuugaaagaauucugcucugaguucaucuggaccuggcuuuucuuuaguuggagaauuuuuuauuuucauuuccauuuccacauuuauuauggaucaguuuagguuguugaauuauucuugauuuaauuuuggucguuuggcuguaucuagaaauuuauccacuucuuuuagguuucuaaucuaauggaguagaguuuuuaaaacaauauuccccaucaauauucugaauuucuuuggugucuguuguaauguuuuaucuuucacuuuaauucuguuaguucucuuucuuucuuugguuaguuggccugagguugugucaaucugcuuuaucuucucaaagaaccggcucuuagaucccuugguucuuuguauuauuuucuuugcuucuauuuuguucauuucuucuccaucuuuuauuauuccuugcagaugaguggguuuggauauuguuuuccuuacuguccauguuuuugaauuauaucauuaagcuauuuuuuucacuccuucugacuuuucaauguggacacuuaggccuacaaauaaaccuuuuaggucuccuuucaauguguucaacaaguuuggcucuguuguguuuucauuuucauuuuauuccagaucauuuuuuucaacucuucauuucuuuuuaucaauucacuauucagugaugaguuguuuaagcuucaugaguuuguguauuuacuggaaauuccuuuguuaucaauuguacauuuuauugcguaguguucagauaguauccaaggaauuauuucaauauuuuuuaauuuauaaaaguauguuuuguaucccaagauauggccuguuuuagagaagcuucuaugugcugcugagaaguaugugcauuuuggggugcuggagugcaauauucuauagauaucuaucaaguucauuugcuauaugaugccauuuauuucugauguuucaguguuuaguuuuuuuucuccagaugaccugucuaauggauaaauggauguuuaaaucaugugcuauuauuaauagauugaugcuaauuugugucuuuaaauaaauauuguuuuuuuaaaugaaaucuaagugccccagaguuugguguguguacauacauauauauauauguacacacacacacacacacacacacauauauauauauauauauauauauauauauauauauauauauauauauauauauaugcuuaaauugaauugaaaauuuuugaugcaguuuacgauuauuuuuuaacuuccauauucuaggauucauuuagguaauaucauugacagucauuuuuucuggauugguagauauuggagagaagauaugggcuugaucguucauguuguuucuauuuuugugaugagaucugggcauuugaacuuuuuuuuuuuuuuuuugcuaguuuugugucauaugaagaaagcaguuugguccugaggagaggauguuugaguagguuggcucuagagguuuauaaugacuuagaaggaaugaaauuguguggacacaggagacagguguguaggaugugcuuccuauuucaagccuggaguguugguagauauagaucuggguuugggagaguguacauagaggggaauaucaggcauaaucacuagauuaggcccuggagagggacuuguaguaucuuggcugggucaugugcaugugugagugaguauguauguauguauguauguauguauguauguauguauguauuuuuccugaaacuuguguguuaauuuuguaucuuuccacuuuucaggaaaugucagcucuaacaauuuucugauggaguguuuagguucucuuauguauacaaucauaucauuuguaaauaaggauacuuuaacuucuucccuucuuguuaguaucuccuuuauuucuuuccucugucauguugcuauaguagacuucuagcacuauacugaauaguaauagagagacucuacaccuuuguauucaaccugaucuuaguagaauugccuuugaauuuuucuccauuuagcauaaucuggcuauaaauuuucuguaauuaucuuauuauauugccucuauuucuugaauuuuuagggcuuuuaucauaaagagauguuggauuuugccaaaggccuuuucugcaccuauugagauuauccugugacuucuggccuuaagaccauuuaugugauguauuauauuuauuuauuugcagauguugaaccaucccugcaucucuggaaugaagccaacuugaucaugcugaaugauuuucucuugauguaaucuugaauuugguuugcaaguauuuuauugagaacuuuuuuccucuauguuccuuaaggaaaauuagcuuuugcauuuuugguugugucuuuaucugguuuuaauaacaaaauaauucuggcuuuguuggaagaguucucuacuauuccuucuccuuuauguuauggauucauuugaggaguauuaguguuagcucuucuuaaaguuggguagaauaagcaguuaauuuaucugggccuacauuuugguaggugaaagaucuuuuuaaauuacuauuucagccaaguuguuuuuuauagaucuacuaaaauuauuuagcucauuuggcuuaacuuugguaggucauaugcaucagaaauacacccauuuccuuuauguuuuccaauauaaugaaauacaaguuuuuaaggugcaugcuuaugauuuucugaauuucacugacaucuauuguaaucucucccuuguuucuaauuuaauuaaugauuaauuugggucuuugauuucucuauuaguuugucuuugucuuugccuaucuugucuaucuuauuaaaguguauauagacuuuuugugucauugauuuugagcccguuuuuacccuuguuucuaucauuuauuucugcccugauaugacucauuuauuucuacauacugauuuugaguuuuguuuauucauauucuucuaaguaccuuagauguagcauuaaguuaucuguucaaggucucugugguuuuuaacuuauagauacuuauagcugggaacuuuccuuucagaacugcuuucauuguaucccauugguuuuggucuauuguauuuucauuauaauucaugucuagaaaauuugaucuucuguuugauuucuucaguggccuagucauuauuuuguaauguguuuuccauucuauagaaguuuguguauauucugaaguuucucuugcuguugauuuuuagcuuuauuccauuguaguagauaggauaccugaaguuauuucaauuuuacuguuuguagagacuugccuuguauaguaauguuugaucuauuuuagauaaaguggauggaauacugaaaagaauguguauuucagaauuugaaaagaauguucuauaaauaacuauuaacucuugacguuucucuguuuacuuuuuguugggauggccuguuucuuggugagaguaggauaauauccuuacccucuauuacugcuuuuauauuuguuucaugaaauaggguauauccauguccaauguauaggguauauccauguaggcuuagauuguaauaucuuauguguggauggauugucccuuuugucaauaugaggagaccuucuuuauuucuguugaguaauucugauuugaaguuuguuuuguuauauaucagaacagcaacauuuaucuuaaucuuaguuccauuuucuuagcauauccuuuguuuuacuuuuuucacacuggaguaauagcuuucuuuaacagcuagguguguuucuuaacagaagugcucucaaucuucuuuugucuagguccucuauuuuaucaucaagcccugauguugcuuuuuacuugauguauuguucaacuuauaaugcuuuccccugaaucuuguaauuagccuguugaguuuuuuaaguccauuuucauuucagggcaaguucuuuuaaauguuucugcuuguuggguucguuuuuuaaauccugaacuaccuuugcuuuuucauuuagccuuauauuuguguuuucuuuaaguucauuguuugguuuuugucuuauuuaaacucccugauuauucaaugacauuuaugauugauuguucaagaucuguguccuagaguuuaugaagguaguuaucguuggagaacaauuuuuagguuuaguggaacuggggagagagaguaauauuuugauauuucauguuauuuuuuguuuuugugaugaaaccugggcaacuggaugucuuugauugauugucugauguggacacaguugugcauggcaguugggaaugguauggaugggguuccucaaauugcagugggacauuggguuuaggaacugggugccaucugaagacugggauauguaaaccuccaagacauaacuuugugugugucuaauccuacauuuaauucuaucagccucuggguuuuguauguuugaauucugcuguuuguuacacauacaguuagggcauugucuuuuauuacuuucuaaguugucuuuauuuugaaguucauuuuaucuuauaucaauauagccauuuuucuauuaaaauguuaauguacuggacaaccaguugguauguucuuagcugucuagugccaaacagucagcccuaaaaccauauguacauaacauuaugugguuuaaaaugguacauuaaggaauauauguauaugcauauauacauguauauauagucaugcaauaucaauuagugaaaaaaagaggacaugaauugggaggagaguggggagggguacauaagaguauuuggauggaguaaagagaagagagagaugguguaauuucaaaaauaaaauuuaaaaaaauacuuaaaauguaaaauuagucaccaaaaauguucauguaguauucuuuccgaacaauuuuauuuugaauuaucuauuucacuaaauuugaaauaaguuucuuauaaagaacauauauuugagcuggguguggugauacauggcucuauucacagagcuuucaacuaagcagaaggaucacaagauugugcucugcuagagcuaugcagaaaguucaguugaauaggcuacauagcgagauugugggauacaaacaaagaacugagaagucuaaugcauacauggucuuuucucuuuacccaucugccagucccugucuuuuaauuggcucauuaguacgguuuacacguaugaaaauuauugacauguagagaugcucaagugugcuauuuauuauuuuuuuuauugcugucaucaucaucuuuucugaucuuggguccucagaccuaagguuuuaucaguuagcucuuccuggucuuaaacuccaagcaagcauuucuuccuuccauuagaugggaagcagggcacugccacaaccccaggauuuuauuuaucugcuuguuuucucuaugacuauaucuccuuaugucauauguauauguauguauauaugugugugugcauguacauauugcuuuuaucaauaguuauuauaauaucuaugauacucagauauauguaugucuguguauauauaccauauauaauauaggacacauauauuuuauacacauaucauauguauauacauacauguauuauauaugcacacaucaguauauauacauauauguauauguauauauaugcaaauauauuuauaaauaccuacaaaauacauauauacacacauauguauuuauacacacauacauauacacacacauauauauguguauuauaguagucauguugcuauuaauagauuauuauauguauacauauauguauacauauucauauauacaauguguacauauguguacauauauauguauguauauauacauauaauacuagugaauugauacauuugggcaucuaauuacaacauaauauauguuguuuuucauuuuuuaauuuaaaauuuauauuuaaaguauauguuguacacacacacagacacacacauacaugugcauguguauucccuaguaugcauguggcauuagaggaugucuuguggaaguaaguucucuccuuccacuauauagauuccaaggagagaaaugucaucaaguuuguuggaaauuuuccuuacaugcugagccauuuuauaauauuuuugucuugaguauuagaugguauuauaauuuuguuuccauggauauauauucuugcugaguuuuuucuucucuauuucugguacuuuuagauuguucuuguugguuucucuuguguuucaagaaguucccuugaaugcuuuuuaaggcugguucuucuagcaauaaauccuuuuaguuucuguucaucuaaaaauguuuuacauccccuacacuccuaaaggaaauauaccagauacaaaaauccauguuugacaguuguuugcuuucacaacaugaaaaauauuguuaucccuuucccauuggccuccacucagaccaaaaauccuuagccuuuugaauuaguguucacauauagcucaauacacauuucuuuugguuuucuuuuuacaauuguuugucuuaaaauuuaagaaucuuaauuauaauguguucuggcaaggguguuuuugaauuuauacuguuuggaauucacucagcuuccuagaugcauggcuuguaccaaauuuugaaagcuuucaaguauuguuucuuugaauaugccuucagcaccuuaugcuuucccccucucauuuugaaacucuaguuauaugaauauugaauacuuuuuaaaauuucuucuuagguaucugagaccccuggcuggguaacuuuugcacuuuguccaaaaguuuacuuauucuguccuucauaauuucugcuguaguauugaauccuccaauagucuuuuaaaaauccaucauuauauuuuuauuuauauacauuuuauuaggcuuugggcucuuuuaugauguuaauaucuuuacuaagguguuuauucuuuccauuaauuucaggagaguuuuuaguuggugcugaaacauuuuuauguuagcuauuuuaaaguuuugucaaguaauucccaguagaguaugcaagcuccaauaucuuagguauacaaaguaagucucagaaugagagaagagcauuuaucucccuagcuacuuaauucuagcucuuuugugcuagugcuagagacagugugcacaucucauguugucagaggaguauuguuucauuuaggagagaaaugagcccuuccuauacugaccucuguugcuggcaucagggauucagaaacaccaggucuauuuauaaucccagaauuugggagguugaggcaggacuauugcaaguaugaggauggucugguauauaaucuguuaagacauugucuuacagaacaaacagccauuaaaacaauuguacccaccauguaugaguauucuuuuucuguguugcaagaucucuuauuguuuuccuauucccaauucagcucagccucuuguuacccaucaaaguuauuuuguuuucucugugauuagcagagaugaacagagaaaaauacugucuuacucggaguagauuuuuagaaguucuauagugccuaccuauaaucaugguuacauucaacagcuugaaggcauggcuuuuuagaaaauaaucaggaguauguguaccucucuccagacuucugcccaugucucauuauucacauuacugucuagacaguaguuugaaaaucuuagcccgcggucuuuucuauauccuggaauuuauuucauuuuauuuauuuugcuuccuucuaugaauacuucuuguacccuuuccuguccuggauuuuguuaacagaggccauauggaaauaauacaggaauugaaucauuuuuguuuuucugucuaacauuguuacugauugcaguuuggaauuccuuuuuauuaucuucaguguaucucuuccugaggcucaggucauuuggacauuuuagguguuuugcagauagaugccacucuuguaguuaucguuggauaguucuuuauacucaguccacugauuauguagauaauugcgagugucagaaaaucuuguauguggaucucaccuguagcagucucuagagcugugugguuugggguuguuaaccucggagcuuauuuccucaccuguaaaguagaagcaacacugcugcuaucaagcagaccaacuucagacuucuuauagagauuaaacaagauaauaugcauuaagcuaaguggcacaguuccuuauagagaagaagcauucuaacuguggucauacauuuuaaaaaccaaggugguagacaaauuuuacuguuguuucuuuggauaccuguuguuacuucucugugauuguauagucauaauuucaguuuugagagccuuccaguuagguuauauaaauuaaaguucucagggaagauugcauaucuuuuaaauuaugaaauaucaucuaauuacaacugacacucuuaauacagugcuggugaugauuuucuuacugaguaguaaaugcaaauauuuuacagugcagucuccauggaauugauguguagguguuaaauuagccuuucugguuaaccauccauaaauauuucaaaauacauaccuuguguggguaccuagcuugcuucuacaugcugcaaaaguuuuugcuuguuagacacuucauuaugucuuaccuguauuucuugacauauuuuaaguaaguguaugguuguaguacaucugcauuccuuuaaaaaaaaugaaguuaccagacauuuacuuugaaucuucuaaguaugcauauuauuauauuuuguacaguauauaacauguuuuaauucagguguuuauuauaacuuauugcaccuaaaauaacagcaguuucaggaaggccaaaaaaggcauuauuauuagaauaguaccagcaaccuauuucuuccaguacacuuuuccuugaguuaaagcugguaaucuuuuuaaucuugguaaauucuuuagguuucauguuugauagcuauaauucuggaaccucccaaaacuaccuuaauuagaggcauguuggaauguguuugaaauuuuucugcuguaguugaguuacuucuggcaguauuauguaaucuuaaggauaugcacuuucugcagggaaucaagcuuucuugcuagcuuuuacuuauuuuuuuaguguuccauucucaccccuggagagaauaguaauccaaauauaaacugucguuaggcuuuugcagauguuuagaacuuuaggucuugcuaacgcuaaccuuccaauguucuaccuuguuuuugaaggucagaacugcuguugcaaccaaauugaaauuucacuaaguuagacucuggcaacagaaagcuaaaugaaauaguacaaggucuaguguuuuguuucuuggugcuuugaaaugccauuguacaguagcuacauaguuggcuuucugugugauuuuuuuucaugagcugauuucuagauauaauuuuauaugggugaaaaguguucaucagucccugggaggaauaaaguauuugauuaguaguggggcuuuuaugcuauccuacagaacuauagccacaaaaacaaagaucaaacaaccucauuccuuuggcucaaacuacaacccugcuugagauguuccaugaccacugugcuuuccccguuucuuuuaggucacucauggcccaauuuguuuuuuuauuuuugaaguuucagauauauaaugacuuugaguuauuuucagccccucauuaucuucucucaucccuccuagucuugaugaaaccucagaaacccuccucuuuccgagaagggcacauccuacuuucuuugguguuuauuugucuuguugagagauugguaacguuucauuaugggugagggagaaguucaccaggcccaccuuucccaaggggauauugauugucaguaguuacugugggagaagaugacauuugcuuuaguggugcagccauugauaaacucuaguucaugcucuaguaaguaacauggcuucucuuuuaaagaggcuucaguuauauagccuaggcuguccucaaacuugugaucuucauuccucauucuccgagugcuggguuacagguaugugccacccuggguucaucacuugguauuucauagagaacaucaauucuggcuucucugugugcagaaucuuuauuuucugacugcuuccauuugugucuugcauagagaauuucuuuugucugccaagccauuuuuuucuggugucaucuugaaagagcuagaaauuuuaccuccuucauuaaacucuacuggccugacugucauggaagagacaguucccugagucauagaucauguaaacacuucucccugucaguuuauguagauguuuaguguuuuaugcugcugucuugguaucuuugugggagaguuauauuuguuuuuuuuuuuuuuuuuuagauuuuuaaaaucacaaaauaaagaagugcuuucugacuuucugguuacucauuauuagaagucaguauuuaauacauuguucuuagaugguaauauuguugggggaaaguauauaaaucacuucuaugaaaauauauaacucauccugcuuauugaacuugcuuauaggcaucagaaaugauacuuggauauucaacuuuuacauucuugcucauacaauauuuacucauaguguuuuagaagauuuauuuuacuuuucuauaaaucagucagaugauacaaagacuugaauuuaacacaguaauuuuuguaugcaugaugauguugccuuugaauuuauaagccuuugacugcaggaaacuuaaauuuuaauuguuucuuuuuuaauuuugaaaauaacuuuucaauaguuaccauaaauuucuuuuaaaaauccuuacuaaacuacuuuauuuauuuacauuagaaaauuugcccugcuuucugcucuacccugccugaguucuucaccucaucuccccugcccccaccucugagagggugcucucucacccacucacccauucccaccgcacccccaccaccaucccuuuucccuggggcaucaaguuuccacaggauuaggcucauccucugccacugaugccauacaaggcaguccucugcuauacaugugccuggggccacagaccagcccguguaugcuccuugguuuuuggcucacucccugggagcucugaggggucuggguuaguugacacuauuguucuuccuaugggguugccauccccuucaguuccuucaguccuuccucuaacucuuccauauugguccuggaccucaaucuaaugguugguuguaaguaucugucuuugucucagucaguugcugauagagucucucagagaacagccgcgccaggcuccugucuacauacacaguauagcuucaguaauaguguaaggauuuggugugcaugcaugggauggaucgcaaguuggacuagucacuggauguccuuucuuucauucucugcuccauuuuuguucuugcauuuccuuuagacaggaacaauucuagguaaaaaaucuggagauauguggguggcucucugccucaacugggacccaugucuauuuacuggagguuaacuaucugaacaaaauuuuguagaauacagauaauaccuucuacaaacagaguucugccugacuuuucuucuuuuugucauaaccuacucugagcacgaucaaacuagucauguccccugcucacuacuguacaauauuguaccuuugcuucuuucugcuuaaaggcaccugaguguuuucaaagcaaaaaggggucaaauuuccagaaaaaaaagaugauaaauugagauaagcccaacauucugugcuaugucuccuucagggcauuugccaguggaaguaguauggacaaagaaaccaagaaacuaaacccagaguggugaacgagacagaaaaugagcaagaguccaacaggcuuauaggcuuuagagauacaaaagagaguuaagagauauccugaugauccaaaccugagcuuucaaauugccagagaaaaauaacacacaaugaaaugaauugaguccaauauuuuguauucuuuucccuuggacuagcuccugauguauaagcgggagggacagcuguaaagcucagcagcuaagcagagcuuucaguaauucuguaaugcuggggagacagaaauuagaguucagagccugccaacgaguaggaacccugaauaauuauccuaauuauucaguugggauccccaaagggcuaaagucuaggaguagggaugaacuggaaaaaaauuccccacagagacuaaaguacagauuugaauuaguucaauguuggacagaauugaggugguuugucccuuccuacuugauaaaagauaaguaaaucucuagaggacaacaauaauguauugagcuuuauuaacuuuuaacauccaauauauaacaugaauaaacagucacuggguuuaccagguauauuaaucuucuaagacuggcaugacauaguacuacagacuggauaucuucaaaauucuagaggcuguguccaacuagauucagaaucuguggaagguacucuuccucauucauaguugaccauucuccuguuuguccuuacagugaagguauugcagaugucuauaaagggauuaauuccacuuaagagagucuuuauggcuaaaggacuuuuaucuacuaauaccauugcuuuucagguuacgauuucaacauggagaauacaaacauccaguaaacaacaauaaaagggaagcaaauucuggaauugaggauuauaauaauuaaaauauauugauugauacaugcauuuagcaauaaauuagcagcucaagaaaagauugacuaaucaacuggaagauaggucuguaaaaauauucugacugaagaaccaagcaaaagaguuagaaaugucacccuuucagaaaaaaaagcuugacacaacuauguaacuuuggaggauuccuugagaucaagauuucaaacagcauggaaaagaaacacugcuaacccaaucucaggaagaggaggaaauggagggggcaagggaaggagaaacgggguggagggcaaaggcacagagaguauaugugaauaugagaaaaugacagugaacccaaacaauggacuggcuuuuauagguaucccuguugggaagccguggcaaaucuacucaacuaaauuguagagagaccauagauuuacagggucagaccugggucuaccucagcuucgccuuuugcuuucuuacauuaucuuugauuugugauucucuaaauugcaguuuccucagauaugaaagaaaguucaauucucuuaaagacuuauuaugcuaaaucauugauauaaacuacaaagucacaugacauauuuuuccuuuauuuuucuuaggguguuuacauuauuuugagcugaaauuuauagauucuagagacauuaucuuuccuaauaaauguugaaaguuuuuacuccauccauuguguacuuaaugaaaacggaggggugucuacacuuaagucuaggucuuuaaauuuucugagguuaucuuuuugcuguguuaaucuuaguuuuggauguguuaaguacuuaauuucauugaauauuguuuucuuuucuuguuguaaauauaauuaaaucauuucccccuuacauuucugaccuccaaacucucucauauacucuuucaaagucaucuccucaguuuucauuauuuuuuuauuccuaaauaucuccugcucagucuauauaauguuacuuguaugcaugcuuucaagucucaucauuugguauugaauuaccaauuggugugcucuuccccagggaagacugacuguuguuccagcuuucagcauacuuuaguugccuguaguuccuuuuguaguauuuaagcuuccuggcuccccccacccccauccacuuugacaugcuuaauguuguuguucuuacucagcucauguuuagugagucaucuuggugagacuugguagcuuuugacuacuaggagaaacaguaucauagcaaaaucacagauucucuggcucuuaaaaucuccagacaucuuacuucuucaaugaucccugagccuuagguaugggggcuuuauuguagaagcauccuuuuagacuggacuccacaacucugcauuugauugguuugguuuucucuaguggucuauagaacuuuccuugauaaggcaugaugacucugcucaucuauggguaugaagagaaauauuuggaaucuaguuagggauuaugcugguuuaauaaagugucaauuaauuuuccucugcccacuuugaaauaucuguuguuuuguucagcucauaguuagucauguuagugagacuuuauagguauagcuucugacauuacuaggagaaaugauaucacaacaaacagguuccccuccaaguuccaagacuucacuagcucugaguaauuggcuagguuuucagcaacaggaaugauuucccucuuguuaaauagaaagcugcuggcuacugccaagauauacaugccacuauugcauacuuaggguaauuguaacauucuugucauugguguuguucauaggcauuauagcuggguaagacuguuaguugcuuccuucucuuagaaccuugcauggcaccuucuggaaugaugaaagcuacucuuuggggaggagucuuccaggucagauccagcucaggugacucugggcccuauaucuaaagcacaugguguuuucagcacuagggacuugcuuuccaucucugauggaaaaccaagagcaauagcaauagcauguauguuuggggaguauuuuggauaagcccaaccaacagcucaaaagaggcuucucauaucuuggguugggauuuguuguuguuguuauguggucuuugucucuuggaaggaguuuuguccguccauaugagaaauuuuuauuuaaauccauaauucucaaccuucuuuaacuuuuuuuccugggauggagagauggcucagugguugagaaaacuggcugcucuuccagagguccugaguucaauucccagaaaccacaugguggcucacaaccaucuguaaugggauuugaugcccucuucuaguguaucugaagacaauggcaguguacucacauacaugaaauaaauaaauaaauuuucaaaacuuuaccucuaaaauuuuuuccuauuauuauuauuuacauugggaccaaaguucccaccucucccaauccaucccccaccuccuuuugccacccccauccacuccucccccauuucucuucagaaaaaggcaggccucccaugaauaucacguaaacauagcauacucaguugaggcaaaauacagcaagcccauagccaacaucaaacucaauggagagaaauucaaagcaauuccacuaaaacuggggacaagacaaggcuguccauucuuuccauaucuauuaaacauaguauuugaaguucuaggugaagcauaagacaacuaaaggaguucaaaugguugcaaauuugaaaggaagaacccuaacccuaacccuaaccccugaauuuuggguguguaccucccacagcucagguaagcuacugaaugcagggaccagcucuuaaucuucuuaaugcugugacccuuuuauauaguuccucguguugugaugacaccaaccauaaaauuauuuucuuugcgauuucauagcugcuauuuugcugcugcauuguuaucugcauuuucugauggucuuagguugacccugugaaaaugucauuuggagugcccacaaaggggucaugacccauagguugagaaccauguauguaaauuauuauaucuauauuuauacacagauuuauguguguguuauaugguauuuuugguaaauaguuaaugucaacuuauagauuugacuuauuuuuguuucuaaaagucaauucauucacucaacgucuguuauuguacuaugugccaggcacuguacuaaaagcuugucauaaaagaugagugauagaaccaguggggaagcaccugaacacuucgaaugugguaagaugacuacuacaggagacaaaggcaggcauaagugauguuauuuuuuucuugggcgcugcugggaacgaaccauuugagccaagucucuaaagauuggaagauaaguauuccaugcagaggauauaguauguaggaacacaggacaauugaaagauugguuguagucagggaucaaguauuauuuuauguggcuaggauauaggauauuaagcaagaaagggggauguagugagacaucaagugugaguguugcauaaacuuggauuggcaguaauuugguaaugugcuggagagggucgugaagaaauauaaagaacugggacgcugaugcaagaagguucuaaguaagaaaggaucagggagaauggcaguggggauggaggguugacacaaagaguaaagcacuugaugcucaagcauaauuaccugaguuuggauucccagaacccacaaaaggccaaauguauuagugugugucuaucaucccagguaucccacugugagauaagauacaggaaaauccucaaaaaucaugcuagcacaacagcaaagaagaggcuauugaagucaaggagcaagguuaggaccaacaguaaaguuugucuuuugaccuccauauguaugagauacauacacauauacacgcacaaacacagacacacacacacacacacacacacacacacagaaaaauacagaaaaagagggggaagagagggaagagagggagagggggagagauucuuuaauagcaagucaaauggauaaaaagcuccacuaugauaauaccuaaauuauuuuaauaaagaguuaugauaaaauuuuauguaacaaggacauaaacacuacccaucuucaugaaauuuuaucuaauauugaaaaauuccauaagaacuauuauauucugagggauucauagagauuaaguuuugcuaucuuuuuaacagcacaaugcuguuauugcccuguauaagaaauagaaagaguaaacaucuaaggucacacaguggguagaaugugagccaucaucaauuucuagaacauuaacauuuauauuuagcuaccuuuuaaauaucaccaguugguaguaauuguuuaauagcauuuuaaaacacaauagauaauuaacagagaaauacuuaaguaacuccuuguuauucuccaucuuacagaaguaaauauucuccugaguguauuuccuucaacugcaaacauguuucuauauuauuaccaauucuuugugcacacauaagaaauauuucuguauucauguuuauaaaacuguuuuuauauuuuguauauuaugaaucauguuuuauacucauuaaauucuaacaccaugaagagucuauagcaccaucauuuauuuuucaauucuacugcuuaaauugucagggauuuuuauugcucucuaaacauauuuaacaccauacuacuucucuucaaacauauguaaaaguagaugaaguauuggauuaaauguuuaauuaauuaaauuaaacauuauuuuaacaaauuaauuagauuuucauauaacauucacauuuuauacuaaacuuauuuuuuguugugaguuugggugugugugugugagugugugugugaguaucaguauuacagagggcaaaggacaacaucagcuguccugcucuaucaaucuccaucucauuuccuucagagagggcuucccacugaaucuggaccuaggccgacagccaacaugcuccagugaccuaaguggaguucaguuuagugaaaccauuuuaauuucagaaaucaauacaaagcuaguuucuuuguggggaguaccaauguaauuguuaaacauuuaaauaugacuaauaucaagaauuaauccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaaaaaugaaaaaaaaaauaucaagaauuaaaaugaggcuuauauaacacauucuguggauauguaaaaauuaaaaugagguccaucuaggcacauagauuuuacauuuagaagaaauugaccauuuuuaaagacagaaaaaacagagcucaugcuuauauaacuaacaauaauauaucuaguaaacaaacugaauguauagauaugacugaauacuaaaggguuuacaugggcugacuggaaauuuaaccaaauauuuaaauaaaauuaauauguaguaaaauacuucaauuuuagugaaaauguugaugagauuugacauaugugaauguacuauaaagauaaaaaucagaaaaauugauaucuaggaguuaagcuuauucauuuuccauacauuaaaguagagaagaaaaugcacuauauguaauauucauuuuucaugaauguguucugcugauuuuguucuacugaucaaaagccauaaaauguagaucauuuuucaccaacuaaagcacucaaaacaccaaauaauuucuuuuuccaacaucaagcuuacacuuucugaguaccucuuggguauaugcgaauaaaucacaguuccugucccaaagaaacaauguacuuaugaaugggaaacuuguaguguuuaaugagcucccaaagaggcacaacuuaaagauuguuaagauuggagaggcuuuuauagacaagagucuggugugguuguuacacaccuuuuaaucucagcacccaggcugcacaggcaauuggauuucugugaguuugagaccauccuagucuauauggugaguuccaggacagccaggcucguaguuacaaagagaaacccugucucaaaaaaaauccagauagauagauagauagauagauagauagauagauagauagauagauagauaaucucuuucauuuauaccuugacugccauuucuugguacuaagacaaaaugcuuccucuccccauaccacaagagcucauucuuacauuccuaucuccauaaauaacacugacccugccaauuacagugucugucaucuucccuccaugcuauauauagcucuccaugcuuuaagaaccuuccuccaaacucacuuccaggagagggccacuaauuauuaaucaauuuggucauucagaaguauuuacuaagcaccuaauacaucuaggagcuauggauacaccagugaacaaacaaaaucuaccucaaggagcucuuucauuagaaggaaacaacauaaaauaagcaaguaaguaaauguaagaauguaaauauuuacauauuauaugaagaaaaauaaugcaggaugaauugucaaacuucauuuaugaguugaauguuuugcaugcuagaaagacuugcaguagaaggauauuggggauuugggaaggaaaccuaaagagauaagaaaacaaaccauuugguguuagucuaugaggagaggaagacagaucaaaaagcacaaacaucccaagucuagaacaugcuuagcaaguuugacuggcacuaagaacaaaggguggaguggaauaaaaugaccagaaagauaucuuuggacagaucacauuaaagacuguugacuucauuaucacacaaugggaguaaaaucagcauaugaguuguuuuuaaagggucauucuagcaauuguauagagaugagaaugacauaggcgggaacagugcagaguagcuccaagauguugauuuguaccaaagcaauagcagaggacauaagaaaccauauggaaaguauuuaugauguuuaguugauacaauugcuaggagacugauuggacuauguggggagagagaauuggguuauaauugcuggaacagugcucucuuguuggaaaaugaagauggaauguaaugcauagaaggaggagcuggcuuuagauuaaagcauggacaguucacuagagaaacaugagaagaauuuggcacagaagcauccaggugaguaaguaugaggauaggaaaccugagggcucaguacugacugcuuucucuuuugcugcagaaagaaaccuggagcuaggaaugaaaaggagagauuugaauaugaaauagucauccaaacauagccacuaaaucuuaaccucuguauccauuuccacccagcuggauucauuuuccuugguuuguguauguucucagaagcucuuucuucauuaaauccucaccuugaaugauagaaacacucauauaaguaguuuacuaaggagaaaauaauaaaccauuaauuuccuuauaaaggaaacaucuacuuggagaaaugaugauguggucuaucuacuacuaccucugucaugcugcucaaaucuccauccccacugccauucuccgugauccuuucuuacuuggaacuuuaugucagcaucccggcucuuuauauuucuucacgacccucuucagcacaucaccaaauuauggccaauccaaguuuaugcaacacucacacuugauaucucacuacaucccccuuucuugcuuuauacccuguauccuagccacauaaaauaaaaucugauaguuuuauccaaaauugcuguaauccagauuggcuucacauuuacuaaguaucuuaggauggcuuugcauugguugaucucuugcuucuaaucuccaugugguggguguauagcaaauccaacuguuguguagagauuucccaaagcuauaaaaaccacugaaaaaauuauuaaaauuauaaauaacaagaaaaaugcauuuagaaaagaauacauguugaauuugaucaaauauauuuuggacuuauugaguugaucauuucucuuuccuuuuuauccuguuaaacagugacaaaaauuauauugauuuauuuugagcauuuuauuaacaaguuucauucacaucuacauucacaagugguguucuccuauaaugccuuuucuugguuuucuuauuaggcuaauacuuaauucagaugaaauggguuggaaaguuuuccuuucucauauuuucugcaaguuuaugagggguugguaugauuucuuuauuuuaaaauguuugguagaauuuaucaauaaaauaacuagugcuugaauguuucuugcuagaauuuuuauaauaguaaaccaaaguuuaagaaagucauagaacuauucauaucaucccuuucauuacaggaacccuugauaguuugugacucugaaagaauucauccauuuugugcaauuuuaccaauuuccaggcacaaagucuugucuuuuaaauuucuguggggucaagcauggugccucuucuuuaucugaugcuuauaguuuauaucuucucuacuguuuucuugguuagguuguaagcgucucaguuuuacugccccccccccccaccaccaaaggacaaguuagcucuugguuugauuaaaaucaugcaaauaacugacauaaaaauuuuauugauuccuauuuuugucucuuucuuuuuaccuuugguuuaauuuccuuuuuuuuucuaguguugaaaguuuugggagcuuaguuccauagugucuuuucuucuaauauaagcuuuaguguuuucauuuuuaagcacuacguacuauaauuguaucccagacaauuugauaagcuaauuauuuaauuacuaaauuuugaugcuauggauugaacugugggccgugugcauguuugacagcagucugccacugaacuacucccucagcuaaauuuuuauuuucacgcagcucaaaguauuuuaaaguuuugccuuagaauucuuuuuugauccauaaguuauuuacauauaugcuuuuaaauguccaacuacuuaagaaauagguguuauauacauuuuuuucuaguuuaauuucauuauauuuaaagaacauacuuuauaugauuucaauuccuguaaaaguuucccauguccauuuaauguacugcuagucuaauuauaaaacuuagcagcuacuauggaaaacaaggagguuccucaaaaaauaaaugcagaaagcuauaauguaauccagcaaucccaauagagucuugaaaagauacuucacacccacauuuguaacaugaguauuugcaaugucaagagcuagaagcaguacaaauauuuuuuugucaauagauggaucaacaaacuauggcuuauagccacaauagacuuaaaauuccacuuuaaaagagaaagaaaugcagcuacauagauggaucuugaaggcuuuuuauauuuucugaaauaagccaaagauuuuaugucuccauuugcaugaauuaccuuaaguaguuaaauucauagaaacagaaaguauaauuaugacuauuagggaauggggaugaaaguaaaggguaguuguaaucuaaugagccuagaauuucagcuuuguaaggugaaaaauuccauaagaucucuuuacaacaauaugaauauacuacugaaauauacacuuccaaaaauggcaaaaauuuuuaaaaagcuuugcauuacauggauauuuuuacugcaauuagauauaaaauaaaucuuuuuugagauuugucuuauggaccagaauaucaugaaagaugguaaauacucuuugugcacuuguaaagccuguuuuuugcucuuguagaauagagguuuuuuuuuuuaauaaaugucaauuaacugaaauuagcuaacagcauugugcaguucucuacgcuuacugauuuucugccuagucguuuuauugauugcugagagaagcguguuaauauccacaacuauagcugucaguuucccuucucagacuuuuuaguucugccaacuuuuguuucauauaucuugaaccucuguugauaguugcauacauaaucuggauugugaggauuucuaguugaagugauccuuuuaguuucaugugaucaucucuguuuauuucagcugauauucuguauuuugaagucuacuuuuuauuacuaugaagugagcuuuuuauauggaacaugugauuuuuuaaaauuucuaucuucuuaagguauauuuauucagaugauuuauauuugauguaaucauugauauaauuggauuuuauuaucugcuuucugauuauucuugcuagacuugguugugauuuucuuucuuuaagaucacuguggaauauuuauuaguccauuuuaauuuauguguuacugcuguauguuacauuuguauauugauguuugcuguaugaauuucaauccauauucucaauauugcaaugucauguuugaguuacuauuguacuacuucagguacaauauagaagauuuaacugaccguguggcuucauuaucuuacccuauuugcauucauaaguauuuugagaauuauagaaaauucaaaguacuauuucauaacauuuugcuuccaauaguugcccauauuuugaagaacauaaauguaacuuguaacauuuguaagagauuuauacuucucuuguauuuucauuguuucugauuaucuuaguuuccaucuaauacauuuucccucaccuaaaagaauuuccuauauaguuuuuggccagaaucaucauauuuuuaguuaucauuaaucugaaaauaucauuuaccuuuauuuauauuuuaaaaguuuuuuugagaaugucauauaugaguguuguaccuucuauaauuucuaucucucucuuuccccuuccaauucuucuugugaaaguaauuucacuguauguaaaagucucacuuauauuuguuaaguaauuuaaauaugaaguucuacuaucuucugacuuccauuuuuuucuuucaagaauucucauauuaauauuguuuugagacaggauuucucaguguaacccugguuguccugguggaacucacucuguaguccaggcugaccuugaauuuagagaucugccuggcucucccuccccagugcuagaauuaaaggcauagaccauuacugccuagccaucuacauauaauuuuaguuguuuuguuuaagauggaggucuaacuauguaaaaaaggcugaccuuaaacuccuuauauaauauauaacauuuuuuaacauuguggccaugauuuucuuuguccauaucauguuugagauuuguugaguuucuuaagccuuuaauuaagccuuuuaccaaguuuuagaaaucuucaauuguaauaguuuagguauauuuucuauguucauuucauucuucucuucuaggacucuagcacauggaaguuaaaauuuccgauguuauucuucaagucucucaucauuucuucacuuucucaacauuuuuucuuuuuauuaaucuuacuggauaguuccuacugauuuauccuaaaauugucuuuuuuccugucauuucuauuucuaauuuacuauuaaguuuaucucaucauuuuaauauuuuagaucccuuaucccucaguuauaaauuuucauaugguucuuuuuaugguuugcuuuuucuacuuaaacuuaucuaguauguuuaccuuuauugcauauagcaugauucucauagcuauauauuagcucucuauugcuagguugugggcaccaccuccagcaggaagacaggacauuugugggguugccaucccacagucacaccucugacccauaauuguuccugucugaaagaauuacagggauggaaauggagaggagccugaggaaaacaagguccagugacaggccuaaagugggauccagcucaaggggaggucccaaggccugacacuauuacugaggcuauucaaugcucacaaaaagggaccuaucaugacuguccucugaaagacccaacaagcagcugaaagagucagaugcagauauuugcaaccaaccaauggacagaagcagcugaccccuguuguugaauuagggaaggcugaaagaagcugaggagaagggcgauccuauagaaggaccaacagucuuaauuaaucuggaccgcugagaucucucaaacaccaaacagacaacauacaccagcugauaugagaccccaaacacacauacagcagaggacuuccaagucuguguucauuuagagaugaugcaccuaacccucaagagacuggaggccccagggaguuuagaagucagguggggcggugggugggggcauccacguggagacaggggguggagaggaggugugggauguggagcaguuggaggguggaugggaagguggggaauggaauauggaguguaaaaaugaauuacaaauaaaauuacaucauauauauauauauauauaucccuuuuuaaaacgaaguaaagcugcuaugaagaaaaaaagagaaaaaaacaaaauguuauacagcuauacagccccauaguacaaaguguaucugugcacuaugcuucuuguucauuacaaagaaguaaaagcuugaaaaauuugaaaaaaaaccaauaaauaaacaaauaaauaaauaaaaauaaauugugggcucuuagcagcuuaaaaccuuaaaagggccagggucuuagauuauuguaauuaaguuguugcuagagucaccugaagcuuggggucuucuacugaccuaacauaguuguugacagaauuagccccuggaagcugaaggacugaauuccucaauuacuaaaauuaccuguaguuuccuugccacaaggcccucucaagaggcauuucacauuuuaucaaguugcuccuuuaagaagaacacggcccccaauggaggagcuagagaaaguacccaaggagcuaaagggaacugcaacccuauagguggaacaacaauaugaacuaaccaguaccccggagcucuugucucuagcugcauauguaucaaaagauggccuagucggccaucacugcaaagagaggcccauuggacuugcaaacuuuauaugccccaguacaggggaacgccagggccaaaaagggggaguggguggguaggggauugggcggguggguaugggggacuuuugggauagcauuggaaauguaaacgaggaaaauacauaauuaaaaaauaaugauaauaaaauaaaaaaauaaaagaagaauaacagacagcuggucuagguggcaugugccuuuaaauccagcacugggaaggcacaggcaggcagaucucugagaguucaaggccagccgagucuacagauugagcuccaggucagacagggauacacagagaaacccuauauugucaaaaaacaaaacaaacaaaaacaaacaaaaaaaccccaaaaaacaaaacaaaacacccaaaaaaucccacaaaaaaaaaaagaaaaagaaaaucugucugguguacuaaaacugguguguuuuuccccuuuaaaaguuuuaaaagucauuuuuaaaauuucuacuauugucgauuuuauuacuucuauuuauuuuucauuuaauuucuuucuccuuuuuaaauuagauauuuucuuuauuuacauuucaaauucuauccccuuuccuaguuuccacucugaaaaaaucccauauccccucccuccccccuucccccucuccugccccugcucaccaacccacccacuccugcuuccuggcccuggcauuccccuauacugggaccaagggccucuccucccauugaugacugauuaggccauccucugcuacauaugcagcuagagccaugaguccaacccuguauuuucuuugauuggcaguccagucacagggagcucugggguuacugguuacuucauauuguuguuccuccuauggggcuucaaaccccuucaguuccuuggguacuuucucuagcuccuucauuggggagccugugcucuccuuccaauggauggcugagaguauccacuucaguauuugucaggcacuggcauagccucucaggagacagcuuuaucagguuccugucagcaagcucuuguuggcauucucaauaguuucuggguuugguaauuguauauggaauggauccccaggugggguaguaucuggaugguccauccuucagucucugcuccggucuuugucucuguaacuccuuccauggguauuuuguucccccuucuaagaaguguauccaaaauuuggucuuccuucuucuugaguuucauguguuuugcaaauuguaucuuggguauucugagcuucuuggcuaauauccacuuaucagugagugcauaucauguggguuuugugugugugugugugugugugugugugugugugugugugugugugugugagagagagagagagagagagagagagauuggguuaccuaacuuagggugauauccuccagauccauccauuugucuaagaauuucauaaauucuguuuuuaauagcugaguaguacuccaugguguaaauguaccacauuuucuauauccauuccucuguugaggggcaucuggguucuuuuuagcuucuggcuauuauaaaugaggcuguuaugaacauaguggagcaugugaggaaccaccagacugauuuccagagccauuguaccagcuugcaaucccaccaccaauggagugauaguccucuuucuccacauccucaccagcacaugcugucaccugaguuuuugaucuuagccauucugacuggugugagguggaaucucaggguuguuuugauuagcauuccccuaaugacuaaggauguugagcauuucuuuaggugcuucuuggccauuccguauuccucaguugagaauucuuuguuuaccucuguaccccauuuuuaauaggguuauuugguuuucuggagucuaacuucuagaguucuuuguauauauuggauauuagccauguauuggauauaggauugguaaagaucuuuucccaaucuguugguugccuuuuuguccuauugauaguguccuuugccuuacagaagaagguuugcaauuuaugaggucccauuugucaauucuugaucuuagagcauaagcccuugguguuuuguucaggaaaauuuccccugugcccuuguguuugaggcucuuccccacuuucuccucuguaaguuucaguguaucagguuuuauguggagguccuugauccacuuggacuugagcuuuguacaaggagauaagaaugggucgauuugcauuuuucuccaugcugacagccauuugaacgagcaccauuuguugaaaaugcucuuuuuuccacuggaugguuuuagcuccuuuuucaaagaucaagugaccauaguuguguggauucauuucugggucuucaauucuauuccauugaucuaccugucugucgcuguacuaguaccaugcgguuuuuaucacaauugcucuguaguacagcuugaggucuggcauggugauuccaccagagguucuuuuauuguugagaagaguuuuugcuauucuagguuuuuuuuuuauuauuccagaugaauuugcaaauugcccuuucuaauucagugaagaauugaguuggaauuuugauggggauugcauugaaucuguagauugcuuucggcaggauagccauuuugacuauauuaaucccgccaauccaugagcacgggagaucuuuccaucuucuuagaucuucaauuuauuucuucagaaacuugaaguucauguccaacagauguuucacuugcuugauaagagucacacugagguauggaauauaauuuuaaauauugugaauggugucauuucccuaauuucuuucucagccuguuuauccuuugaugaggaagacuacugauuuguuugaauuaguuuuauauccagcgacuucgcugaaguuguuuaucagcuuuaggaguucuaugguggaauuuugggggucacuuaauuauaccaucauaucaucugcaaauagugauauuuugaguucuucauuuccaauuuguaccccuuugaccuccauuuguuguguaauugcucuaguuaaaacuucaaguacuauguugaauagguagggaaaaagugggcagccuugucuagucccugauuuuagugggauugcuucaaguuuuuccuccauuuacuuugauguuggcuacugguuuguuguagauugcuuuuaucauguuuagguaugggccuugaauuccugaucuuucgaagacuauugccaugaagggguguugaauucugucaaaugcuuucucagcaucuaaugaaaugaccaugugguuuuugucuuugaguuuguuuauauaguggauuuuugauggauauauauauauauauauauauauauauauauauauauauauauauauauauauauauuuaaacauuccuauaugccugggaagaaaccuugauuguggugaaugauuguguugauguguucuuggauuucuuugugagaauuuuauuguguauuuuugcauugauauuuacaagugaaauugaucugaaguucucuuucuuuguugguuuuuuguaugguuuagguaugagcguaauuguggcuucauagaacaaauuggguaguguuccuucuguuucuauuuuguauaacauuugaagaguauuguuauuagaccuucuuugaagaucugauaguaauaugcacuaaacccaucugguccuggguuuuuuuuggaugggagacuauugaugacugcuuauauuucuuuaggggaaaggugacuguuuagaucguuaaucugauccugauuuaacuuugguaccugguaucugucuagaaaauuguccauuucauccagauuuuccacuuuugugaguauaggcuuuuguaguaagaucugaugauuuuauuagauuuccuugguuucuguuaugucucucuuuucauuucugauuuuguaaauuuggauacuauuucuguacccucugguuugucuagcuaaggguuuaucuaucuuguugauuuucucaaagauccaguuccugguuuuauugauucuguguauaguucuuuugguuucuacuugguugauuucagcccugaguuugauuauuuccugcugucuacuccucuugggugaauuugcuuccuuuuguucuagagcuuuuauaggugugcugucaagcugauaguguauuuucucuccaguuacuuuuuggaggcacucauagcugaguuuuccucuuugugcugcuuucauugugucccauauguuugaguauguugugcuuucauuuuauuuaaauucuaaagagucuuuaauuucuuucauuuuuuaaaauuccuugaccaaguaaucauugaguagaacauuguucugcuucccuguauaugugggcuuucuguuguuuuugaagaccuaccuaagucuguggugaucugacagggugcaugggauuauuucaaucuucuuguaucuguugaggccuguuuugugaccaauuauauggucaguuguggagaagguaccaugagguacugagaagaagguauauucuuuugcuuuaggaugaacuguuuuauaaauaucuguuagauaaauuugguuaauaacuucuguuauuuucacuaugucucuguuuaguuucuuuuuccaugaucuuuccauugcugagaguuggguguugaagucucccacuauuauuguauggggugugauguuugcuuugaguuuuauuaaauuccuuuuaugaaugugggugcccuuguauuuggagcauagauguucagaauugagaauucauccugguagauuuuucuuuugaccaguaugaaguguccuuccuuaucauuuuugauaacuuuugguuuaaaguugauuuuauucaauauuagaaugaccacucgugcuuguuucuuggaaacacuugcuuggaaaauuguuuucuagccuuuuacucugagguagugucugucuuuggcacugagguggguuuccuguaugcagcaaaauggguucuguuuaaguauccauucuauuaguccaugucuuuuuauuggguaauugaguccauugauguuaagagauauuaaagaaaagugaugguuacuucuuguuauuuuuguuguuagagcaggaauuaaguuuguguugcuauuuucuuuuagguuuguuuaaagacuacuuucuugcucuuucuacgguguaguuucccaccuuguuuugguguuuuccauccgauauccuuuguagggguggguuuguggaaagauauugcuuaaauuugguuuuaucauggaauaucuugguuucuccaucuaugguaauugagaguuuugcuggguauaguaguaugggguggcacuucuguucucuuagggucuauaugacaucugcccaggaucuuuuagcuuucuuagucucuggugagaagucugguguaauucugauaggucugccuucauauguuaccugaccuuuuucccuuacugcuuuuaauauuuuuucguuguuuagugcauuugguguuuugauuauuaugugaugggaggaauuucuuuucuagucuauucuauugggaggcucuuguauguucauggacaucucuauuuuuaggcuagggaaguuuucuucuuaauuuuguggaagauauuuacucacccaguaaguugggaaucuuugcucucuuuuauacguguuauccuuagauuuggucuucucauuguguccuggauuuccuggauguuuuguguuagggucuuuuuacacuuugcauuuccuuugacuauugugucaguguuuucuaugguaucuucugcccuugagauucucucuucuaucucuuguauuguguugaugaugcuugcaucuaugacuccugaucucuuuccuagguuuucugacuccagcguugucuaccuuugugauuuuuuuauuguuucuauuuccauuuggaugauuuuguuuauuuccuucgacuauuugauugugcuuuccuguaacucuuuaagggauuuuuguguuuccucucugagggcuucuaccuauuuuccuguguucaccuguauuucuuuacaggaguuaguuauguccuucuugaaguccucuaucaucaucaugagaagugauuuuagaucugagucuugcuuuuccagugugauaguguauccaggacuugcuauggugggagaauuugguucugaggaugccaaguaacuuugguuugaguugcuuauguucuuaugcuuuucucucagcaucugauuauuucuagugcucccugcccuccauuauccgacuggauccuuuccuuccuguaauccugguugugucagaacuccucagugcccagcuauaucugugauccugugauucagggauccugggauccugagauucugggugugucaguguuccuggaagucaagcugccucugggacccugagaaucuggugugaccaagcuccugggauccugggauccuggaauccugugagccugucaaccugagcaccugagauuugagccuccucuggaugcugugggacuugcuguggaguuagcacccaugguaaacuggugcagaacggaaagaaugggagccacugguugggugggguuccugagucccuggauccugcuggucccaguuauuccugaugguguuggaacggauguuguguccuacucaccccugauucugcgauccuuagggugcuagagucccugggaguagagccuccucuggguguugugggacuggcugcagaguucuugccuaaguuuuggguuccuuuuaaguagauguuuuuuguauuuucuccagaauuuuauuacgaaaggucaguucuagugagcuucuuccaucuugaccaggaguguagguuuuuauuuauaacauauuugcacauuuacaguggguuucuuagagacagcacauaauguacuuauuuuuuuaaccuaaccucaauuuugacauuuaauuuggacguucagauaauuuuuuaaaaagcuuguggacaauuuuauuaguuugagagaaaaacuacaaggcaggaaagcuguaaaucucagcagcuacuuagaguaggaaaacagaccacaagucauuucauuuguaagcagccauguagugggaaguggggggagcuucagagaaagacugagaaaacccagugucagggaaagcaugcggagacuuuggaaaauagauaaagaaauuuuuuuuuucgcuuuuaucugcaacacacaaaaaaaaaccuuguucaggcuucacauagccacauugugguaacuccauaaguaagugcagugaggagaggcuucugggaaagaaaaguacauuauguaaucaagagaauaauuauuccuccacucuccucagcaugucuucaggugaauaagauuuccugggguguguacucuugggcaggugguugacaggcccaguuggacuaauucuuauuccaggauacaauaguauguagaguucugaucuuuggagccauucagaacauugcaucucugcaucucuguccagggccagacacagaucccauucuuuucuaauuuuucuucuucuucuucuucuucuucuucuucuucuucuucuucuucuucuucuucuucuucuucuucuucuucuucuucuucuucuucuuaucaggaaagaaguagcuuuaucguaauggcccucaacagagcucugauacuuauccuccgugguauuucuguaacauacuuucuuaaagagugaagacccuaaaaucguuuagaaauagacaaaauuaaaaaaaaaauaguuauaaccuauuucugccaugaaaaugcagauguaauuguaaaccuguuuaccagagggaauuagugucuggacuggugguuucugucauacccucauguauagccuccaagcugggcugcuaauuuaggagaagauaacaagaaauaagagcuccuuucuggcauucuuggccucuggccagaauagaaccaaggacauuuccggcuucuggccaaggacaagaaugaaaacuguucccuuuggggucucugccccuaagucugucuaagcuguuucuguuuccuguccucauuuaacuguuuaaagaggagaauauuguugggaaauuugggcaauaacugguucuggcauaugccugcuggauggggguccucaaaccguccagugggccuagaaaagggacuucagaaguccauuagugauuccacuuguauaaccaaaagguguagggaggaaaagcauccccugcauagacagagaugugaggguggagaaaaagcaagaaaggagucagagaaaagugaaauuggagcccuuuaagcagaggaaaugauuccaucccaccaggagcagguacagaaguuuaaauaauaccuuagaguuauaagcccuagucagaaaaccagaagucagaacaaaggacauugaaagauaucuaagucaauuagaaucccuuacuagacucacaagaacaucauccauaugaggcuuauuggguuucuccuuggaguuuuuccuauaguauuuaaaguccgacuaaagagcgacgaacugagggucuccuuucaaauaaguacuuugauacuuauuggagucaugauaaaaaucaaaugguaaaaccuacagaagguggcucaacaguuaaaagcaucuguuccucuuauagaagacuugaguucaguucccaacauccacguuacuagugcacaaccagcaggagaucugaugcccucuucuagccucuuugggcagugguacaugguauacacacacacacacacacauacacauacacauacacacauuuuaaaagauuaaacaacagcuaaauccuuuucucuuuuuucccccuuagaaccuaccuagaagggaccuaauucauuauuuuuuaaagaaaauauuacuugguacuguacagggggcagcaaucugggaaguaauaacaauacuuaauguuugcccauaauuuucauuuaauaucauuacaauaauauuuggauuuaaaucuaccauuuuucuauuuauauucuauugauuccaucuacuuuuucaugacuuguuucuucucuucuugucuucuuucagaguaauauauuucuaugauuucauuuuaucuugacuuuuagaucacuagucuuaguucuuuguuuuuaaugguugcaccauuuaaaaaucuucauucaacaccacauauaaaccauacagagcuaugccuguguuguauauguguguguguguguguguguguguguguguguguguguguguguguguguguguaugguguugaggauagaguaggggaaagcuaaaagauugcuacacacuguuaaugacaacucuuggcuuuuguuuggauaggauuuguuuagcacuuaaauuugaaagacaauuucauugaauuaaauaagcuagguuuacagauuuuuguuuaaucacuuaaaaauguuacucuacucucuucugaaucucauagauucugauauuauguuuguaauuauucuuaaccuuuuuccuaugucuuuaaauuuggguacuuuuagcauuuucuuuuuaucacuggguuaaaggaauuagauaugacauguuuuacuguguuuuuguuuguaauuaugcuucuuguggcuuguagacuuuauuaaguuaucaggauuaucauuuucaaccaucuggaaaaaguuuggucauauuuuucauuaaauacauuuuugucuuugucuccuuguauggguccagugcuuuguuuauuuugaauuuucuuucuuggcauaauuccauuugcauuguuucuauuaccuauucuucagcauugcugauuuguauagauuguaauuugucauuuugcuuuuauauguuuacugauuuaauuuaaauuuacugcuacauauauucaucugcuacauauauucaucucuccccuuugugugugauagugagauauuccuacaagugaaauaauauauuguuauauuuacuacuuuauacaacauguuuuguucguuuguuuugcagcacuaguaucaaacccauauuuuuauacuugcuaggcaaguguucuaccacugagcuauauccccacuucucuguaugacauauuuuaaaguagcugaaagauuuaaggagaacaaaaacauauucauaggguuuauuaucuuuguguuccuguuguauuucugguucuuuacauguuuuuuugccucuaaauucaaguugccauuugcuaucauuuccuuauucccuuggugcuauuauugucauuaauauauuucuauauauuauauauacauuaauucaauuauaaaccuauagcuucauucaauuaaaauaauauguacaaaaaaguaaguagaaaaauauacauuuuacaauaguuaauauuuauauauuuaccuuuacaaguccuaugcucuuuguguaagaucaaauuaccaacaaaauuaaccuuccuucguaauauuucccacccuucucucucuucugagaggaucucacugugugcacagguuggucuagaacuugugcugagauugcagugccauuuuaggcuucuucaguauuucucaucagccagguaaaguagcaacauuuuuguuugaauaucuucauuucauuuuaaguuuugaaagguugguuuggagagagaacucuugguugaccccuuuuguauuuauuuuucuuuauaauugcauccuucugccauuuguuguccucuauaaucucugaugggaagucacuuuaaacuuaguugguucuccuguauaugcuacauucaugauuuugacuuuuucuuugaacuuauuucucuugucauaagccuugauguagaucuauugccauuaucuucuuggucuuuuucaggauuaucauguuuagguuaauggauuuuguuauauuuuauugguuuuaguuuugguuuucuaaaucucggguuuuuccauucauuauuuccuuuuuuuuuaaaaucuuaacucuuuuuuugguauucuuuuaauuauauguugauuuuauuaaugaaguccugaauuucucugagacccuguuuucuuuugauucgcuguucuuucaguugcacaauaugcugcuuuuccauguuugcuaauucuuuaucagaucuacuauugacauucccuugcucucuuuauaaagaaaacugaaauuauauuacauacauucaauaauuauguguuaauauauuuccuaucucuauuaagauuacguguuuaaagagacauuuauaguaguuuacuuuuuagucauugcuugcuuccuuuggcuuuuuaaaauguuuaugucuucuuuacauauuuugcucagucaguaacugugcuuuuuuuuaaugauaaucucuccuuucuacuuuuuaaaaaguuauaugggccacaauuuauuaauucuuucuauaucugaaaagaccugcuuggcuuuauaauugaccugaguaggguaaaagaguaaaaacaucacagguauagaaaggcugggaucaggugggccacgcacugugcugaaguugcaccagaagccgggaaauucaacaugcuuauuucauccagcagaaggaggagacagguuuaugacauauaguggaacaaggaggcagguuuauuauauacagaugaccgaguaggcgagggaacagauagaaucuucauaggcgcucucugcuggggaguaguuuccugcugaaguccucuggaaggaggaccuuuugcuugacacccuucuuuaaccaggagaaggcauccaucccaauugccauauuuugauagauuugaauugaguccuugacaugcuaucaauacacagucacucaguaauuaaucuguuccuuuagauaucugucaaguuuuuuguuuaaaacuggacauuugcgguuagagauggagcucagggauagaguacgugaggaccauguacaaggccugugagucuaucccuaccaccagaaaaagaaacauagguauuuuagauauaucaugucacuaucuaguuacugauuacuauuacugcagucccauucuguaaucuaaacuuuauuuuuauugucuguuugaugacuugaauguauuauuaguuuagugaaguucauuucuucagcauguacaaaguuuggcaugugcauaguuaccuuggaaugucaaugauuuuagaagaauuauguucuaauaugucauuuugucccucugauaucauauauuuagcuuguugccaacagcaauaaucaacugguuuuuuccuauuauuuuuuauaauguuuugggaaauucugauccaauuacauucuagcuguuuugguaguuagccuuuuccuccucccccucccccacccccuccccccuccugcugcugcugcugcuucacuucugcuucugcuucaucuucucuccuccuccucuuccuccuccuucuuuuauuccuuaguuuuaguccaaauugacuucaaacaugugauucuccugccuuagccuccugaaugcugggauuacagguuaugcuauaauacauuuuugugucaguauuuuugagacaaaucuuugagguuuagucuaaccccagggggccucuuuuuaaaugaaucuuacccugguuuugccuuaagugucuaacugguggauaguuuaguuguuucuuuuaugaaucaacgagucuuucaguacucaucaguaaaaccuucauaguguuuggggacuaaccuucuccccaugcucuuuucuaaguaaaaucaaucaccuagggccgaauuacauggaguccuuucuucuuauggcuguucugucccuaugggaaaaguugucuaucauucuucagagguggaggcagugaaaauagccuguuguuuuuuuccucauaguuauacuuuguuccugggaguaccaucuucugaacuccuugguuuuccuucucagcauaauaauucaccuuaugacagaacugaguuaaggaaauuugagacccacaauucuuggccaacuauuucaagaggagcuuaugaagugguagcucgguaaaagaagggagucucagauucuuagcuguaucuaccuggauuggauuacaauuucugaaacucaacauugggugcuauguaugaacuuuccgaauucuacccuaugucacacaacaccaugauuuagauacagcaaacuggagaguaugccuguguucuuguuuauaauugucuaggguaguuuuugucauuagaaguuggggaaauggguuggagucuaggugauaauagugucuuaagugccauauauugauauuauauaaauauuuugauauuaauaaauauuuugauauuuuugauaguuuuaaagaaaugcuuuucauuguucuaugcucuuagaaugauuuccugguaccuuuuucucucccucuucucccuuguguguguguguucguguucuguauucacauguauguaugaguauacuggacauguauauggaggcaagucugugggacauuuuuuaauuaauuaauuaauuaauuuauuuauucacuuuaauucccaauauuagauccccucuccucccagucccccuugaaacuccucccccaugcuccccuccuauucuccucugagaagagggaaucccuugggucccugacccccagcacaucucauuguaggacuaggcacaugcucucucaauaggccagagaagguagcccaguuaggggaaugggauccacagacaggugacaaauucaaagacaagccaugcuucaguuguugggagacccacaggaagaccaagcugcacaucugcuauauauggggggggggguagguccagcccauguuuacucuuugguuggucauucagucucugagcuccccaaagguccagguuauguaggauuguagggaagugcagagacacugcucugggguuggaaaaacacagugugagaugugggaaagacagugcugguuggaggucuccaggccugcaaugaguccugggccaugggguucucaggcucauggacaaccaggcacugcagggaguggcagaaggggagaguguggaauugggggcucaggcuggggagugucuagccuggggcccagggccagggaacaaggagagcuccagcuugucacacaggggaugacuguggcuugauggcagcagauuuggugguggauaugccugggaaugcagagagaccuucuaugggagauuagguugcagcucuguaggugaaggucuucuucauggcuccccauggcagauuuuuggggauacccuccuucucaggguggaccuaagauuaaauaccuuuugcagggagggaugucugggaagggcagcuuauugacuaagcccuccaggccucuagguaccucuuuagagggagaacucuguuuucgggccuaugugacugugaucaugucucuuuuccuauugucuuggucugagauguuagggaugcuucaucuacauguggaagggauuggggcauugccccuacaugacugauggccaaaauucucucuacagagggcuguguauacaugagagguaccuggugccaagagcagguaacacuccuauuguccuauuguucagggucuccagggcuucuagccuuuagcucaaccuuaccaggcuucuuuucaugguccaccaccccacaaaguuaguugacucuguuggucuuccuguggcguuccuauccucuucaguucacucaauccuucacccaacucuuccacaggacucuugaacuccauauaauguuuagcugugggucucugaaucuguuuuggucagcuguuggguggagccucucagaggacaguuaugcuaggcuccuguucuaccaucauagcagaguaucauuaauagugucaggaauugguuuuugcucaugggauuggucucaguuugggccagucauugauugaccauuccagccaucucugcucuaucuuugucccugcauuucuugcaugcaggauacauuuuaggucaaagguuuuguaaguggguugcuguccucaucccuccaccagaaguccugcuuggcuaaaggaaguggccacuucaggauccaucuacuguggggcauuuuaggugguuccaucccugguuagauaguuuugagugguaacagaaagcaggcugaacaauguguggcaaggaaaccaguaggcagugcccccauggcuucuguuuagguuccugcccuguuugugcuccugccaugcuugagugcuugcccuaacuucccuucauguuagaagguaaguuguaaaccaaaucaaauccuucucuucccuaaguagcuccugcucaugguguuuaucacaggaaugagaagcaaacuaggauacuuuucaccuuaguuuuggagguagaaucucuuucugaaccugaagauccgauuuugauuaagccggguaacuaguguacucucaggugcuaccugucuccuacuucucagcacugagguuacagauuaaaaguggacauggccauggucaguuacauaccuacuaaagauuugaacucagguccuuuugcuucaucaguaagcauucuuacaaacuuuagccaucauccuagcccccaauuuucuguuuaauuacaauugcuucuuauaauauucacuaacucugguuaucuaucuggguugagagugaccagugguguaugcuauuaucguuaaagucauuccuucugguuuuuuuuuuuuccugaaaauccuuucucucaguuuuggguagcuccuggucaugcauauacagauugaauaaucagcuaauuacucauggagauuccccugacccaaguaaaucacugaaguucuuauauucuguggcucucucauucacaauuacaaaacauagugacuaguaguaacuucagucuguuucuucagucccgagaaaacauugauucucuauuucaguuccuucuugccugugacuuaaaaacugccucagugccaugaacuguaauaauaauaauuugccuggucuuuccuuagcaauuacagucuugugcagcuugucuaauaucagaaugaagauuuuucuagcuauuuuccuguuuaaggaaggaagguaaaucugacccuuuuuacuacacuuaucuggauauaagauucuuacaucaauuuuuuuccuuuuauuuuucuugaaaaggcacuauguaguaguuaaggcagcugcuccauuuuucugugccucauuauuggccucuguggacuagagauaguaagacucuuacccuugcaguguuguuaacaugacugaguuaauguaugccaacaguuuauaaaaguuuacacuuaagcugaaauaaguuuuaaauucuacauccagcaauauuuucaccaucauuaccacugauacaacugucuuuauuucccauauaucauuggagaaauuuuccaaggcuucacuuaugaacuguauauaaaaguggacuagaucaaaauaucuaaguuacuuguaaauauuagacauuguagcccuuccgcucgacucgagacucgagccccgggcuaccuugccagcagagucuugcccaacacccgcaagggcccacacgggacuccccacgggacccuaagaccucuggugaguggaccacagugccugccccaauccaaucgcgcggaacuugagacugcgguacauagggaagcaggcuacccgggccugaucuggggcacaagucccuuccgcucgacucgagacucgagccccgggcuaccuugccagcagagucuugcccaacacccgcaaggguccacacgggacuccccacgggacccuaagaccucuggugaguggaccacagugccugccccaauccaaucgcgcggaacuugagacugcgguacauagggaagcaggcuacccgggccugaucuggggcacaagucccuuccgcucgacucgagacucgagccccgggcuaccuugccagcagagucuugcccaacacccgcaagggcccacacgggacuccccacgggacccuaagaccucuggugaguggaccacagugccugccccaauccaaucacgcggaacuugagacugcgguacauagggaagcaggcuacccgggccugaucuggggcacaagucccuuccgcucgacucgagacucgagccccgggcuaccuugccagcagagucuugcccaacacccgcaaggguccacacgggacuccccacgggacccuaagaccucuggugaguggaucacagugccugccccaauccaaucgcgcggaacuugagacugcaguacauagggaagcaggcuacccgggccugaucuggggcacaagucccuuccgcaagacucgugacucgagccccgggcuaccuugccagcagagucuugcccaacacccgcaaggguccacacaggacuccccacgggacccuaagaccucuggugaguggaacacagcgccuaccccaauccaaucgcguggaacuugagacugcgguacauagggaagcaggcuacccgggcuugaucuggggcacaaaccccuuccacuccacucgagccccggcuaccuugccagcugagucgccugacacccgcaagggcccacacaggauuccacacgugauccuaagaccucuagugaguggaacacaacuucugccaggagucugguucgaacaccagauaucuggguaccugccuugcaagaagagagcuugccugcagagaauacucugcccacugaaacuaaggagagugcuacccuccaggucugcucauagaggcuaacagagucaccugaagaacaagcucuuaacagugacaacuaaaacagcuagcuucagagauuaccagauggcgaaaggcaaacguaagaauccuacuaacagaaaucaagaccacucaccaucaucagaacgcagcacucccaccccaccuaguccugggcaccccaacacaaccgaaaaucuagacccagauuuaaaaacauuucucaugaugaugauagaggacaucaagaaggacuuucauaagucacuuaaagauuuacaggagagcacugcuaaagaguuacaggcucuaaaagaaaagcaggaaaacacagccaaacaggugauggaaaugaacaaaaccauacuagaacuaaaaggggaaguagacacaauaaagaaaacccaaagcgaggcaacgcuggagauagaaacccuaggaaagagaucuggaaccauagaugcgagcaucagcaacagaauacaagaaauggaagagagaaucucaggugcagaagauuccauagagaacaucgacacaacagucaaagaaaauacaaaaugcaaaaggauccuaacucaaaacauccagguaauccaggacacaaugagaagaccaaaccuacggauaauaggaauugaugagaaugaagauuuucaacuuaaagggccagcuaauaucuucaacaaaauaauagaagaaaacuucccaaacauaaaaaaagagaugcccaugaucauacaagaagcauacagaacuccaaauagacuggaccagaaaagaaauuccucccgacacauaauaaucagaacaacaaaugcacuaaauaaagauagaauauuaaaagcaguaagggagaaaggucaaguaacauauaaaggaaggccuaucagaauuacaccagacuuuucaccagagacuaugaaagccagaagagccuggacagauguuauacagacacuaagagaacacaaaugccagcccaggcuacuauacccggccaaacucucaauuaccauagauggagaaaccaaaguauuccacgacaaaaccaaguucacacaauaucuuuccacgaauccagcccuucaaaggauaauaacagaaaagaagcaauacaaggacggaaaucacgcccuagaacaaccaagaaaguaaucauucaacaaaccaaaaagaagacagcaacaagaacagaaugccaacucuaacaacaaaaauaaaagggagcaacaauuacuuuuccuuaauaucucuuaauaucaauggacucaauuccccaauaaaaagacauagacuaacagacuggcuacacaaacaggacccaacauucugcugcuuacaggaaacccaucucagggaaaaagacagacacuaccucagagugaaaggcuggaaaacaauuuuccaagcaaauggacugaagaaacaagcuggaguagccauuuuaauaucggauaaaaucgacuuccaacccaaaguuaucaaaaaagacaaggagggacacuucauacucaucaaagguaaaauccuccaagaggaacucucaauucugaauaucuacgcaccaaaugccagggcagccacauucauuagagacacuuuaguaaagcucaaagcauacauugcaccucacacaauaauagugggagacuucaacacaccacuuucuucaaaggacagaucguggaaacagaaacuaaacagggacacagugaaacuaacagaaguuaugaaacaaauggaccugacagauaucuacagaacauuuuauccuaaaacaaaaggauauaccuucuucucagcaccucacgggaccuucuccaaaauugaccauauaauuggucacaaaacaggccucaacagauacaaaaauauugaaauugucccauguauccuaucagaccaccauggccuaagacugaucuucaauaacaacauaaauaauggaaagccaacauucacguggaaacugaauaacacucuucucaaugauaccuuggucaaggaaggaauaaagaaagaaauuaaagacuuuuuagaguuuaaugaaaaugaagccacaacguacccaaaccuaugggacacaaugaaagcauuucuaagagggaaacucauagcgcugagugccuccaagaagaaacgggagacagcacauacuagcagcuugacaacacaucuaaaagcccuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuaccuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccaucuaaacagucccauaucaccuaaagaaauagaagcaguuauuaauagucucccaaccaaaaaaagcccaggaccagauggguuuagugcagaguucuaucagaccuucaaagaagaucuaauuccaauucugcacaaacuauuucacaaaauagaaguagaagguacucuacccaacucauuuuaugaagccacuauuacucugauaccuaaaccacagaaagauccaacaaagauagagaacuucagaccaauuucucuuaugaauaucgaugcaaaaauccucaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguuuuggaaagaucaggaauucaaggcccauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauucuaccagagaacuccuaaaccugauaaacagcuucggugaaguagcuggauauaaaauaaacucaaacaagucaauggccuuucucuauacaaagaauaaacaggcugagaaagaaauuagggaaacaacacccuucucaauagucacaaauaauauaaaauaucuuggcgugacucuaacuaaggagguguaagaucuguaugauaaaaacuucaaaucucugaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuggaaggagcaauuugcaaauuugucuggaauaacaaaaaaccuaggauagcaaaaagucuucucaaggauaaaagaacuucuggcggaaucaccaugccagaccuaaagcuuuacuacagagcaauuguaauaaaaacugcaugguacugguauagagacagacaaguagaccaauggaauagaauugaagauccagaaaugaacccacacaccuauggucacuugaucuucgacaagggagcuaaaaccauccaguggaagaaagacagcauuuucaacaauuggugcuggcacaacugguuguuaucguguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaaucgacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcacuugaaaaaauguucaacauccuuaaucaucagggaaaugcaaaucaaaacaacccugagauuccaccucacaccagucagaauggcuaagaucaaaaauucaggugacagcagaugcuggcgaggauguggagaaagaggaacacuccuccauuguugguaggagugcaggcuuguacaaccacucuggaaaucagucuggcgguuccucagaaaacuggacauaguacuaccggaggauccagcaauaccucuccugggcauauauccagaagaugccccaacagguaagaaggacacaugcuccacuauguucauagcagccuuauuuauaauagccagaagcuggaaagaaccuagaugccccucaacagaggaauggauacagaaaaugugguccaucuacacaauggaguacuacucagcuacuaaaaagaaugaauuuaugaaauuccuagccaaauggauggaccuggagggcaucauccugagugagguaacacauucacaaagaaacucacacaauauguauucacugauaaguggauauuagccccaaaccuaggauacccaagauauaagauauaauuugcuaaacacaugaaacucaaggagaaugaagacugaaguguggacacuaugccccuccuuagauuugggaacaaaacacccauggaaggaguuacagagacggaguuuggagcugagaugaaaggauggaccauguagagacugccauagccagggauccaccccauaaucagcauccaaacgcugacaccauugcauacacuagcaagauuuuauugaaaggacgcagauguagcugucucuugugagacuaugccggggcccagcaaacacagaaguggaugcucacagucagcuaauggauggaucauagggcucccaauggaggagcuagagaaaguagccaaggagcuaaagggaucugcaacccuauagguggaacaacauuaugagcuaaccaguaccccggagcucuugacucuagcugcauauauaucaaaagauggccuagucggccaucacuggaaagagaggcccauuggacuugcaaacuuuauaugccccaguacaggggaauuccagggccaaaaaggggaagugggugggcaggggaguggggguggguggauaugggggacuuuugguauagcauuggaaauguaaaugaguuaaauaccuaauaaaaaauggaaaaaaaaaaaaaagaaacaccaaaaaaaaaaauauuagacauuguauaacaguuguuuuuuguauguaugaacacuuauauauuuguguauauauagacaaaccuuagguugguagaguuugagaguuaaaagaauuacauauauugauuuacuugguccaugaacacauuuaugcccauuaugcugaguagcuugaugaaauuuccauagcaagccuuuuaaaaguuguccaugaagcauucuuuuacacaaugucacuaguuggcccuuugguaccuaauacguucuuggccaccaacuaaguauaaaauugcacuagcaauucuguacaauuaucuaguuuuaaaaauugagagccaggcauggugauucaugcucuuaauucuaguacuuuagaggcugaagcaaguaucuuaaguucaaagccaucauggacuauacagugagagcauaucuuuuaaaaaauuaagauaaaacugaugauaauugaccacauggaauuuuagggcaauuuaauccaaguaguuagaaggguccaauacccaagcauuagcagaauauccauggcauguuuucuauuuuauaaagaucuggaaauaguuaagguggcuacuuuuagaaauauauugcauuuccaucuggucuaaaucaauaaaauuaaacuuuaugcugugugagauggagauuccagauuuagagacuguuauauaauguucuuagaaucuucauuuaguauuauuugagaaacuuaucuaguuaucaggacacaggugauaugguauacauaauuuuuuaugagaaaaaaugaauuuuuuugugauuuggacauauugauuuugagccuucccuguauagauguucuuuaucaagugaaguuuauguuuuaguauaaauuuuuuuucaucaugacaagaugauuuaguacaauuuauaaacuaauauugaucauuguguaccagggauugugugcuagaacuauaacauacccuuuguguauguuauaucaccuaauccucacugaaccaguauggggacuggagcaauggcucaguaauuaagaguauggacuguuauucacaggaccucaauucuagucccagaacccacauuaggcagcacacaacugccuguaacuccagcuucaggggaucauacacccuuuucugcacucugaucaugcaaucaaguauggaaacccauauauauauauauauaaauguuuguguguguauaauuuaaaaauaaaaguaaaaaaaaucauuuugauguagguguuauauuccaguuuuauagaagagaaagaugagguucaaaauauguaacuuccaagauuauaaaacaauucaauagcagauuuagaauucugacccagggucuuacugauauccuguuuuuaaagaacuucaucauuaguauuacuauuaacaucuuugcucauaccacuguuaccuaaugauaguucuagcauacagauuguuaaaggcauuguuagaaagaaaauacagugugcuuuuauacccagaagauuaccagggggaguaaguaauuaaagauuacaugucagauaagacuuuagugaaaguuuaacagccaccagguggucuuaagagaaaagagauguuuuuaaagcuaagcagaaacagaaaauaaaaagggacugugguuuagaauuguaagaauugguagugggaggcuaguugcuaggugccuguaggauccuaguuugauuauaaauagagguuaucauuccuauuuucagauaaagaguuuaaagcuuaauaauuggcuuaaggggacgagcuguguauucauaguuauccuccagguugaccugcauuuuacuauacccuauuuuccccucccaaguaggauucugguagcacuguccuugcgacuaacuuauuuuccucuuagcuuuuuuuauuacuugcuucuuuuucaguggauuacaggaagaacuauuucuucagccuguaaaacuuuucacuggagaguaguaugugguucuucaggcuguacuuaaucugucuggagucagugaaggagaggauuaaauaucuuugaaacuguuucauguccuaauuaacauguuuccugucacguuugcuuuaucaaaugaggguggcacucauugucacauagugaucccaaguuccauuggguagcuauguauuuuuuuauugauaaaauccaaaaacuggccaauuuacccaugagauuaaacuuucaaaaaugagauacuuuugggcaacugggagcaaaagaggcuucagugagaaaaguucuuauaguugauguuuugggggauuggugaaucuuguuagauugauagauucugcuucuucccuuccauuaacuacccuuuaaucacagcuaucacacacacaaaaaugaguaaauaaauaucuaaauacuugacuuugcacuccaaauccuuucacuaugguuguuugguacaucaaagcagucuuuuuuuuuuccucauuaagaguagacccuauaagucagcuacuaaauauuucacuaauggaauuaacuuauuaguguuccaaaauaucaagugccccagaaacauucugucauaaaaugguaaauggaaaagaaugauccuguguucccccuucuccccacuuccuuccuucauucagcugcucuuacuucucccgucccuccuaugccccuccuuuaucugauaaucuuucuuauucuccauuguguuuuccuuuccuccugcuuucccucuuuuccucuuuguuuacauuagaaccgcugcuccuuuaugcgaacacuaaguagcagucauguuuguucagguugccauggaaauauugcaaguaggccuuuacacaaacuggcuugcucuauuaaugaaucacaccuagaacuucuaaggcuaauaauauaggaaaaaaaauucuacauagaaauuaggucucagaacucaaguccaauuauuuucuccuucagauagaguuuuuauccauuguaucauuuuagagauacauguaugacuuuauuaauaagcuauuucuuuagacuuuuauuucuuuucaccacagaacagugacuuccaguauuuuucauuucagaguacacggggaauuuacaaauugaaaucuugguuugggguagaaauaaaaauguuuuagaguagaaggagagagacuuguugacucucucaaaggcaugaagguaagcagcagcagaggccucuuuuguuugggguguguguguguguguguguguguguguguguguguguguguguguguaaagacuucccaaccccugucucuagaauaagaagaaagcaguugaaggagggcuucagccucugagggauaaaaagugggcauagggaagagacaaaggaaauacuggauacugugagggagauagugugagaaggaaaauaauaugcccaacuguggccucagaaaggcccaaguaucauuuacaagucuguuacucuagcucuaugauaaacagcugcuuccuccuuucuccaaauaggcuuugagguuuuguuuuuguuguuguggugguggugguuuaaaucacuugagauacuguuguaaguagauccaaucucuuccuuccuagagguuagcuuaguucuggggccggugggggggggggggagguaacaacuuucaaagacagcaaaaggaauguaagaugaagaaaaacauaggauagugauaacaaaaggaaauuaaaaugggaagacaaacucuuugauaagauaauacgcaaagugagacuuagauuuguucacauuuagaacccuugagaaagacugauucagauagagaaaaaggcaaguucaaaaggcaaguacuauuauacugauaguagaaaaacuuccagccuuuauuaggaaccaagaguaagugaauaagugaagacugggaagaagugacagaacccagaucauguugauuaagauuuauaggccauaauaagggaugaguauuuuauucuagauauagcaggaaaaaauggaggaugagucuuuaacaagaugauguuguacagaauggauaauggauagaaggaggucaaaaguaaaagcagacagacuaauuaggaagcuguugcuuuuauucaagacugagaugauggcuuaaaucagauaacaaaggagauagaagcaggaggacuuuguugauaauuuaaagguaguuaacaggaauugcugagggaauaaauguggugauuuaaagauuucuuuuuaaacuuugguaacuggguagcuugaaauagaaugugggaagagugcuccuuggauuagaaggaagggcagugguuuggaaaaauaaaagcccacaugagacuggcagagcucugaaauugauaggcugacaacagucaguucaguagcugccaaaugcaagagaaguagcauccuggaacagacaaaaguuaggacaguugcucagcuggcuuaacucuuguuguucuguagcaguuagaggugcagaagaaauccucucuggaaaagaagaggaggaauaaaacggguguucuaggauuggggucagaaggguuugauuuucuuggcaccuucauugugacucaaauaauuagucuuccccgccucccucaaaaccauaggaugcauauuaagccuguaguggaaaaguuuuggaagugaaauccccauuuuucuguuucuaaagugaggauugaugagauaaaaagaaugagugaaagaggacugcacuguucuucccaacccugggacuuuugagaguuuucuuauuaagacucaaagggcccuguggugcaguauguuauacguagucaucauguaaacaaacuucuuagucaucauguaaacaaacuuaggauguuugccaccugucuguuuguuuugaaagaacuacaacaucaauaguuuacauuuuuuagaagaaagcaaggcaucuuuaggauaauugcuaaaacagcccucauaauuuauuuucuucuuugggaggauggcauaacauaauugcuaaaaccaugacucuugaucuaucuguggucuaaucucugcucuaccaaauaagcuuuucuuaucugugaaaugaagcuaacagaaucucccuccuaaggauuuugugcuaaugaaauauguugacauuuacaaccuucuuagagcaguaucuauguguuuguuuuaaaagguuuuuuuuuaaaguauuuagaugggaagcuaaucaaaaaauaugacugacccagaauucagguucacuggguuaggucagucagcaagccaggcauugaacacggguuuagaaaaagcucuagaguaggacugguaugcuuacuaugcagugcccugguuucaggcugggaguugauaggauuuagagagacucuugaguuccaggcacaggugaagaauccccagauucucucaguguacuaaauuauauacagauaguuaaauuacuuccuggugacauaaaauucaauaggauauuauuucuuaaaaacacuauuuuuccaaagguaggugugacucucacuguguccuuauggaaacuauuccuuaccaagguuucuuuuuuugucaggaaaagucagauaucaggaggagagugguucaaaagaauugaugaaguuugaaaaaucuuugucuugcuuuaucuuugucauaaaaguaacccuguacucuucugaucacauaauguauauuguuuccuucauaaaugaggacauuucuuuuaucuccuuauauuauuacaaauaccccauccaaaagauuuauaauuggagucuuuauauauuagaugaacuaccaagugguguguuaugagcaucagauugcaaaaggcagcaucucuugauggaucaagauaguaguuauaaguggcuguuuuauccuaccccaucugugcaguacagcagaaauaaggccuuuuuuaaaguuauaggacuguauagguuuguaguggucucauauaucuuccucccucuaugcuuaccucuaacauuucuagaaagaugacuuauuuuuaaagggccuuugagaauuaaauuucauaacccuccuucuaagucauuucgguguugagaacuuucacagucaagacauuuugccuuuuauucaagugaaaucucauuacaaagauaucguuccucuuucuucaggugcuuuauagggaaggugcuuuguugcacugaguacaaugggcuacauuacuacaagcaagccuauucaagcaggcuuuuuuccuugcccuaauucuguaucagcuaguuuacaagacauauaucuaaguguguguguguguguguguguguguugugagaggaaaaggaauaaaagguaugggggauguauaagcaguuuguuuuauaauguuuauucuuuacugcuaggcuaugaucacaugcugauguaucauugacauugaccucucuugcuuugggagcccauggauccguaauauaauuucuagaacuacaauaauuuaaaaaauuaucuucaggcuuagugugucucuaaucccgaugcuuggaaagcugaggcagaaagaucacuucaaaggaagccugcacauuacacagagugccucacaacaucagacaaaauaacaaaagacaaagcuucuaccguauagugcuaaucauccaggcagaauaugcccaccgauguaauaauaucaugaauguuuggagaguaacaaaacacauuaugauuauaugugaagaccacuccacaagaggugauauaugccugauucuguaaaccucugugaaaaacuuauggcugcagauuucaaaggcauuaagggagaaauuacuacuaauacuuugugauguacacauagagucaaaguucucgcuaaucagguacuguuuucagucuaagaggaaccucaggccuguguauuagugccgugcucaaccuugaucagagaaguuucuuuuugcagaaagcagaaguaaguacagaaacucauaauuuaccaauacacugagaaaaggugacuauuuucucucuuaaauagaauaucuaugucaugucuucuaaaauccaagaaacacuucagaaaaggggcagaaggauuguaagagcugaaggacagaaagggagcuuggaaaugggguuuucuggauaugacaugucuauuucaaucauaagcacacaacagcuaugccuaucugcacaaaaucuuugugugcaaguucaugaguacauauaccccaaaguagaaggggagaaagggacucaagugggaguggaaguugauaaaaauaauggggugaauauugaauauauucaugauacauuguauacauuuaugaaacuggcauacaugcuuaaaaugaaaaaggggaaacaauggacccuuaugcuggcuacuuacuuuuaagaggcugacaaaaacauguuauuuaaaacccuuucauccgagguuccauaacauaaugguuagcacuguagacucugaagccuuuauguauauuuggaaagcaaacaagcaagcaagcaacaacaaaccugugugacaugaacugauaguggcacaaguucaaaccaggaaaaaccccauuguggaacaggaggugucuauauauuccaaacccuagcugagaaguguuuggcaauuaauaguugcuggggaggcgagaggaaguuuucuucaaugacguagccacuagaaagcuccccaugcuguaguaguuggcagguuugaucagaacgcauuagauaacuguacgaaaacauuucuccaacauuaaaaauuaccugugugaaggaaaaaaagaaauaacugauaaaaaugaaggcugacaaaggauauaucaauuagugauaauaguuaucucuauguaacaauuccaugugucuuucucaauauuugaaaucuucugguccuuuugauuuucacuuuuuuuuuucagaauguagcccaugaaaacuucagaguagauguuguuggcuaagaaggauucucaagcuguauuucuuuaggaguuaaagugagugcuacauauaaucagauaauuaguggacaugcugacccaccaugguugaugaaaugugauacuucacaguucauaucugcuuagauaacuuaacuccaagauugacuauuaguuaaaaaucucucuuuuuaagcuaauacugaucgcaugauccugaguacucaauauuaaaucaucuuaagccagcguauuucuuuuaggagguaaaggguaucaucugguaggcauuaaggcucuaauguaguccauauuucuuucuuuauaacuaaaaauauucuaacuucaucucagcagauacuaugauagcugcucagcagcaacauguucagauuuaacucugcccugagggguacuguaaagcauugugaacagaaaacuaaacuuucauaaugaagccauuguggauagugugucaaaaugucauuuuaauaauccauauuuuaaucauacugacuucaccugucagauccuauuuuaguuccuauuagccaugcacuucugagaggcucgguaagaggcaguggugauagaaucuacaccuguccuaauuuguuugcuuugccagguauugcugggagaguggguuuaacauacauuguauaaagaucuccaucugggcucagucucugaauggaauauguucuuuauguggguacagauaggaacuugucagcaucuuuuggguauggagucaucauuuucaagugauuugucuguguuuuuauuguauaucacucagaaguagaguuuauauugaaguuuauacgaaaugcucuagugguguagacagaaaaggaaaaaggagcuggcacuuccaauguccuuagaaagaacaaguugaacaaucagaauuuauagauaaucauugugugcuugcuuuucucucugauacugcucucauuugaacguuuuucuuuaacuguuacuuggcucagggaacaauauuugcagauagaaaacuuuuuaaaugcacuuuaaaaauuaucuuuaaucuuuuucuacagucuaauuguuauccuccuccugguacgccuuccaacaguuacuucuucaucccauccccccugccccaucuccaagaggauaugcccacuuccaggccuucccacucccuggggccucaagucucuggaggguuaggcgcaucuucucugacuaaacccagacccagcaguccucugcuguauauguguuggggaccucauaucaguugguguaugcugccugguugguaauccagugucugagagaucucagggguccagauuaauugagauuccuaugggauuacccuccuccucagcuucuuccagcuuuucccuaauucauccacaggggucccugacuucuguccauugguugguuguaaguaucugcaccugacucucucagcugcuuauugggccacucagagggcagccauguuaggcuccuaucuauaaguacacuauagcaucaguaauauuuucagacuuuggagccuccccuugagauggaucacaauuugggccugucacuggaccuccuuucccucagucucuucuccauuuuugucccuguaguacuuuuagacagggacaauucugggucagagucuuuuucugugggauagcaacacccucccuccaauugaugcccugucuuucuacuggaggugggcucuacaaguucccucuccccacuguugggcauuuuaucuaaggucccucccuuugaguccugagagucucucaccucccaggucucugguccauucuagaggaucccuccacgcaucuccugagguugccuuuuucuauucauucuucuggcccucugggcuucucuccugucucccccaccauaccugaucauguuccccucuuccccucccuguuuccuauucccuuucccuuucccacccaggucucucccucccugcguccccugugauugcuuucuucucccucccaagugggauugagccauccucacuuggguccuucagcuuguuaaccuucuugagugcugcagauuuuauccugguauuuuguaccuuuuggcuaauauuacacuuaugagugaguauacacaaugcauauccuuuuggggcugaguuaccucacucagaaugauauuuacuuguuccauccauuugccuacaaaacucaggauguccucauucuuaauagcugaguaguauuccauuguguaaaugaaccacauuuucuguauccauucuuucauuguggcuaucacaaauagagaaacuauauacauaguggaacacgugccccuguagcaugguggggcaucuuuugaguauauacccaagaaugguauagcugggucuucagguagaucuauuuccaacguucugaggaaucuccagacugacuuccagggugguuguaccaguuugcaaucccaccagcaauggagaaaauugauaaauuggaccucaugaaacugaaauuguucuguaaggcaaaggacauaucaauagaacaaauaagcuaccuacagauugggaaaaauaucuucacuaaccccauauuggauagagggcuaauauucaaaauacauaaagaacucaagaagcuaaccuuaaaaaaccaaacaacccacuuuaaaaaaaaaugggguauugaacuaaacagagaauucacaacugagaaaucuugacuagccaagaagcacuuaaagaaauguucagaguccuuagucauuagggaaaugcaaaucaaaacgacccugagaugauuaaguugcacuuguuuaacuguaaaucuagaugggcaaguuugcuuuaaaaaaaaagauaagaaaaaaaaaacaaaaaucacauagugaucacauccuuuucuuuccauauggacacuugugaaaccaguugcugccguguuggaguuuauggaucacacuugaauccuggauccacauaagaauauaugaccugucucauccaguuagcuucuaauucauuuugguguuuaaaauuacugugagucucuaaauguuuagauucauggcagauuggguuuuauuauucagcaacuaucuguaucuuaagguuuucuuuguucuggggaaaucaguggcuuuacuuuuaaaaagcagaauuguuucccgguagagcaguguaacugaugauagcuaggauauguucaaucccaaguggaaccagguugauuuucuauaaaacuggaggaaaaaguucaucuguagauaagcuugaaggaaaauggcuuguguuuuaccuuuagaggagcaucuugaaggguauuuaauuugauauucuuaucuauaagaaaugcggcaggaugaagcauguacacucagauguguagcugauaacacucgugaaaacuggaaguuccauuuuuuaacuuuuaaaaauaugcaagaagggcccaaaauaaugcagggaaagaaaaaugauaccaaacugaagucacaggacucaacauauaauucuggugaaacucaggaagaaccguauuagugauagucuagaauaugcacagugcuuuacaauagguugauugcacuaaacaaaggagaaaauccuuucucugaagagcuuacaaucuaaagaugcaaguuaguuacaauguggaaugagaacaauaagagauccccaugguggguggccuucauagaugaaauacuuaaaaauaaggugaggguuagagagaguugaagggaaauagaagcuucuuugagacuggugaauagggauaaggaaaugaagauuggacaaugugucugaaaagaggcucagcauaagaaugggcaaagagaugagacugaugacauuacagcgcuuggagauuuagugaacaagagaaaaaaugccagcagaggagaauugagacauucuauaaacauucuauaauaaggcucugaauuacagagaauaccacagcuuuaaagacacagauuccgagaaugcagcuugcaacagcuuucuugccacaguguuggcuucgauagcagaagaaggaagaguguagcaggcuugaaacaauucagugagauucuauaugugcuucauaagcaguaaagcaguacagauguacauacagucaucauauuuugcuuaacuuugauuuuauuaaaauuuugguuagcauaauauuuuaagucaaaugauuaucaguagaauguuccauuacagagauguuaugaggaauuuaucugauuauaaauguuucauuuguuuccauguuuuuacaagcucauugcaaauucuccucaugagugucacagagcuuagccuuucuuugaacauacauacaucuucaugucagugaaauucucaucgccaucaucccugcccucucacuugcuuccagccucaucuauaccuuugcauuuauaugucaugcauuuccuuugauguaacaauauuguuuuauauuaugccuaauuucaauaaggcuuucagugcauuuacuguauauauauauaaagcuuaagccgggcaugguggcacacaccuuuaaucccagcacucagaagccagaggcagacagauuucugaguuccaggccaggcuggucuacaaagugaguuccaggacagccagggcuauacagagaaacccugucuuaaaaaaauaaacaaaaaacagaaacaacaagaaaaacaaacaaacaaacaaaaagcuuaacacauugacaaagaaaugagccuguuagaaaaauauauguaaguuaaaggggaaucagauaagguuaguacaauaaauacauaaacuuaaggauuuuauaguuaugcucugacauaggugccaugcuucucaccagacucaaaaaaaaacaaaaacaaaaacaaaaacggaugaguuaauaaaaggguuugcaggugucaauaagcugagaagcacagcuuuuuaaaauuugugagaaauuucugucugucucuccuccccaaucucucucuccuauguguauguuucucucucuuucugucugucugucugucucucucucucucucucucucucucucucucucucucucucucucucucucucucucugugugugugugugugugugugugugugugugugugcauaaauauaaccuacaaaguccauauaauguuacuucuguuuguuuucagggcugaccauuugcuacuggacaaucaauuggagucucuggggaaaaacaccucuccugcuuucagcuuuccucaguugccugcugugaguguguguguguguguguguguguguguguguguguguguauaguguugaggccucaugagcucuuucuaccauccacucugacaugccauccacaugacauaugugucaucuauguucagcuuauauugaggcagucauguuaaugagucuuuaugaauguggccucugauuuuacuaggagauucauucucauagcgaacucuccaguccuauggcucuuaugaucuuccugccuuccucuucuauaauguccccggagccauaaaguucagaguguuuuguauccauugggacugggcuccacaacucugcauuuugauugauugugguuuucuguaguggucuccaucuguugcaaagagaaguuuccuugauaagggcugaggacuacacuuaucuauggcuauaaagacaaacauuuagauuguaguuaggaauuaugcugauuuaguaaagugguaguuuuacauucuccuccaaguuacaugacuccauaagcacugaguaguuggcuaaguuuccaauaccagaugugauuucccucuugcugagcaggucuuaagcccacauagagagcuguugguuacuggcaagguaugugugcuauuauuguaaccuuaggguuauccugcuaugcugucuguugauguugauauaguucauaggcaucauagcuggguagaacugcguccugacucuggaagcuuucauggcaauuucugguaucaugaaagcuaguccugaggaugaagacuuuaggucaauucuagcucaggggucucugggcccugcuucugaaguguguggugucuucagcaauagagacuuaccuuccaccucuggcaggcaaccaagggcaacuccuagacaacaauucaaaagaggacuuuucaugucuguuauuagaguuuugguuaauuggucuuuggcucuugggggagcauucucaguacagauaagaaaagcucauuagguaaguagucaguaguuuguuuccuuauggcuuuuucagaaacccucaucuaccacccaucacuaaagaacccuauccugucauaauucccugaucauaucacuuguacccuaguauucccuucugcauugcuccccaaaccugggaaacacuccuauuuuauguuacuugauuucuguuguuacuuaagguauagccucacaugugaacauuuggagcuaggaucuuuuaaagagucuuuuggaucuggauuacuucauuacaaugaucucuaguuguaucuauuuaccugcaaagcuaauuauuucauuuuucuuugugcugaauauuauuucauagugcauauguaccacauuuuauuaauuggaggacauuuaguuguuucuauuuccuagaaauugugaauaaagcuucacugaauaugucugagaaaguaucuauagaguaggaugucaguccucugggcaaauacugaggagugcuauacuugggucauauuguacauuuauuuuuaucuuucugaagguuuuucacacuuauuaccagaauggcuacaccaguuuaucaucccaccaacuguggaugaggguucccuuucccccaaaucucuccagcauuuauuguuauuauuuuguugaucuuuuccuuucugacuagaguaaaauuaaaucucaaaauugacuuccuuuugcauuuucuuaauugcuaggaaccauggacauuuuuugagauacuucuuagccaucuuuguccuuuauagaacuuuuuguucaggucucaggcccauuuuucaaaugagucauuucgagucuuuauucuuuguuucuugaacucuuuauagauucuagauauugcuccucugucagaugcauggcuggcaaagauucucucccauccugugagguuuccucuuuacccaguugacuguuuauuuagcucugcagagccuuuaauugucaugaggcccuacgugucacuuguuggucuuaauucuuggggaaauggaguccuauuuagaagucauuucuucaccuauauuguuuaaguacugccuuuauucucuucuaguaguuucaguguuucagguuucacauugagguauuugaucaaguuagaguuaguuuuuguguaaggugauauagguuuaguuucauucgucuauauguggacauccauuuuuagcaccauuuguugaaaguccauuuuuccuccaguguauguuuuuggcauccucaacaaauauuaaauggcuggauuuacauauauuaaaacuuuggucuucaauuuuguuccauuggucucuaugucugauuuuuguaccuguaccauauuguuuuuauuacuauggcucuguaauauauuaagauuuuauuucuuccaauguuguucuuuuuuccagucuuauuauuuugucuguuuugggucuuuugugcuuccauauaaauuuuaagaguuuuuuucuauuucugugaaaaauaggaucagauuuugauugagagcacauugaaucuguaaauaguuuuuuaguaaaacggucauuuucauaauauuaauuaucaaucugucagcaugggauaucuuuccauuuucuaguguuuuucucuauuucuucagaauuuuaaaguuuuauuguagaguuacuucacuuucuuguuuagguuuauuucuggauacuguguuuucuuugaggguuuauuguaaaagggaauuuauucauguuuuccuucucuguauguuuguugugauucuauagaaaauauguugguuuguguaaguugauucuauaugcuuccauaaugcugaauuuguuuauuauuucuagguauuuuccaguacacuauccaguaggaugucuaauguauaaugucaucugcacauagagauaguuugauuucuuauuuuccuauuugcauccuuuuaguuuccuucucuugccuuaccacucuagcuauugcuacaaguauauuaaaauggaguguggauguugaacaucucguucucauuccugaguucaguaagauugcuuuuuuuuuccauuuaguguaauguugucugugggcuucucuauauauagcuuuuauuaugcugaggacuguucucucuauuccuucauucucuagaacuuuuaucaugaaggcaugcuggauuuuaucaaaggcuuuuucuacaucuauugacaugaacaugugauuuuuauauuuagauugauuuaugugguuuacuuagucuauggaauugcacauguugaagcauccugcuuuugagggauaaaguaaauuugucauaguguauacucuugauacauguuuguauucuauuuguaagcauuuuuucaguauuuuugaauguagguuuaucagagauguuggccuacaguuuucuuuuuguugugucuuuaccuguaacuggauauuagaguuguuagcauucuguccuagcucuaccacacaguuaccuggcaacaaccagguaugcuccuccccacaguuaccuggcaacagccagguaggccugacucacuauaaaaggaacugccugaagucuccucucucuugccccucucucuugccucuugcucucuugcucccucucucuccccauucucucccccccuccauguggucauggcuauggcuggccucuacuucucuacucucucccccucucugccuuucucugucucuacuauccucuuaacucuccuccccauguuuugaauaaacucuauucuagacuauaccauuguuguauggcuggucccuugggggcgggggagagaugcuuuggcaugggucugcugagacauucucuucccccauaccucaccaccaccucccagagaacauauucuuauaucucuuuaucuucuuauaaacacaucaagagugauccugucuccaugaaaggauuuuccuuccuuccuuccuuccuuccuuccuuccuuccuuccuuccuuccuuccuuccuuccuuccucucucucucucucucucucucucucucucucucucucucucucuuuuccauccuccuucuccugcuccuccuccucuuccuccuccuucuccuucuuuguuguugagacaaggucucaugauguagcacuggcuguucuggaacuugaucuguauuaaagguacacacuauuuugggguauuuucuucuuuucuucuuuuuuauguuuugcuuuugaauaguuuaagaaaugguuggagaucuacuuugaaugucuuauagaauucugcuaagaauccaucuuauccugggauuucuuuuuuuuuuuuuuuuuuuuuuuuuuuuagcugaaagccuuuuaauuacuauuucaaacucaucauuuguuauuaguuaauuuaggcuguugacuucuucuugguuuaauuuuggugguuuggcugaauuuaaaaauccauccauuucuauuaagguuuucuuucuaugccauugaccuagaauucuucucccucaucuacaccuauaauucuuauuuuuugguuuuuuauucauggcaucucauauuuucuguguguuccuuuauuuuuauuuuuauauauuccuugcuuauuauuuggucuagaucaucuacuuuaucuuugaguucugauauucuauuuucugcuugauuaguucuacuuguaaggcuuuccuuuaguucuuaguugaguuauuggauuuuucaauuuuauuuucauuucagcuugaguccucuucauuuauaucuuuugacugaauucuguucucaagugauguauugucuucaucagccuauguuucuguuuuuuggucauuguucaguaguuuguucucuuugagcucuuucuucuuaauuucauggagcuguuucuuugugucuucauuaaacucucccaauucuuguuagaguucauacuuguucucuuaaauucuguguccuggaguccaucuagguaauucucauuaucaaacauuucuacacaacuuuuaaauuucagacagaagauacuggcuugaucuaucauauucuugguauuuuugcaaugauaucugggaauguggacuuuuacuguuaguucugggucugauauggacagaguaaauuggggaagaagacaauuuguguaagugguuugggucucaagguguggaaugaagucacagcaauacugggacaggacugcucuacagaauaugcuuccuaugccaagccuagaguguaaggguagaccugucuaggugcaaaagguuggcuaugucauggaagaauacuguggguuagaguauagcuagggaggauccuagccaaagccuaguguuccuucccugugcaggcaggagaggucaggcuaagcugaugcauuuguugugggacccaggcuagauuugguggguuguggaaaaggcauggaugaauuggaaggucaaggggacucacuggaccuugauggggauaugggaaguuugcauaaugagugggcugguuggaagcugugcagaagggacuuuugggugguugcaguaagacggguccuaguauaacccugaaguuguuugagcaacaggcauagaaggucagacuagacuggagcaugugaugugggacccuacgaaagccuagaggcucacuaaagugcaagagggguacuccugaaaggcagacugaggcugaaagagacuagacggggagagaaauaaagacaccaagacaaaaguacucuguucaaggcaccuuaaaguuuacuuagugucuaagcuuauauaggggguaggcccaucccccgccaguccauccaggcaccuguagaaagcuacacugcagguggccccacuucaguugcgacaaggucugcacaagcccgcuucaggcugggggaggcuacaauuccucccuaaguauauaauaaaaauagcuggaccaagacauaaaauuuauuuaugcuccauaguccugccugggaguuaugguagcugguggccaugccuggcuugggaaaucucagauuuuuccgaacuauucuuaucugucaaggaguauauaugcagcuuguuuguguuuauuuuacacaaacauggcucugugguguauuauuaacaaaccacggccucuuggcauaacccuuagauugauauaguuccgaaaucugguugccagucauuggcugaccagcccucauagcacaccuuauucccaaaucagaccaaagccacaauauauacuuaaaaugcuucuucauauugacgaauuucugccaccugcgcuugcuggaggugaggcugcacacuugcugaaaucaggcuguaaggagagacuuacgugcuugaaaaacaaaguagaaacaauugaaaaacaacaggauaauagcuucuuuggggauguccagguacuuuauucaguugcaaauuagcaacgaucaagcucagacucugaccuccuagugugggggagcuggcuuugagaauuaacagaaagacuguaaauucucuggaaguggagguuauauuccaaauuaacucuucuggccaaaaagaauuuuuagccaucaucgagguuagaaucauacuuacuagaagauucgggaucugugaccacuugacaaaccaaucuuucaggcagccaucgcgcuucaucuucuuuuugugaauaaacacaguccgaacaucuuccccagauuaaaacggggucuggaccauuccacgcauuaguuaaugggucccgccaauuaaccauggcauaagaacuggaaguaacuggaugccaguggugauuccugcagacugaccuuuaacaucaguuugcaaaaaaauuuaaaacgaacaagacaaaagcaagaugugcuuuuggugaccuuggggggggguauaacugccccucuuuuguuuuuaaaagccaauuuuucagagugcaaugagcacguuuaacaauuccuugucccaugggguuauaaggaauuccaguuuuauguuugauaccaaauuccuuacaaaauaaaguaaaauuguugccaguauaagauggcccauuaucugucuuaaugaguuuaggcaaucccauagcauugaaggcuuguaaacaaugaucaauuacauuucuagaggccucuccuguauguagagaggcaaaaagaaauccugaacaagugucaauacaaacauguauauauuuuaauuuuccaaauucugcauaaugaguuacauccauuugccaaauaugauuaggcauaagaccuuguggauuaacuccuaaaugcagcacuggagauaauguaauacauuuaggacauuguuuuacagucauucuugccuguucuuuagugaucuuguguuggagcuuuaagguauggcuggagagaugaaauuuaucaugaucacgacuagccaaaacaacaggaucuggaauuaaggccucuccuauuagagcucuguugaugcaaucauugccugcagcuaaagguccaggaagaccagagugagcucauauaugaccaauauaauauggauguuuucaggcaagaaugauguuuugcaauugugaaaacagagauccuacuggcauauuaaaguuaaacaugccacaagucuccaauaagggaaucgauugugcaccauauaaacuaucaguaaaaauauuaaaaguaucauguacagacugaaaaacauucaguacugcugucaguucugcuaacugagcugagaggcucaggagucucuaugacuacuuguugauuauucauaagauauccagcucauccuuuagaggagccaucaguaaaaaucaaaggagcaucauacaaaggcuguaaagaagucauauuaggaaauaucaccucauguacauuuaaaaauuuuaucaaccuaucuugaggauagugauuaucuauaauuccuauaaauccuauuugagcaagcaaccaauccguacugugcugauucagccaacuaucuugauccauacuauaagacugaacaaugauaucuggcucuuugccaaaauaaguuagugccuacuuccauccaaguaugaucaucugagcuacugcuucauaauauccucaaauguauccauguuagaggagcccuuugccacaacaauccuguaggcauaugaaucauauuaaaaauuaacagauguaaaggcaaagaguaaucuauauaagugacaaauuguucuucaauagcucuuucuacuuguuguaaggccagcaauccuucugagguuaaagaucuaggggagguaggaucagaacucccuuuaagaauaucaaauaaagguuucaauuccccuguaguaagcuuuaaauaggggugaagccaauuaauaucaccuaacaauuuuugaaaaucauuuaaaguuuuuaaguugucccugcgaauaacuaucuucugggggaaaacagcuugauuuguaagucuaaaccccaaauaauuauaaggauccugaguuuguaucuucucaggagcuauuuauaguccuuuaucagcuaaggccuuuuguaaaucuguauaacacaaaagcaaauccugggggucuuuuccugccaucaaaacaucaucuguauaaugaauuauuuaaaucauaggccauuguugucucacaggcugaauggcuugugccacaaacuuuugacauaagguaggacuauuagcaaugcccugugggagaacuguccauugauaucucuucauagguucuuuaaaauuuauagaaggaauacuaaaagcaaaucuuucacaauccucaggaugcaaaggaauaguaaagaaacagugcuucagaucuaccacaauuuuauaauauccuuuuaggaauugcuaucagagacggaagcccagguuguaaagcucccauugguaccaugguuucuuuaaccuuucuuagaucuuguaacaaucuccauuuaccagauuuuuucuugauaaaaaaaaauuggaguauuccaaggagacugagauucugcuaaaugucuugccucuaguugcuccugcacuagcgaaguggcgacuucuauuuucgcuuuagguaaagaccgcugguaaaucaacccacaccagaauaucauuaagccauugaauuuuaucagcaugggaugcaggcaagauaguagccauuacugaaaauaccccaaaccucuuguguuagaguggguuuuaggaccuucaaaagucuuaauaccuuguacuuucuuuccuagcucaugaccaggcaaaaauccuugucugagcaucugcuuggguguuuuuacaaagcuucuccaacucucucccagguucugcuagcuaaaguuuuuucuucccugaaccaugggcaacaagaaucuaucuuaucugaaauuuuuuucuaacaauuguucuucaaacccuacuccucucgccuguagcagcucuugaaggcuguggacaacugccucuuuggaagugucuagucccauauuucgaugccaacccuaaguggaaucagcgccggguuagcacuguuccaacuuagcccguauccaaucgcaccuccagcaacacuuuaaaauaugaaguuuaaagccagcgcuagcauaaauaccuguugcucacugugcccgauaugauauucuuguucuucccuucuuguggagcuccacauaagacagcagucccucagcuguaccccgccauuuucagguccguguucauggcaccaaucuguaguaguaagcugcccagggccuacaugaacuggguacuccugaaaggcaggcuggggcugaaagagacuaaauggggagagaaauaaagacgccaagacaaaaguacucuguucaaggcaccuuaaaguuuacuuagugucuaagcuuauauaggggguaagcccaugcccaccccaccccaaggucugcaucagcccgcuucaggcugggggaggcuacagggauugucagacuagcccuaugcacugguugagagaccagugcuagaucugguggguugugggaaaggcauaaauggggauuucugagaaacucacuaggcuagaauauggaagagaaagaacaugggacauuugggugcuaaggggguggcucaagacuguacagaaggggccugugagugauugcagguagggugaguaguagcagaaaugcaggugcggcuucacacuaggcagaggcagugcuuuugaaaccugugcuagauauggaaggagcaaaagacauggaucagaaagucagauggacucacucaccuggcuugacuuuggaaaaagauaugugaagucguguacagagugggauagauugaaguggugcagaacagacuggugggugguucugcucugagcucuuaucauuacauuuuggagcaaauacaacaaagaaaauggguguagcucauuuuuuauaaggugcuuucacacaacucacucauuuugucuuuguguaacuccuacaugaaaaguaguaguaagcacauuuuacaauuuaauaaaccuggggcuuagaugaacuaaucuauguaauaugauauaacugauaaguucuuugcuuucuuccauaugaaaccauaugguaaagcagugcuuuaccauagagcucuuuguguaauauuacuggaagacuaaauugggacaaguuaacaguauuguuaucguuaugguuuuuuuguuucuacuuugcuuuauacaauuguugaacugggaucuuuugauaugaaugacacugcuugcucgggcacuaaauaucccccagacuuauauucuuauaaauuguccuaucuucuuuuuuuauccuuuuuaaaucacuuucucugcucugagcuguuacuauuugauguaucuugcagcuccccuacuucuaaucaguagguaaguacauaggacuuucaucugauaauacaaaaccuaauucucuaauguuuucauuauuugaauauacauuuuugccuguuuucuauguuguuagcuaauucuggauaguugaaggugcuagguaaauuaccuccagaagugagauauucuuauauuucuuuaccaccugugggcagcuccauuuugaguucuuauuguuacauuuuggaggaaauacaacaaagaaauagagaguaggacauauuuuuugaagugcuuuuauacacuguauuauuuuguccuugugaaauuucugcaugggaaauagcacuaucuacauuuuacaauuuuuuaaaaaaaaucugagacauugugauuaacugaucuauauaaacauaucuaauuaauaagugaaguacucaauacuuuuguuuauauuuauuuuuugaggcaaagucuugcuauauuguucagacuuaacccaaacucacaaacuccuggccucuaccuccuaaguauugaaauuacaggcaaccacaccuggcuugacucuuacuuuaaauaaaacauuacuguggccaaguauaugauucaguugguacacagaaaccuaaggaucuaaguugagauccccauaacuccuguaaaaggcaggaguaguaguguaugcuugcagucccagugcuugggacucauagacaggaagaucccuagggcuggcugaucagccacuuaugcugaauuugugagcuuaagguucaguaagagacucugucuuaaaaauaaauugaggagugauugaagaacacaccaaccauugacuucuggccugcauucaaucugugucugucugucugucucucauauuccuguuaccauacucugcaaacaggauucugugaaauuuuagaaagcuauuuauugaagguuugaagugacugcccaauguaccuuauuccauaguaguacuuaauuucuuuuuuuuuccagucuuuuuugcuuaccuuuugucucccuauaagucuuccaaaaauagucacugaagcuucccauauaacccucucugccuagguuuacucguuaaccucccuuccauuuuuggauaaguuuugacauaaagauguauuggccaucuacagggacauugcucuuauagguagcacugcacuucauguaaaauuugugucuccagcuggcugaauagucuuauaguacucaguacuguguauacauaaaauucagaugugagaguuguaaacaugggcagauacguugugucuaaauagaaaugguauuuuuuuuaauuuuuauuaauugugauucucacauccugcaucccaauccuacuaaucacccuguuccuucauauccaccuuccgcccuugcaaccucccaccugaagaaaaaacauuuugcagcagaagcuguagugcgucacacauauugugucacacaguauauuuguccacucuucuuugcuugcaaauguucauugcaaugagucauuugucugguuuaaggucucuuguuucugcugcauuauuaauacaggauccccaccagggcuucucucagauauccuguuguugcuuugugucagaaagaucagguagcuuucauucugcaaacuagcccccgcaugugcucuagcagaucauagaugggguauguguugaggugggccaacucaaggcccuggaucugggcuugggugguagcugaguuggucagcccaccagcucuccugcacuggaaccaccauggucagcucucccaucuuaugcuauugggguagcucuacugugcugaccagguagggugcugggccugcucucucuaaauuuacuuuuuaaguuauguguaaggugauggacaauuuguggcuaaucaguauaugcguuaauucaauggaacuugaugaaaaugagagaaaaggaugcagauuucauccucugugaaguaugaaauuaacaaaaguugauaucacuagcuaaaacauuugguuuuaaaaaugucucaggaaagauuguauucuucauaccaaugagaaggcaaaguucuuauuuuugucuauauaauuuaagguaaaauaauuacuuuuacuguuacaaauuacauaugugucaccuaaugcaaacaaaaaugggaaugacuuuggaauuucuguggucuaugaaaaacauggagcuguaauguuacuaacuucugccuuugaauugggcuuugggaaaauauuuuugguuugaugcuuuuuggaacucacaauggaauuuaagauucaugagaugauugguaagauacauguccaaaugcccuugcauaaauccauuucuggcaugaaaauauuuucuggaaauagauaggacguccaagccuuccagugauccuggaggucaguuuccuggagucuccuuguauuacuuacuugucaguuugcugugauaaaacaucaugcccaaaggcagcucagaaaagagggaguuuauuuugguuuaugguuccagagggguaaguacccaucauguuugaaaaaacugagagauugcaucuucagccacaagugggaaauagagcaaacuugaagugaagcuaugaacacucaaagcccuuccccaggacauacuuccuccagcaagccugcauccuccuucaaacagugcuaccaaccagggaccaaguuuucaaauauuagugcauauggggacacaguuucauucaaaccaccacaccuuuuuucuuuaguaguuguuauguuuuacaugugaacaugucaguaaauaaauuuugggcugacuuuucagagagaaaucuguuuuuuuucuuuuauaucuaaguguccauuauaggaacauacaguuaguaggcauuccaaugauccugaugagaugcuuauugguaagugaaaagguguucucugaagggugaaaguggucugcucucuaaagauaaucaagguuaccacuucaaaaauauuucaaagaaacugaaguaucagggcaaaaugguaaauuaugaauuaugucucuagaauacugcaucugcuccuuuaugugaccucaacucuagcaauauaauaaagguaaaugacuaaacauuuauaaacagccucacuuauugaauaaagacaaucaguagcuugauguguuauguuuggagguagugcuacagauacuuuacaugguauaaugcuugugaggucagccccugauauuugaaagacaugcaaauuuaaccagagcagcacaguuuggaguuuucuuugauguauccacuagcuuuaguuuccuguagacgaugaugaguggguaucaaguguaagcuauaauauaaacaaaugagauguauacuuuuggguuuucaauuacuuuucaucuaacugcauugaacuuucauuuagugaaccaaauugaccgacuggcaacuguugugagacucugcuauaauaaaucuugauuaagcaucagcagauguaauagguauaagaguugagcuagacagaaagggucagauggguggacauuuuugaucuguagagcggauaaugagaugauaucaaaaugaaacuuccauaccucuucacccuuccucugccauuacuuuauucugagaacugaacuuauagaucagugauccuuauuuaacuuuucuuauaccauaacugcucccauuuaugcuuuguauuaauaauguagcagaaacaagagaccuuaaaccagacaaaugacucauugcaaugaacauuugcaagcaaagaagaguggacaaauauacugugugacacaacauaagcuuuuaaaaaguuaugucuuuuuggaaguugcuuauuaaugaaugacauaauuaaagaaaaacaucaagaaugacuuugcuuaucuuuguuuuacuuguuuuuucuauguauucucuuauuuaacacaucccaaccacagcuuucccuccauucccucuuuuuaguccuucuccaaccuuuucuuuucccccagauccacugcuucuccauuucucuucagaaaagagcaggccuccuagggauaucaacagaacauggcauaacaagauguaguaauacuaggcauaaaaacugaagaaaaucaaccuagugggaguaaaagagugagucccaagagcagggaaaacagucagagacaaccccagucccacuguugggagucucacaagaacaccaagcuacacaaccauaacauauaugcagaggaccuuugcaaagaccuaugcaggcucuauuauuguugcuuuagaagucuccaugagcccugcuuguuugauucugugggccauguuuuccugguguccuugacccucuggcuuuucuacaauccuuccucccacuauugugagagguucccugagcucugcauagugcuuggcugugggucucugugcuggcuccauucagcuacuggaggaauccucucuggugauuguuggccuggguacuggucuaugaacauaguaaaauauccuuaggaauuauuucauuaauucuuuuugucaguuguguuugguucuaccuuaggugucugagcaugguauaggugucugaguaugguaguuugaauagauauagcccuauagacucauauguuugaaugauuggccauagggagugacacuauuaggagauguggccuuguuggauuagguguggcuuuauuggaggaagugugucacugugggagcagaguuugaagucuccuaugcuuaagcuacauccaguauggcauguagucuccuacugcugcuuacaauucaagauguagaacucuccgauccuccagcaccaugucugucuguucacugccauacuucuuaccaugacaauaauggccuaaauucugaaauuguaagccagccccaauuagauguuuuccuuuauaagaguugccuuggucauggugccucuucauagcaauaaaacccuaacuaagacacugagcuauccagcuuccaauuuacuuguuuugaaaaauacugccuaauuuucaucuuaccuuucuuuacugacacuguaagaauaaaugccuuauaaaauaaucuuauacauacuuguuauaauagaauucucauaaaugacugaaacaauuuugcuuaucugagaaauaguauucuuugggucacaucucaaucauucugacacccugucgucuaggguggcaucccgggauauuuauaaucuucucagugguuaccaugaaauuaucaaacuaaaauuaauuugaagucacuuuauguaaaaugauuuagauaagaucuccaaauuaaauuguuauacacagagaaccauuuaauaguuagaaauuggugcuuuggaacaaugguucuuaaacuauuucauuucuacaugaaauaauuuauuacacuccacucuaugaacaacagucauuuagaacuaaauauuguaaaucauagucugucaagauucuggguacuuauguugguguuagaacuuuuauaugaacaggaaaaaaagacuuaagcuaucaaacuugcuguuucuggccuugauaccucauuuggguuaucaugaagaauaaagacccuaguagaugaugaacaaauucuaaugccauggucuugaacuuccaugcuccuagauccaugauguaaacaaacuuguauucuuuauaaauuaccauguuucauguauuuuguuauaacagaagaaagcagacuaaaacaaacaguacauaguuggggguuaucacuuucuacuauuaugcuuuuguuucuagucuaggaugcugcucaggucuauagcauuuguguuaguuaggguuucugucaaaacaccaugaccaaaagcaacuuggacaaggaagaguuuauuucauuuuacaacucucauggcacauucucaucacugauggaaaucggggcagaagccuggagggacaagcugauacaggggcugugaaggagagcugcugccuagcuugcuccucauggcuuucucugagugcuuucuuauagaaccuaggaccaccagcccagggcauccauagugagcugggcaaucccacauuaaucaucaaugaaaaagagcaccccaacuuguacccagucuaauugaggcauuuuuuuuuucuugguugaauuugacugguguggaguugacaaaaugaaaacaaacaagaaaacccuaccagaacagcaucauauccauucuuaacuauccuuccuguuuguugaguuuuuccagugucuucacuuuauuuuuucuuuauuuuuaaaauuauuuuaaaauaucuuaacauaaccuuuuacuuuuaaaacucugcaguaaauuucaaaaagucgaaaggucgguuucucccagugguuacauuuuguauagcuacaguauaauaucaaagcaggaaacugauacugguacacuaauuauauauauugugguaguuugaauguaauugguuccauaggcccaucgggaaugacacuaauagguguggccuuguugagguagguguggccuuguugagguagguguggccuuguugagguagguguggccuugcuggaggaagucugucacuguaggggugggcuuuggggucuuauaugcucaagcugcaccugguguggcagauaucuucuuuccuauugccuguauaugaagauauagaacucacagcuccuucucuaggaucaugccugcuugcaugcugccgugcuucccaccaugcuaauaauaaacuaaaucucugaaacuguaaggcagcaccaaugaaauguucuccguuauaggacucgccaugcuggucaugcuucucuucccaggaaugaaacccuaacuaauacauauaccuucugccauuuuaucacaugauauuuuuauagucaaucaagacauagaaacauaucaaccacaaaaagcucccucuuacuaccuacauuuuagggucaagcccaugccuucccauucuuuaauauucauuaaaaccaaucaacaacuaaaucuuuuuuaacacuaaaacauggucacuccuagauaacuauuauaaauacugcguguguauauauauauauuacaaaguucguuuaguguuguuuguauguacuuguguuuagggcugaucacuuaggauuguuuaacuauaaccauauguucaugugguggcauacauuguuaauuacuguauucugaagguauaggcaggugaauuucuguguguucaagauuggccugaacuauauagagaggcccugucuuaggaaaacaaaaccaaaaacuaaaacuaaaaaaaccuugaauaaucauaaccauucaugagcuuaagggcauuuugucuguuuccaguuuggcuauaaugauaugaacuauuauauaaaguucccuuacauaagcauaaauuucucuggaauuauuauucaagaguauaagcaauugugguuacauuguuuuguuuuauaugagacuuccaaauuguuuuucagauuaucugugccauuuuauagucccaccaacaaugugggaucccaucuugccagcauuugauauuaucaguaaucuuuauuucacuuaccuuuacugucuacaugcacacaugcauguguaaauacaugugccugcacauauaugucuaucacacguggggaaaucaaaagacaacuuuugggagcuauuuuuuccuucuaccaugcguuccuggaacucaaaucaucaggauuaugucacaagugcucugagccaucuugcuagcuauuuuagucucucagaccuguaaugauaucccauuauugauauaaguugcauuuauuuaacagcuaaugagguggaacaucuuuucauaugcguauuucucuucaauguaugacgaaauauguuuucauguugcuuucagucccucucucucucucucucucucucucucucucuuuccuucuuccuuucuuuuucuuucuuucuuucuuucuuucuuucuuucuuucuuucuuucuuucucucucucugucuuucuuccucuuucacuuuuucuuucuuuugguaucuauacaugcuauauauguguauaaauguucuuaugugugcauauguguguacaauuuugugcgugugugugcauacaucuugagaucagaagucaaugucaaauguuuuccuuacucuccauauuguuauuaagcaacugaugaaaacugaugcagaggcccacagccaaacacuaaguagaguuuggggaguccuguggaagagggggaggaaggauugaaggaaccagaguguucaaggaaaucacaagaaaaccuacagaaucaacagaccugggcuaacaaggguucauaaagacugaacugccaaccagggagaguaugcaugggacagaccuaggcccucugcacauauguaaaaguugggcagauggaucuucaugugggacucuugaagugggagcauuggccuucucugacucuguugccuuggcaacaauagaugugucuaguucuucugcaucuugcuaugccaaggcaaguugauaucuaugggaggcauccccuucucugaggagaaggguaggagggauggaucaggggaaaugagaggagggacugagagggaaggagggaagggaaacugcaacugagauguaaaauaaauaaauaaaaaaugaauauggguaaaacaaaagcaaaaccaaagguuccauacauuuauagaauguguauucaucauauccaccaaccgccaccucccuucagcucccucuagugacaacacacuaucuugcucccagcuucauguccucuuuuuauuuguuuuuuuaaauaauuacugcucccuuaguccauuugguuccacuuauaugcacacggaguguguguguguguguguguguguguguguguguguguguguaugacauucuaccggggcaugaacaacuuucaaguagccaaauacccaaagaaaacagacucuacaucagcagcuaucaacagucaaugacuacucuaaaaguuauggugccauagagcccauccucuguccaugcuggaauuuuuuuuuuuuuuuuuuuuuuuuuuuugguuuuucgagacaggguuucucuuuauagcucuggcuguccuggagcucacuuuguagaccaggcuggccucgaacucagaaauccgccugccucugccucccaagugcugggauuaaaggcgcaugcuggaauuuuggcaggccagcucuuaugcagguauugugcaggaaaccacaauugcuuggcaccugcagcucucauaucacgaccagaagucauuauuucacagcucucuucuccacucacucacuaacucuuaaguucuuugugccucuuauucucuaagccuugcuugguaggagauugauucccugucccugccuccccagcauugggauaacagguacacagcacuguacuuguuuuuuugucuuuuuacaucaauccuggggagcuaaacacagguauccaugauuguauaggcaucacuuuaucaacugaaccauccaccccacuucuuucccuuauauuuuuuauuuuuuuauucucucucuuucuuuucuuuccauuuuuucacguucuuucuccucguccuuccucuuccuacucucacuaagguuggaacuuuuauaggcaugauuacuauugacaggcugucccauuguuuauuuuuuuaauuauuucuugguuguuuuauuuacuuuuuugauaaucuuacauguuuauaauacauucuagucaaaugcauccaucugcccuguuuuaucuuuaucccaccccuacaacuuccuugccuucuuguaaccaagucccuauuugaauuuuuugucucuuugcuuuguuuuugauuuugcuuugcuccucacuuuguucaaucaagcccaccuuagugggaauggcuaugaagcuaucuccuggaguauaaauaacuuaccaauugacuacauaacugaagacaaugacuuucuucacuagucauccuauacugcagucaucucccguaguagggcgauguaguagggugaacaaagacccugugagcccuuuguucaucuaugacugaauauuuacugaaucagcuuugugcaggccccguguaggcaaguguagcuguuagucauguuguacccccaaaccacucuucaucaaccuaccuuaucaucacucagcucuuaaauucuauauacccaaucuucugugauuuuucucagaacuuugcacauaguacugaacgugaacucugcucugcugaauaagccuuggaucuauacagaauagucaugccacuauugcaccauuaaguaacuaucaucugcaaaauuaguaggacaacauguaacuggggaugacuguuacugaccuuuuaguuuuuccuccaguugucugcaugggaacuucuaaauacaauaaagaugccuuaguuacuugcuuguugcugugauaaaacaccaugaccaaggguuuguaucgguguacaguucuagagggaaaauagucagucaccaucaugggcaagaagcauggcagcaggaacagcugaaaacucauaucucuaaccucaugcaaaaaacacaggaagagaaaguggacucaaaauggugcaaaucuuuuaccucucaaaacccaccccuagugucauacuuucuccagcaaggucacaaacagacccacgaacuggggaccaaguauuaaaaugccugggaauauggagucaucugcuauccaauucaaaccacaauagaggacuaaccaacaggaaggaagccucuagcucgguucuauuacaauuucucuguauuugcauacaaaguaucuucaaaaauagucucuuaccuuccaauuuuucuggguaaccaaugacaacuuguauaguuuuugaggacucugggaccuuucuguucaacagcuccuaaggaggugccccacacuuggauuuucuuugaacaacuuaugacuucugagaucaucauuagccauccaauauauauccauauauauauauauguagauauauauauguagauauauauauauggauauauauguguguguguguauauauauaugcaugcuuuauaagcuaauuauaauauauauaauuauauauuauaauuaacuuagaaaguagucagcuuccaugugguuucauuaugaauacuuaucuuugguuagucuuuuccaugaacuccaucuucucccccuucuuucaugccuauccuuguuuaaacuugccacuggcaguauuucuuuccaaugucuccauaucauguguauacuaccuuucuuaccuuucuucaaaucucuuuccuacuucaccaugaccccuuucuugcuuccacaucucuacaggcauaccaugauaaccaaaucuaaaaaaugcaaugcuguguuccgcauaugagaaaggggacauggcauuugacuuucugagccugaguuaccucauucaauauaauuguucuaguuccauucauuuuuauacaaauucugcuuuucuuuccagcugaauaaaaauacauuguauacaugugccacacuuuacuauuuauugaccuguugauagauauguuugaugauuccauuuccuacauauuaugaauagggcagcaaugaauaaagauguccuuguuuuuaauagcugaguagcauuccauuguguuaaugaaucacauuuucuguaucuauuuuucaguugacgggcaucuggaucuuauccagcuucuggauauuacaauuaaaguugcuaugaacacaguggagcaugugucuuucugauaugauagaccaucuuuggguauauacccaggagugguauagcugggucuaaaaggagaacuuuuccaaauuuucugagaaacaccaaauugauuucagagugguugugcaaguuuuuauuuccacaagcaaagaaguguccuccuuucuccacauccucaccagcauguacugucccuugaacuuuugaucguagucauucugaugagaauuaggugggaucuagaguuguuuugauuugcauuuacccgaugacuaagagaaaguaaucccacauugacucaaagcauauuauguuguaaauuauuuguagcauauuucaccaaauuuauugcauuaucuagaaaauaugucuaauuugucuaauuuacuugggaaauucauuuuuaacaugugauauuaaagcuacaaaaguuuaauauaaucacuuuaaaggguaccaaaauuuggaagaaguaguaauagaugauagcuauauucuauagcuauaucaaaaucuauucuauauaguauagagauuaugauuugcucagauaacuauaaaagacaacaaaguuaauaacuacuugcuaaucauagaucauuaauuuugaaacuuaauagaagacucuggacuuaauggguuauauugaggaauauacugguuacuuuuaggaacacauauguauauauuaauacauguauacauguaauaauaauaauaaaaagagaucauauauuugagggagaaugaggagguauauaaaugagauuguagcuaaauugcaaucucaaaaauaaaaacuaaaugaauagaagacucauaguuaacuuuauuuccaaguugaaucaauauauuuuuaauagaaauguaagaaaaauucuaauaggcauaguauauaaauaggaauggaaauauauuaaagucuuuaauuguuauuuuacaaaauuguuauaauaugacaaaaacauaaauuugaugacagcaaagcuuaauauuguacuugugucucaaaauuuuagaugagcagaaaugugaauacaauuucaauacacauauucaugcauaaaauucuaaaagaauuaauaaaaauaauuauuuuaaaaacuauauauucgugaaaagaagucugaccuuguuaguuagcagugugccuuaaaaaauccauacuaguuaaccugauaaaacaaauuaaugacuuagguggccauuacaaauuuaguauauaaaaaaauucaaguguguguguguguguguguguguguguacaugauguaccuauguacguguaguuacauaucacaguguguauguggagaucagagcacagcuuuguggagcuaucuuuuuccaccuuuauauagguucuggggauuaaauucuggauuccagacuugugcagcaaguagauuuacucaucaagcaaucuuguugacccuguuacacagcauuuaaauuaauuuaaaauauuuuaaaucguuggaaauuuuguaaguugauugguguucccaucaccccacuggggguucugucuggcuacugaaagcaaucucuucagguuccauauccccacuguugggcauuucagcuaaggucaccugcauugaguccucggagccuccccaucucaggucucuggaauuucuuagagauucccuauaccccucccccagcagcugccuauuuccacucauuuuccugagccuuucagcuucucuucuguuucucccuauaccugauucugcccaaccccauuccucucuccucaugucucccacccugaucccucccucccucugguucccaugacuauuuugguugcccuucuuuuuuuuuuuuuuaauuaccaacucuuuuuuuauuuuuaaggcauuuucuauuagacauuuuaagugggauuuaugcauccucacuuggaccuuccuucuuguuuaacuacuuugauucuuuugggguauaucaugcauauccuguacuuuauggcuaauauccacuuaucagugaguacauaccaugaaugcccuuuugggucugaguuaaucacucagaaugauauugcuccugucuaaaagaaaugccgggauaaaaauggaccagagacugaaggaauggccaaccaguggugggccaaacuugggauccaucccaugcaugccauguaugcacaacaaaccccaacacuauugcagaugccaagaugugcuugcauacaggagccugcuauggcuguccucugagagguucugccagcucauacucacagucaagcauuggacugagccuggggaccccaagggaaaaguuaggggaaggauugaaggagcugaaggggauuucaaccccauaggaugaccaacagugucaacuaagcuggaccccucacagcuuccagagacuaagccaaaaaccaaggagcauacaugggcuggucuguggcccugaacacauuuguagcagaggacugccuuuuuuggccucaaugggaaaggaugcaccuuauccuguagagacuugaggccccagagaagagggaugcuuagcuuagcauuuggcaggguugaaaauuaccaucagugggauuaaugcaucucacuuauuuguuuaauaagccaauauaagauuaaaagaagaaugucuuuauaaauauggacacagugaucucugacuaucauuuuuacuauaaucuuuuaaguggucuugucaccuuuuuauguuucauguguaugaccagagccauaggccaagacagauaauguuaccuuauuuuugauguugagugaauuuuaugagaauugccagguacauuugguguuggugcaugauuguagucauagcauucaggagacuggggcaggggaauuuucauaaguucagugugaccacauguaacauagcgagacuguuucaagggaaauauaaaagugauauuuauggggaaaguauuuugugagauugcuuuacaaauuauuaaaauuauaguuaggaaugacuuauaaaguauacauuuaaguuaaaagcaauuuaauugaauaauauugaaggacuucugaaaagcuuuuagucaaauguacguggguacuguuagagaugcaguaucugaccacaagcuauaccuuauuuauauguagauccucuuuguaugcuuuauuacccugauaauaaaaggcacuacucuauuuuguaacacaguaaauuuccuuuuuccucaaaguuauggagggaccauauuuagcugaguuuaugagguuucucuauuaauucaaaccuuuuagauaauauugacaauguaagccccccaggcuacuuuugcuugauugaugaaauauuacacgaaacuugaauuuacuaugaugagacuuuagaaauacugauaagaacaagcucucucuguauaguugucuacauuaaacgcuugaaucaacagaaaguuagcuguggcuacaauuaaaugaaauaugucuuugauauuuguuucuaauacuauugauuaagaaaagaaaugacuggggcaaaagauaauccccaaauucacaaacagugauaaauacuguucucacucuuauauaacugaagguuugagagccaaaauaccaggagguauuguucaguauuuuaucggucaucuguuuugacacuuccagcuuuuaugugccccuucauuuuccucuuuagagacacuuagugaauaaaccuucuaaaacuuguagugaguuuacugguugguuuuugucaacuuacacaagucagagucaucuggaaagauagaucucaauugagaacaugccuucuucagauucucuguaaacaaaucuauagggcauuuucuugauuagugauugacaugggagggccuauccucugggcagaugguacuuaguuguguaagaaagcaaauuuacuaagucauggagagcaagacaguaaacagggucccuccauggucucuguuucuguuccugccaucaggcucuuuccuugaguuccuauccugacuuccuuugaugacuguacgguugugguuuuuguuuguuuguuuguuuguuuuuaaucacaacuaagauagaaggaaauaaugacuauauacuaugguuuucaccaauugcaagguucauugaauuuuuauacucuguuaaguaaaauacucaccaguucaugcaucccauaaauuuuuugguugucuuuuggauuacaguuaaaauaaccuucuauugagucuguaucuugcuacaucaauuuuguuguuuugucuuagaaauuguaaggacaaaccaaugaaugauccugagccuucagaaugcuagaauaaaaauguuuacugcaauuuuaaagccuaaaucucuacuucaguguucggaacauuuuuuuuuucuuuuuacaaagggccagagaagaaauaaccuucaacuguacugauaguaagcuuccauagacaauacagaauagagugugucuauguaguauuaaaacuguuacccccagagaccccugggacuaaaccaccaaucaaagaaaacacaugguggcacucaugacucaagcugcauauguagcagagaauggccuagucggucaucagugggaggagaggcccuugguccugugaagguucuaugcccuaguauaggggaaugccagugccaggaagcaggaguggguagguuauggagcaaggggagcgggggaggauaggggauuuucagaggggaaacuaggaaaggggauaacauuugagauguaaauacagaaaauaucuaauaaaaaagaaaaagaaaaaaugugcuuucuaaaacaggcugcaauauauuucaaaaauaaguacagauguccaacaaacauauguaaagaaguucaguauuacuacucauuuggaaaaugaaaaugaaagucacuucacuuuuaacuaaggaugcauacaauuaaaaaaacugaaaguaguuuuuagaaggauucauagaaauuggaauaaaauauauuggcaucuuuggaaucuaaaacuucaaguguggcaguuugauuaagcaaauaaucccaugauauaaaauuuucauucauagguacugccuuaguuaauuuucuauugcugugaagagacacuaugaccaagguaacuuacgugaaggcauuuaauugugggcuugcuuacaguuucagagggcuaguucaagaucaucacaguggagaucauggcaauggccauuugggcaucuuguuggagcaguaacagagcuuacauuuuaucugcaauuuagaggcagagaaaacaacugggcuuaggcuuuuaaaaccacaaauccaacuuccuaugacauaucuccuuuagcaaugccacagauccuaauccuucccaaaauaguuccaccaucuuggaaccaagcauucaaaugguaugaucauuagaguaucauuuuucauucacaccauugcagguacaugcccuuaaaagcugaaauggcuauucuuuacauacuuuuauaaaaauguucauagcaguauuauucacaauagucaaagcuggaaacgaucuaaaaguucacugcugaaugaauagauaaucaaauuauagcauacccacacaagagcauuguguggcaaccaaaagaaaugaagaacuaguacauauuaugacauggguaaaccuuaguacuaugccagaugacagaagucagaugcaaaagguaugauuccauuuguauuaaagacccacaauagguaaauccauggagacagcagauucauaauuucuagggacugguauaggaugaggacuaagaauaaggaauggaugauuaauaaacacuucuuugagaagcgaugaaaaugaauuggaauuaaauauagaugaugagacggcagaacuccuguccuguucucuugcuuugcucuccucuucagacaauaugagcuucaccacccucuccacuaccuucuccaccaacuaccagucccugggcucugugcggacucucagccaguaaguccagccuaccagcagcccagccagugucuauacaggugcugggggcuccggaucugggauaucccugucuugcuccaucugggauggcucucuuggaucuucaggccucgugggaaugggcugagagucucaacggugcuccggacuccaacaacuccaugcaaacuaugaagaggacaacuaucaguaaggucguggaugguaaaaugauguccaagaccaauuacaccagaguucugaggcacugaggcugagaaggagagagccccuggagacugagggaccaauaaaaguugagagcucacuggaaaaagguauagaugauggguaugcacuacugaauuacugaaguggacaguuuaaaguaguuaauuccauguuuuaugaacuucaccucuauacaaaaaauggacaguuaugaugauugaccagaguuuacugaccucugcucuauuugguaagugaguauccucuaucuccuucauuucugagguuucucugucucucauaucaugagagcugcuagagaauaugccuaaauuugcaggaaaagguauauggcuuuaaugcaacccagcuaccaugagcugguaaaacauagaacgauucucucaggguuuugucaguacaucaucaucauuguuaucaucaacaacaagaacaacaacaucaccaucgauaacaauaacaacaacaacaacaacaugacuauuuuugaagcagaguaucacuauguaguccuuguuagccuagaaccaugaauucuuagaguuccaucugucugccuucaaaguacugggaaagggucuuaaccccauaccaaauuaaaaaaaauguuuauagaagcagccuugcuaagauauaauccauacacgcaugcacgcguacacacacacacacacacacacacacacacacacacacacacuagaaucuaccuauuuaaguuacaugauuuaguuacaugauuuauuuuuuaaagucauauucuaugaaaggucuaacuacuucuauauuuaacuuuagaccauuuugguuguuacuauauuuuagccaguauaacaauacaccugggguguuggaaaaugauucagugguaguaccuagauuuggauccccagaaccuaaguuaaagagccaggugcuaugguacauguuuauaguccuagcacuggggaggcaaaggugggaagguucuugcgguucaccuugcauucuaucagucaagcugaagaaacaacaccagaccaaugagaaacauuuucuuguaaaacaagauaaauauuuccugagaaacaacacucauuuuuaucaaacuuugcccuccacaugccugccuacucaaauguguucacacagacauauguauacacagaaauaauacaucuaugaacacucauguacagauguuuguguggacauauguaaucauuuaucucuacaccuagggguagaauugcuggauuauaugacaagucuauguuuaaccuaauauuauccagucagcagaaauuugugaaauuucucauuuuuuucucaaccuuaccagcacacauuauuuaucugucuguuaauaaagauauauuugaaauaccacaauauuccuucuuuuacagguugucugccacugcuuuugcaauacaaucauuuuggugguuauaacaaagauauuauauuccacuauaaauuacaaagcacccaguaguuacuuguagaacuuuuauuguucuacuaacuugacuugugaauuaaaaguuugccagcugcugcuauacagggauucucauuaaguugaaguuaauuguguuuuuuaaugucuuagugaagucugauaaugaggauucuuuuuucuacauuguuuuucuuugaaugacacuccuaaguggccuguagucacuuuguguguguguguguggggggggggggaaggcguauccuagauauaaaguuuuaucuauuugguagaaagccuaugauuuaaaaagaaaagacaauuuguucucauaguuuaucauccaaagcauugacaaagaguacaaauaucaaaaggguaccaauaaaugugcuauuccagaacuugaguuauauagcuuggaauaucauaguggagaggguaagauugaauuaguaaguuaaaaaugaaaugggaagggaguuuggcagguaaagaucuggguauaaggcgggugcuaagucuuggaagaagcuauagugcuaacuuuguucccagaagggccuauagccaaguucuauccugcuguauuuuccaccaagggagccaaauacaaacuggaauggucagagauauggaaagcugcuaucagaaccuuuccucuuuguugauaagaaaaaaggauuauauaugaaaaugccacugggaucgagaugguguaagugaagaaauagaaaagugaaucaggcaaaauuugucauguucgaucucugaagagcuuugauugcuauuaauuguguucaggaaacauaacauuaaauguuccagaagacauacagcagcuacuaaggaaacuugaacuuaauggaagaagagggguuacagagccuugccuagaaguuauuuuuguuuugcguggucacacaaaugaguagccuagcaacugaaagcaacugcaagguacauuagugacgcuuugugugauuauacaguacugcuuguuuuaagcaggauguacuucauuauggaagguuuuuauuucugagacauuuguuaauugaaaugucccagggagagacuuuguuuugaauauauugaaggaaguuacaagucuaagccaaggagcagacaaaaucuaguacuugucuucugugcugugaguuaacuaauuaauaaaacaaaauggauggagcaggaaagcaucauaguaaguaugguaacucagauucagaaagacaaaacuuacauguucuauuucauaagucacccuuguuuauaaggugugugggggugggggagagagagagcagggggggagagggacaggggggaagaggagagggagaggagagagagaaagggagagagagagagagagagagagagagagagagagagagagagagagagagagagagaaggggggaguauaggaacaaauuauaaaacuagaagggaaaccaugagaagucuaaugagacaaugugggaacaguguagggcacaugggacaugaaagaggaagcaaugggugguagauggaggaguagguggaggaguggggucaagagaguugaaaaaaaaaggggagggagaacaacaacaaaaacaaaauuugcuuuaaaaugcccaaauggaacuuaauuacuguguauguuaauucaaacgcuuggauauaaaaaaaucucuugugcaaagaaaaaucuguuaacacaacuaaggacuuggaggcugaacuugguaaagcuccuucucuucuuguagaaaaugcacuaagaccauagcaaagcauccauuuccaugcauuguucaugacauuaaaugaaaacaccauguucauuguaaucagacuuucacucuuauagggauaaaauaugaucuguaaaccgggcaugguggcguacgccuuuaaucccagcacuugggaggcagaggcaggcggauuucugaguucaaggccagccuggucuacagagugaguuccaggacagccagggcuacacagagaaaccccaucucgaaaaaccaaaaaaaauauaugaucaauaaauaauauauaaggauuuauaucauuaugugccauaaauuauguccauaaaaauuaaaaacuaaugggacuggagaugaauuauauagguaaaguggugaaauaaaugucauucaacuaaaugauuuucuggggaguuggaacucaugggauaguuuuaaugacagaagaaauauuucgugggcuaaagugguaaauauaaucugaucuuauuucaugccaaaacuaagguagcagcaaauugaccagauaaaaaaauuuaugaaauuaguaucauaaaaugaaggauaucauauuccuugaaauauaauccaaaugaaugauaaaggccagaugucuucauuuccuccacauucacugucaccauucuguucaaacuguugucuagaagaaagauggcagcagcugccuggaccugcagcagagcauccuggaguuucagagacccaaggagguuccaaggagugacccgagggcaggaguuugcagggccagcaauagcuccagaacaacuaaggggaaaaauagacaagucuuauggaaaagugcuuuuaaaaugugaaaucacaaaaucagaaggaaaaauggaugaacagagcuggcucagagaaugaugaauuuguacccuucacugccacuagucucagcuucaagaacaaaauauguuucugaugagcauugguguauaggcaccaaggacugggagaugugcugcccccuggaguuccugcaaaaauccauuauuguugaauagggccagcauagguccuaggcacccaacauggaggcccugaagcugcaacuccaugcuuccuguccugcugggacauggaaaguacugagcagcaucacuguacacaggcuucaaaaggucacgucuggugagccucaagguggcagacauugagggcagggaggugugugacugccagcagcucccacagaacuuaccccagccuccaucccuccccaaagccccaguuauugacacccugccuagcuccaacauuauccuggcucugggaaacgaaacaauaggauaucugagacaaaucucaacaaugguccaauauuuauggugcaacagaaaccuugauccagaccaccaccucauugcaaugaauaucugcaugcacagcugucugagacagacagacagacagacauacagagacacugcaguuucuaaugcuacuauuauggaugaauauuugauagagaggugggaaagauagaggacuguagcagugagcgagugguggaaaaaggaaugugguguugcugaguagggccagcccaguggugugcagcagauugaaccuugcaaucuuacucagcccccagacaugcugugcagacucaugaucacucugguccgaagcaaugacaggauuccaaggugaagaacaguacauuuucugaauuggaucuccuugaaaucccucuaugaucacugcugccuuuggagaccacuuuaguaucuguggucugcugcuccaggcucuauugaagcccuagauucagguagaugucugugauccuacagcagcucagagacuuguugaugucucuggcccgacuuaccacugaaagcuauauggauauccuuggucugggcaaccaccugaggccauccugaugucuauggacuguacuucuaccuggaucaauguugugaguagccugggaagccaccugaggccauuuugauugaugucugaguccaucauccuacucuauccaggaccuguguugauguuuguggccugugcuaccacuaaagguuauucagaugucugugguguaugguaccacuggggcaaugucuggaugguccuacugcagcagggguuuguugauuucuguggaucauguugccacugaaggcuguguggauguccuugcucuguacugcagucuaaacccauuaaauggcuaugggcuaugcugccuccaaggccauguugaugaaaguagcuugggguugccccuugagaccauguuaaggccuuggccuauguugacacuuagggcuauggugguaucugugacccacagagcagucacauagagggcaugauguccauggucuguagccacaggagaccuuuuuuguuguuguuguuguuuuuaaggcauuuauuauuagauauuuucuuuauuuacauuucaaaugcuaaccccaaagcccccuauacccucccccuacccugcuccccaacccacccaaucccgcuuccuggcccuggcauuccccuguacuggggcauaugaucuuccgaauaccaagggccucuccucccauugacagcugauuaggccauccucugcuacauaugcaacuagagacacaagcuuugcgggggggggggguacugguuaguucauauuguuguuccuccuauagcauugcagaccccuuuagcuccuuggguacuuucucucuagcucuuccauuaggggcccuguguuccauccaauagaugacugugagcauccacuucugcauuugccaggcacuagauagucucacaagauacagcuaugucaggguccugucagcaaaaucuugcuggcauaugcaauagugucuggguuuggugguugaauauggaauggauccccggguggggcagucuuuggauggucuuuccuuccaucucagaucugaacuuugucucuguaacuccuuccauggguauuuuguuccccauucuaagaaggagcgaaguauccacacuuuggucuucuuucuucuugaguuucauguguuuugcaaauuguaucuuggauauucuaaguuucugggcuaauaucuacuuaacagugagugcauaccaugugaguucuuuugugauuggguuaccucacucaggaugauauccuccagaugcauccauuugcccaagaauuucaugaauucauuguuuuuaauagcugaguaguguuccauuguguaaauguaccacauuuucuguauccauuccucuguucagggacaucuggguucuuucuagcuucuggcuauuauaaauaaggcugcuaugaacauaguggagcaugugucauuauuacaaguuggaacaucuucuggauauaugcccaggaaugguauugcugguucuucugguaguacugugucuaauuuucugaggaacugacagacagauuucaggagugguuguacaagcuugcaaucccaccaacaauggaggaguaucccucuuucuccacauccuugccagcaucugcugucaccugaauuuuugaccuuagccauucugacuggugugagguggaaucucaggguuguuuugauuuacauuucccugaugauuaaggauauugaacauuuuuuucagguguuucucagccauucgguauuccucaguugaaaauucuuuguuuagcuuuguaccccauuuuuaauaggguuauuugauccaucuuaaaaucagccaccaaaccaagacacuauugcauaugccagcaaguuuuugaugaagggacccugguauaucugucucguaugaggcaaauacagaaguggaugcucacaaucaucuauaagauggaacacagggcccccaauggagaaucuagagaaagcacccaaguagcugaaggggucugcaacccuauagguggaacaacaaaaugaacuaaccaguacucccagagcucuuaucucuaguugcauaaguagcagaggauggccuagucggccuacacugggaagagagacuccuugguauuacaaacuuuauaugccccaauacaggagaaugccagggccaagaugugggaguggguggggaggggagcaggguggaaggauggcauagggaacuuucaggauagcauuugaaauguauauaaagaaaauaucuaauaaaaaauaauugauuuggaauuuugauggggauugcauugaaucuguggauugcuuuuggcaagauggucauuuuuacuauaucaauccugcccaucuaugaucaugggaguccuuucuaucuucugagaucuucuucaauuucuuuauucggagauuugaaguucuugucauauggaucuuucacuugcuuagagucacaccaagauauaguauucgugacuauugugaaagguguuauuucccuaauuucuuucucagccucuuuauccuuugaauagaggaagaacacugauuuguuugaguuaauuuuauauauagccaacuuguugaaguuguuuauuauguuucggaguucucugguggaauuuuugggucacuuaaguaaacuaucauaucaucuguaaauagugauauuuugacuucuuccuuuccaauuuguauccauuugaccaccuuuuguuuucuaauugcucugucuaguauuuauaguacuauauugaacugguagugagagagugggagucuugucuagucccugauuuuagugggauuguuucaaguuucucuucauuuaauuugguguuggcuauuaguuugcuuuauauugcuuuuacuauguuuagauauaggccuugaauuccugaucuuuccaugacuaauaucaugaagagguguuggauuuugucaaaugcuuccucagcaucuaaugaaaugaucauguguuuuuuuuuuccuuugaguuuguuuauauaguggauuaugauuauggauuaccauauauugaaucaucccugcaucucuaggaugaagccuacucaaucaugauggaugaucauuuugauguguucuuggauucacguugccagaguuuucuugaguauuuuugcaucgauauucauaagggaaauuggucugaaguucucuuucuuuauugggucuuuguguaguucaauuaucagaguaacuguagguucauagaaugaauuggguaauguuccuucuguuucuauuuuguuuaacauuuugaaaagcauugguauuagguguucuuuaaaggucugauagaacucuacaccaaacccaucugguccugggauuuuuuugguugggagacuauuaauaacuguuucuacucuuuaggggauaugggacuguuuagaugguuuaucugaucaucauuuaacuuugguacuugguaucugucuauaaaauuguccauuucauccagguuuuccaauuuuguugaguauaggcuuuuguaguaggaucugauccaaaaaggauuuccucaggaucuguuguuaugucucccuuuucauuucugauuuuguuaauuuggauucugucucugugcccucuaguuagucuggcuaaggguuuaucuaucuuguugauuuucucaaagaaccaguuccugguuuggaugauucuuuguauaguucuuuuuguuucuacuugguugauuucagcccugaguuugaucauuuucuuccuucuaguccucuuggaacuauuugcuucuuuuuguucuagagcuuucaguuguacugucaagcugcucuugcaugcuuucuccaguuucuuuuuguagguacucagagcugugaguuuuccucuuagcacugcuuucauuaugucccauaaguuuagguauguuguggcuuauuuucauuaaauucuaaaaauuuucuuuuuuuauuucuuccuugaccaaguuaucauugaguagaguauuucucagcuuccacuuguaugugggauuuuuauuauuucuguuguuauugaagaccagccuugguccaucaugcaugagauaggaugcaugggauuauuucaaucuucuuguaucuguucaggccuguuuugugaccaguuguauggucaguuuuggagaagguaccaugaggugcugagaagaagguauauccuuuuguuuuaggauaaaauguucuauagauaucuguuaaaucuauuuguuucauaacuucugucaguuucacugugucuccguuuaguuucuguuuccaggaucuguccauugaugagagugggauguugaagucucccacuauuauugcaugcagugcaaugugugcuuugaguuuuacuaaaguuucuuuuaugaaugugggugcccuagcauuuggagcauagauguucagaauugagacuucaucuugguaaauuuuaccuuugaugagcaugaaaugcccuccuuguauuuauuggcaacuuuugguuuaaagucgauuuuauaugauauuagaauggcuacuccagcuuguuucuugggaccaaauugcuuuccagccuuuuacucugagguagugucugugacauggguuuccuguauacagcaaaauauuguguccuguuuacauauccagucuguuagucuaugucuuuuuauuggugaauugagcccauagauauuaaggaaaagugauuguuguuuucuguuauuuuuguuauuagagauggaguuuuauauauauauauauauauauauauauauauauauauauauauauauaugucuaucuuccuuuugguuuguuaaaaguuuauuuuccugcuuuuuucccuuacugcucuuaauauucuuucuuuguuuugugcauuugguguuuugauuauuaugugaagggaagaauuacuuuuaugguccaaucuauuuggaguucuguagguuucuuguauauucaugggcaucucuuucuuuagguuagguaaguuuucuucuauaauuuuguugaagauauuuacuggcuguuuaaguugggaaucuucauucucuucuauacuuauuauccuuaaguuugguucucucaucauguccuccuuuuuuggguuaugagcuuuuugcuuuuugaauuuucuuugacuguugugucaauguuuucucugguaucuucuguaccugagauucucucuucuaucuuuuguauucuguuggugaugcucacaucuauaacuccugaucucuuuccuagguuuucuaucuccacaguugucucccuuuguguuucuuuauuguuuauacuuccauuuuuagauccuggaugguuuuguucaguuccuuuaccuguuaaguuguguuuuccuguaauucuuuaagugauuuuuagguuuccucuuuaagugcuucuaccuguuuaccuguguucuccuguauuucuuuaaaagaguuauucauguccuucugaaagaccucuaucagcaucaugagaugauaauuuuaaaucccaaucuugcuuuucugguguguuggaauuuccaggacuugcuauugugggagaucuauguucugaugaugcccuguagucuugguuucuguugguaagauucuuaugcuugccuuuugccaucugguuaucucugguguuaguuggucuugcugucucuuccuugaguuugucccuccugugggccuguaagccugugucagcacuccugagugaccagcucuccccuggcaggaccugugcacagaggggcuccuggguacagcuggaggcaggaaggacccuaucccacugcuuuuggggccuggccugugcgcuccugguugguccugccuuagauugucacuggagagaaaauggcaaucucaccuccgaguccaggagucagaacacucccuggagaugagcucuccccuggcaggacccaugcacagaggacuguggaacagccccagcuucuggcugcaauagaggcuggaaggacccugucucagcugcuccacugcuccugcggccuguguacuccuggcuaauaaguacaguuuuauaaauaaauaaaucaaaucauuuaagucacagacuggaaagauaacauguuaaauaaccagcuuccaaaugacagggcucagauuugauuucaguaagccugagaucauauuucaaaaaaucuacccucuuaaucacugucaaaugggcaaaauagauaaaaucaaugugguaucuaauuaaaugucagucagaaauugaaguucuauuuuaggaaaugauacaucaauagagaaaugguaucuuuauugaaauuuaacugauaucauuucaggacuauauuuguuguguaagucagcuuucuguacuacaucaaaaacccugacaauaugagcuaaaaggaaaaaaaaaggaaagauuuauuuuggcucagguugucacagguuuuagucuaugaucacuuggccccaaugccuuuagugcugaacaauugccuuaacaugauagaaguacuugguggaggaaaauacucaacuuaugcuagaaaugaagcaaagggggaaaaaggaagggcagcagcaguugaguccccccucgagcauguaguaucacuucauuuuacuagguuacagcuccuaaguagcucaccaucuccaucagccucaucaaauuggaaccauacuuugacacaaaaacauuugggagacauuuaaguuauagaacauaacaauuguuucaugacauaaaagcauacuuccauauugaaaagcaauccuuagugaagguguuagaaacugucuuauauaaguuuuauuuugcacucucuauuucaucagucaauaugauuauuaucaauuaauguuucuuuggguagaaguaacagaaaacccaaccaagucaaagugacuuuuaacuguuuuauuuucuccaggaauaugcuagucaaaauccuagaacugagaaauucuaagucaccugguaccaacaaggaucuggggucuuucgucauuugucuuuuaccauccuucacacauuagcuauugccuauaaucuggaccucuaauagcugaacauguuuugcuguaacuuaagagcuuauaucuuuauaaaauucauauaguaagaauuauuaugauagucauauauaugucuauuauuuauuauaagaaaauguauaaaaauacauuacagucuuuuuuuaaaaaaaaggauauaggauaaucuaaaaauaauucaggcucuccccaguacuuuccuacaaaucuucucacaguggagccccagagaacauauuuaauucucucagguauuaauugaagcaaacuauaugcugaaagcuuacuagggauucaguaucuagggguuuccuugggagaugauuauguaggaaaccucugccuagcacauaaucaaauucacucucccgaagggaauuagguauuccacauacucuacauugguuguacaaacaaucgagguauaguaauguacccucaagguacacaccagaaacucaaauucucugaugcaaaccaaaggccaaccuuucuagugaacuuuucuauguauaccaacuccaggcuugcuaugucaucucuuuucuucacagauaguaaaguuuucuugcaagcgaaacuuucuuugaagacaaagugucacugccaauacuagaacaguugcccauuuccccucuuaaacggauaguugaaagaaucuaguguuuugcaauuuuagccucucauggaagauggauuuuuauaaugagguaaugaacaagggcuucugaauagagacaacuaguaaccucuuccaaaacaccuuuacauguuccuugguuuaaaaauucacuauuugaacuugcucuuguuucauuuaauaaccauuaaauauuuauugaaugccucuuaucuagaaacucuuuaacugcaaaagugggugaugaaaaggagagauuuuagacagaagaaaagaguaccacaaaaaauguuuuuuuuuuuuuauguauccaaauaacuaaaaauaagguauagcaaacacagauagugcaacagguguuauuuaaaaaaaaaaaaacaagccagguaugcucuauaggacuaugucagacucugcaggacguuguuauaaggacaggguuguaaggauuugggccuuuagcuucauuaucaaggagagccauugaagguuuuuaaauagucaguuucacaucuaaguuuguuaaaaguuuuuuacuugaaaauaauuuagacacacauugaauuucaaaguaguaaaugaguuccaguguuauauuuaccuguggaaauccuguauauggagguucauuuuaaauaaccaucuuaaaugaucuuacaugaguauacuauaguuuaucaaaaccaggaaacuaauaaaguaucaacugaaauacagaccugagcuaauauguuacuaguuaaauauuuuuaagcauucuccuguauacaguguagaaaaucuucuccauaauacacuauugacaauuagauucaguagauacauaaaccauaauguaacaaaauaaggugagucauuuagugggauguucagagaaauaaugucaggaaugguuucuaaauuucugguuuagaaaacuugauagaagugguguuauauaugcugagcuaaggauuaucuugguauguggucagguagaguucaacauguagagcuguugaguacacagucggguguuaaacucuggagcucagauaaaggacuauaugaugcucuauagcauugauacaucaugacauguuuaucauuuucuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuguggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuugccuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcacguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcucccuugucgaagaucaagugaccauagguguguggguucauuucuggaucuucaauucuauuccauuggucuacuugucugucucuauaccaguaccaugcaguuuuuauuacaauugcucuguaguaaagcuuuaggucuggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagauuugaaguuuuuaucauacagaucuuucaccuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuugugcagaauuggaauuagaucuucuuugaaggucugauagaacucugcacuaaacccaucugguccugggcuuuuuuugguugggagacuauuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagggcuuuuagauguguugucaagcugcuaguaugugcugucucccguuucuucuuggaggcacucagcgcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauguggcugcccuugcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcucccuuuuauuuuuguuguuagaguuggcauucuguucuuguggcugucuucuuuuugguuuguugaaugauuacuuucuugguuguucuagggcgugauuuccguccuuguauugcuucuuuucuguuauuauccuuugaagggcuggauucguggaaagauauugugugaacuugguuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaugcuucuuguaugaucaugggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcugaugcucgcaucuaugguuccagaucucuuuccuaggguuucuaucuccagcguugccucgcuuuggguuuucuuuauugugucuacuuccccuuuuaguucuaguaugguuuuguucauuuccaucaccuguuuggcuguguuuuccugcuuuucuuuuagagccuguaacucuuuagcagugcucuccuguaaaucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugauuucuguuaguaggauucuuacguuugccuuucgccaucugguaaucucugaagcuagcuguuuuaguugucacuguuaagagcuuguucuucaggugacucuguuagccucuaugagcagaccuggaggguagcacucuccuuaguuucagugggcagaguauucucugcaggcaagcucucuucuugcaaggcagguacccagauaucugguguucgaaccagacuccuggcagaaguuguguuccacucacuagaggucuuaggaucacguguggaauccugugugggcccuugcgggugucaggcgacucagcuggcaagguagccggggcucgaguggaguggaagggguuugugccccagaucaagcccggguagccugcuucccuauguaccgcagucucaaguuccacgcgauuggauugggguaggcgcuguguuccacucaccagaggucuuagggucccguggggaguccuguguggacccuugcggguguugggcaagacucugcuggcaagguagcccggggcucgagucacgagucuugcggaagggacuugugccccagaucaggcccggguagccugcuucccuauguacugcagucucaaguuccgcgcgauuggauuggggcaggcacugugauccacucaccagaggucuuagggucccguggggagucccguguggacccuugcggguguugggcaagacucugcuggcaagguagcccggggcucgagucucgagucgagcggaagggacuugugccccagaucaggccuggguagccugcuucccuauguaccgcagucucaaguuccgcgcgauuggauuggggcaggcacugugauccacucaccagaggucuuagggucccguggggaguccuguguggacccuugcggguguugggcaagacucugcuggcaagguagcccggggcucgagucacgagucuugcggaagggacuugugccccagaucaggcccggguagccugcuucccuauguacugcagucucaaguuccgugcgauuggauuggggcaggcacugugauccacucaccagaggucuuagggucccguggggagucccguguggacccuugcggguguugggcaagacucuguuggcaagguagcccggggcucgagucucgagucgagcggaagggacuugugccccagaucaggcccggguagccugcuucccuauguaccgcagucucaaguuccgcgcgauuggauuggggcaggcacugugguccacucaccagaggucuuagggucccguggggagucccguguggacccuugcggguguugggcaagacucugcuggcaagguagcccggggcucgagucucgauuaucauuuucuauuagauaccaaaaagaaauuuucacuuauaguguguaauaucuguauuuguugauacauauuucuauaaauauucauuuucucaugauaaauucucagaagugaaaugucugaauaaaagaacaugcauguuuuauuuuaauacuaauauuggaguuaacuccuuucucuuugauacuaauguaauuccucauuaacaauuuaagccagacuauuugaggucaaauuaaaaauauuugaugaacuauaauaauuuuugagcaccaagagauaccacaacaugugguuugcugccuaaauguacauacacuagaauauuggucuucaauaugacaauacuaagauuuagugaacguuuuuugacaaggugaggcuuaguaggauguuauuaugucauuggaaguacuuggaaauuauuaaccuggucuuuuaguaucucagucuuuaucugacuuccugucuugcugugagaucuuucccacuaugaugccaucauccaugauuugacccagucagcaaggaauugauuggaugccaauuccauccauggaauuuucaaaucuuggguuuucagcuucuuaaaauaugagcuauauaaacauccuugcuuuauaaagaaccuggccaaaaagcuuuugguaucaaugggcaguaaauuaagauaccaguaaaaugguuuugaguuuauuuguggaauaagucgguuccuagguaucaaaccaacuuaaauaguuuacgauaagcuagaaucuugugaguaauauaauugagaaaauaugcauccgaaaaguaaugucuuuauuccagucagcuauugguacaguaauuguaguacuaucuugauccaugauuuuccacguuuaaaaauuuuaaauauuacucuaauuuauauuuagcuuuuuaauucuuuauuuacauuccaaacauugcuccccuuccugguauccccuccaagaguucuuuaccccauaaccccuccacuuugccucugagagggugcuuccccaccccuuacccucccacccucaccucaccccuucauaucccccuucccugggaccucaagucucuacaggauuaggugcauccucucccacugaggccagacaaggcaguccucuguuagauaagugcugguggccauagaccagccacuguaugcucuuugauugauagcuuagucccuggaagcucccagugguccaggauacuugacacuguuggucuuucuaugggguugccuucccauucagcuucuucaaugcuugcuucccuuaacucuuccauaaagguccugaucucaaucuaaugcuugucuguaaguaucugcaacuuucucagucagcugcugguagagccucucagaaaacagccaugcuagguccuugucugcaaguacaacauggcauuaguaauagugucaggguuuguuucccacccaugggauugauccaaguugggccagucacuggguggccuuuccuuucccuguauuucuuuuagacagaaacaauucuaggucaaauauuuugaagguagguugauauccccaacccuccacuggggucccuaucuaucuacuugaggugguuuauuaagguuccaucuccccacugcuggacauuucaagguuacgcccauugaguccugggagccucucacaucccagaucucugagacuuucuagaugucucccucccccaacaugccccucagcugcauauuuccauucauuuuccugacccuuugggcuucucuccugauucuguccaugccugauucugauccccuuuucccucccccuccccucucccaccaugauuauuuauuuuccccccuucuaagugggauugaagcauucucacuuuggccuuuuuucuuguuaagcuucuuauggucaguggguuguaucauggguauucuauacuuuugggcuaauauccgcuuaucaguguauacauaucauacauguccuuuuaggucuagguuaccuuacucagaaugauauuuucuaguuccauccauuugccugcaaaauuuaugaaguccuccuuuuuaauaauggaauaguauuccauugcauaaaugaaucaauuuuuuuucuauccauucuucaguuaagcgacaucugaguuguuuuccagcuucuggcuguuaugaauaaggcugcuaugaacauaguggagcacauguccuugugguaugguggaacaucuuuugaguauaugcccaggagcaguauagcuggguuuucagauagaauuauuuccaauuuucugaggaauugccagauugauuuccagagugauuuuacccaccagcaauggagguguguucuucuuucuccacauccucaccagcaugugcugucacuugaguuuuugaucuuagccauucugacugguauaagguaaagucucaagguaaguuugauuugcauuucccuaaugacuaaggauggugaacguuucuuuaaagcuucuuggccauucgagauuccucuguugccaauucuguuuagcucuguacccaaguuuugggggguuauuuggcuuuugaaagucuaacuuuuggguucuugguauauuuuugauauuaguccucugucagauguaggguuagugaagaccuuuccccaaucuggagguugcuguuuguccuuuggauguuguccuuugccuugcaaaagcuuuucaggcugggcagugguggcacauguauguaaucccagcacuugggagagguuguggccagcguggucuacagagugaguuccaggacagccaggacugcacagaaaaaaccuaucucagaaagaaaaaaaaugcuuuucaguuucaugagcucccaauugucauugaucuuagagccugagccacugguguucuguucaggaaauuuuucccugugccaaugcauucaaggguauuucucacuuucucuucuauuagguucaauauaucuggucuuguguggagguccuugauccacguggaauugaacuuuguacagggagauaagaauggaucaauuuauauucuucuacaugcagacaguuagaacagcacuauuuguugaagaugcugucuuuuuuccacuuuuuuuuuuuggcuucuuugucaagggucaagugaccauagguguaucaguuuauuucugggucuuuaauucuauucaauugauccaucugucugucucuguaccaauacuguguggauuuuaucaucauugcucuguaguacagcuugaggucaggaacagugauuccuccaggaguucuuuuauugucgagaauaguuuucacaauucugggucuuuuguuuuuccauaugaaguugagaauugcucuuuccaugucugugaagaauugauuuggaauuuugauggggauugcauugaauuuguagauugcuuuugauaaaaugaccauuucuacuauguaaauccuaccaauccaugagcaugggagaucucucuaucuucugaugucuucuuugauuuccagcuucagggacaugaaguucuuuuuauacagaucuuuaacuugcugguuagaguuacaccacaauauuuuauauuauguguggcuauugugaaggguguuguuucccuaauuucuuucucagccuguuuaucauuuguauaaagaaggacugcagauuucuuaaagucaauuuuauauccauccaguuugcucaaguuguauguuacguauaggaguucucuaguagaauuucuuggugucacuuauguauacuaucauacuauauuuagguauguggcaugaauuucugaucuguccaagacuuuuaucaugaagggguauuggauuuugucaaaugcuuucucagcaucuaaugaaaugaucauauguuuuuuuuucuuugaguuuguuuauauuguggauuauguugauggauuuucauauauugaacaauccccgcaucccugggaugaagccuacuugauuguagugaaugaugguuuugauauguuuauggauuuggagugcaagacuuuauuuuuuuuuuacuuuuauaaguguauaauccucuuuaauauuuauaauuaauucauagauuuagagcaaaaugauaucuucacauagucuccuauguuuacauaaauauauauauauauauagagagagagauagauauagauauuuucuucauuuauauuucaaaugcuauccagaaaguccccuauacccucccccugcccugcuccccagcccauccacuccugcuuccuggcccuggcauuccccucuacugaggcauauaauauuugcaagaccaaggaccucuccucccauugauggccuacuaggccauccucugcuacauaugcaacuagagacacaagcucugggggguacuaguuaguucauauuguugguccuccuauaggguugcagaccccuucagcuccuuggguacuuucucuagcuccuucauugggggcccuguguuccauccaauagaugacugugggcauccacuucuguauuuaccaggcacuggcauagccucacaagagacagcuaugucaggguccugucagcaaagucuugcuggcauaugcaauagugucuggguuuggugguaguauaugggauggaucccccgguggggcagucucuggauggaccuuccuucugucucagcuccgaacuuugucucuguaacuccuuccauugguauuuugcuccccauucugagaaggaaugaaguagccacacuuuggucuuccuucuucuugaguuucauguguuuugcaaauuguaucuuggguauucugcauuucugggcuaauauccacuuaacagugaguguauaucauguguguucuuuuguuuuggggguuuuuucuuuuuuuauuuucgagacaggguuucucuguguagcccuggcuguccugaaacucacucuguagaccaggcuggccucaaacucagaaaucccccugccucugccucccaaguucugggauuaaaggcaugcaccacuacuaccuaacauguuuguucuuuugugauugcguuaccucacucaggaugaugcccuccagauccauccauuugccuaagaauuucauaaauucauucuuuuuaauagcugaguaguacuccauuguguaaauguaccacauuuucuguauccauuccucuguugagggacaucuggguuuuuucuagcuucuggcuauuauaaauaaggcugcuaugaacauaguggagcauguguccuucuuaucgguuggaccaucuucuggauauaugcucaggagagguauugcuggauuuucugguaguacuauguccaauuuucugaggaacugucagacugauuuccagagugguuguacaagcuugcaaucccaccaacaauggaggaguguuccucuuucuccacauccucaccagcaucuacugucaccugaauuuuugaucuuagccauucugacugaugugagauggaaucccagguuuguuuugauuugcauuucccugaugauuaaagauguugaacauuuuuuuucaggugcuucuuugccauucgguauuccucaauugagaauucuuuguuuggcucuuuaccccauuuguaauagggcuauuugauuuucuggaguccagcuucuuuaauuuuuuguauauauuggauauuaguccccuaucagauuuaggauugguaaagauccuuucccaaucuguugguggccauuuuugucuuauugacaguggcuuuucaggcuagggauuuuuccagggucuacugagcuccaacuugaccacuugagguucugcucuuucuuaaaacaaagcauauaugugaagucauucuuacagagacuuauaaaauauccuugauuucuaugaucucuguacauuuuguaacgcaaaaaccguaauuuaagaaaacucuauuugguacuugcagagucaugcacaauuccaaauuacauccaaggacugguuuguuuagcuacauuuauaucccucauuagucagagcuggaguggacaucuaaguaugaagaacacauuucuugugugugguacauucuuuaaaauacauaauuucaguguguugaauacagaaacuaagcaaagcuuuucaaaauuuagguaaaacuuuauuacuuuggaaucagucaaaauuuauauauaccagguuaucucucagaauauugaaaaauauuaauuuuuauuuacuaaaacauugcauuucuguucauuuuaaucuaaauauacauuaaaggugaaaauacaaauaugauagaugacauuuguaucacaucuaauuggcagaugaucauuacucagaauuuauaaagaauucaaauaauuauaaaaaguuguuggaauaacuaguucuuagaagaguaaaugauugacuuaugaacaugaaaaaauuagcauucuuauuaaaaauaaaaaauaugaauuaacacagcccggcuaacacuuuauauguuucaaauuuacagaauugugaagucugauauuuccaguuauuaacuagaaauuacaguaguggaacuuuuuuuccugccuaaugggaauguagauaugcacagcuacuuugaagaacaacauggcaguaucauuuaaaguugaagaaguaaaaauuccuacagauaaauaacauugugaauagaaacucuguugaacugccaaggcaguccuaaaagggaaguuuauagugaugcacauuuacauaaaaaaaauuaagagagauuucaaauaaacagccuaauguuucaacgcucucaaaaaaauaaaaaucagcccauccaaaacccaauaaauagcaagaaauaauaaauauuagggaagaaauuaaugaaaaagagaauaaaagaacaauacccaauaaugccagaggccuuuccuuuauuuuaacacauuucugagaacacuguguuuaaauugcauugagaucucuggguacccugauagcuuauagaguuguaucaggccuacaaacagaaagcucuaugucaguaguucagaaccuuccuaauauugcaacucuuuaaugcaaucccccauguguggugacccccaacuauaaagucauuuuuuuuugcuacuuccuaacuuuaauuuugcccugacaugaaucguaauguaaauaucugauaugugggauaucugauaugcuaccuuuauggaaagguaauuugacacccccugcaaggaggucacaaccuauagguugaaaaucacuucuacugcaagacauaaagcaaggaaaccuauauaaucauugaagauucaguaguagcuguuuuugccccuuaauugguuaagauguuugugggugguuuaaccaguuguguacagugauacagauacuacaacuuugagaugcaucuguaagaaaugaucuguaaacauccucuguacuguaauguaucuuguccuuuuuaguaccucaaaaagaugauucacugggugguaauuuuugauaaaaaacgacuuugggaaaauggcucauacaugucacugaguuuuuauuguuuuuaaucauagcuaacuuaauuuauauucaaaaaaggauguggucuacuucuuaauauuucuuugacacagagcagauaagauuucuuauuauuuuuuucaagauauacaacuaaaaggagaucaaaaucaguguuguagacucucagugugccaaaaaggcugagaguaaaauuuaaucauugucacacacuuaugaaauaucauuaguggaucccuaccacuagcccucuuucucuuucuagagcaaagauaaaagaaacaggcuuaauauacauugggagugcuaguuuacacauaggaagaaguacaaaauggugagguuuauucaacaguagaucagcuaagcagaggagacaguuggacuuuacuccuggguaaaggcuuuaugaaauaggacagacaaucaucuaauaugauuaguuagggagaaugauauucauguaacuaaauggccucacagggugccuucuacacucuacucucugugaaaauaauugaauuaaaaccuguuuccaagacaaaauguacugcucaagccuauaaccuggcacugaugcagucagcuccugagcugugcucuucucacuaccgaaacuagagugcuggaccagaacaauuauucaaggauuuugugaaacuuuuugcuacauaaggaaaauuacccuuuauucacggggaggcagauauuguuauucuagaucacuaucuauuuuuaaaguuguauauaaaucauuuaauuuuuuaaaaauguaugcccucuucuuagaaaaaugaaaacaaaauaaaacuaagccauuuucucacuaguuuccagguaaaaauuucugcauugauuugccucuugugguacagucaagcuuagcacaguaauuaacaucuacuauuaaaucagcucaaacauaaaacacuuuaauuaagcagccauguaugugcccaagaaauuaagaaugugcugauuggaaugaagcagcuguuguuccugcuugugaucuaacuuggacaauacugagcaaacauaacuaaagcaggacaaagaacaaauaaacaauuauguauauucaugaauuucacuuguuauauacucugauaugucccccauuuacuaacucccuauuauuagccuagcauuaugcucugugcucucucuauaucuuuccacacauauagccaggagauauacauauagaaaaauagauagauagauagauagauagauagauagauagauagauagauagaaaaauagauagauagauagauagauagauagauagauagauagauagauagauagauagagauagauagaugugaauguggauguggauauggauauagauauagauauagucuuguucauacuaccuuuuaaaauguaauagaagaaauagaagcacuauauaaauaaugaaaauaccuguaguguagauuaugugcagccguggagaauuaauucaauuaugcuagucucucuuccucugcaacucucucucucucucucucucucucucucucucucucucucucucucucuuucccucccaugagugagugugugugagugugugugugcaugugcgugcgugugugugugugugugugugugagagagagagagagagagagagagagaaagagagagagauccuacagcauaccuguggaaauaauauuuucugaauaaauagucuugacuuuuucugugcacagcagagagcauaugacauugggauucuuaauguagauuuauauucuuuauauuuaaguaccauuauauauuuauucuuucaucaaauauuuguuuaaaaguuaaaauaugcaaggugccaaggagcucaguuggauuuuccacuuauauacuaaaggguaugguugcagaaaaaauacaccacaaauauaucuaaaaauaucaauacuguuaacaugcuacaaaagggaugcuauggugccaagaaaguuuguaauaagaugcuaaaagagguuuuaugauuaccuagcagucugaaggaaaaagugguaauugccuagauugagaaguagcugagagaauuccaaguagaggagaaaguaugucuaaugucuuguaaugggaagaacgcaaggaauugggacagaugaaaggaguccuguauuacagaaaaaaaaaagaaaagaaaugguagucaaagagacuuaagaaggucaaauugaacuaugcuaccauuuauacgucauggaaaaguaguaguugcacaaguuuuaaagaaagguuuuaugagaagaguugacucaauguuauauuauauucuuguguauaccaagugcuuuuuccaacuaaguuaugucggcacgugcauauauaugcaguuauaauuaacaagauuauacacaauuggaaaaauuaguaaugaauuacauacaagaauggaaacuaggaagacaauucuauguggggacauaauuggaaugccuaguacacaguauccuaaaagaauucagucuauuaaguagacaaaagauauguuuugaauagcuaacauaggagauaauaauaaauaaaggauaucaugaaugagggagagcuaaaauggguagagugaaaaugugaacauguugugaaggcuaggagaugacucaguggauaaaaucacaagccuggugacccuauuuuaguuuugaaucccagaaucaguuguaaaagccauauacaauagcacaagcaugugugaugccagcuuuccuacugugagaugcagagacagcagcaucuucuggagcaugugguccagucagcuucacuuguacaauggcugagaccuuugucucaaauaaggaccagaggaaaggaccacagccagagguuauccucugaacucucccuuccucccucuuucccuuucuccccuccuccucucuuuauacacacacacacacacacacacacacacacacacacacacacacacacacacacacacagagaagcacacagaacaauaaaguggcuaugagcuaguauaguccagaaaaacaagaggauaauuuaacuugaauuuaguucugaaugcuaaguaguguaucauauuaugucucaaaaucucaaauuauaaaacuuggggaucacaaugaaaaaaaauguuuucuuaggcguugccuuguuaauauaauucuuccauugaguggccuagauauaaauuauuucuguguaucuaucuagcaaccaauucuaaagccagauucuuucaaaguacaaguucaacagucaucccaaauuuucuuucuuuauuaauuuauuuuucacacuccauauuuuauucccccauccacccucugacuguuauauaucccauaccuccuccccacucccugucuccacaugcaucuacccauccccaaccccaccugaccucuaaacucccuggggccuccaguuuccuuaggguuaggugcaucaucucugaaugaacacagaccuggaaguccucugcuguauguguguugggggccucaugucagcugguguaugcugccuaguuggugguccaguguuugagagaucucaggaauccagauuaacugagacugcugguccuucugcaagauuguccuccucagcuucuuucagccuccccuaauucaacaacaggggucagcugcuucuguccauugguugguugcaaauaucugcaucugacucuuucagcuauuuguugggucuuucagagugcagucaugauagguuccuuuuugugagcauugaauagccucaguaauagugucaggccuugggaccuccccuugagcuggaucccacuuugggccugucacuggaccuuauuuuccucaggcuccucuccauuuccaucccuguaauucuuucagacaggaacaauuaugggucagagaugugacugugggauggcaaccccaucccugacuugaugcccugucuuccugcuggaagugggcucuacaaauuuugucucccuacugucuggcauuucaucaaacuucccucccuuugaguccugagucucucaccucccaggucucuggugcauuugggggucccccaacuuccuauuuccugagguugcuuguuuccauucuuucugcuggcccucggggcuucaguccuuuucccucacccaguaccagaucagguuccccucuccccccuccucugcccaccagauccccacccccacuucugacagcuuucuucugucucccaagugggacugaggcauccucacuuaggcacuucagcuuguugaacuuuaugaguucuguggacuguagcuuggguauucuguaauuuuggggcuaauaucuacucauuagggaguacauaccaugcauguccuuuugggucugaguuaccucacucaggaugauauuuuccaguuccauccauuugccugcaaaacucaggauguccuuguuccaaauuuucaaaguccaaaaugcucuaaaaaucuuaauuuuuugaguaccaguaugaugucaaaaguuccacaccugaugcuagcuauuuuaaauaccaucaaaucacacucagacacuauguacaagguguacaugaaauaauguaugaauuuacauaaaugaauuuuaucuuuguaacugaguuccaacucaagauaugacauuagguguauguauauauuucaaaaaguuacaaagcucaaaaauccaaaaugcuagucucaagcauguuggauaggagauauucaguauauugaugguauuauagacauuacaugguaaacuuccuuuaguauaguuagccaacagguucauuuuguauccuugcuugaaguggucauuaucuucuuuuuugaucacuuacaggaaauaaucaaaaagcuaacauuaaaaggaagaaauugugaguaggaaaaguccagagugugucaaucaauguaagcauacaaacauuagaauccgaaucccuaauccaaaucccuggccuccuauacaccugaaaugauucacaaaguaucucugaacuuuaauuucuuuaaguuuaaaauaagucucagaaaaguacuuuguuuauaacugaguaugagaaauaauaaauggaauguuuuguuaaaugcuuugcaaauuaugaaacuuuauggcaguguaaauuagugucuugaucaaauauauaaagccaaauuuuacguccaauaauagcaacuguuaaaaccuuuucuuauccccuuuuauuaauuugauuauuuguauauuauaugcuuauguaguauauaauuuaauacaggaaaagaauacagauuauaacugaagggaaaggcucaaaauguuaaagcuuccuuuaucuucagaagaaauuauuuucuaagcaucaauguaugucacuauacaugaacucuugccaaccaagaaacucacauuucuugacauuaaauuugugauugaugcuugauuauauagauaugauugauugaauuguugcccauauacuugaacucagccuugagauuaacugauuuuacauggcucaaaggcucuacccauaugauauuguuggucuuucuguuaugacugauuuccaacauuaagacucucugguauauucuauccuuuccaugaugaaagcaaucugaaaauauaagguuauucaaagaacuaaauaauaaccaccacaacuaugaaacaaaauauuguuuaguucuugauuggauggagucagaaauuuugacauuauucaauuuugacuauggggauacuaaucaggaaugagaugacauuaagauuguggcaguccacugcugaaugucauucauuuuauuacuuuuuuucauuggccacacuauggccaucauguucaagaaaaaaacagcaggaagaauggcccuuccuucaguggguuuuaucuaauucuuggcuauuuuguuuucaucuauauugggccauauuaaccauuuaaauccuaccacaggucauguuuaugggucaccacuuguaacaacuuacugggaauaugaaauauuuauuuuauuuuacuuauuauccuuuaguccagaauaucaauauguauuaugagauauuuuagauuugcaaauacuguaguguuugggaauauaggcaaggaaauaauuccaauuauuaaaauaauacaguucaaucuguccuuuauuuuaugucuaggaacuccuuuugaauuuaguaugaugccaugguauaccuauaaucaaaauccugauauuaauuaaaggcaugacaauuugccaauugguacaucuuaguaagugcuaaaauuaauucagaaccuaugugccuacaaguccaagcaaucaucuuucuuuucuaucacauagucuuauacaaucauacaauuuggguuuccaauuagaguguuauuauaguguucugcuuuagguuuguguuggcaggucuugcuuuucagugcuaagguugauucuggaccuugcacaugcuaggcaaggacugcaccacuuagcuauaucuuagcacuucugcuucuuauuuuuuaaaaguauuuuuaauuauucugcauauuucaggggggcagaauccuuuucccaguucauauuuauguuugugccaacagagaaucccaacucaguaucaucaaguuuaauggucucccaaaugugauaaauuuuaauuuauuugguuugagaacccuaagcuuaagucaaguuugguuuaacaauaacacuggcaacuuuguugaacucagaaucacuguugcuucuuuuuacaguuguccaaaaugagcaagggucuccucugcacauuuauuuuuuuguuuucuuuuuuagauagggucuugcuauguuacucgggcagguguuaaacucacuguuuggaucaauggauccuccugccucagcuuuuccuuaauagcugagucuguaagcauaccaccaaacagaucuacuacaaauuaaaaacaaaacaacuagacuucaaacauucagagcugccuuuuauacuggucacugggugccacugguaucuauauguaaccaugcuagucggaagauuuuuggagauauagacaauagcugaagcauuucaaagaguacugaugaacuaugauauuuagaauaugcucuaaaguaugcuccauagugauuuuucuuugucucauuaccaacuaugcaaugggcucauacauuauagaugaugugauuuuuuuucuaggcacuguauaaaaugagggaaaguccucauuugcauguauaaccaacaguuauaggauaagagccauuccccugagccuagcaucacuugucuuccacuacaaucaaggcaccugauuugaucugaaacacucacauaggccaacaaacucaguguaguacuacuuuaaauagagcccuaauuucauauuccuauuccuaaauguaagucaucaagacauaugaauuagagaaguuaaauuuauaacagaaacucaggcggacuuagcaaaugcaguacagcacagcggaacuugaugcaaagugauaugaaaguaccagcaucauucuaauaugcccuguaaaacacacagugcagagccaguuaguauagagggaagaaagaaagcuuucuggguaauucacauugacaugguauuuaaacuucaguugucuuguggggguugcucuacaaagagagagagagagaucagccuccaccccaaaauaugauuugaaugcugcccauggacuaaaaagaguauaagaugauuuguuacuagcauaauuaguugugcuuuuuuuucuuuuuuugagauagagguggcuuucaagccacagauaucuugaaugaagggaagggugaauagcuuugaauuuuacauugguuggugauucguccugugcugauugguugugcaugcucucugaauuugcauaugagcaguauagaaaaaagagaaaagccugaaggagcuugcaaccccauuggaagaacaacagugucaaccaaccagacaccccagagcucccagggcuaaaccaccaaccaaagaguacacauggagugacccauggcuccagccacacauguagcagaggauggccuuauauggcaucaaugggagaagaggcccuugguccugugaaggggaaugugagggugggaaggcaggagugggugggugggugggggagcacccauauacaauaaauaaauaaauaaauaaauaaauaaauaaacgaacaaaaggggaaaaaacaguucccacugcugacaguucuuagcaguuguccuaauguggcacaagggagagaaggaaauuguuagaggggaauaaaagagaauaacaauagcuuaauaugaucaaaauauauuaugugcauguauggaagugaauuucacaaugaaguucauuauuaugggaaguuaaacauuugaaaauaauaaaaaccucuuaaagggaaauaaugaagauuauggcuugaaagcugcuaacaucaaaaugguagucaggcucuuuauuaaaaauuugaaucucuaaaaauaaauuccagugucaccaguuaaaguuugccagauaaacaagagcucuauuaauagucuuagauuuauucuuaaguuuaucagcauucuuuuugcuguuauagugaaaaugaugauuuagugguaagauccauuuccuuuccucuaugugauucugguuuuagaugcuuugaugugaugcuuuacuuucaaaauaugccccuuuauuucuaaagacuucuuaucugucuuagaauaaaacuaaauauugucucaaagaagacaagaccucuggcccacaucuaugggcuuuuuucuacacuguauucuaacugugcugcuuuggggaagacauuuaagcuguucaucagcuucuucauguuccuuucauaagauagacauuacaaaggguggugaguguaccaacauaaguaaguuuucuccauguuuguaauaugcuuccaauaccauagacacugguaauugccaaggcagcagugugcguaugcugcugggaauuaucuggguaauauuuuaacugaauuacugggaagggaauaaauuaagaaaaaccauguuaaacuacuuugagauauauaaaguaaaauaagaucacggaugcauuuuccuaauuuaucaauuuuuugcaauuaaauauuuagagugugugguauuccuaaguuaucuauuuagaaauugggaagauuugggagcuguguugguuguauuucuaagauucauuuuuaguuccuaaugguuuuauuuuccagaauaaggaacuguguguuccucuugccacaaugacuaagugcugcuggcacaaauaacacaacugugaaauuuuuuaauauuauaaaauuauggcuuccaaagaccccaacugccccuguagaguacaauuuacuaauccuucuuauguguucuuaauuaguccccuuuucugcugacagugguagcuauugcaaacuuuacuguauccuuucucaucaacauguuuccauacauuuucucugacucaaaccacucccuuuguucccugucuuccuacauacucugagauacaguaucugugccucaaacuauuaagugggcuauccaugcugccuuauagcucucuccauuucuauagacuauuucugacugaaugccaccaccauacaacaaacuuuacuaauccccuuucuuuccagauucagacaacauaucucaaauuugugaggccuucuucggcagcugaagucuaguuagguccuuccuuguucuaccaccaggcauacuuucugcuagcaaaaaacagcguauacaacauucucuuguuuauuuucauaucugucucuuguaauaaacuauaaaauccuaaagaacagguaagguacuauuuaauuugucucugaguucucugaacaaauauaguguuggcacaaauaacuauuuauugagauuggaaagagaaggaaagagaauaaauauaagaaguauauacuucuuucagaacacaaaccacuuucuuucaaccuuuuaaaguaauuuucaauggcauacccauuuacauuuucccucaaccuuuacaaaacuuucuuugcauuuaauagauacaugcugauauuuuuaaaaggaacuucaacaaagacagcugucugacagcuguacaccaucugugcuuuucagccugaguaaaaacaucuggcuacucgagaauaggagcucuguacuaaagaaguuucccaggcuggugauuauuaguauucuaccaaugugcuuugcuuugucccacuuugacauaauaauuuauacaacuuguccaucuggauuaugaaguuuccuuuugcuuacacaccucgacaaagguaaauguaaaacaaacaaaaaauuaaacagaaacuguagcauguugcuuuauuucuuccaugaguaucuuuuauaguaaaaguuaauaucauagaaaauaucuacauguacauguaaacuuguacauuugugcuuugggucaauaaucuccauggauuaugaaucuccaguuaaacaaaguuaguuaaauuuuaaaugucuuuuucuuucuuuccuugauuuggaacuacuucaggggcuguguccaacaggacaaaggagagaucuuaauuugagagcaauggaauugagaugucaugaaaaaagaacagagaacuauuuggugagaggaagggaaccagcaagaguggaacagaaggguuggaggagugacauagaggagaaggauggaugaaaacaaaguaugguggcauaugcauaagagagagagagagagagagagagagagagagagagagagaggagagagagagagagaaagagagggagcauaacuucauaugcuuauucucaaaaauuaagaaaaaagaaaauguaaaagaaaaaacaaucccuagguggggcagucucuggauggccuuuccuucucuguucugcuuugucccuguauuuccuuuagacaggagcaguucuggauuaauauuuuugagauggggagguggccccaucccucaacugggggccaugccugaccucuggauauggucucuauauguucuaucucccuuuuuuugaguacuugagcuaaucucauccccauuggguccugggagccucuugcuuuccuggcaucugggacuuucugguagcuauccccaguuccccauccuccauugcuacaaaccucuguucgauuuccugacccucuguacuucaucccuaucuccuccuguaucugaacgggccccccuuuucccucucccuccuaucucccuccuagaucccucucaccuucugcuuccugauauaauuuucuucccccuucugaguaggacuguauauaguacuguagccuucacacuuugguguggucuucuuucuucuuggguuucauauggucugugaguuguaucguggguauucugugcuucuuuuuagcuaauaucacuuaucauugaguauaaccaugugucuucuuuugugacuggguuaaaucacucaggauaauauuuucaaguucaacccauuugccugcgaauuuaaugaaacagaggacugccuuauuaggcaucagugggaggggagugcauugguccuguggaggcucaaugacccaagguaggggaaugcuagggcucugaggcuagaguggauggacaaguggggaaacacccuccuagaggcagagggagggagaaggggauaggggguuugucgagggguaacugaguucgaggccagccuggucuacaaagugagcuccagaacagccaggacuauacagagaaacccuaucucaaaaaaaaaaaaaaaacaaaacaaaaaaaaacaaaaaaaaacaaaaaaaaacaaaaaaaaacaaaacaaaaaacaaacaaaaaaaaugaacuuauaauagcaguugggacuaacccauuuacaacacaguuuuuacugcugaguucccguugauguuuucaguaauacauacuuuauauauagauguauguuguagucugcauuugugugcauguucauguguuuguaggcacauguguaugugugugcaugcuaauagaggccagagggcaaccucagcugacagucaaguucuguccacuguuuuguugguuuguuuguuuguuuguuuguuuuaaaagauagagucucucgauagccuagucaggguagguagccagugauccugagggauauucuugucucugacuccuuagugccccgcgggauuacagaccgacaaagaaacccagcuuuuaauguagguucuggggaucuaaucuaggccuuccuacuugcuaggaaaccacuuuacugacagccaucaccccaucuccuuuucaauauauuucucuagcauaucuuuauuguacaaagucgcuuguaucauagccacauucuggaauagcaguauuauugugauaaaauauaugcaacacaaaagauuucaaccaugugaaguauuaauauuauuuaggaauccauauuguaaaucaugaccacugcuuaucuuuauuacuuuuugucuuacaaaauaaauuauuugaacauacuugacaagucugcuauuauaugauuguauuauuuuaaaacuggaaacuuuaaguuuuuauuuccagagguaguuugguuuuaaguagcucacuaagacacuguguuguaucugaaaauacauagcuucuagauggucuacaagaccuaaauaaugguugaaggacuuggacuuagaaaacaauagugaauagcaauauauuauuuaguuuugaaaggauagaacuagagucaauuauugagaauuccugaacaccauguuuggguuauaguaagaagauguuuucuagcaucugggacauuucagaguguaguguaaugccuuaaacacugaauguauuuaagcaaugauuaccacuggggggguuauauauuguaugagagauuagauuaaguucuaucauccuucgaauuauauuaaagguuagacaggcauugaaugguagucauguuuccuguuguaucagaugucauauuugccuaucaacuaaauacuuaaagcauuuugucuguccauugguuaccaauauaguguuugcuauuuuuguuuguugcacccagaaauuacuuuccuuagaucuacaaacaauagcauuacuuuuaucacucagaguauaaauguaucacuucagauaugccuucuuucaccauuuuauuuaaaauaauccaccccuaucccaccauugccgucucuaauuaccuucuagcauauugcucuguuuauuuccaccagagaaguaaucagucuguaauuuucuuguuugcuuuuucccgucuucuucuacaaaaagggaaccuaacuuuggcuuacucaaaaguaaauucauauuuuccagaccaguggcaugcaugaaauaagaauuugguaagcauuuguuaaaugaagaaauagagaccucuccauggguuaagguuucuauuauguuaaagcacucuguagaagaugcuugcucagagacauuuugcauuucuccauaacacaaaaucagguauuuggauguccaagggugauaauuuuucaguuuuucuuaucuuuccaaaaauuuccuucuguuagcuauuuucaaugaaacuagguuuuaugaauuauaaauauaagaacuggggcauucaugagaaaauauuguaauugaauuuuguggguauuuaagaguaaaugaugaccaucacagauggccauuugcaaacauauauaugagugcuuaguugcuuggacuucauccagugauuuguuauaacuuaauuacuuaacugauagaucagaaaucgagacaccugggacaugauaacaucugcuucugaaaccauaaugaaagugugcuuuauaacauucucaucuccaagauccauugaagcuacuuacaugcuucccuuggcuugcuuuucuuuaaugcucacuaguuguguuucauuuucuugcuuccuaauauuaauaguuuaaacagcucauuugucaguuuuauguggguguuaauauuaaaccaccuuuuucuuuuuauaaauuccauaagagcacauauccuuuaccaaaccuuuucauuugcaaugacccugugguaguuucccauuacuuucuuuuuucuauauucaacaguauugcauaauguauuuuggacaggcuguuugaucagauuuuuuuuuccaggcaaguauuucuaguaagauuuggcuuccuucucauuuuaucacuauauucuuucuuguuuagcccugccuuuucaucuuucuucuucccaagucacuuuuuucuauuaucuuaaauuguuuucuggugugaugaauuaauagugauaaaaugguuuauaucaauaaauggcuucuuggauuuacugaaauuuuuaaaugguuucuuuucuuuuauaaagacaaaaaaaaaaaagcuguucauuauccauaucagaucauguaagcuccagauuccagguccuguggaaaccaugaaagaguagucagcauuuuuaaaaguuauuugugcacaccagaauacagucuuauuauaaaguauuuacuuguugaacacguuauacauaaucguguauguuaucaugucaacggaagauccaagaauaaggaauucuacaacucagguuuggcaggguuggguaggagaaagcaaccaauucuacauaaaucucaaaauauugaacuuccacaaacauuauuuucauagguauuaugugagacagggacuucuuaugggcccuagacuggucucaaauuuaaggcacucuuuuccugaaagaaaaguaggaagagaaugugguaagggaaggaaggagaggggagagagagagagagagagagagagagagagagagagagagagagagagagagagaaaggagaagaggaagaggaagaggaacagagaacuaaaggcagaagacagcacuugagaaccugcucuccccuuucaccaugagucuuggguccuugaggucacccaguucucagucucguuggcccccuuaccuacuaagcccccgcacuggcucagaauauuuuuuuagauauguugugaaaaugcuauaaagugaguagagcaauguuugauaugaagugaacuuuuagaaaugaccaggcuagguacugcaccagaguguuucucaaaugcaucaguuaaggucuugaauuucuauaucauggcaacuuuuaccaaacuuuacucuuuggaacccuagcauaagaaaauauuucaauaguuuuauuugagggaaacaagcaauuucauaacuagcagcuugggaauugcugcauacuuuauguauuuugagacagggucucucuauguaaccugacuguccuuuagcucauuaucuaggcccagcuagcuugaauucauagagaucugucugccucugucucccaagugcuguaauuaaaggcaugugccaccacauucagcucauucauacuuuuuuucacuuagaucauuauacaucaucacacuaauggcaguaaaaauaugcaugguuuacacuuacuuuagccauugcuuucaaaguugagaaauccuuuuacuauggaucauacauuaguauguuaccagacauuaguuuggggaagcacaauuuugagaaacaaauagggcacuccccuugucuuuagcuggacaaaucauucuuuuuaacuuacaauugcauaaugaggggaguagagaaaugguuuagugauuauggucuuaugcugcccuugcagaggaccugaguuugggccccagaacuccucucaggcaacucacaaacaccugugacuccagcuucacaguguuccaaagccucugcccuagggagacacuggcaauccuauguacauauccacacagacagacagauagacacauauccacacagacagacagaggcagacagagagacugucagauaaagacacaaacacacacacaaauuuaaaaauauaagaaaauuaaaaauuuaagaaccuggauaaagucugcuauaccucauuggcaaauuggaaaaccaaacuaacauuuaguguuguugccuagugacauucucuagucuuuauuccuacaauuacaauuauuccuugauauugccacacaacuacugugcuacugcuuauccuggcuuuuacuuugguuuguuuguuuguuuguuugguauaaucaucccaugagauuauacaacauuuuguuguauuaaagacuagugcuugccuggcacuauguaagagacucauaaaccauuacuaaaaguucauagaaacaauaaaaaauggaguuuuaacagcuuuguauagucauugcacauuuuuaauauugauuauguuuuuauucucauuuccacuuacucucuauaccaugcuauagaaagcuuucuaugugauaagugacuuaggugaaagucaauaucugcaauuagaagugucuguuuugcaauuuauuugucuuagugauaccaggaaaugcaaaucuuuucaaacaaagaggccauccaaaggcacugaugauguagagagucaauucuuuccauuaccacaccuuugaaaggcucaauuguaagaccuaguacugagggaaauccaguuguucuucuaauuaaacucucaaagauacccagagacauaagaaaccgauccuaauaugcucacuauuuuucuuccuuccuuccuuccuuccuuccuuccuuccuuccuuccuuucugucugucugucugucugucugucuuucuuccuuccuuccuuccuuccuuccuuccuuccuuccuuccuuucuuucuuucaggucaauacuguacuuuaaaaaaaaauuaauauguaguuaaaucauuuuccccucccuucccucccuccagccccucccuaucaaauucaugaccucuuauuuuuaauuauuaucacauauguauauauaaaagugaauaaauauauaaacauaaccugucgaguccauuuagaauaguuuguauguuuauuucuuuauugcugaccacaugguauuggauaaccauuuaaaggauucaccccuggggaaagacuaaacuaaaucuccucucgguaguuguucauugccuagagcucuucauccaggguugaggccccauaagauuucccccauucaucuuggcaugucaguugaugcuuucaucguuuagguccuguuuaggcaaccauauuauugauauuuuaugggugugacuuaccugacauauaugguagacacaaucuugcagcagacuuccugaucuucuggccuuuacaaucucuuuaugcucccucuucuauuaucuucccuaagccuuaaguuguaaagcagggauucucaaccugugagucaugaccccuacagagauuuuauaucugaaaucuugcauaucaaauauuuacacuaugauucauaacaguagcaaaguuacagucaugaaguagcaacaagaauaacuuuaugguuggggucaccacaacaugaggaacuguauuaaagagucaguauuaggaagguuaagaaccauuguuguagagacuaugcuguaggugucucaauagggcaaagauugagagugagguaggacaacaggagauaugguggaggagauuguagagauuaccauagaaagcagaaccucuuauccccacaugauuucauuggaccaagggaauaugcuuaaauaucaccccccauaccaacuuggaagaaguggguuugauauaaaugacacauagaaggucacacacacucugcagucaggugagaggccagucugacacaccaccaaauucuuuauaucucucuauuaauaaauuaccuccuuaaccauccccuugcucuguacaagauaaaauccagaaacaaggaauguuagauuuacgaaauaaaugucaucgagaacacuggacagaguagaauggaaggaaaagaauuccccuucccacacuaugggcuaccacaagcaaaagaaaggaggaaugucucugaagcaaacugucuaaaaaccaaacucugaaaaagagaucugcacaaggcccagcaguagucacuuagaggguacuugcccagagcugugccuccccuuccuccaaagcugggacaaaagaggaagcuguucuugaggccuugcuaucaaacugcucugucagaaagaguagaaaaucuggcacuauaaaaucuccaaccccuaguacccuuuccacuauuuaggccagcaaugacccugacaacuaggaacaaaagaaaugagcugaaccugacauagacucaugaaugcaaacauauucaggcaaaggcugugggucacagguuuggaaaaguugucugggguccuagagcgaggaaaacccagaggcaaagguaaauacaagaaugggugccaccccucccacacauucaccauaaaagccuuagauagugacaaccaugcauagaaaacaaugugaucacucagcacagcagagagcaggcaguaacugguaggggcacauggaggacuaggaaauuccuaccaagggccaggguggagggcugauucuugugcagcagagacauucugguuuaacuaguuuugaacugcauagaauuuagcaaccuucuuccuaccugcagagucagcuacaaaagacaaccuauaggguaggagaaacuauauucaccauacaaguaagaaauauagauugguugguugguugguugguugguuggcugguugguuuguuuguuuuuagcuuuauuuuucauacauuucacauuuguauguugguuuuggggguugggguuuauuuguuuuuagcuuuuucuugcuugaauaaaaucuuauaacugaccuuucuuuuucuacaccuaaccuauaguaauuucgcucauaccuucaucucuauuuuacuauuuuacuccuguuucccucuuccccguucccuucuccuuuugcuucuuaauuauuaauauugaauauccuuaaaaauacacuacauuuauccuaaugguguuuuaguuccauuuucuaaucuuauuggggauauaauugaaguacacaaauaauuuuuacuguauuuaaguacagccuugcugucaaaucacuguuucaguuacagcugccuguuccacacacuaaauggcaguaggacucauuaccucaacuaaagacuauacauaaaaaaagacauaaaguaaagggaauaaugaaugcacagaggaacucagaauguaacucagugguagauuucauuccuagcaugugcaagccaguggucaauuaucaauagugaacaaaaaaguguaaauguaauaauaaaaauaacagcuggagaacauauccuucucaauagauacacaaaucacaacaaagagacagaaaauauaugagaaaacaguacuucuaaaaguccacaagaccucaauaauagagaacaaagauaaugaaauagccaucaugcuagaaaaaauaguuuagaauacugcuuuuuaaaauguuccaugaucacauagcagacaaaaacaagaagaugaaugaaauauggaaaucaauucaggaccuagauaagaaaguuagcaaaguagaugaaauauagcuuuuuauuguuuugaaauuuccuacaaaggcagacacaucacaguaauaucacagccuucaucagcaacccuaaaggccaggaaagcaugcaacgauauauuucaaauuuugacaauaaucaacuuccagcuaagauugcuauauacagcaaagcuaucuuuuaaaguuggcagcaagauacagucauauuaagccaagcacaugaaacaauguugaacugaaauuuaaaaaaaaaaaaacuuggagaaaaaaaauugagcaaggugauugaaauuuugggaaaaaaaaaaaaaccaaaugcuagaaaugaaagcuaaucaaucaaauaaaaaggacaugauaaaaccuuaacccacaagauuaaugagggggaaaaagaacaccaaggauggaaacaaugucaagguaauauuucguucaaauaucaauaaauaaaaagaaguauauacagccacaacaccuaagaacucagcuguuggaucaagagaccaaacuuaagaaucuauaugacaugaagaggaacugagauuaaaacaaaaacacagaaauauguuucauugaaauuauaucagaaaauuucucaaucauaaagaaaugaauauccaaauacaagaggcauuuaaaacuacaaauagacacaacuagagaagaaccuucccacaaugcaggcaaggugacaucuguaguggugacaaagaaaaaaaaccacauaccuacaaagcuauaaaggcaaaucuaucagaauagcaccaggcuucucagcaacccaaagccaggaaaagaacauacugauguauuuugaguccugaaaguaaauaacugccaaccaagguugcuauuuccagcaaagcuuauuuaacauugaaggaaagauagggagauuucaagacaaaugcaaacuggaguaauucaugaccaccaggauagcacuacagaagauguuugauggaauccuaaacacacaggagaaauacagucuucaucauagaguacaggaaagaauaaauuuuauaaaagaaauggauaaauaaaggagaacaaggaaauaauucaucaagccaaacagaacccuaauccuaguagaggaaaaaaggaacaaacaaaaauuuaaccaaccagaaagacaacgaacacaauuggaaaaacuagacacaucucuuucaguaauugaauauaaauggccucaaaucuccaauuaaaauauguggaccaggugacugaauccaaaaacaagaucaagcuaucuguugucuccaaaucaugugccuugcugucaaggauacuuaaagauugucagaggaucgaaauaaauuuaucaaacaaauugaagcggaaaaauaucuguuuuugauauucaaagaaauaaaccucaaacaaaaauuaaacagaagaaaagaaacaccucaucucuuaaagauacagcaauuauaauugcacauuaggacuacuaguuuuauuuaaaaggugaaaauaaaauguaacacaaaucuugauuaaaaugauaguaauuucaauauccacuucuuaucuguagauaggucauccaaacuaaacucagaauuaaacuacaacauaucaagugagcauaacaaguaucuccugguuuguguauucagcagaaucagaaugcauauuaguauuaguuacuuuucuguugcugugauuuaaaaaaaaaaacaaguugguaaggaagggguuuauuuggucacaaauccaugucacaguucaucauuaaagcaugacagcaaaaauucaaggcaggaaccacaaagaaguguagaguuaggguauaugcuuugaguuagaguuuaauaugguaguuuaucccauagcuaggauugacaggucuagugacccauaaggaaaguuuuuacuuauuaucccugggaucuuaugcucuagacuagaaguuuugguuccagaguaacaaccacuucugccaagagauacuggcagacuaaucacauggaagcuagaacuaucucccagcuauuugggcucuugauacccauaagucaaugggauaaaaagggaauaguauuguuaggacaggugauucgagacuuucaguaauuaguuuguuuuuuucacagugaagauaaggaagauuaugucuagagaacaguagauucuuuaggguuucucuugguguuaccaugucuugugauaaaaauaaaaaauaaauaaacuggaaacuauaaaaauccaauccagacaggaugacaaaggggcuagaccauucagugaugaagguauaggucauccuuccagggaaagaaccaugaccucccuacauaggagcuugcugaaaguagaggaaauauagaauggauaguagagcaaggcagauaaauaccagauaaagccacaugaucgguugcagaaacaaggauuauaauugacaugaguauuuuucuaagaacauguuugugcagauauacacauauauuaaggugacauuugcauuucccucuuuuucuuuaucauguaauguaacauaaauugagauaauaucaguaguuaaguguuguaagucuauaguaucauauuuagguuaugagacacugaaagacaaguauuccucaauggacuuugcaaccuagucuaaaaauauauaguguguuggcacuuucacaugcgauaguuauaacaucauaauuggaauuaugaccuuauuuuuuuccauuuaaaaaugaagcaugacauaaaaaaugugauuggaggcuguuagugguggcucaugccuuuaaucccagcacucaggacagaggcagguagaucucucucuuucucucucuuuuuuaauuagaucuuuauuuacauuucaaauguuauccccuuuccugguuuccccucugaaaaccccccuauccccucccccucccccugcucaccaacccacuccugccuccggacccuggcauccccuacacuggggccuagaaccuucacaggccuccucucccauugaugaccuacaaggccauccucugcuacacaugcagcuagagccaugagucccuccauguguuuucuuugguuggugguuuagucccugggagcucuggggguacuggguuaguucauguuguuccuccuaaggggcugcaaaccccuucagcuccuuggguggcagguagaucucugaguucuguuacacacacacacauacacacacacacacacacacacacacacacacacacacacaaaugugauugggcgucauguugauaaaggauggacuugugguggauauucuuaguugucaacuugacugguucuagaaucuacugaaauauaagaagcuggcacuccuuuuaaggaacuuucuugaucagauuuuuuuuuuuuuuugaagaagggagauccauccuaaagugggugacaccuucugguggcaaccaagauaaaaggacauaaaagaaaacuuuggcuuuuuucuugcuugccuucacacucacuggcaaguucuccuaucuuguuuuaguggcauucauucacuaauaucagaaccugcuuauucaaacuuucauuguuuccugaagaccaacaacccuccuaaacugcauucugaaagccaaucuaaacagcaauuuuuaacuacuuacaaaaucuuccuuuaaaagaacucauucuaggccagaaaccaagcucuaaugaauacaaaagaaacaaauaauuucuuauaucuuaucaaagcauaguaaaacaaaaccagagaucaauagcauggaagaaaugaggacacuauauaaacaaguggagaauaaaaaguauacauuugagugacuagugugucauugaaggaaauaauuuuuuuaauuccuaaaaucaacuaaaacugaaagaacaauuuaucagacccuuugggauauagcaaacgcagucauaggaaagcucauagguguagauauucacauuaaaagaauuaaagucaucucaauuaaagaacuuaaucaugaaccucaaacucuuaaaaaagaaagaagccaaacuaaaaccuaguagauggaaaagaauaaugaagaugaggguggguauuaaugaaaugaagacuaaaaaaucaguacaggggauuaauaaaagaagaaauaauguccuugaaaaguaaacaagacugacaaagccccagcuaaacuaaccaaagaacaaaaaaaucccagguuaauaaaauuauagauaaacaugauaacauuacaacaaauucucgugagauccagagggucauugaaaacuacuguccugaaaaacugaaaaaucaagaaauggauaauuuccuagauacaaaccuaacaaaaugaacuuaagaguauauaagacauucaagcagaucuuuacuaaacauuggaaaugaagcaguaauauucucucaacaaauaaaaauucagagacacacagguuuacugcuuuuuuacauaucaucaucguuguuguuguuguuguuguuguuguuguuauuauuauuauuauauuugcaucccaaauguuucccccuucuuguccccuccuucagaucauucucccuaaccccgagccccuuugccuucuagaggguugggacaagaagggguaaaccuuuggguauccucccacccucuggcaucaaggcucuacaggauuagguacauccucucccacugaucgcagugccagggacuugggagcagcccuuuugguugguggcuccacucugggagcuauaagggguccagguuagcugacacuguugcucuuccuaugggguugucaucccuuucagcuucuucaaucuuuccccuaacucuuccauaggggucccaaccucaguccaacguuaagcuguuaaguaucugcaucugucucagucagcugcugguaaagccucucagaggacagccacgucugcaagcucaucuaucuuggcaucaguaauagugucaggguuuggucucugcacauggaauggaucccaaguugggccagucacagaguggccuuuucuucaaucucuguucuacuuuaucccugcauuuucauuagacaggaacaauuuuggguugaaauuuuugaagguggguugguguacccaucccuccacugggggcccugaauucugcuuuaaaaaaaaaaaacauuuauuuuuuuauuguuacuguuuuugguggugguggugguggugaugguguguguguguguguguguguguguguguguguguguguguguguguguguuagggguaggggaggcaaugucuauaaacaugcguauagguguguagacaggugccaggcacagagugccuguagaggucaaaggacaacauccaugaguuaauuguuuucccucauuguggggauuccagagauggaauucaaggacugucaucgggcuuuugauuaaaaacauuaaauaaacagaaguauaugguuucucuuuuuaaaaaaaaaaacaaugguggaauuuucuuaauccauugcagcaguucuuuagcacuuccaauuuguuaauuggacccuuguagauacuuaaauauuagcagauugucuuuaaaauguauuucauuuaucuuaaauaaaaguuguuggaaaguuuuuggugccaaugaagaucuaauugcacuagguuuggaguuaagaggucagacucauugucuuuuuuucuauuugcuggcugugucacucaucugagaaugauaagaguugcacuucuucccuuguauaagacaggugcuuuguaaauuaugaaguuccauacaugcggugggaucagaagaaagucauuaaauuuauagaauuuaaauaccaccccuuugagaaaaaagaaaagcaagaguuagagacauaaugaaaaauaaauacagauuguccuaaauauuauccuaauuuuugguucauaugcacuaagaacagauccauggucuaauuuugacucaauuaagggggagaguuucaaggguugaggaaauguugaauagucucauaucuguugaaaauagacuguucaaaauauguauugauugcuaucacuauuuucugaguucugaaagguacaaauggacuuuuaauuagcccauguuacagcacugaugggauaugagcuuucccacugcugcuguuguauuaucaugaucaagcuguuuguguacuuguugcaauuucauguucacaagcauguugggaauuuugugcauuagcagagccacucagcacuccugggcauuguaacccuguuccucaaacuucaucuuugaacaguauugaaauauaauaaauuaauccauaagauucccauaagccuaaagguucuagaagagguccuagaagaauguccauuacacguccccauccuuuaacuauuugagguuggauuucugaccagcacugucuuagaguuucuauugcuguguaacacuaucaccaaaagcaacuuggugggggggguauuuuauuacacuuccaugucauuguucauuauggaaggaagucaguugggacaggaacucaaacaggccagcaacuuggaggcaggaacugaugcaaaagccauggaggggugaggcuuaauggcuugcuucacaagacuuguucagccugcuuuccuuauaacauccagaacacuagcccagagaugacccaacccacaauggacugagcccuccuccaucaaucacuaauuaagaaaaugccugacagcuggaucuuauggaagcauuuucuuaauuaagauucucugcuuucagauaccucuaguuugugugucaaguugacauaagacuagccagcaccaccacuuauuuuuucuauauaagaauauuuguuuagcuagaacauccccauaugugcuugugucuccaaaguuuagcaagcacauuuuauucgauccuauauaaaacuggcaggaaaugauaauaaaaccuacuguaauaauaaccagugauuuuugcccaccaccaccugacauuauugacaugugcuacaguccagcuccauccauucuuucccagaaguggccucagaagaaguacauuuguccucuucaggcuuagauguguuucuucugaaauauguaauugaagucuugaugauuugagaaggaaaugagggaugugaaaauaaauaauuaccaccaguugguaaccucauaaaacuuagcuuuucauggaacccauaaaauagcaugcaaaguguauucaacaauagauacucucuuaaaaaucuccagacaucuucaaacacauucauguauugggguaacuuuaguucaaacauaguuuaacaugaauaaaauuucaguaggcaucuuuaauuggaaacagaaacguugcuucuguggcaguuuguggagaaccauucacaacuaguuuuguuacaguucauuuuagugauuuuucuguauauggcagcagagaucaaaucaaggcuuuguacauucuagguaagcacucaaucaccuaugcuauagcuuuuaaaaauacuuccuuuauuuuugaagauuauagucauaucauuucccccuuaccuuucuuccuucuaagcccucuuauauacuccuucuuguucucuuucaaauccauaaccuuuuuaaaauuaauuuuugauauuguuguuauuguuguuguuguucuuauaugugugugaaaaacugaaguagcccguucagaugaugauaacaguggaaauugugccuguuuuauugguugacugaugaguugaaguuuucauuaaaggcacaaagcuuaugaauggguuuuaugaaaaagagaguaccgugauaaggauuauucauguuuacuaagauaucuaacccaaggcuggggagauggcucacuaguuaagaguucuuauugugcaagcaagaaaaccuuaguucaaauccccgaaccuacagaaaaagccaagcauaaucaagugcaugccuauaacuauagcccugaagagggcggagacaaggagauucuugaggcuugcuggccuucagucuaacuauaccuugaaugagagguacugccucaagggaguaagguggagcaugacagagcaggugcccuccuuugaccucuuugugggaaugugcacacauaacacacaugcacauacaacacacaagcacacgaagaauuccaagccagaaauagagaaaaaugcacauuaacaucaaugaacaaaguuuuaaauauugccagccuguucguagauuaugcuauacauauauguuuagacaaguguuauuuauaaaauacugggagaacuaaaaaaaaucaacaucugauuuuugauuaacauggaauaaaauaagguuugcuaaggggcguuucaugccuuaauaaaguuuaauuuauauauagauuaauuuaacuacagcacuaaucacuucuacccccuccaaaaaaacuguuucauccuaccugcuuauacucauauuaccuugacuucccuucccauggcuaaccucuucuccauuguuuucuuuucaaaauauagaaauauguacaacuguauaaacacagcuuguaauguuuaagucugcacuaguuacuuuuugguuguugugacaaaacaccaugaccaagacaauuuauaaaagaaagcucuuaauuaggauuacaguuucauagugugagaguccaugaugguuuguguguuggcaugauuguaggaauagcugagagcuuauaucucaaacucuaagcaggagacaacaaccgggaauggcgcaacacuuuugaaaucccaaagcucaaccccaaugacacccguacacacaaagcuucaccucuuuauccuuuacaaauaguuuaggcaacaggggaccaaguauuuaaacauaugacccaugggagccauucuccuucaaaucaccacagagaugacugucaugaagcauaauaccuuugagauuucucuaaacuuuugcaacuaacacacuggaggauaucuagggauuuuuuuccagcuuuggguaauuaugaauagaauuauaaaacauucaaguguauuuauguauuuucacuucucugggauaaaugccuaggaguagaauuucuggcuuauaagguaaguguauguuuaauuucaaaagaaacugccaaacuauuuuccagaggagucauuuuucauuaacacugguaguacaggagaauggcaauuguuucauacuuuuccaaauauuugauauucucaauauuuuuccuuuaauuuuagccauuguaguggguaguuaaugauuugauuuuaauuuaauuuugcauuuaauggcuaaugauauugaccaguucuucuuauauuaaauuacuuacuuuuacuuuguaagcuaagaggaaaauuuaaauuuugauauaaauaggaauuuagaaaaauuuugguuggacagcuucauguauuuauguaauaaauuuuagucauuuuaaaaaucuuucaccccucuccugcuggaacccuugacaacaagucccauacuacuuccaugucuuuuguuugugagucacugugcuuaauuaguuuuuguuguuguuguuguuguuguuguuguuuguuuguuuucucagaacaugccugggaaguuauuuauuggaguaacuuauuaucagugguuauaauacugagaaaaaauggcaccccucucccaacaacuauuaauugccaauaguaccucagggaaaguagggcaucaccaaucccuccaugaaugggcauuuuuaacaucaaaaaaguaaauagaaucauaauggugauuucuaaaauuagagagaaagagaagagauggaggauggguagaagauucuaaaauaaaguuugacaugaagaauggagucuaguauucuaaaguacauuaagguaaauauagauuucaauaucuuauguauuauaugcauaaagccuuaaagauaggauuuuuguagagucagaauauaaagaaacauuaaauauuaaagaaauggaaaugcugacuacccuuugaucauuacauauuauacauguauccaaguaucacacuguauuucauaaauauauacaauuuugugucaauggcauuuuuuuuuaaaaaauguaauaaauaaaugugccuucaucaaagguucagggcaucauguugacuauucucauuuuaccccaggcuaauugaaauuugauugugaaucaacacugaucuacugacaagacuuuagaaacccaacuguucaguaccagguuuuguuuuguuuuuuuuuuguuuuguuuuguuuuguuuuguuuucuuuuuuacauuaaccuuauugcuaucagaaaauuuagugaaucccaccagaguuaccacauguugccaggaaauuuaggguccuuccccaccgccaacuucuuaauuucaugaaggaaauaauuuaaaauggacugaaaugaaaaugaaaaugaaaaagacaauauuauuauuauuagaguuuaaaugaaaauccccccaaguggaucuuggcaguugcccaaggagggaaauggagaauaagaagagugaaauccaugcuguuuuuaagcagccacauugcagacaaacagguacaaggcagaaaggaggacuucaaagaaagaggaaaaaccccaaagaaccaaagaaagcagacuugggcugugaaagagaccaaagagagaaaaaaggaaauguuauaucuuucugaaaagugaacaggcuuaacacacucucauggugacucuauagcagcuacacccagaacaguguuucuaggaaggacaugucuauuuuuccuguccguuuagcauggcuucaaagugaacguggcuuccugaugggucaugccuuugccaggaacugacugguaacuggauuaacucuuaagagagaaaacaguagacugcuucuacccagagauagacgccauucuuuuuauacagaaagacccucauaggucuucaguacuacuguaacaaugggucaacacaguuaauucaguuuuacuuuauuggcucugugcaauuuaccagagucauaugcaaacuuucuaccaugauggcugaaguacuuuauaauuuuucuuucuauucuuucuauauaaaaauuuccuucccuuuugagauacuugggagggggaggcaaaaggaucagaaguucaaggucauacucuuucuacauauguggcuuguggauagcuugggauauaggagacucugucucaaaacaaagaaaauaaaccaacaagaaauaaauaaauggauacuaagucugaggaaggaauucagauccuucuggccuucuuaccugcaacauauccccacauaguacccccuauuauucucucagccacauaccucaggacuguacacaagaccuaaaaaucaguagacaaguguccucccaguguacuauaucugcauuuucccuucugaaacagauucuugcuauguuguccagguuggccuuccacucauaauccuaucucaaccucccaccugcuggaaucccaaauccgugccaccacuucugacucuaccuuacuuacuuuacugucucuauguaaucccagcuucaucugucguuuggaauguucagcaaaccugcuuauaucuuacuuuguuaaacuguuagugauucacacaguauauucuaaggagcacuugcauuggaauauaguggaauuucuaaguguaugggcuccugugccuugcuauauugaagugcucaauuagauuuuucagaaaugggucucauaauguacauuuuuauuggauauuuucuuuauuuacauuuccaauguuaucccccuugcccuguuucccccagggaaaccccaacaauccccuacccuuaauuccaugaggguguuccccccccacucaccugccccacuccugccauuccacccuggcauuccccuacacuggagcaucaagccuucauaggaccaagggccucuccucccauugaugcccaucaaggccauccucugcuacaugcccaucaaggccauccucugcuacauauguggcuagagcuaugacucccuccauguguacucauugguuggugguuuaguuucugggagcuuugggggcucuaguugguugauauuguuguucuuccuauggggcugcaaaccccuucagcuccuucaguccuuuuucuaacuccuccauuguggaccccgugcucaguccaagguuggcugcgaggauccaccucuguauuuauuugucaggcuuuggcagaaccucucaggagacagcuaugucaggauccugucaccaagcauuucuuggcauccaacauagugucuggguuugguaacuguauauggggauggaaccccaggucgggcagucucuggauggccuuuguuucaguuucugcuccacauuuucucuccauauuuccucgugugaguauuuuguucccccuucuaagaagggcugaagcauccacacuuuggucuuccuuguuagguuucauguggucugugaauuuuaucuugacuauuccgagcuuuuggucuaauauccacuuauuagugaguauauaucaugugugaucuuuugugauuggguuauuuuacucaggacuauauuuucuaguuucauccauuugccuaagaauuucaugaaaauguuuuuaauagcugauuuaaaacauuguguaaauuguccauuguguaaauuccucuguugaaggacaucugagguugaccacgcuccuguggucauugcccuacugcaacugaggcggcacaaacuggacucaguagguuauagaaaaaaaaaggauguaaaguugggagguggacaguauauuugggaagaguuagggguaaauaugaucaaaauauauuguaugaaagucuccuacauuuaguaaaguauugguauuuaacuacuguaaaaaaaaaaaaaagaagaaggacaucuggguuguuuccagcuucuggcuauuauaaauaaggcugauaugaacauaauggggcauguguccuuguuauuuguuggagcaucuuuuagguauauucccaggagggguauagcuggguccucggguaagacuacauccaauuuucugaggaauccucagacugauuuuuagagugguuguaccaccuugcaaucccaccaacaauggaggaguguuuucucuuucuccacauucucaccagcaucugcugucaccugaguuuuuaaucuuagccauucugacuggugugagguagaaucucaggguuguuuugauuuguauuucccuaaugacuaaggauguugaacauuucuuuaggugcuucucagccauuugauauuccucaguugagaauucuuuguuuagcucuguacacccguuuuuaauaggguuauuugauucuccggagucuaacuucuuggguccuuuguauauauuggauauuagcucucuaucagauguaggguugguaaagaucuuuucccaaucuguugguugucguuuuguccuauugacaguguucuuugccuuacagaagcuuugcaauuuuaugaggucccauuugucuauuguugaucuuauaaaauaagccauugguauucuguucagaaaauuuuccucugugcccauuggauuugaggcucuaccccucuuucucuucuauucguuucgauguaucugguuuuauguggcgguucuuuauucacuuggacuugagcuauguacaaggagauaagaauggauccauucgcauucuucuacaugauaaccaccaguugagccagcaccauuuguugaaaaugcugucguuuuaccacuggaugguuuuagcuccuuugucaaagaccaauugaccauagguguguggguucauuucugggucuccaauucuauccauugaucuaccugccugucacuguaccaauaccauacauuuuuaucgcuauugcucuguaauacagcuugaagucagugauggugauuucccuuaaaaguucuuuuauuguugagaauaguuuccgguaucguggguuuuuguuuauuuguuauuucaaaugaauuugcaaaaugcucuuuauaacucuaugaagaauuuaauuggaauuuugauggggauugcauugacuguguagauugcuuuuggcaacauggccauuuuuacuauguuaauccugccaauccaugagcaugggagaucuuuccaucuucugagaucuucaauuucuuucuucagaaacuugaagaucuugucauauaggucuuucacuugccugguuagagucacaccaagguauaucauauuauuugugacuguugugaagggugucauuucccuaauuucuuucucagcccaauuacccuuugaguagaggaauaauccuuugaguuaauuuuauauccagccacuuugcugaaguuguucaucagguuuaggaguucccugguggaauuuuuggggucacuuaaguauacuauuauaucauuugcaaacaacgauauuuugacuucuuccuuuccaaauuguauccccuugaccuccuuuuguuuucuaauugcucuggcuaggacuucgaguacuauauuguauagguagggagagagugggcagccuugucuuguccccgauuuuaguggaauugcuucaagugucucuccauuuagucuaauguuggcuacuuguuugcuguauauugcuuuuacuauguuuagauaugggacuugaauuccugaucuuuccaagaguuuuaccauguaggaguguugaauuuugucgcaugcuuccucaacauccaaugagaugaucauaugguuuuuacaagugacacauauaugaucauuagacacaacugaauauaaaauuccaugaaucuagauguacaucauguaugacucucagucacaacaauuucuccuuucuaugaacaaucaaagucucuuuuuuauuuacacaugucaguaaucuuguuuggucauuucaucuguuguauuguuuuacaauuuaaauguuaggugugacuuaauuuauaagccacugaaauacagggauucucuucauaucuuguuuauuauguugcuuaauauaguguacauaauguguauauauauuaaaaauuucauauauacacauaaaauaguguguguguguguauauauaaacuuuguacacauuucaguaguggaguuaugagauuuaaggagaacaauuguuuuuaaucauuuuucaaaggcauaguuacucugugaacaauggugauguaaagcuuugagaauuuugccuuugauucaagauaguuuguacuccaagugcuaaauugauuuacgccuuugaauauugcauugacacuucaaaauaucuuaaauauuugugauaugaaggggugaugguguaccauauucguuccacuuguucuuugcuauuucaaucauaccaucaacauuaccauccacccucccuugcuggcccaugcuuuucccauuauacaagucccacagcaguuuccaucuccucugacuuauuguuaccacuuaggcccacaauccacaugauuccccuuaccagugaaucucuaauauuuccuguuggugguucuguuuugacaccuaacauacugguugguaacuugcugacuuuuccuccuacucauucauugugaaacucuccacaaauuaauagcaugaugugcaagcuaacacagguuccuggcugcuaaagguuagaaacuacuuuuuuaaugcuaaagaaauuaacuaaacuugagauaauuguugauggguagauagcaaaagaugccgcaauucaaguuuucaaagaggaaaccaccauggaaauauuaaacauaggcaaucuacuggggcauugcuacaucuacaugcacuuacaauaagauucuuaauuuguacuuuauaaugaauaaugauaugagggugugauugaaguaauaucuuuuuguuuuuugguuuuuuuuucugaaugguaaucuauacuaggcauagucaaacuguucauuucuggcaucuugguauuuaggaauaguuuuuguauccaaauccaucaugugaugagucucauugguuacuaauacaauccugaaaaacagauggcuuuugcuuuggccugcuggucacaaauuuggagguguggcuucauauucugaaggacaagaugaucauaaauaguaucacuguggcuuguuaguagaggugauuugacucagauuauauauaaaauuauaauauuauauauuauguauaugcuauuuuucaagguacaauggaauaggaauggugugagccucugucacuucaaauuuucuuuagguuagaggauacuuuauccaacccacaaaucuaggaaucacauuuaguaguuccuuucucugguucauuuacucuaauuacaucuaauaaaguccugugcugucuaacuccauaccaucucuuaauucugugcucuguucccauauacccuuacugcuacuuucuuacuucaugguuuucuauuucaccaagauuggcuacuuuucagcucuuggauugauagaauaaaauuugggcaaaagaauacaauggcuuucugcuuaagcauaguagauggacuuccugcuucugccauuuacuagaaguuuaaaauagaaauaaauggauaaaaauuccuaagaauaaagagaugagaagaaacugauucacaaagaaaauauaaggaagauggaagagagcaaguauuaacuaccuguuauagaaaacaauacuucaaaacuuagugauuuaaaauggcacaauauuuagagcucuuuccucugaauauugaauuucauaugaaucauuuauuuuccuacuauauaggaaauggaaaauagauaguauuugacagucaggaaucugauaguuguuuagucuggcacuucagacugaagauugugcacaggaauauagugagaauagcuauagucauagauaaagcuggagaaucuacuucuagguuccaucauaagcuucuuugcaggaagccucaguuccucaccacaugugucuaauagacagucagcuugggucaucuuacaacaugacaccuggcuucuaacagaguaagugauggaaaagacaaacaaggaugaagccagaguacucuucaaaccucaccuuuaaacuuaacagcaucauguccgcuuuauucuguuuauuagaagaaagugauuaaauccaacucacacaugagaaacaucaaguuucacauacugaaugaaggaauauaaacacucgugggcauacauucaaaccaccacauaguggcaacuaaguuagcagaauauaauaacuauaauauagaugaguucacaauggguacuuauuaaaaggagccaauuuuucccugagagauuuuuuucaagcauuagcuucuacaauuuagagugauguucaaggcugaaaauaaagcauugcuugaaauccacguaugagagagcugaucucucaugucucuucaccuccacacaaaccacaucaccacuagcaccauuaggaaggagaauggagcuuuagucucuaaaacaauuagguaaaaaucuccauguuaagagaugacaaacuggaugcuagucuucucuuaaaaugcugugcauuaaauuauauuccuuaaaccucuuuuccauuuccuauguaguaggaaaagaaaugaaucguaagaaauucaauauucagagaaaagagcucuaaauacugguauauauacccccaaucaaauaaaugucaguuuauuccuaauacucccacagaaugauaauccaucggcaguuccaaccgugcacacaaggcauauaaccaaggauuagcagauaguuaaggaauccuuaaauccuaaaaauaggcuaaauaucacugaaacagaacaaaacaguuguuggaugguacaggaaauugcaaaagcuauuacacauguguauauaucucuacaacacacauauguauauguauaaauaagauaauuguguaauauauuuaauauuggauuaauauguauuuggggaugauaaaaauggaauuagcuggcugugauggcacaugcuuauaaucaaggcacuugggcauuggaggcaggaggauugggaguucaaggacagcaugggcuacauagugaaacccuguuuuacaaagucaaaaacuaagggaccaagcucuaaaauuuggauaauccuaauauaucauugcaacaacugacagcugcauuuauguuguacaacacuaucauucuacuugauugucuuaaacaacuaauggauugaccugacauuucugcucuguucuguuguguucuggaacuagcuuauuaaaacuaaauuuaaauaauauauuuugauuauauuguuuuccaucccccaacuuuuuuccaucuacauauucacccaauuucguguucuuucucucuggacaaugugcagagcuuggaagacuuuggaacauucaguucuaagugagcucuuuaucacacccuuccccucaaggcucaggaaucuaugugaaaaaggaggcagaaagauuauaagagucagagguaguggauguauccaaggaaacagcaucauuuagacacagagggacugagcccauaugaacucauggagacugugggagcaugcauaagaccugcacagauucaaaccagacaaaaaucucagcacagaaaaagaaggggaagucaacacaaaguugcaacccuggccaagaagcuuuuucuguucuuuauuuacaguauuuaaagaaaaaucuucguguguuucuacgcacuaauguaagaaaugguuucuaggaaggagcuaauuuaauugaucuuuauuucacuguuaucuuuaaugccuacuuuauugggauaauuuauauacagacauuuagcuuuuuaauuguacaguuuugauauuugaacaacucauagagccauguaaucagccuugcaauaguuguauaaaauuaccccaucacccauaaguuuugucaagacccuuuuauagacagcuuuuacaccuaucaucaguucuuuauaaacacuuauccuuuuaccucuagguucaccuuuuccagaccaucuuaaaagcacacacauaguguauacuguuuuaugcaucuggcuuuuucauguagcauaauucauuugagguccauccauguaauuguguacuuuaacuauucaucauuuuuguuauuguaugagauuccacuuuaugcauacaaugcauugauuaucaguucaaggauauuuagacuguuuccaauuuuuuggggaguguguguguguguguguguguguguguguguguguguguagguagguagauauuugugcaucuuucuguaugaaagcuaaagaacaauguuggguguuuuccucagucaaguaaacuagacugucuggccccaggaagccuccugucugcacauaccuagcacugggauuacaaguguacaucgccauauuaggacaaacgcuuuacugccugagccaucuuccuagccccaagcuguuuccaacugucaaugauuauaaguacagcuuuuauaagcaaccauguaugagauuuuguaagcauaauuugucauuucucuuguaaauacauaggaguagcauuacuagauuguaugaaaaaugugugcuuaauuuuagaaggaaauaucagcuauuuuccaaaaugaaaauaccacuuauguaucuaugaagaaaugcauaagagauacuauugcucuuuauuguuuccagcacuaaauucuuagcuuuuuguugagcauuauuauuaguacaauaccauucaaaaauuccuacuucaugaaucauaaccucaaacauuuuaaaaucuacuuguauuucuauugcccauuuuuaauauuuagguuuguuuauacugaguuuugagaguccauuguuuguuuucuuuucuucugcuuuucuagauagaaacaaacccuuuaaaagacauaugauguguaaauauuuuguuuaagaaaacucuuguuuucuuagaagugacuuuagaacaaugggauuauauaauaguuuuguugguacggugucucacucuguagcccaggcugaccuuaaacuccuagcaauaguccuacuucugcccauuaacugugaauuauaugaaccaccaccugguuugucauaguaagaauuuuguugaaaucaguuuuaucaaguugaaucucuuagagauugcauuuuggauauuguaucaguuuugguguguggugugauguguguguguguguguguguguguguggugugugugugugugugugugugugugugugugugugugugcgugcgugcacgggcaggcauucagaggccagaaccaagucucauguauuguuccccaggaaaugugcacuuaguuuuuguuuuguuuuuaaaucggaucuucuagaaccuagagcuuaccaaauagucuaggcuggcuggcuagugagccccagaggugagugugucucuaauccccagugguaagaugauaagugcaaaauaccacacccagcuuuuucugugggggcuggggaucauacgcaagugcuaauguuugcacagcaaauacuuuaccuacugaguucucucucagccacuaugugccaaaugaggacuacacagauuuucuuuuuaguuaucuauuuauaucuuuauuugauacuucuuuauuuuaauguaaauauaauugcuucauuuucucucuucccuguccucucuccaaugucuucuauucccacuuucccccaacucccugucaaaaauuuaauucugcuuauuuuuuuguuauuaacacacacacacacacacacacacacacacacugguggaaugagauuucaccaaugagagagagagagacacagagagagagagagagagagagagagagagagagagagagagagaauauaaauauguauauugugccugguuaugagaaugggaccagcuaagcuacaacaaauggaauauaaaccaaauucuuuguccuauugaguuaauauaggaaacacauauguauugucauuaaucuuuuuagacaaaagaauguuuuugcuagucccuugaccuaaucacccuguacuuuggaaagcuuggcucucuuacacguaggauaagugaaggaccauauugagauaagaaauaucucauccuuguccuggguaggugauauaaaaaggggggaggguaucuccaacaacaacuggguauagccuguaaauuccuggugaggaaaccaguguugaaaaagccacccccaugcuggcaguagugugcuaaaggagaugggacaugaacuugcucucugugcaucagaaaauccucaaggugugguauaaggcaggagugacuuucugccucaaugacugaauucuaucauuuguggugacuugccugauaagaaacuaaaccaauggauauccuauccaugaagaccuagaguggcaggcuuagaaaucaguauauauggcuauaaauaaaccagagggaaagauggguuuauacuagaaaauugcagagaaaauuagacagaaaugaauagaaguuuugaaaauuuauuuugcauugagccagacuccuuucaaagaggaagguuucugguagcgucuagagccaugguucucaaccuuccuaaugcugugacccuuaaauacaguucauguuguggugacuccuaaccauaaaauuauuuucauugcacuucauaacuguaauuuggcgacuguuaugaauauuaauguaaacaggguuuuuuuuuuuuuuuggagauacugguuugccaaaggggucaugacccaccaguugagaagcacugaucuaagagucuguucucuucagcauuaccucugcccccuacuguggcauguuuaguauacuuggaugaaggaucuucacucuucauucacugcuugaagcaccaauacuauaugcagggacccucuuggugcucacuauuucaguuuagcagccuuuacaaacagugauuuuugacugcucuaucaggcuccugucagcaaaaucuugcugcugcuucuucuucuucuucuucuucuucuucuucuucuucuucuucuucuucuucuucuucuucuucuucuucuucuucucuucucucucucucucucucucucucucccucucucucucucucucuuucaagacaguauuucucuguguagaccuggcuguccuggaacucacuuugcagaccaggcuggccucaaacucauaaacccaccuggcucuggcucuggcucugccucccaagugcugggauuaaaggagugugccuccacaccaggccuugcucuuucaauuagauauuuucuuuauuuacauuucaaaaguuaucuccuuuccuaguuuccucucugaaacuccccuauccccucccugcucccccugcucuccaacccacucacuccuccuuccuggcccuggcauuccccuacacuggggcauagaaucuucgcgagaccaaggaacucuccucccauugauggcugauuaggccauccucugcuacauaugcagcuagagacaugagucugaccauguguuuucuuugauuggugguuuagucccagggagcucuggggguacugguuagaucauauuguugauccuccuauagggcugcaacccccuucagcuccuuggguacuuucucuagcuccuucauuagggacccuauguuccauccaauggaugacugugagcaucaacuucuguauuugccauguacugucagagccucucaggagacagcuauaucaggauccugucagcaagcacuuguuggcaucugcaacaauuucugggauuggugauuauauaugggauggauccccaagugggguagucucuggauagucauuccuucagucucugcuccgaacuuugucucuguaacuccuuccauggguauuuuguucccccuucuaagaaggaacaaaguauccacacuuuggucuuccuucuucuugaguuucacaaacagugauuuuuuuuuuuugauuccagaaguaccaggagaaaauggauuguuuacauuggagaaaacaguuaaauauuccccauuugucauuacauuccuuuucaguggagggcaaugacugauauuaaucuggugguuuagaacagacaaaugccucuguuaagggguaagucugucuuuaagacuuaaauuuagggaugcuuuuuguuaaucuguuuguacugacaagucuccugguguaccuaguuuacaacagaaauagugaugugaggauagauagguuacugguuucaccuguuuaugaggucuuggcgaagagaugccauuucacuggcuucaauccugcucaauuuauguaaagaucauaaucuugcuuuccuugaagaaaucucucuguauacaaaacauaacaacagccaaguacaaugucauguuaguucuccaaagagccuuugaguucuaggguuugcuucuuugcuauuauucaacuacuaaauauguaguaguuaagcuuucaucaauaaaauaagcauauuugggcaacuuuaacuuucucauccaucuguugaaaaaucuuagccucucaagggagagcaaguggagaugguaacaaagcccagccauugcgacacccucuacuaaacaaaaugucauggcaccacagaaaaauaacuaauuauuaaaaagacacuuaacaucugauuuggcugcacucuugcagcuagauagauucuuuuuguccugaaaaaucuuuaaagacuagcucuuagaggcugauccugagaaguuguugcaggggagggaguuccuucccaguaccccauuuucacuccauauccaccugucccuuacuagauaccgccuuucauuaaaaaaagggaaaaugccucaggccuugcaugcggggugauagugauccuuccaaggucacugacagcaaucaugaucuuguuauuuucuuuaauauuaaaacuuagagucuuagaagagauuuagccauuaguucuaucccuacuaguacaucaaggcucuguccucagccugguugccacaguugcuuagcuagauuucagaucccuggcauuauauucuucuuucauccacccaaaucaauuuuucuguucuuugccccagcucucuuuacuauaaucacaaugccuaaggaucuuuacuugaagggaggagauuuguguuauuauuucucuuuaaaguuaauucagcauugauuccauuuuuaaaaggcuguauacguugccauuggaagaucucucgaauaguguaguuccuuaugcaaugcauauuccacagauuaaggcaaguauccuagauuccaaagcaaaaccaguucucccaucaggagcagagcauaacugcuuaucuguacugccugagaauacaaggguuggccaguugcuauauacacuuaggucucucauuccaaacugcuguauaauggugaauagaggauacaagcaacaaguguguguucaagacuguuuaaauuuguauucugcugcuauuuuacauaugucugaggguaaauauggucuaaggguguacaaguugagcgcuggauuagccuccaguuaaaguuuuauuuucauuuugguauagagauuacaauuuucaguagaaaugcugauugacuuuucucagugaacucuuaaguaccuagcaaaagccugugcccauuagagaaaagaagcaucuaucaucucuacagugguuuccaacuugauuugguggaaaugaacacuagcagugcauguucccugccuugcuauaaagcucaggcugaccucauacuuccuauguagucuaggcugucucaaacucaugcuccuccucuacauauaccaucauccuuauaaccacuuuaauguuuuuuaauauuucuuuauuugugugugagagauacaaagagggagagagagacagagagagaacacacuugucuugucugccauggcacauguguagaggucagaagacaaucaugaaugaguucuuuauuuuaccauguggguccugggauuugaacugaaguugcuaguuuuuauaacaaguaccuuuaccugcuaagccaucucaccagcccugauaacaaguuguaauauuagaaauaaacaauauugguaauguuuuguuaaacugguuacugaaggguauaagguuaagguuuuauauaauaguauaaucuuuuuccucucccuaugagcaggaauuguuuacauuucucaaaugauugccuagaaaauauuuccacaaaggaauaugguauuucuucuauuucgcccaaccccacauggcucuuauguacuuaucaccucuccuguguuuugaaaaugauuagggagccagaauaacuggccauuccaucugaauugcccacauggacaauaggccauguuagucagagaaaacuccucucugcaccucacaguccauuagcuugcagccuuucccauaaguuaauagaaaccaaacuguguucccuuucauuuguacuuguucucucucucucucucucucucucucucucucucucucucucucucucucucucucuguguguguguguguguguguguguguguguguguaggguugaugcuuuuuccaaauuaaaaaaagcaaggucucuucuaagugcuuguagaauuauaagcagaauuuuagauaacauauuuagaaguauaaauaacauucuuaggugucuuugaucagaaaagcagucuuacaacuaagcuuuuccuaaaucauauugcagguaacugagugaaaaacuguaggcuucugcauuguauuuaaaauaaaaaguacauuccccguguagcaaauaguaguaauagcucaucuagucucucaaaauggaacccagaaacauaccccaguaccugucuguagaucaacuuucaaaguaaaagugaacccauaauccauauauuuacaauuuaauucccaagcuuaauguuacuaagagaucuccauucugugacaaguugcuuuugucauuuucuucuuucacucccacacccaccuuucuggaguccucaggagcuucacagucucagagcagaggauucugcauaggguauaaugcacagacaccaaaagugccagaaaacgauagcugccuugaauuuucccagcccaguuucagaauggauucuacauuuucaguaucuucuuuauaaguaucagaccaaagcccagaccaacugcuacacugaaagcuuucuuuucuuuucuuuucuuuucuuuucuuuucuuuucuuuuuuuuuuuuuguaagaggaagcuuauuguucuuuuaagaaugucucaggaaaguugagccauugcuuuugguggguaagugugcuugcagauuagugcaugugauugcaugugugggcauauguuugugcuucagcugugugcauuucacuuuuagacaaacucauagcccaggcugcuggggaccagauguuccuaaggauucuuagaaguaaacagugacaagugagcuucucaacucaguauuggagucuggcucgaggaaugaggccccucuguaaaucagagaggagagcaacagcagaaaagauggauaugaaaccacagauauuguaaucuccucagugaaaaaaguugauccagcaauucccacuggauccauacauguuguaauuuauuauuuuaugacuuuaucuuuuccuuuaaccuuugcccauuguacuuuugaaaaaauguugggauacugauuauaauuuuuaaaaacugcaaaauauaugaaucagccccuugagucauuuuuaaauguuauaugacuauaauuagagguuuuuguuauuugccuuuugaagacagguauuauuauuuuauaaacuccagcacagguuagaaaguucacuaugaaauuaacuuuauagcauccuauuuugugggaauuugcaugugagauuuuuagaguucugagaauuuuauacaugagcauaauauauuuacauauccaacccucccucucuccccauauuucucucagaguaccuucugcaugucuaucuuucaaauucauguccucuuguucuauaaauguuauuaaaucuacuuaguguuauccauauguacaugaguuuagggauaacuacuuuggcauggacucaucaagaggcucaucccugaagaaaccugacuguccuucccucgaaagcuguugguuuccuguggaucuucaagccagaaguagggucuuuugaaucuuuacuucauccauguuugaaugucucucaguauagucucaugcugaucuugcgcagacaagacacuauuuagaguucauggauguggcaucuccuucaggucccucuggcucauacuaucauuuuuaauccguuuccauugguaauaggugaagggauuauauuacaaaucuacugauuugggaugcacaccccaccaugacuuauucucuacauuggaugaauuacagaucacuaaagaagcccgugucugcuacaaaaugaagcuucuuugggaagugacauacaugaagccuguguuuauguauggauuuaaggauaaguauuuagaacggaguuagauacucuaucaguuuagcaaaaugauaguaauagguucucuucuagugucuaugacuacuccaaccacagguucuugacuagguuuauaguaucagccaugagucuccuauuauugaguagaacuuaacccauaucagugagaugcugguuaccccaagauauuagugcuacuauugcacuacugaggauaucuugcuaguuguuacuguaguucacagaauuuacaacugaguagaaucagugauauuuuuuucucuucugccagcuugcauacuaaguaccuuaaaguaaucauaggaggcuugcagguccaucccagcucuauuuauccaacuccugugaccagugugcuaucuucagcaagaggguuugacucuuuuaaguacuagcaggcaaccaaaacuaacagcaauagccuguauuguugagggaagucuuuaguggccuguggcuaacaacuugcaaggcacugggcuuaaaaccagaauuccugcgucaaguguaugugagaaugguucuucugagugagagaauuggauucaauucgaaucaauucccaugcagaggaauaaccuucuuugaagagaauggaaaauguguucuaugcugucucagagaagcccacuucccaggcaccauggcuaacccaaaggucaucuuuaaaucuaauucuccaauugaggaggaaauuguugcaccuccaugcuuuugggcauguaaaauaaaauuucuucacauaaaaaaauagaacuagguaacuuugggagucuucccauuuugcaccuguagcccauuuuuggaguuggacuugccuugaauucagagugaugccagaagaaacauuuaaaaguuaccucuaguuugaugauacuuggaacucuggacuucuuguguuuuucugauacccuuuauuucuuacagucuucaaauagcugcuuaauuuuauucuguguaauuuuacauuggcauuuaguagaaaggacaggauacuauauaguaaccccacccuaugugaaaccaggacccaccuacagaugcuuuagacaggaaaugguauucuguaacauuuuuaaaggaauuaaauugcaaccauuuuaaaacauuuuccagagaacauuucuuuguuuagacccaggcuucugucuaagauuuuuuuucuccaugaagaaaucccuucuauauuuauugaaaugcagguuuucugauaugacuucuguugguccuuaucugaacaaaaguauuguuugauuuuuauuuugaaagauaguuuugguaggguggaaaguucugauuugauuuuuuguuguguuuucugcucccaugccauauggagugucacuccaugaucggacauaguuucuaacaauaugugcuauaaucaccuuuguuuucccauaggauuauauuuucuauuccuuuagguauugucaagauuuuaucuguaauuuuaaacaauuugauaugucuauauguuuuuaaaugauguuuauccuuuuuggcauuuucuaaacaucuugcauguauguuuuagagucuuucauugauuuuguaaaaguuuuaaaaaauuauuuaauauuaaauucuuuuuuaauucuuuuguuacucuacauacauauauguuaggucuuuuaauaugguuccucagcaauuggauuuucuauuuugcuuacuuauuuucugcucuuacuauucaaguuuguacaaccuucauugguuuaucuccaaauuaccugagguaauuaaaggcauucuuuguuauuuuauugauuacuuuucuuguugcugacaagaagcaacuuaaagaaaguaaaguuuauuuccagaucacaguuuugaguugagggagcccaaucuggcaacgaccuguggcaguagcucccuccaaaguggcuggaccaugagccuggaaugguggagguagaacuaagaguucuacaucugaaagugcuaggagaagacuggcuuccaggcaacuaggauaagccuauacccagagugacacacuuccuccuauaaggccacaccuccuaauagugccacucccugggccagguauauucaaaccaacacaagucccuucaguuuugaucauugaacucccacuacaaucacucauuaaucucugauuauggcauucuagggguucucuagccccaguuccaaacucuucugcauuccacuucuaaacuuauuccaaaggccuauguagcacauagcagguuuaccacagcaguaacuccacuuugauacuaguuuucuauaacauuugcuuuucucaucacugugacccaaagccuaaaaagaagcaacuuaaggggggggaucauuuuauuuuggaucaugauuugagaagauaucagcaucauaaugaggaaggcaugguggcagacaucucuaaaacagcaggagcaugaaacucagaauuaucauauuuucacuucauugcacaguaacuagauauagaauagaaaaacuaaggauaggcuauaaaaccccaaggucugcucuccagagauccacuuccugcaacuaauaccacauuccaaagauucuacaacauuccuaaaugaugucaccaucuggggacuaaauguucaaacacaugaaucuaugggggggggcauuuuauauccaagcuguaacaauuauucuguuucaauuuuuucuggugugcugcccaccuuuuucauuaaugccuauaauaauauuaugaaaauuacuuaaauuuuacuuucuuguauauuauuucccaaaucaacauaauucaauuguuuaauauucucucucucucucucucucucucucucucucucucucuccauauauauauggaauauggacugcaucaaaguguuuggugguaguuuuuuuuuuguauagagcaauggagauuguuauaaacaauaauuguuuuaaaggcagauggccauccaauauuugacaaaggcaucaaaacauagacuguggagggaggagacauccuauucaacacauguugcugacaaaauuggauauccaacuacagaagaaugauuauguccugacuuuucaccaugcagaaaauucaauuaaacuaagccaaagaccuuaauuuaaaucccgcagcuguuaaaagaaaacagggaauauauuucaaguuauagggauaguucaaaccuuucugaaaaggcucuaauagaaaagaaaacaggaaauaguccucaauguuaacaaauggaaauacauaaaaccaaaaaguuucuacauagcaaaagcagcuaucauccaagugaacagacaaccugcacaauggaagaaaaaccuuucugagcuauaccucagguagaguguugacaucuauauaaaaaccauaaaaaguaaacacacacucucaaaacaacaaaacuaccaaucaguaaaugggcuaaugaaguaggcaguuuucaaaaaaagaaacaaauagccaauaaguauuguuuuaaauguuuaauacucuuagucaucaagaaaaugaaauuugaaugcacuuugaaauuacaucuuucuucucaauuagaauagcuauuauaaaaauaugaaggagagugcaauacuguguaugaaaguagcaucaucacuaaaauaacuaucauuuugagaaauaccaugaggacaaaaccuaaugacuucaugguucuuauugauuacuuuucuaaggaacaugcuucauuauuuauauuuaagaguuuuaccuaaauugauguguaaaaauuauuuuucacugauuacauauauacugcugauauaaggguauguggaaagaaaaacuguuuucacugcuggugaggauauaagcuaauacaaccauuaugggaauaaguaagagucuucucuaccucugggcaagugcccaaaggacugaaugucccuacuacaaagauacauguuuauuucugcucuguucacaguaacaaggaaauggaaccagccuagguguccauuaacuaauuuuaaaaguuucauaauuccaaugagaaagcccaugccuaugaguaguccuuuccagcuuccagccccuguguccagcccuuaguaaccaaacauauuuucuaucucuauauuuaccucuuuggaaugcuucauauaaauaggauuguauaaaauuaugaucauuugugacugauauaaaaaugaaagaaacuauuuuccaucuuuaucuaggaaguaaauagcauuaucagcaccccauuguuucuuaaugcugaacaacaguccuuuguaugcuuaaaccgauuuuguguguucaucagauggacauuggaguuguuucuaccuuuugacuauuguaaguaguauaaaauagucucauguuuugguuaaauuuuugguuaaauaccuaguucaguucauuuggacacguacaaacaauuggaauuaccugauuaucuauauuuaacuuuucagagaauucuucuuugugaaauggcugcaacauuuuguguuucugcuauuaacaauagaagguuuuaaguucuccaacaccaguauuuauuauugccucuauuuuccauuauggucaggcuaguggguacgaagugauaucucuggaguuuaacucaaaguuucuuuaugucuagugauauuaagaauaucugugugcuuuuugauuauuguguuaucuucuccaaagaagcauccacucaaauccuuguccuaauuucuaauuguuuuucuuuuuugccauuuaucuuguagcaaauauaaacaacauaaaauuuaccauuaagcauaguuuuguggcauuauuuuggaaccaucucuucuauccauuucuaagaacuacuucaucauuccaugcuaaaacucuaacccucauacaccccacccucugacagccaucauuuucuuuucucuacaguuuuauauagguuaacacauauaaauagaauauuacaauagcuauccuuuuguggcuggcuuauuuaauuuagcagaguaucuucaauguucauccaugaugaggaaugaaucagaauuuuauuccuuuuuaaggcagagcaggagagccguaucagccauaugacaguauacuuccccagcaacagaaauuuauacccaacuacaauuaaaauuacuuuggggauccuuagaauucaguuaaggguuugaacuuugguggaaagcuuauuuuaagagggugucagauuugccaaccuuuguccuauuuccugaggcuccauauucuaauaagcugagcuacaagucuacuuaguauugguauugcuacuaaaaccaucugauggguuucuuuugaaggaguuacauauaccuguaccucaaaggauaagccugcacacauuaaaccucaccuguccacuggaaauaucaaacauucuuugccguaguccaaggucaauuguguguguacaaguauucaaagagagguauaccccuggauuuuggaaucagccccuucccugccucuacagaaauucagagacaagcauguuuaucuguauguaaucuuauaaccagggaguucucauggaauaucccaaaauggaccugaaauauauuuuuagcuccucucaaccuugauuugaaaacagucuaccacucagagacuuugcacacuggaacuguccacacagcaagggacacuaucaugcucuaguagguggagccaacuuucuuaccacuaugaaucuugaaacuguauuaguaaucagcucuagcuccucucagcuauggucugugaguagaucuucuugcuuaucuagggaauagucaauagccuuuuucauccaugaguacagaguaaaauuccuauagaucccaggucuuagucucagcugaugauucuaaaccucccaguuccagcaguccagaaaauguacagauagcuuuaaccuguuaaaaucagucuagaaaaauucaaagagucaggucacguggugcagaauacugaaguagaaggaucagaaauucaagcccugccuggucuacaaaggaaauuccaggccaacccuugcaauggugacagacguagguacugucugacuacaauguguugaaauauauauuucacauuuccagaaaguaauuaacugcccaaauucaguuauaagaugcaugcacacuucuugaauaaccacuuguaaauguuggaauguaaaaaaaauuaacugggauuauggaugcuuuuucugcagaacagguuaguuuuagguauaaaugcccucccuuuguuagauaugaaacaauauucaguucucuuucaccuucaaaagacugacaguagguggaaacguugcacaugcagaauguccuuccugaguuuuaguuuaguaguaaacguuucaaauucccucaaaagaaauuggagaaacaaauaugucaccugugacccaugucacagcacugagaggaggaugaagaagcaucaguauuuauugcauaacaaauugccaggcagccuacaaaacauagugagacaaauacagacacagacacacauacacacacuauaacuguaugcaugggagggagguaaaaugggagagcaauaagagaagguguggaggagagaguugucagaauacauuauaaaauguauaaaauugccagaaacaaaacuaauuagaaaacuauauggcauggcuucucuuuuagaaaugaacuaacaaaacuaucacauuuauacuaugacuacagguacuauugucccaacaaagcuggaaaccagucucccacuuauaaagacguaauuuaaugcuaggauuaaugaauuuaaaacugaagauaaaacucauugagaaauguagagaucauguagaauuugacccaucaauuuuuaauaucaaacauugaaauuagguuccccauuuuuauaugaagagauuucaaauaaacgauuaaauugucagcucuucuuggaagccagacauuguggcaaugcuugacugcuuggcugcugaggagugugcagaucauuguucacuguguuguaugugaugcuaaggugcuugucuccuaccuaucaaucauuacaguuacacuuguguuacauguagcagucaauuucauucauuuauguuaccuuccuggagccuuaaucacauguaauccaguucucauccccuuauguucucuguauuuccuaagaaugccauaaaaguuacuaugaacuugguugcucaaaauacauauauauguauauguguguaugugguguauguauauauguguguguguguauauauauauauauauauauauauauauauauauauauacauacauacauauguguguauguguguauauauauauuuaauauuuguuuauacuuauacuacuggaggucagaaguccaaaaucaaagacuauucaaagcugucuauguccuuuuucuguggcuuaguugcugaggucugcuagcaaccuuagguaucuguugauuugucuuuguucucacaccaucuccucaugugugucuauacggcuuaaguucuccuuugccuauuucuuauaaggacaccuggauuuggauuuggauuuggauuuggauuuggauuuggauuuggaacuuacacuaaaugcagcauaauauaucuuaaguucgugaacuuauaucugcaaggaccauuucucuaaacaagaccacauuuacaggcaauaaaguuguaguauaggcauaguuuuuuguaauuacuauucaacccaucacaaccccauuuacaaauaauacugaaagcaaaguagguuuaugcaugccugccaaauauacaaguauuugugauaguucauucaagaaucuugauuucugccgggcgugguggcgcacaccuuuaaucccagcacucaggaggcagaggcaggcggauuucugaguucgaggccagccuggucuacaaagugaguuccaggacagccagggcuacacagagaaacccuguuucaaaaaacaccaaaaaaaaaauaaucuugauuuccugacacucagaguuuccuuuucauugauuuaugccuguauucaccccugaucaacucauguucuaaauaaaauauaaaacagaaacaauaaauuuccuuuaccuuugcuauuuugccuguagaaauauuuaaggguacaguuccuuuuaaacuuuguguaaugcucuuuaagaacaugagaaauaacugggugugguaacauaaaccuguaauuuuuacuuaggagauagaggcaggaggauuucagucgagcauagaucacacaguaagaccuuaucucaaucccuguucucccccuaaaacaaaacaaaacaccaugauggaguaauaagaaacaaauuauauguuaauuaaaauuucccugaaaaauuuuaaguucaaaaccuagcucugugacuaaccugcuguguaaccuugggcaggcuccaucuuuuggggacuucaguuucugaacugugaaacaaggagcauagaccugaugaugucuaagcuuccucuaccuguaacucucuggaaucccacuuguacagaauuauccucaaugggguuauauagccauugucgagguacuguuuauugcccagcuuagcuuuuaaaaauaauagucucuagcagagauaaucuguuccaccacuagcucuaguuuagugauguuacuuaaauguaauuuccaguguuaggaaugaguuugucuugaacuguaguuucaagaaauguaauuuccaguguaggaaugaguuugucuugauuccucucccauacccgaucuuuguaaccuucuuauacacacacacacauauuacuguacaguaguuaaugcauacacccucaugaucaucuucugaucuaggauauaugauagauugauaugucaagccaacuggcagaccaagauaucagcccugacuuuagauguaaucuuaaauuuggugcugauauacucugccuaccuggcugcuuuuugcugaauuucuguguuucaguccccuugacugaagcacauaucacgaagccuacacaugcugaaaugaagagccacaaaaauugaucuucuaucaaaaucaccaugagcacaguuuaugauaugauguaaaaaaaaaaaaagucaaagaaucuuuugguuuuacacaaagaguauaugcuguucauuggcuaaggcuaugugggaaauuaccacaaaacaaucuuacaauccuaaaggcuaauggcugagaugaagauagcaguaagguuaguuucuucugagguuucccuuauugguuugcagaugguuaccuuguuccauuuucaugugaucuuucuuuuuugagugaauacuccuuauguuuguguuucugagaacacaugccauacugaauuuagguccacauuaucagcccugacacacugcuugguacuaaggcuuaacccuuuaauauauacgaauuaaggcagacaauucagccugcaaaaugcauuacacuaugaaauauuggagcuagacuuuagaguuugcuuacuuuuauuuuacaagccauaaagauuaagguggaggacaguuaagaccuauccuaaggcaagucagaugaaauuagugguagaggcaggcccagaaaucagaucucuaaguucuuguccuucccagcauaccaugcuggcacaucauuucaucucacuuauucacaccuuaaauaucccacgcacuugcccuugcuuguucaccacugacuauucggaauaacuuuggcaaaaguaggaacucauaugcuuuuaaaacuauguuuaauuuuucuuauacuuauuuagcuucaccacuuauauuuuaaaagaaaaaauugagguuuucaacuuaauugcuuucccucuuucuuuuaauacauauuuuuuucauugaaaauaauagcaauuuuuuccgaaggugaaugaacucgacuuugucaaaacugacaguggauuaaaagagaagcaaccucagcuuuuaaaaaaauaaaucaccuuucagaucugaaguagcaaaauaugauuaggacaaaccuuugccccccaccuuccccugucuucuuuccguagagcaggaauucagagcuucuagaaaccuugaugugcacucuuccaccuacagacaguaaauaucaggauggaacuggugggguaaaauggccugucuuuggccagagguauuuaagcucagaccuuggaaucuaaaaggaaauucaaaaugcaaaugcuuccugucuucacuuguaaaucuucuguacuuuuuuuuuaaaaaaaaaacugaaauaucaagagagaaaaaugaaaaaaaauugaguuauacagacagguaaaaggucugauaguucaaaagauuuaucaaaaucaaguguacucuuccauuuaauccucgaggaguuugcuuuuacuuaacuacuggcagagcuauuucuucucaacagcaguuaguuacugcaguggaccauagaaugcuuaauucgaucaucccuaaauccucacuuauuugcaucuugagagggagagggguguuuaaugacaaaaagcuuuucuucagcugaguuccugaguaacauggccccaaggcugcccucucagguugucauccacuguggagauuagagagagacacauuuguaccuccuguguauugugucagagccccacccuuacucaggucagucagcaacccuaggaaguacaaaaauauauacagcugugccuuugagguagaaaagacauucaaaauucaaaacacuucuaucaagcagacucucaauaauuuucacuccauaugagauacaaauauagauuaaauuagacugauaugauuuuauacuggucuugaacaggggggaaaaaucaguacagaaucauauaauucuauuugaaguugagauaauaaagcaauaauuucuuuauuaaacuauaaaguuuuaugcuguguguauguuaguaacuuuguuucuauuuaguaauucauuugaacacaguuucuuuggccugacaaauauucuaauguacuaucagaauuucuuucugacuuauaaaauaguuuauguaauuuuucuaauuagguuuuauugucaccugggaaaggagaaccucaacugaagaguugccugaucggauuggccuaaggacgcaucuguggggcuucuucuugcuugcuaauugauguaagaggguccagaacacuaagggcaguacccucccuaggcugaugcaaguggucuauaccucagaaagguugaaugugaaccuauuauugagccagccagcaagugcuguuucuccaugguuucugcuuugaguucuggcuugaguuccugcccagacuuugcucaguaaugggcagugugaccugaaggugaagagcuaaauaaauucuuuccuccccucaguaacuuuuuuaucagugcuuuaucgcaccaacauaaagaacacuagaacaguaguuaaacaauuuaauggaaauaaaauuaagguugcaauggcugugccuauugagcuuauucccuccauucucucuccauuugcauuuuaagcagucagguggcgggcaucaccauauucuuuauguucccagaguuagguaauuaguagacacuuaaaugcuuguaaagccucuugcuuugcuuucuugucucugugcauuuacuaaggcuuuuggcagauauuuguacuccuuuaaguugguggcugccacucuuacaaugauuuuuaaguguuucuugaauaugauuuuacauguaaagaagagcuguugugucauaagaauagagcuguugagcucugcuugaugugucuuuccuuaaaugugagauccuagcauccaaaagcgccugagaggaauauauuauaagaagauaugugcaaaucacuugcauucuucuguagcucaucauaggaauagaacuauuucagugaggaacacaguaagaauauaucuaauagguuacacaugcugugauggucucaucaaauggucccugcuaaucauaccagucgcugauugccaucccuuggguuaccauugaaaacacucuuccauuguuugguaaugaacagucccuaaucucacugcugauuucagguaagugugccagacuugagauaucaucaaaaguauaucauuugucauagcguguuuuagaauucuaaaagaccauggcaaauaggaaggagaccaagauucuucucuuucguuuaauuuuuuuuuuuuuuaaagaauagucuguaucucagucuggccucagauucacuguuuugucaaaaauaaccuugaacuccugaucuuccugcccuaacucucaagugcuggcauuaucgaaguaugccauugugacuggccaagagaucauauuuuuuucugauuauuagaaauucaauuuguuacaauauauguguuagcuauuuacauauacaguuaguagguauauagagaauaaauaucaugauauggucaaauauguuguauauaguauauauuauauguauguguauaguugguuaacuguuccuacaugcuuucugcaauaauuuucuacaaauauauaacuauauacauauauaaauauauauagcuauacaaauauauaaacauacaaauuaauacauucucuaaaaacaucuuacauacauccucucuuuuaacuuuuaauccuuaaagaaucucuguaaguaacaaaaaaaaaguaaggcuaagagauaucauauauccuacaagguuucagagccaggaagcaguugauccugggccauuuuucuaaguucuuacucuacuauuuugccuguaugccacagcuaucauuauuacagagauaaugugcuaaaauagagccagaccuccuguauuugaaacacagcuauuuugcuuccugguaguguuauuucugacaauuuuaagcaucucugugccaaaaguuucucaccugaaaaauagggacaauaagaguaccuaccccauaguguuauuguaaagcuuaaauaaguagauuuauaggaggcauuuugaacagugccuugaguaguuagcauucucuuaguguuugcugcuauuuuuguguuaucuuuauuauucuuauuaugaucagcagcagcauuauugcauagcauggcagcuaaaauucacagucauuaugcacagacuaccuucauuuaaauccaaauuccauuaauuaugucaacuugcacaaauuucuuugauuuccccaugccucggugucaucacaaauauaucagauacuaaccacauaaagcuagagcugcugugaguuugaaucugugaaagauucugauguacagaauccccauuugccuuuuuccugcugucuugccugcaaacucagagcuacgaggugucgcuauggcaguuauauauuguaugugucauauguaacucaucaguccucuguagucuaaucacagaagccagugguuuaguugucauggcaguccuuugguaggaauguauuugucauauaaaaguuauuuuggucaaucaguaugguauggugaaaugaacauuugcuggagauucaguucuauugcuaagucguuuuacaagugaaauuccagagcgugaagaaaucacuuagaaagaguaagaaauaauaacuuucuagucaugccuguuuuuucugugaagaguggugcuauauuuuccagcauauaauaguuugaguuuauauuagacaaugugauaacugugcuuggggaaaaacauuccaaguuugauguuuuuccuccacaauuauauuagaaauuaauuagaaaaugggacacacuuagcaguuacuucagaaaugacuugguaggcucuguucauuaaauacuacuaauugggauacuauggauauauucauaggcaacaccucaguuuaugaagugauuuuauuccaaaagauucuaggcuauuuaauuuguuagaguuuccuguacaaacuauguuauuauugugaggaagugcccagguuagcucacaaccuguuauaagacuuguaugugcaguuuacauaagaaugcugcucgguguuaguaauuaaagcaaaaaaauauaauugagcagaaaauaacaccuggaugcuaaaauguaagaacaguagaauuaauuacagguugaggagagagacggcagauucaagagggucuuucugaagagcacuucuagccacuuugagaggacauuagguguugauggcccaggauuuuuuggucuaauuucaguucgaaaaggauagcaaucucacuaacauugcucuuauaacugucagucauaauuauagucauuuaggguccacaaauagaacaaaaggaccgauagaguucuugaagauacuggacaagagaaaggggaagaacaaaagggugaucuggguccaugagaugacauacaauaggguaagguagaauuagccccagcaaaugaugaaagaagagaaauggagagcucagcuuuuaugcaggauccugguaaaaaacaaagacgggaacauuuccauaauaccugagcaccugcuuaacuuuuauucucauucucucgucucugcuaggcuggcucuuaaagggcaaaaugauuucuuauucaucccucugcugccaacaauagugaguacauaaguguugaauauacuagaugcuaaaugaaaucagauuucaucucacaagugaauuuuuuugcuuguaucugaucagagcuuuaaaaaucugcaaaauuaugccuuugaucagaaugagguucauaguuuuagaauuuaccauaauugaacucagaguuuggaauugugguauugcaaauggagaacugagaauccagucacagguuguugauuugaugaccagcaaagucccuucugccuauuucauagguuacagcucuucugacuccauaucucuccuugaagauaucugaccaaaguaauuuguaacacucugcacauagacucccugauugacaaaacucucugacugcuauaacuucucacaacauccugucacacacaaaaaggugauggggaguuugacuguugauucuuucucuuccucacuauuuuuuuuucuguuugaccccuucccugaugcauuccugcuggagacaaaaccacaugcugaaccaugaggaacagaccgcagugaaacaacaagcugcucccaauuuuaaauauugcguguuggggcaaaggcagaguuccuuuuacucuaaagcuauaacauuaaaaaaauucuguuugauauucagaguuauuugaucuggcaguuuaacaacuguugauguuuuaauugcuucuuuaaaggauuucaucuacauuuuaagcuuuauuuuuauuuuacucugaaggaaugucaauauuagccaucacuuugcccaguaacuuaccacugcaagaucuuggaguaaaauccaguaauuacuggcgcugguaacuuaagacccugcugagaaguuuggcaguuucccuucuccugaggaggcucucuucccauggagcuagcaaucuuuuauuguucugaaucaauuuuaagcaaguguuguaccuucaagaucagcuuucuauguuccucuagaagagauugaggucacucuauucugagugaaagagaaaucuuagguuacucuuaacauggacaaauguacaauuguaagauguguuaacaugaaugacuuagagauuuuauaaucccuugggggucuuaguucauuuuuauuugucuauuuguuagucuacuuccaggaccaaauagaaugcuuaauuggcaugcuacuuacaugcauguaacuauccauuuaaauccucugaacaaaacuacuaacauucaaagugcuuuagagaugaaagugcccucugagaucaucugguccagccucuucuaaaugcuuuagcuuguauucauuaauaauaauaauaauaauaauaauaauaauaauaaaaagaugcuugcuuucagaccucauuagaugaguuucuuuguguaauggguugugauuaacucagaagcucacaacugguugaagugcauaguauaaugucuguggagugcucaguuacaaauaaggcaucuguaucacauccaaugcacaaggcucagggaccaucuaggaaaacagggaagaaagauucuaagagcagguuugagaggagcugagcaaaacaauguguucuguacaugacaacugcacucaugaacucacagcaacagugguuggccgguaaaagaccugcacaaaaucaagccagucaacauuccagcaugaaugaaauagacauuucaugagcuaccacuagcuggggagcuauggacuguuaaaugcuucuaggagaaggagagucuauuuuauuuaaggguaugauggcuucuaguauuccaaccauucuucagugaaugaccccauacccaagaguauguaggucaauagauuauuuauaaaaagaauaugaacuugggggcauaagaagguaguggucggucuggaaagugccgagggggaaguuugaggaagaauaugaucaacauugugugaaauucucaaaguauuaauaaaaauauuugaaaagaaagcacagaaaauaaagaaguaugcuagagcucacauucucaucuauuugcaucuauaugucauuugaauuauuuacaccaagaaauauuuauaaaaugcuuacaauauugaacccagucugaagcaauacuuagaguuugagagcuuacacacuaaaaugagaagcacugacaggccacauuuagagaauuauauucucucuucugaagcuucuuuauacucucuguccaacacacacacacacacaugugcgcgcgcgcacacacacacacacaaacacagaggggggaugacguugaggccauagaaacuaaucuccaaaccaguugcuuuucuucaugaagcagcacugcucuauaagacuuccuuuuucaggaauacuucauccuuaucaaggauaaucaaaaguuaauuuaaaggaccagccaacugguugaugggggcaggaaccccuggcuaggauauauggaaagcaguauacuuaaacaugagguauauuauucagucauauuauccuuuucugccuauacucuaucuccucaacacagaaaacaacuauaugacuuugugcuuagaaacauaaugccuaaguuuucauacuuacauaucauucucaaccacccuuuugggaaagugggaucaaauacuaguuuaaguaauauuuacaagucagaagcuuccaaaaggaucucuugacuuucuacugcuucuuucugguaucacuucaauagccuuaaaaggccaacuuuugugggugaugauaugauuuuaagucuuggcauccuuuccugauagacaucucucaaucuuugaaaaguuuaaauauuacucugugaagaauuuugaaauauaaauuaugguaguuaaaaaaaauuuacauggagcuggagagauggcucaccacuuaaaaucacuggcuguucuuccaaaggacccagguucaauucccagcacccacauggugucucauaaccaucuuuaacuccaacccuaguggaucugaugcccccuuuuguccuccauaggcacugcacacuugcagugcacagacauaccugcagguaaaauacccaucuguacuggcugauuuugugugucaacuugacacaggcuggaguuaucacagagaaaggagcuucaguuggggaaaugccuccaugagauccagcugugggacauuucucaauuagugaucaaggugggagguccccuuguggguggugccaucucugggaugguagucuuggguucuauaagagagcaagccgagcaggggaagcaauccaguaaggaacaucccuccauggccucugcaucagcuccugcuuucugaccugcuugaguuccaguccuaacuuccuuuggugauaagcagcaauguggaaguguaagcugaaaaaaaacccuuuccuccccaacuugcuucuuggucaugauguuugugcaggaauagaaacccuaagacaccauccauguaaauaauaaaugaaaauuuacaaauauaaaaauauaacaaaugaaaauguauacacauauagcauaauauuaaaacuuaauauuuucuuggauugcuuuuucugagucuauugauguagaucuaaccuucucugccuaagauuucaguuuuuguuucugcuugauuucuguagaucauaagcuugauagaagaggagacuacccugucuauuuuaauuuuuacuaauaagucuuuauuauuaucucauauaccaaaaauaguacuuagcaauaauuggcauucaauauuuuauuuauccauccauuuguuaauuuuugagucguuuucucacuauguaguccaggguugucucaaacucuaacuccauccuccacuucucaagcccuugaauuguaggaguguacuaccaugcucauuuuaauacuuagcuuuagacuggucuauagucuuagccucaucccauguuuaugucuaucuuugcucugauuagaugccucuaucugaacucuggguauuuauugauaaaucacaagauugugggcauuuauguuugauaucaaguauaucugguauuuucccaaauuccuuucuauuucuggagacauuucucugauuaccuacucuugaaacucuuuaaguguucucuuuucacacuagauuucucuccuaaucgcuucucagacuuuuggcaaagaucuaguguagauuucucuccuaaccaauuccuacccuucauuucugacuccuauuccuuuaucuauuguucccuguuuaaccuagguugcauuuugguucaaagcauuuuauauauuaccauccagucaugucugucucuuguuugauauucuauaaagaacaaacuagcauuuauguuuuauuuguguaauaaaauacaacuccuuucuaccugcaauuuauaagcaguaaaaaggaucuucaaaaacaaagacaaaaaguagcugaguaauuguuuuuuaaaaauaauuuuaaaaucauaacauugagauaauagugugaaaggacuuccuaaaguuaaauuuguaaguuucuacguaucuucuucauuucccuacauauauauugcacuuacauaucuaccauuugaauuggauuuugugaagcuuuugauuugggaguuaugucauaacuaugacuuauagaaugucuuuguauuauuaccuccugagagcugggauuauggcauauaguacagucauucugucucuauucccaaucaccaguguaaauugauagcaguaccaugaacucagguauacuggcaaacaugcaaacacacacacacacacacacacacacacacacacacacaucacaguauaaguucuacaauaugccuuaaaaauacaucacuucuuagccuuuuggcuaagauaaaguauaaaaauauuuauagcuaaaagcaaucucuuuccuauuuccaugcauagcuuagaucagagaaaauuucaacuaaguagauggcaaaguuagaauuguugccuugaugacaauuucauuucucagcauguagaauaauucaagcaaguaauugcuacugugauaauaauuccaaacgugaagaauaacuauuuggugaaacaguggugauaagaaccuuggagaaagaagaugugcaucuuagaguuuguaaugacagaagugguauugaugaccauucauccuuacagaaaugugauucacgauuugacugaaauauagcuuuuucauccugcuacugaaaucaugaagucuuucagaacugaacaauucuaauuucuggacaauagacaaggaaaagaacugucuaaaauagucaaauucaaccuuucuuaugucccaguacaccagaagggauaugacauauaucacuccagaaagugcaugagcacacaucacaauuuucagagaagcauauauaauuuaaaaauccacccaaaagggcauucucaauucccuaacccccucacaaagacauaauuuaucugugggacugcacaguacauucuucaauauguccauaugugacaugauacaaagaguacacaaaucuaguuuuaguaaagaacauaauucuaagaauagugucacagagguuaaagccuuucgaaaaugcuaaggaccucugaauguaugcauaauaaauagaacuaaaaauaguucucuuuaaagcaagaaaaagaaagaucuggucccacuuggcauccuguugaaagugacagcuggcaguacuaguugcccagaccucuaucaaugagaaugguauccaaguagaaaggcauggauaaaauaauuaagaaagaaauugaagcucaaaguuaguaaaaaguaugaaaauguauauauucuuuuuugagucucuaagaccagacaaacuagaguagagcuaaggguacagaaagaggcuguaaucacaaaaccacuacaaugugaccauccuuaauaugaaaauaugaaauauacaggagcauuggcauaaaccuauaauccuagcacuugaaagacugaggccagaggaucacaaguuuaagaccauucaggucuacagaauaagaccccuaccaccaaauauagauagguagguaaguggauggauggauggaugaauaaacauacagacacagacagacagacacaugagaaauagauacauauauuugaaaugcaaacugcacuggaugcuaaacuauuugaaacccaacaugauacuacaaguggaaaauucuguauucaaccuuaugagacagauuacaauaaaaacuggcauauuuaaaauguauuacauuucuuucagguaguuauacaugaaagaaaugaacuuuauauuuagacuuaaguacaaaucccaggauaucuuauaugaauauacaaauacacuuaauuuaaaaaaaauccuagauuugaaacuuuuaugaccacuguaauuucaaauaaggaguauuuaaccaguacuccagauuauaagaaauuauauuaagaauaaucuccaaaagacaagaauaaacaaauuauuuuuucucaaacugagaggcuuggagugauuuggaaauacuguguaucucuaaauugggcaacuacuaucaggaaaauucuaaaaguauuguuucagggaaauacuuuaugauguagccagugaagaaaauguuugacaccagaaccuucaaguucauucucugaggauaagucacuaaggaaaguauagauuuuuggguuuuguuuguuuaguuugucgguugguuuuuuuguuguuguuuuuguuuuuguuuuguuuuguuuuugagacaggguuucucuguguagcccuggcugucuuuuaacucacucuguagacuaggcuggccuagaacucacugagaaaugugccugccucuacuuucugaguggugggauuaaagaaugcacccccaccacuggcugaugcaucauuuuuugauaggguuacuaaauuagacauaaaaagagaccaugaggaaauucugauccuucaggggugcacgcuagagcagguugagcugcauucgcuguaaccuagagggaguauccaguggauuacuguagagcauugugcugcuuaaaauucccaccaauaacuuggacaaaaguauugaagauuugcauauugaauauuuagaucauagaaagccauaaauaauuacauauuugaaaauugguauauauaagaaaaauuagaaugagauaauauuugagaauaagaggaagaagccaagagaagaaguuguuuguuuguuuuuuuuuuuuuuuuaguguagaacaaauuucugauaggguuugacaguuuaauauuuaauauuacagugguaugucugauaugauaaugaguacccucauuuccaguagauggauuuaaacugaaauuagaugaccaacucucagacugauuguuaauguaacucacuagguagaaaaguuuaggaaacugaguucuaagaucucuuccaguuaugagaugguacaauauucccuguacaggcuguuuugacaauagcuauuucuaucauucauuucaaaaacuaaaauucaguaauuccaaaugucacaccacagauacuucauucaaauccaacccaauggugauauuuacauuuuuguguggaagggguauguccuccuuggucuugcaaauaucagacaaauuucuaccacugggcuauacccucagcccccauauauacucugcauggaaagcuccccugugugguuacuuucuucucucauucuccucugcuuccaaauaucuaaaaaggguucauuaaauuaguaguagaccuuuugugguagaguucuacuuguuuaugucucuguacaaaacauuaucccugccaucagaguaaacaauaaauagacuuauucuuuuguuuuguauauguauauuucaaaaauaaacaucauaaucauguuuuuuaaaaagucaguguuuccuuuguagaagcaguauaggcuccauuuccacaucuagccaguggaacacucugucuuuuagaaguauggggcacuguuuuauaauuuaggguguuuucugaaagaagucuaguauucuguauuaaacuacuguggauuuaucauuuaucuaugaauguacaugaauuucuuagacuuucuuuccuauuuguguaucuagucuaauuaauuucuaaacaugguguugaaaauauacccagaaagcuagguaaaguaaaauauaguuucuucagcacaaagguuugucacuguugcuuaucucuuuuaacaauuaucaggccccuauuauugugcuagacaguuucauaguugucugaucuuuuccaaaaauaucugugaaguaagcaagcaauacucauagauuuuaacuucaguuuucaacaguauaagcaugcaugcauguauguaagaauuacccuuagauauuugcuaaucauuuuucaacuuccugcuaauugucuuauguucuuacuauuuucagcagugaguuucauuucacaagaaacaaaaagucuguugccuuuuuucagggaccuuuccaaaugaugccuuagcaaagucuucauagaauggauuauaguguucuucgguauugcugaguuaaauggccuagucggccaucacuggaaagagagguccauuggacacacgaacuguauaugccccaguacaggggaaugccagggccaaaaaaaaugggaaugaguggguagggaaguguggggaaggguauggggaacuuuugggauagcauuggaaauguaauugaggaaaauauguaauaaaaaaaagcagaaggugagaguuuaauaaauuccuauuauucucuuccuuaauaugguaccuuauucauucauaaggaaguuuaacauuuucuucuguuucauuagguauauuuuuuuuagauuuuuuugcuuuaaaauguuaugauucugaguuguaguagauuuaaaacagcauuacaacaguugcaugucugugugcaagugauuuugugaguaccuagugugcuagucauucuggugggagagggaacaaaacagacauaguucucacccugcuagaacacuucugauguacgggcaaagucccucauguaaucagcaauaauacaaugacaaguucauauauauaugugugugccaaagauaaccuuuuuagggcacuuuagagaaaagaagacucuaaaaugaaggcauacauuccaaucccacuucuaauuucuuucuauggcuuccuugucacugauucucccuagcuucuuuucucucucucacacacacaaaaugaacauguugugcaagacugcuuucaacuucuucccuagucaguuaaauacucagucucaccagugauacauagguacaggcuuuuaagacagauacauggauucacucccugcaucgcaaguccaauuuguauaauauguaaaugaauauuucagaucuuggguaagaaauugaucauuuuuauuuuuuaaauauuuauuuuacuuaugugugaguguguaucaugcuaguugccuuuaaucccagcauuuggcaggcagaggcaggcaauguuugugaguuugaggcuagccuagucuagauagcaaguuccagacuacccagggcuacauaaugagaccuugucucaaaaaauaaaauauaagucaauuaauaaguuuaaauuaauaaaacuuuaaaauaaaaauggagccaggcggugguggcgcacgccuuuaaucccagcacuugggaggcagaggagaccagccuggucuacaaagugaguuccaggacagccagggcuacacagagaaacccugucuugaaaaaaaaaaaacaaaacaaaauaaaauaaaauaaaacaaaauaaaauaaaaauggggccuuugagauugcugagugguuaagcauacauacugcucuugcagaggaccugagcacaauuccaggcaccuauguccaguagcuuacaacugcuguaacaccagcuccaagauaccugauguccuuuggucuccauggacacuuguauuaaugugcacuacuccuaaaugauuggauuaaagcauuuaccacgauauuugggcugauaaaagaauuauaugagggcaaauaugcaaccuugguauuagaagaagacaccauuuuccauuuguauuaagguaaaauaagcaauuuauaauaauucuuuuaauaaaacauacuuauaaaauacaauuuaaaauuugccaauuguuaauaaaaacaaauaauuuucuaccuuugcauauaccuuuugacauuaccagcauuagaacucuuuggcuuuaguggaugcuuucauuguaaaguuuuaagaagcauuucauaaaagucccuacuaaggugcauaguacauaacgggacuucaguagaugguaguccguauuaucaguauagcucucagaaguguucacugcuuauaacuuccaaucuugagcuuauagacaccuuugauuuuaaaauuguuuuccugguuguaccucuucauuaauucauuuccauguugaagcaaccuuugguaugugacuguggaaaaaaagagaaaacucccuagaacccaaauaaauugugcauccauugauuuuuccacuggcuacaucuuuaccuccuuaacgagcuccuacaaauuuaaucagaaugauuucuacuuuuaaaauguguugcuacuucccacugaguuauuaccuuguagacauuuguucuuagagauuacaguguuuaaacuccaaagaacauuucuaaagcacagcaaccuaagugagguccaaaugcuaguguauggcauuucuaggcagaguuaucaaagauuaaauaggauccauaggucagugccaaacuuucccuuaucugcugcucucauuuucauaagccccuugccagaagacaaaauaaucuaauuccauuucuccucuggucaaguaauaacacauuuagucuauuuuguguuaauaacauauuaauccaaguuuccauauauuucagcauuucaauuuucuuuugucaugaaauaagggcuuacuauguacacaggcuaguccugaacuugcuauauagccuagcauuacucagaaauuucacuguuccuaucuuauccucucuucugcuuugauuauagauaugcaacaccaaacccagguaaauuuuaaacgaugguauuauuuuaauuguauauauuuaaggcaaugacaggauuucauauaccuuacauuuuacuaaaagaucuuaagcccaugugacaugguggcauaugcuucuuaucccauaguuugagagacagaagcagaaggaccagaaguucaaggccagccagccuaacuucauaaucaguguguagccugggcugcauacuauuuaucucaaucaaaaugccaaugccauccuucacagaaauagaaaagauagacuugcccuuucggucggcaccagcaccaggucaccuugggcacagagucagcgcauaaccccaagguccccuagaggacucuccaugccgucuuaggaccacuggugaguggaacacaacuucuguuccaauccaaucgcgcaggaccagagacagcauuagggaagcagaaaacccggccugacuagggucacaaagucccuuccugugggcgccagcaccgggucaccuuuggugcagagucagcagacacccccaagcuccccuagaagacuuuccacgugaucuuuggaccacugaugaguggaacacaacuucuguuccaauccaaucacgcaggaccugagacaacacuagggaagcagaaaaccgagccugaccaggguccaaaucccuuccgguaagcgacagcaccgggacaccuugggugcugagucgguggagaacccuaaggucccuagaggacucuccacgcgaucuuaggaccucuggugaguggaacacaacuucuguuccaauccaaucgcuugggaccuaagacagcacuagagaagcaauaaacccggcaugaccagggucacaagucccuuucguucagcaccagcaccaguucacaugggcaaagagucaguggacacccccaagguccccagaggacagcuucugaggcauaccccguuucgggauccagacauucgggcaccuucccugccagaggagagguguccacccugcccgggagagcuuugccagagcaccugguggagccaucauggcucccgaaucccgcugagaguagucugcacaggugagagugaggacuacagaagcuaacagcuucugggacaggccagagugacacagcuucuggacacauccuauuucgggccuucaucuucugcuaggagucaggucugaaugccagauaucuuugcaccuucccuguaagaggagagcuugccugcagagagugcacugaccacugaaacucagaggagagagcuagucucccaggucugaugauagaggcuaacagaaucaccagaggaacaaucucuaaccagagaccacuauaacaacuaacuccagagauuaccagauggugaaaggcaaacauaaaaaucuuacuaacagagaccaagaccacucaccaucaucagaacgcagcacccccaccuugcccaguccugggcaccccaacacacccgaaaagguagacccggauuuaaaagcauaacucaugaugaugguagaggacaucaagaaggacuuuaauaaauaacuuaaagaaauacaggagaacacuguuaaacagguagaagaccuuaaagaggaagcacaaaaauuccuuaaagaauugcaggaaaacacaaccaaagagguaauguaauugaauaaaaauguccaagaccuaaaaagggaaguagacacaauaaagaaaacccaaagugacgcaacacugaagauagaaacccuaggaaagaaauuuggaaccauagaugcaagcaucagcaacaggauacaagagauggaagagagaaucucaggugcagaagauuccauagagaacaucugcacaacaaucaaagaaaauggaaaaugcaaaaagauccuaacucaaaacauccaggaaauccuggacacaaugagaagaccaaaccuacggauaauaggaguagaugagaaugaagauuuucaacucaaagggccagcaaauaucuucaacaaaauuauagaagaaaacuucccaaaccuaaagaaagagaugcccaugaacauacaaaaagccuacagaacuccaaauacacugaaccagaaaagaaauuccucccgacacauaauaaucagaacaacaaaugaucuaaauaaagauagaauauuaaaagcaguaagggaaaaaggucaaguaacauauaaaggcaagccuaccagaauuacaccagauuuuucaccagagacuauguaugacagacaagccuggacagauguuauauagacacuaagagaaaacauaugacaucccaggcuacuauacccagccaaacuuuuaauuaccuuagauggagaaacaaaaguauuccacaacagaaccgaauucacacauuaucuuuccaagaaucccacccuucaaaagauaauaacagaaaaaaaccaauacaaggauggaaaccacaaccuagaaaaagcaagaagguaaucccucaacaaaccuaaaagaagacagccacaaaaacagaaugccaacuuuaacaacaaaaauaauuggaaacaacaauuacuuuuccuuaauaucucuuaauaucaauggacucaacuccccaauaaagagacguagacuaacagacugccuacacaaacaggaccaaacauuuuacugcuuacaggaaacccaucucagggaaaaagauagacacuaccucagaaugaaaggcuggaaaacaauuuuccaagcaaauggucugaagaaacaagcuggaguagccauucuaauaucggauaaaaucgacuuccaacccaaagucaucaaaaaagauaaggaggggcacuucaugcucaucaaagguaaaaucuuccaagaggaacucucaauucucaguaucuaugcuccaaauacaagggcagccacauucaauaaagaaacuuuaguaaagcucaaagcacacguugcaccucacacaauaauauugggagacuucaacacaccacuuucaccaauggacaaaucauggaaacagaaacuaaacagggacacagugaaacuaacagaaguuaugaaacaaauggaucuaacagauaucuacagaacauuuuauccuaaaacaaaaggauauaccuucuucucagcaccucaugguaccuuccccaaaauugaccacauacuuggucacaaaacaagccucaacauauacaaaaauauugaaaauuuucccaugcauccuaucagaucaccauggacuaaggcuaauguucaauaacaaaauaaauaauagaaagacaacauucacguggaaacugaacaacacucuucucaaugauaccuuggucaaggaaggaauaaagaaagaaauuaaagacuuuuuagaguuuaaugaaaaugaagccacaacauacccaaaccuaugggacacaaugaaagcauuucuaagagggaaacucauagcucugagugccuccaaaaagaaacuagagagagcacacacuagcaguuugacaacacaucuaaaagcucuagaaaaaaaggaagaaaauucacccaagagaaguagacagcaggaaauaaucaaacucagggacgaaaucaaccaaguggaaacaagaaauauucaaagaaucaaccaaagaggaacugguucuuugagaaaaucaacaagauagauaaacccuuagccuggcucacuagaaggaacagggacagcauccuaauuaacaaaaucagaaaugaaaagggagacauaacaaccgauccugaagaaauccaaaacaccgucagauccuucuacaaaagacuauacucaacaaaacuggaaaaccuggaugaaauggacaaauuucuagacagauaccagguaccaaaguuaaaucaggaucagguuauugaucgaaacaguccuauauccccuaaagaaauagaagcagucauuaauagucucccaaccaaaaaaagcccaggaccagauggguuuagugcagaguucuaucacaccuucaaagaagaucuaauucaaguucuucacaacuauuccacaaaauagaagcagaagguacucuacccaauucauuauaugaagccacaauuacucugauaccuaaaccagagaaagacccaacaaagauagagaacuucagaucaauuucccuuaugauaucaaugcaaaaauacuuaauaaaauucucauuaaccgaauccaagaacacaucaaaacaaucauccauccuaaccaaguagguuucauuccagggaugcagggauuguuuaauauauggaaauccaucaacguaauccauuauauaaacaaacucaaagacaaaauccacaugaucaucucguuagauguagagaaagcauuugacaaaauccaaugcccauucaugauaaaagucuuggaaaaucaagaauucaaggcccauaccuacauaugauaaaagcaaucuacagcaaaccaguagccaacaccaaaguaaauggugagaagcuggacgcaaucccacuaaaaucagggacuagacaaggcugcccacuuucuccauaccuauucaacauaguauuugaaguccuagccagagcaauucaacaacaaaagaucaaggggauacaaauuggaaaggaagaagucaaaauaucacuauuugcagaugauaugauaguguauauaagugacccuaaaaauuccaccagagaacuccuaaaccugauaaacagcuucagugaaguagcuggauauaaaauuaacucaaacaagccaauggccuuucucuacacaaaggauaaacaggcugagaaagaaauuagggaaacaacacccuucacaauagucacaaauaauauaaaauacuuuggcgugccucuaacuaaggaagugaaagaucuguaugauaagaacuucaagucucugaagaaagaaauuaaagaagaucucagaagauggaaagaucucccauguucauugauuggcaggaucaauauaguaaaaauggcuaucuugccaaaagcaaucuauagauucaaugcaguccccaucaaaauuccaacucaauucuucaaugaauuagaaugggcaaucugcaaauucaucuggaauaacaaaaaaccuaggauagcaaaaacucuucucaaggauaaaagaaccucugguggaaucaccaugccugaccuaaagcuuuacuacagagcaauugugauaaaacugcaugguauugguauagugacauacaaguagacaaauggaauagaauugaagacccagaaaugaacccacacaccuauggucacuugaucuuugacaagggagcuaaaacuauccagugggaaaaagacagcauuuucaacaaauggugcuggcacaacuggugguuaucauguagaagaaugugaauugauccauuccuaucuccuuguacuaaggucaaaucuaaguggaucaaggcacuccacauaaaaccagagacagugaaauuuauugaggagaaaguggagaaaagccucgaagauauggguacaggggaaaauuccugaauagaacagcaauggcuugugcuguaagaucaagaauugacaaaugggaccucauaaaauugcaaagcuucuguaaggcaaaagacaccgucaauaagacaaaagggccuccaacagauugggaaaguaucuuuaccuauccuaaaucagauaggggacuaauauccaauauauauaaagaacucuagaagggagacuccagaaaaucaaauaacuccacuaaaaaauggggcucagagcuaaacgaagaauucucacuugaagaauaccgaauggccgagaagcaccugaaaaaauguucagcauccuuaaucaucagagaaaugcaaaucaaagcaacccugagaucccaccucauaccagucagaauggcuaagaucaaaaacucaguugacagcagaugcuggcaaguauguguagaaagaggaacacucuuccauuguuggugggauugcaagcauacagccacucugggaaucagucuggagguuccucagaaaauucaaccuaguacuacuggaggauccagcaauaccucuccugggcauauauccagaagauguucuaacggguaagaaggacacaugcuccacuauguucauagcagccuuauuuauuauagccagaagcuggaaagaacccagaugccccucaacagaggaauggauacagaaaaugugguacauuuacacaauggaguacuacucagcuauuaaaaagaaugaauuuaugaaauuccuagacaaauggauggaccuggagggcaucauccagagugagguaacccaaucacaaagaacucacaugauauauauucacugauaaguggauauuagcccagaaacuucgaauacccaagauacaauauacaagcugcaaaacacaugaaaguaaagaagaacgaagaccaccauguggacacuuugccccuucuuagaauuggaaacaaucacccauggaaggaguuacagagacaaaguuuggagcugagacgaaaggauggaccaucuagagacugccauacccggggauccaucccauaaucagcuuccaaacgcugacaccauugcauacacuagcaagauuuugcugaaaggacccagauauagcagucucuugggaggcuaugcucgggccuagcaaacacauaaguggaugcucacagucagcuauuggauggaucacagggcccccaauggaggagcuagagaaaguacccaaggagcuaaaggagucugcaacccuauaggugggacaacaacaacaauaugaacuaaccaguaccccagagcucauuuuucuagcugcauauguaucagaagaaggccuagucggccaucauuggaaagagaggcccauuggucuuucaaacuuuauaugccucaguacaggggaaagccagggccaagaagugggaguggguggguaggggagugggcggaggguauggaggacuuuugcaauagcauuggaauuguaaaugaaaaaaauaccuaauaaaaaacuuuucaaaaaaaagaaaagauagacuuaaaauucauauagaauuauaacagccaacgucaccauaaacaaaaagaauagugugggcaguaucaccauucuggcuuucaaauuauacugaaaagugacaguuucauaaucaugauggcacugaaauaaaacagacauauauaucaauggagaaauuauguugucuccaauaaaugguucuaggaaaacuauuuaucuacauauaaaauaaagaauauuuguggagugcaaauuggucuuuuugggguuuauuuuauaaauaguggguagaaaagguggugggugggacugcagagaguugagaaagguuaguggauaugaucaagauguugaauguaacuaugaagagacuaauaauuuuaaaauauugauagccucuacagagcacaauucugccuuccuguauuugcaacaaaacauaaauuuauaaaaauaauuuguaauaacgaugcaaauccuggaggugaacaugaacaucugcacacaaagcuuauagaauugccugaacgacaauguaaaaugcagcauuuugaaauaacaaugaaaauauauaaaaggaaaguuauaacaugguauacuuuuaaaauaaauacuuauuuacuaaaaaaauaagugaaggaaagaaggaaggaaggaaggaaggaaggaaggaaggaaggaaggaaggaaggaaggaaggaaggaaggaaggaaauagaaccaucucccucaccauacauaacaguucauuucaaacgaucaaagaccaacacuuuugacauaaaaucuguucugucuaaaagaaauucagggacaaagauggagcagagacugaaggaauggcugaccagugaguggcccaauuugagacccauuacaagggcaggcaccaaucccuaacauugcugaugguauagugugcuugcagacaaaagccuagcaugguuguccucugagaggcucuacccagcagcucacugagacagaugcagagacccacauccaaacauuagacugagguuggggacccguauggaacaguuaggggaaggauugaaggcccuggaggguauggcuaccccacaggaagaccaacaaugucaacuaacuaggguuccugggagcucccagaggcugagccaccaaccaaagagcauacaugggcuggucugaggcccccuguacauagguagcagacaggcagcucagccuucaugcgggucccccaacuggagcgggagcugucccuaaagcuguugccugucuguggaaccccgucuccuaaaugggcugccuuaucuggauucagugggaaagaaugcaccuaauccugcaauaacuggaugcacuagggugguggauacuggggaggggggaacccucccagaggaaaaggggagaggggaugggaagaauucuaugagaaggaguugggagggggcauuauuggaauguaaauuaauauaaauaauaaagaucugaaacuauuaagagaaaaaaguaaggaaaacauuuccaauuauaggcaaggacuucaguuacucaagaaauaaugccagcaguuaacaugugggacuucaugaaauuaaaaggcaaguaaaacaguuaauuuggugaagagguacccuagagaauggaauaaaccuuugccagcucuaaccuaucaaggucccaauauccaggguauacagauaacgaaaagacaaagcugagaaauuaaaugucccaaucaacaagugagguaaugaaauaagccaguaguucucaaaaaaugaaauacaaauggccaguauacugauaaaaaacguucagccucaucagccuuuagagaaauacaaguucaaacuacacugaguccaguucaugcugcucauauacuuacaaauuugaguuucugaugguuguggauuuuuuuuuuaaaaaugagaacacaaaguuggggauauggaauguggguggaucuggaaagaguuauaagagguggugaauaugaucaaaauauaacacaugaaauucccaaagaauuagcauuuuugagauuauaauuuaaucauaacauuuucucccuuaaauagucuuuuuaaaaacuacauuggugggcuagggagaugggucagccaucaaaaaaccuagaauacagagcccaucauaaucuauaucuuaugggcugcacuauaguaugcucucaauaaaugccuauuagacugaggcggggguaacugcauugagaccuaaucucaaccuacucaaaauggcaacuaucuuggucaguguucuauuacugugaagagaagacaugacuaugacaagucuuauaaaagaaagcauuuaauuggagcuuagugacaauuucagagguuugguccacugugaugucagggagcaugguggcaugcaggcagaaauguagcugagggguuuacaucuggauccuuaggcagcaggaggagagagacacugagacuggcuugggcuuuuuuguuuuguuuuguuuguuuuucaagacaggguuucucuguauagcccuggcuguccuggaacucacuuuguagaccaggcuggccucgaacucagaaaucugccugccucugccuccugagugcugggacaaaaggcgugugccaccacacccagcuggcuugggcuuuugaaaccccaaagccaaccugcagugacacgcuuucccaacaaggccagaccuccuaaucccuuucaaguagugccauuuccugaugacuaggcauucauaugagccuaugggggggggcauguuuauucaaaccuucacaaccacuauuaaggaaacaaauguuaauagaauuuagacaaaagagaaccuuuauacaguuuugguaggaauauaaacuaguccaacuacuaugugcagcacuauaguagucuuuaaaaaauuaggucuaccauauaacauaaauauaccaugcccuagauuuacccaaaggacucuuaagucaacaaaucacagagagucuugcauauuaauuuuuaaaugaaauccuauucaccauaguugagcuauggaaacaaccuagguauccauuaacagaagaauaaauaaagaaaacacacauauauacauguauaugcauauauauguauauuuauauguauauaugugagagagggagccuuaaaaaacaaucccuaucaaaauucuaacaccauucuucacagaaaaacuguauauacaaaguauauucacauuguaaauaaagaaugaaauuuuguaaggaaaaauugaugcaaauagagauaaccauauuaugcaaaauaagcuagugucagaaaugcaaauaucguguuuucucuuauuugugguuccuagauuuuauguagacauaaaaucauaauguacaaguagaagaaacaaugucuagggguacaaagaacuaaugggagcagagacaugggauggugcgauuauagaggaaauauguucaacaagcuauauauacuuauauaaaaugguccuuauguuaaaaaauguaccauguauaguaaauaaaauaauaaaaaccaggaaauuuuuaaauaaaaaaggauaaaaaauauuccagacuccugugcaagcaugaaauauauuucaagguucuccuuauuuuuucuguaaugucugugauuuauagacuucuauauaauguagguguuuaguuaguguuaacuggcuuuacacugucucauaucuguaaguacauuaaaaagggagcaaauaaguauuagcaaaaauauacaugaauggaaauuuaaguugauacaugauuguaaggaugaauuagcaccaaaaugacuaaauucccaauaucagaaguaaacuaauucauccuuucugcuaaaggaagcuggauuccuauugaaaaugaaaggcaauuugaacagucugcaaagauauaauuauucugccugggaaauaugagacccugcaucucuccugcaacccccaaaagaaagaaaaauaaaucacuauucugagauaacuugccuuucugugaagugacaguucuuuaagaaaugcauuuaccuacuuccuacaaagguaacaaccaagugaguuaauauccuuucagcuuugucaaaaccauuucuauaccccauguuaguuugugaaggcagucaaaucugguagcaaaauacugauuugaaaagaaaauuuccagaagaauuaaacauaugguucuuuccuaagcaacuggcuagauuaaaucuaaauaaauguauuuuuaacauauacuggaaacauuugugacugcuuaauaguggggacuguauuagauuuuguagugugacaggagcugaaacuugauaaauggacauugaugaaaacccauaacuggucaauaauuaaccauuuggaguucagaacaugggacagaaaaggcacuguugauuuauuauauuuuuguuccuucuacaaaagcccauuggguguauuuacaaacauguagacaccaaacauaaccaggaucacaccugggcuauacaccuucuccaaacucauuaacugaaaagauauagauuaauuggagggaguucagagaagaguaacagaaaugauuaaggggcaagagggauugauuuaugagcaaagaugaaaagaauuuugucuauacaauuuagcuaagugaugacuaagggagaaggggguggggacccaacugucugaaggauguaaacaccaacgaguaaagagaauaauuuacuaugcaacaugggaauauaaauagggcuaauaagcuguaauuacccaaaggaauaacagaauaaguaguucagggaagcuuagaaccaugagacugccaacuuauuucacaaggagacaccaacagacauuucuagucuuauccaaauuaacaaguauuucgugugaaauaaucauuuggugucacuaaguuuccucuuccucagccuugucaaugacugugccuuuucuaucacuacgauacaguucaagucuaguuuaccagaguucuacauaauuugcuuagcacuggugggucuuugagcguuuuauuccaguaguggccauguaagaacuucuccuuuuggaugagcacuccuuaaguacugugaacagagcuguaaaagcaccagaacaagggcucaaaccuggaggaggggaaaucuuggauucaauuuaggauuguaaacaagccagaauucagaguguuuauguuugggucuccaguauaauuuuucaaaauguagcucauguugagaaaaguucaauuuuagcauuauuggaaaaaaaaggggacacuaaaaauaaaucuuuguaagcuucaugauuuguguaaacuuuggaaugugguucuucaaaaaacaaguuggucuguggguuccugccggcuaaguuauuuggcuaauuccuagugugcuaucaugaugguccaaaagcauugcaucuaacugcuccagagaagauuuugcaugucgcugcagugaacgcagccucuuuuguaugcauacuuuuccucuuuucuuuuguguugagaagcuucacagcaugagucaauucuggaaaucauuuuggggguugaguuaagguuuucccuuggucacuguguugacauguuccucugguuuugccuuacauuuuauacuuccuugucaucaccuuugggggcaaacaacaucuuaaugcaaugcuucauuugucguauugaaguguguuuuaauuuuuacacggaggaguuugaacucugagacucacacaugcuaggcaauuguuguaguacugaguuauuguuuuggucuauuuuguuuguuuguuuguuuguuuguuuuagagaagcuuuagauuuccagaaaagcaguggcaaagacacccugccccuggugucuuuuauuucuauaguccacaugccacaccaaauuaacauuaacagaauuaucaagugauacauucuuaugaacuagaauuccugauugagucacauugccuuagauuugaucuauuaucuaauaucuguuuuauuuuccaggguuccauccaggaaacuauaguauauuugauagucaucaugucuccuuaauuucuucuugaauguaguaauuaauuagacuucccuugcuuucaaaaacauuuaacaauuuuguagaaugacaaucaauuugauuaaucugauguuuguuucaugauuaaguuuuggaaggaauuaagaccauaaagcuaaaauauauaguaucaaugguacaugguuuauauucagaguuaaccuuggucacaagguaauauuuuuuaagauuucucaacucuaagauuauuuuaucccuuuuaaaacuuuauucuuuguaggggaguugugauguccagcccccacucaagaaauaaagauuugugcuccaucuccuugagaguggaaauaguuacauagauuauauggaauuaugcaagguugauuuuucugaucucauauauauauguauauauguauauauguguguuuguauaugugugugugugcgcgcgugugugcgcacgugcauaguaguuuaaaauuaacacaagccucugugggaauguuacuauauuaguauucaugguuaucuagaguuucuuuaccauuaugaauaacacucgucccaaaguucccaaauuaaacuuucuugcuuaaacccuuucaaaacaauuucucagaaugaguuacauauggccauuuucauaaaaguauauaauguacauugaacauguuuuucucauacgucccuguggcuccuuuaguccccuaauuaguuugacuucuacuuucauauuauauguguguguguacaaacauaauaaguaaauuauauauuguauuuauauuauauauaauaauauguaugauuuuauguauguauauaaauucuauggccuacaaauuagagaaaaugugcaacauuuuucugaagcuggcuuaaauuccuuaagcacuggucucaccauguauuucagugagauuguuucaaacauacauaauaagauucucuuaucaaauucuguaucccacccucagaucaaucccaccaugacuuuuuaaauaauuuuuuuucauucuguaagguucacucuacuauaauguucuguguaguuugaaaaaugccauguaucugguaucugguaagugcuauuuaaagucuauuuaucaucugcauaggccaucccuuucuaaaaugucauguaaauaggaugauaaaguauauagaguuuucaaacauuuuaauuuauuguggguugugugucuaugugugugugugcaugagucacauuccaagggguuugugcuggcugguuuugugugucaacuugacacaggcuggaguuaucacagagaaaggagcuucaguuguggaagugccuccaugagauacaacuguaaggcauuuucucaauuaguggucaaggggagagggccccuugugggcgggaccaucccugggcugguagucugggguccuauaagaaagcaagcugagcaagccaggggaagcaauccaguaaguaacaucccuccaugguuucugcaucagcuccugcuuccugaccugcuuguguuuccaguccagacuuccuuuggugaugagcagcaguguggaaguauaaucugaauaaaccuuuuccuccccaacuugcuucuuggucauguuuguacaugaauagaaacccugccuaagacaaguugguaccagcauagugggguauuccugugauaaccugaccauguuuuggggaggacuguggaagaacuuuggaacuuugggcuagaugauccauuugauguuaagagcuauuucaggagugggugauaacuggugaugacucagcaguuaagagcacugacugcucuuccagagguccugaguucaauucccagcaaccacuugguggcucacaaccaucuguaaaugggaucugaugcucucuucuggugugucugaagagaaugacaguguacucauauacauaaaauaaauaaguaaauaaaucuuuuuaaaaagugcucuguaguaugauauguaggaccauggaacauaauguugagaacagugcagaagauggaggcuuggcuuggaaaauuucagagggaugacuaaagacucuuuucagggccauugcuauuuugauugugaagauucugugguuuugguuaccuggggcugaagaaucagcugugauuaacaagauaccagaacuacuaaagcaaaaacuuuucauuacugggacuauugaugcugguuaguuggagcuaagaaauuaguggugauuaagaagagaccagcaucacugaagugaaaucuucugggaaguguuuucugagagcacaaagaggcuguguuccagagauagccaagguuguaccuccugcugcagcaggacuugguaauguauaagagucacucaggugguacugguuuugaaggcauggaggagucaugaaguguaguacaaugaagagcagcugaggcuuggcacugugagaggccauggaaggccauugguaaaggugcagacucaguugcaauugauggcccaggucaaaggggucaugucauguaaaggaguugaggcuuggcaccaugaagagagcccaugagaggcuauuguugaagccuaguuacaucggaagacagcaguguuuuggagaugccaguauuauaggaugaccaccaagaacagcagcagcaguggaguacaggcgccggagccuagaaggcaaagugugugcuacaaagggcaaggcugcagaagugacccaagcccuuggaggagcuuagaagauccggaauggaucccagacauuggacaguuggaguuugauuuuguuuuugauugugacuguacccugauaauuuuccuuccugaaguaagaagguauuuuaguggagcccacaguuaaaagacuuugaauuuuuaaaagacuuugaaauuuaaaagauauuggauauacuaaaggaauugaaauuuuaauauguaagaauuugcaaagacugcaggacuucuaaaauuauuuagaucuuggggaugaauaagaaaguaagaguugaggcuuaauagugagugauguguuuguguaucagguugacaaggagucaauuguacuggcugguuuugugucaacuugaccucaagagcaauguggcaguguaagcugaauaaacccuuuucuccccaaccugcuucugggucaugauguucugugcaggaauagaaaccccaacuuagacagcguucauaugguagucagaggaugacuugcagaaauccauuuucucuccacaacuugaagacuagagcuggaacuauggucaugagacuuagugacaagcaccuuugccuacccagcuaucucucugaucccaaaagucuauggaauuuccaagugacuuacuuacuuaucaauaugguuuucagguuaauccagguuuuaugugaccucaugacauacucccuuuuuuaaaauagcauucuauuauauggauauauacuauauuauauucauauauucauucauuuaaauuacaucuugguugcuuuuaauuuggauaaguauagguaaaucugaccuaggcauuuuauucauauguuuaugugaauauaaauauugaaguuguuggauaaaugucauugguagauuuguacaucuaguacauucuuccaaaauaguucuguuaauaagcuuuaucauugcuguuaccaaaauaccuuccaggcacaacuuuagaggggaaagauuuauuuuggcucuugguuucagagauaucagucuaucauagcaaugaaggcauagcagaacguuaaugucaauuuaugccaggaggcagaaaaggggugaagggaagccaguacucagcuuguuuuguacuuuuucccauuuuacuuuuaucuaaaccuucaguccaugggauaaugccacccacauucacaaugggucuuuuuuauacaucauuuaauccuuccuugcaacacgcaagcauacugagguauauaucucaucaaucuaaugaauucuucaugcagucagguugacaaugaagauuuacaaccacaaaugauuuaucaucauuucauucucacuagcagugagugaggguaccuccugcuguguacccuugccaacaauuggaauuguuuaaaaaguuuuaaccuuuuuaaugguaccuuauugucuuuauauuacacuaaugacaagcuaaacuucuguuuuuuauuuuguuauuagauauuuucuucauuuacauuucaaaugcuauccugaaagucccuuccacccuccccaugucuugcuccccaacccacccacuccugcuuccuggcccuggcauuccccuguacuggggcauauaaaguuugcaagaccaaggggccucucuucccagugauggcugacuaggccaucuucugauacauaugcagcuagagauaugagcucuggggguacugguuaguucauauuguuguuccuccuaugggguugcagaccccuucagcuccuuggguacuuucucuggcuccuccauugggggcccuguguuccaucuuauagaugacugugagcauccacuucuguauuugccaagcacuggcauagccucacaagagauaagcuaaacuucuuuugaauaauagaaaaguaaaagccucucucuuuccuuccagcccccccccgugugugugugugugugugugugugugugugcaguacaaacacacauguaguucaaagaucaacauuagguaucucccauaauugguccuagcuuuuuuuuuuuuuuuuugagacagggucucucacuaaaccuagaucucaauucaguagcaaagucaggaaucugccagacuguguccccucuaaauccccagugcuaggauuacagacacaccacaucuggcauuaauuuggaugcucauuaucacagcucagguccucaugguugaaaggcgggugcuuuacuaacggagcgcucucucuagcuucuccaaauccaacguuuuaaggaauacuucuacuuucaccauuucuuccuuuaucgaaaucgaaggaccaacuguuuaucaagugguagaauuaauuuauauaggaaagggguugcuuagcauucaggcugcuacauuuuauaacuguguagguuuuguguuucuguauuaauuagcuacaaguuaggcaaaaagaaagauuuacuaaggugaacauuaagucacugguggcagagaaucaauccuauguggugauuaugaagaaaguggaaggaauuuuauuaguaagcaagaugccuauaaggucauugucucccucuuagguccaucacacccuauacacacauucacaucucccauucuccauccuuaccacaugaauguggaaacaguggugaagaagacuaaaaugaacucaggauauauaccagcaugauuucuucaguaccuuuaauuccuuuuaaaaguuauuaauuaaugccugacucuuuuacacacacacacacacuuguacaagggauaaaacuagggccucucgccgggcaugguggcgcaugccuuuaaucccagcacucgggaggcagaggcaggcagauuucugaguucaaggccagccuggucuacaaagugaguuccaggacagccaaggcuauacagagaaacccugccucaaaaaacaaaacaaaacaaaacaacaacaacaaaaaccuuacggccucucaugcaugcuagauaaauaguauuccacugaucaguauucccacagcucaaaaccaaauuuuguuuaauguuuuucagugcuaaggauuuaacccaaggucuugugcauaucaggcaaacauuaucacugaacuacaucuuaaauucuauuacauuuaacacugacuuaacuuguauuuugugaaauauauuuagagcaucuaugauuuggguagcucuuccaagcugcaaacuugcauuucccucuucaaucuauauuauaucuuuauaguuucauguaagguuaaaaaugcuuaaacaaauuuuauuuuaauuguuaauagagaacaauacagauaacacugauuggacaucugugagcaccagacacuuuuauacauauucucauuacaccucuugaaguaauuguugcuccaucuuauagauuacaaauuucagaggaaaaugacauacucuaaaugaggcauuuguacaugugauuccuucugccuggaauagcacuuccauuccauuuccaauagcaaaguaucaaaccuacaauaaucacuucagauaccaucuaacucccuagacaguagucucaguucaucagaaaucugauacuuacccuugucaagagucaccauacacagaaccaugccaucugcaaauagggauguguuaacuuuuccccuuccuguugguagccuucuguuuccugcuuucuucuauguccuucuguugucuuguugcucuagcuaacacuauucuaacuagggauggugaaaaugaacauccuuguguuguuccugaucuuagugggaguguuucaaguucuucauuuaacacaauagugacuauugguuuaucauauauagccuuuaguaugguaagauaccccauuccuaguuuuaucaugaagagguguuguauuuugucaaagaucuuuuuuuuuucaucaauugaaauaaucaugugauuucugugugagucuauuuauguaaugaauuauauuuauugauauauauauauauauauauauauauauauauauauauauauauauauguaaucccugaaugaagauaacuugucuucccaaauuuuguuugcaaguauuuuacugagaauuuuugcaucuauguucacuaagaaaauugaguaacacugguguuaguuuucuuugauggccuaguagaguucuucauuuaaccuaucuggacaagccaguugggagauauuugcuuguggugugaacauugauuaaugcagaaaaaacacuaaugguccaagugcagagagagagacuucuggagagggacaguaaguuuucuuuaagggugugauccuaguagguguaaaugcugcuuucauuucuucagauaaagggaugaaaggaaagcuguacccaagcugugugaauacacagaucaggcugagcccagagcauuuccuucucuguucuaaccaucccugggccugggccugggccugggccugggccugggccugggccuggaaguuucuagccucuguacaaucuaaucuuccaagcuuacugauucaauccuguuguggguuggccucguguuguuugucuuuugauguuaauuuuguuuccuuaaaaggggcugcccuaacuaggaguggaucacacacucaggugauuccaugugaaccuucucccaauucuagcuggucaaauaaaggcgagggccugugguugaacaguuagaaggaaaagguagagcuggaagauugagagcauggaggaagaaggacagaggaagaagagguggaaagaaguuggagcagaagcacauggccuggagaagcuagcaagggaccucauagccgggaauagauuaguggagugguauaucugaguucucuaggcuucuaacugaauugcauugccuggccucauacuaacuuuggcaaaauauucgaaucuuccggcuccuuuucauucucugacuccuucugucuucaccagugucuagcuuguucucucuguaacuugucucuguaaaacuauccuggucaaacugccacauagacacaccuaccacuaccaccccuuuucucucucucucacuguucuuagguagccucucuuccccugcuguucucauauggguuggguguagcuuaucucugagucauucugccaaaucuuucucugauucaucacuuugucccuuaauuaaaugucacuuucaaaccuaucuccguccuucuacaaacuaaucuuaccuucauuguuagggacuaaaaguguauacuaaggacuugucuacauucuuuggaggugauccccugccagaacaaccauguugcuggauuaaaauuucguuacagguagauuuauuaagcuccauggauggcuuuacaccugugaguguaugaucagcacaaauugaacuugguagguuauuacaaaauuuaaaaagaggacaugaauuuaggagggggaaagaguuggagaugaguaucaccaaaagacauuguaugcauagaugagauucucaaaaaguuaauaaaauacuauaguucuaaaaagaaucaccauacagauauguauauuccuauugaauuucucagucccuuuugcaaaauacaguaguuugucacucacuacauuuagcaaacgaaucaggagcuuauagaaaugcauuucuuuguuguuguugugggugaauggauaaauggauguagagccacuugaacaaacuuacucaaacaaaugcugaaucucugggaaugaguagaagugaaagauuaagaauguuauucuaccaugaaaggggugguuuuccuauguauauuuuuguaaacagaauuaguuauuaucuugcacacuauaaagauaaguuuugguaaagucuuuuggcagguggagauguaggcaauuuuacaugaggaguacuuguuggggagcagguugccaucaggaagaaggacugcacauuaaagcaaacgugagcuacauaguaaauacauauuaauacaguugacaaacacuguauuaggaucacauagaaaauuuuaagaaauguacuacaaaaauuaguuauucacacuuugguuacuuugaucuuuacuguauugaacauugcuagcgauauggauaucuuuuagaguauauuuuaauucaaugaaaucaacuuaguaguauaacaagaaaugaagaugaacauaaauaauacaauuccuucuuucuuacaacauaguuaacaucuaguucaguuuucaucauguaaaaccuacauaggaaaauauugcaugugcaaucaugcauguacacaugcacacacacggggggauuuuauaaaaacuauuuguuuacauuacauaguugggauauuuugcaacuuacaaaaugauuucauaagagauccuaggaagcuaaaauuagugauauguguauguuuaugugaauauauuuaagguacauuuucauagugugaugacacuguaaguaaauggcauaauagcugcuacaggauugacagcucugucuagcaaaugccaaucccacuuuauguuuuugcauuugaaggauauggaaaauuugucauuuuacaaaaguuucuagccaggggugguagcaaaugcuuuuaaugcuuucucaacacuggaaagacacagugagguagagccagccuagucuacauaaugaguucuagcccagccaaggccacagaguuucucuuguaugauacagguauuuguugaauacaaucucacuucuugccaaggaaugauacaaaacauuuucuuuuuuauuagauauuuuauuuauuuauauuucuaauguuaucccuuuuccuaguuucccuucaaaaaaucccuaucccuucccccucccccugcuccucaacccacccacucccauuccuggcccuggcauuccccuacccuggggcauagagccuucacagcaccaagggccucuccucccauugaugaccgacuagaccauccucugcuacauaugcagcuggagccaugggucccuccauguguauucuuugguuggugguuuaguuccagggagcucuggggguacugguuaguccauauuguuguuccuccuaugggacugcaaaccccuucagcuccuuugguccuuucucuagcuccuucacuggagacucugugcuuaguccaaugguaggcaaugagcaucaaccucuguauuugucaggcccuggcagagccucucaggagacagcuauaacagguuucugucagcaagcacuucuuggcauccacaaaagugucuggguuuggugacuguuauugggauggauuccccaggugagucagucccuggauggucguuucuucagucucuacuccacacuuugucucuguaacuccuuccaugguuguuuuguuucccccccuuuuaagauggauaucaguauccauacuauagucuuccuucuucuugaguuucaugugguuugugaauuguaucuuggguauuccgagcuuuuggacuaauauccacuuauuaaugaguacauaccauguguguucuuugauacaaaacauuuucaagauggcacuuuccauacaacuauauaugauccgagguaaggucuuugauuacuauuucaaccauuaguguaagucagacugaagauugggacugacccacggaugucaguacugacaugauuauuuauugcuuagaacuugacucugcauagucccaguucaaugacaauucaagaccccaggaagauauuauacagaugacuagauuugcuaaagaaauuuuaaaacuuuuuuaaagguauuuaaaauuccugcuucuuuuuggcagugcuagguggaacuuggcucaucauagagcuggaguaaucaaagagugagcaaaugauaauuuagauccuuaggcaaacuuacaagcuuugaagcuacaguauuucuaauugcaugccuaauggcugauugacgugauucugacaauuaccucaaaauacuacucuuaguuguugauuguuuaccagucaccuuccacuccuccacauaaaacucugauucacagacugacaaugaucugccaggguucagguuguaucuugcuacaguguagauuuuacuugggauuaaaugaaaguauuucauaauuucauauuuacuugaauguauauuauauggcauauauucacacacauacauauacauucuucuaaaguagaaaacacccuaauacuuaggacuguucuuccuucuucugccaugggaaaagcagggauaccggaaacauugggaaguguggagaaacuuaaaagaaagacacugcugugaauuauggccacuuuuguggaguucccuucucucucagaccugcucagaaaucucugguuacuuccuaaaagucagcucacaagugauucucccuaacuucccuccauuuuaaggaaaagcucucucuuccguggcuccacugaguuccuucagugaccuuacuauauggcccuggucccauuggaguguucagucuuaacuccucacuaaauuguaagccuuaaagagcaucuacgauucauuagaugugcauuguugugcacaguauuugauuaagacaaguacucggugaauuguugagaaauggauggaugguuaaauggauaagcgauaagacaaacaaacaggaaaaguacauccauucaucaauguccgcauacuucaacaaaagucuaaacuuucuuccuaauguucuauuucaggcaucugcauauaggaguagauguucacuauguugcuuucaacuuauauaucaucuauggauaucauaauuuuaauacggaaaaauucaauauaaucuacuucauuaaaaauuucaggaauaaaaaaucauaugaucauauaaguacaugcaaauaaaguauuuaaugaaaucaaacaaauuguaauauacagauauauucucauucuuauaaaggacaaucuauagcuaguguuaucuugagaugaaaauuugaagacuuuuuuucuaaaaucagaaacaaggcaaugaugucugcugucaucacuuguaguuaaugugcuagaaauucuagccgaauauauagaaaaaaggcaacuaauuuugaugcuguuuauuacaguguuugaaaaugaugcuaucuuuauaugcagacagcaugauuaucuuuguaagucauaagaaaguuacaaagcaauuacaagaacuaguaagucaguauaacuaguucacagaauaugucacuauuaaaaccaaucauauuccauaguuagcaugccacacacucugccccuaagauccuuccaugcccuauuuucuuacuguuucauuguccucauaucugcaccuuguacgauguaagaucuuuugacaugauaauccaauuauuuaaaauuuguuacuugaagcugaaggggucuacaaccccauagguggaacaacaauaugaacuaaccagugcccccagagcucaugucucuagcuacauauagcagaagauggccuagucggcuaucacugggaagaggggccccuuggucuugcaaacuuuauaugccccaguacagggaaacaccagagccgagaagugggaguggguggguagaggaguggggguggggggaggguauagggaacuuucgggauagcauuugaaauguaaaugaagaaaauaccuaauaaaaaauuggaaaaaaaauguuccuugagaauaauucuaauucaaaaauuaaauaaacugguuaaaacucaaaauaacggaucauauuccaauguauacuaacaauaaacgaucauaaauuuucaaacacuauaauaaaagcaucaaauuuuugcaauauuaaaaucucaguuuugguuugcaaccucauaggaagaacaacaauaucaaccaaccagaccccucaaaguucccaaggacuaaaccaccaaacaaagaguauacaggggguacccaugacuccagcaacuguagcagaggauugccuuaacuggaaucaaugggagggaagccccuugguccuguggaggcuugaugacccaggauaggggaacacuaggccacugaggcaggaguaggugggcagguggggagcacccucauagaggaaggggaagggaggaggggaaaaggggcuuguggaggggaaacugggaagggguauaauauuuaaaauggaaauaaauaaaauaaccaauaaaaaaaaugaaaaaaaaaucucaauuuucacaaacuugauuuuauaaauguaaugcaaucuuagauuuuuggcaaaaaccaagaagaugauuuuaaaacuucuguugacaaaugauccagaaugucuaaagcauaaaggaaaaguugaaggucuuaugcugacugauuucauaguauauuaaaaaguuauaguaaucaagacaguguguuaacaaaaaucccaacacaaagggggaaauggacacaaaauucuaccccuaagaaguuauuugcaauugguacauguuggaagacagaaaaucaguguucuucaauggaacgacacuggguagaucugccaugcuucaggacaaccccauguccaggaguagagagccaagugaaaucucaguuauuuuagugcuuuuuagugacuuuuugcuucuuuuugaaaaaaagagggaaauaucauaaaguuggguaggcggggaagagaagagguucugggaggaauuggaggacagagaagaauaugauaaaacuguaccacauggaauucucaaagaaaaaagaaacugaaauacauggcauagguuagaauaaaauauuugcauagcacuuaccuggcuuauaucaagacuuuuggauaaauuauuaaaaccuggauaauaaauagauaucucacuauuuuaaaauaauuaaaaggauugaacagaaauuucuccaaagaaauguaugaaaagauguucagcacauuagucacuggggaaaugcaaacuaagacaacauugagggcugaagaggugacuucauuuguaacgugcuuaccauauaaccaugaagaccugaguucagcuccuccucggcaccugagccaggagcauaugcuagaucuguugcuagaguuuugaggaaucgccauacugauuuccauaagagaugaaccagcuugcacucccaccagcaguaaagagguguuccuccuuccccacauccccaccagccauuguuaucauuugcuuuguuuucugucuuuagccauucugacugggcuaagaugaauuuucaaaguaguuuuaauuugccucucugcaaugacuaaggauauggaucauguuaaaaaauauuucucagguauugcauuucuaauuuucagaacuauuuccaugccacaaguuuuaauuauguuuguuuucuuuaugcuuguguguguuuauuuuuuaguucuucccauauucuagacaguaacccucugccagauguauaccugguaaugauauuuucccauucugugggcucucuauucauucaaauggugauauacuuugcuauacauaagcuuuucaguuucaugaggucccauuuuucaauuguuaguagccugugcuaccaguaucuucuucaaaaaguucuuuccugggucuauaaguugaaacauauucccuacuuuaaccucuaacagauucaggauaucaggucuuuuguuaaggucuuugauccauuuguaguuaagcuuugugcaggugagagauaaaaaucuaguuucauucuucuccauggagcuauccaauuccaccagcagugcagaguuaagauucuuuccuuuucaguguguauuuuggccacuuugccaaaaaucaggugucuauaaaggaacauagacuuauauuggggugcucaguuuuguucccuugaucaguguguuuguuuuacuaucaguaccaugcugguuugauggcuguauacuauaacaugaaaucagggguggugccaucuccagcaaugcuuuuauuguuaacaguuguauuagguaucuuggucuuugcuguuuccauaugaauuuugagagugcuuuuuuaauuaugugaaaauugcacuggaauuuugauggguacuacauugaauaugaagauugcuuuuguuacaguggacauuuucaugauauuaauacuaacaauccaugaacacgggauuguuauauuuuucaaucuuauguuauauuuuucaaaucuuuaagugucuuaaaguuuuuauuguuuauauuuauucccagauauuuuugaagcuauugugaauggaaauguuaccccgauuucuuucuuaguauguucauuauugguauauaggacgccggcuauuucagcuguaccacuccugagcauauuccgaaaggacucuauccuacuacagagauacuuaaucuuaacuccauguucauugcuacuccauucacaacagccaggaaaugaaaauagcauaguuguccaucaacugaaaaauggacaaugaaaauaugauacauauacauauugguuggaauuuuugucaacagauaccaggaucauuuggggagacugaacuucaauuaagaaaagugccuacaucagacugauuugugggcauggcuguggaguauuuucuugauuaaugauugaugugaguggaggaccugacacauugugggcaaugacagcucuggaugggcugucacauggagggacccaugacuccagccccauauguagcagaggauggucuaguuggucaucaaugggaggagaggcccuugguccuaugaaggcuggaugcaccaguguaggggaaugccagggcagggaagcaggagugaguagguuagugagcagggggaguggggaggggauaggggguuuucagaggggaaaccaggaaaggggauaacauuugaaauguaaauaaagaaaaucucuaauuaaaaaaaaaaagagaaagaaagcaggcugagcaaaccaugaggaacaagccaguaaacagacuuccuccaugguucauggucucugcuucaguuuauuccuccagguuccugcuuugagauccugcccugacuuuccuucaugauagacuguauguuuuaaaguaaaauagacccuuuccuuccaaaauugcuuuuggccaugauguuuaucacggcaauaaaaaguaaacuaagaauuguucagcuauaaagaaaaugagguuaugaaaugugcagguaaauggauggagcugaaaaauaaucauucuaaaugagauagguaaaccagacaaaccauauaacauguccuaucuuauauguggaugcuaacuuuaagauguacauccaaauugaaguacccauagaagucggaaaacuaggaaggagucaagauuucaacagaagagggcuagagcacaggugguaugaaagucuaaauuggaguucuccauugacucccuuuuuugccuugucuuauucuauccuguuuuguccuguuuggccuguuugaggccuacucuuuucugaagggagauggaggcaaaguggaucucgggaacaggggagguagagaggaucuuggaggaguggagggaguggaaacuaugguugagauguguuauaugagagaagaaccuguuuucaauaacaaaagaaguuuugcuggaaaaaaagaaagagaaauaauagaacaggaaagauuaaauggugagggagauaggagauugggguaaaagagggaguaugagaagggauugcuaacacuaaaggcuuuugaaaauaccauguagaagucuacuacucuagaagcuuccugaacuauauaugcauacauauacaaaaagaguuaggguggaguuacccuauaacaugugaacaaccucucucucagauaccauaguauccuccuuuugugauguugucuugucugacaccauuaacugggugaaaaagcauggcuggcuaggucauagguccuaaggaagaagcuaaugcuauuacucugcuaaauggacuuaguauuacacugcccccugaauucucaucuuuaugcccagagagauuagugcucuuucagccuuuaucggagaagcuucuuuucagccgauggcaguuaauaaagagaauaacaacugaucacuuuacagagacuaggggauuuuaggaugcucaauucuaauuggacaucuguccuacacugcuacaccaaagcucaaaaaauauuugggaagaagggaauagaguuauaaggagaaucagaaguuuagagugccuguagcaaaacacuauuguugaacaugacaccaccauugcacacagaauuaauagggaauggauaggacuauaugccuccgaacucuacaggcucaagcaacccaaaauuccaucaugaaugggagagggggucaugaagucccaccccuaccugaggagguauugacaagugacaucugcuaggagagggagagaguuuucuuuagggauauguccccugagaagcuacccaugccccaguagacaguccuaugcccaugcauaugcaggcaacauuaaagagacucuaagauggaaaugaaguugggagggaaaugugguuuagggagugaauggggaugaauuugaucaaaacacauuauaugcauguauaaaauucucguguguauccaugcacaaugccuuguaauuucagcucuugagagcaucgagacaggaaccuagagugcuugcuagacagucaaucuaauuagaacugugaauucugcuucgcaucugcgagauaaccugucugaacuauacaagguggagagcccccauuuccccucuccaauuccucccaucucuauauuauaucaaucgaaaggaauacacacacacacacacacacacaugcaaaacaaauauuuaaacagcauggagaaacuuuucuggguguuagacauugucauuauuuucauugcgaugauauuuuuacacauaugccaaaauuuaccaaguuuuacacuaaagaauuuccagguuuuauaaguauaaaagaacauaaaauaaccucuguggaugaaaauaaagcaggucauaacuguauccacaauuuguguuaaguuucaauaguuuaagagagagggcauaggcuuuaaggcagaugagagaggggguauguagagauggcuccuugucaacacucuuucaggugaaauuucucaggcugguuugaauuuggauugcuauuuuaagguucuugguuaauuuggaaauagccauaugauuauuuuuauaucuuauaaaguagugaaugcaugugguuucagaaaguaugaacuauguacacauaagcuuauaauauauggaauuaacugggauccagcucaaggggagaccccaaggucugacacuauuacugaugcuaugaugugcucacaaaaaagggaucuaucaugacugcccuccaaaaggcccaagaagcugcugaaagagucagaugcagacacuuacacccaaccaauggacugaagucagagaccccugugguugaauuagggaaaagcuggaagaagcugaggaggagggugaccccauaggcagaccagcagucucaaccaaccuggaccccugagaucucuuacugaaccaccaaccagacagcauacaccagcugauaugaggccccccaacacauauacaucagaggacuaccgggucuggacuugaucagagaagaugcaccuaacccucaagagacuugagaccccagagaguggggaggucuaguggaguggagggagcauccucuuggagaggggggcggaggaggagguauagguaguggacugggaggggaauaaagucugaacuguaaaaaaaaaaagcuuaaagaauaaaaauauucaaaaacacacacaaaaaaccccaaaggaauaguuggaaauuuuuaaaauaauuuuucauuaaaauuuuucucuccaccaauuuuuaaaauagaaauuauacuugugugauuuuuuuucaguucucugauucuguuuuucauuguauugucuaugauaccauaaguuucucuacuuucuucaugaugaauguaguuaggagccucugcuccugcuucuuguggaugcuacccuaguugucauuaauugucaaguugacauagccccgugucaucuaagaaaagaggcuugagaggcauuuccuaggucaaauuaaccuguggaugugucugugggacuuguccuaacaauuaauugauacaggagggcccagcauucuuugggugucucuuccuaggcaggugguacaaagcuagcaaagcaugggccugagagguagccagcaagcagcgaccucccaugggucuucucuaauuucuuaccugcaguuuccuagucagaaguaaugucauguggaaugacaguucugccaucauguuccuuccuuguauuccugcccugacauugcucagugguagauugugagcugcaagaguaagauggggcaaauucuuuccccuccaaguugcuuuugaucaagauguucugucacagcaacagacaacgaaugguaacaggcaccuuccguuuucagagccuugguugcuucaauuuggauuuugugcuccgcaggccugccgugcagcccucaaccuuggccuuacuuucauuagucucugguuuuagguccacuguuuucugaagcuaauauaugugucaaucuuuguuuacucuuacauuuugcuagaauauaucccugaguaacuuuguaggaauaggguguaaaaugugaaguuugggaauuuguaaaaauaaaaacaucauucuuuugcugucagacucaauuuugaguuaagagacagauuacauuuucaaaauaauuucccuucagauaguugaagguguuucucuauugcuuucucuuaaaaauagguuuucugguaagaggaucaauuuauucaaaaucuuguccauuuaacuguugauguuuuuccuuugugaaagcucuuagggacuuguuuuuuuccuuucugaaagcucuuagggacuugauuuucugaacuguuaaaaugugucuacuuguugaggaaagugccuaccauacucuguaugaagccugcaaggcaauaaaccacacccaucucuauaguuguuaggcuugggaacuuauaaaggacucuggaacuguacucuucauacugugugccucaauucuuucacauuuuauuuaaucucuuuagaaaaagcuuucugauuuguagggggaacacuuggaacgaaauuccugauuacuacagauucuauacauggggaaagaggugacuguucuguauguagaugcucagugaauuccucacauccucacaaucacacccuuuuuuaugguucuguaacuccaggucuacaugcuccaugauacacuguguucccaggaccucacccucuuuucauuuguccuuuccaaauuuuaaacuacuccauugucucuuugggcaggcccauaucuccacaagcucuaaacucccccuucuauuuucucuuuauuaguccaucuuuauuauccagaacucuaccuacuuucuguguuucagagaccuauugaaaucucuuuucugcugauauccuguauugcuucguuaucuguuuaauaucauuuuaauuugagucuugggagccaauggugcuaacauggcuugguuagucagcuuccuugucuauauguguauaucccuguuaaauguuagcuuuuauuaguuuucuuaugauucuuuugaaaauauuugcaauuaggggcaauuagguaugagcuggacaaaucuacaccguuuacccaucaguagaaacuagagaauucauuaggguaaaagcccugugagagauuaguagacagugguggaaucugauucuccauugcuuugugggaagauggcuuucuccugaaaacuaacaggcaaacauaggauauacauaaaauuaacucuacugaaacuguuguuauacuucauuuuauccuaauuuuuauccuaauuucuuuucaggggcuagcucugcugugauacuauggggaaaaaaaguuaggagacaauagucagcaagaggcuuucauugugcagugguguggccacaaaugaaaggcaggaauuuuccucugaucaaacagaguuuuccauagacacagucuagaaguagauucuaaucagcagccauguugaauuuuguuucuucuugucuguuauacagcuacuauaacaauuuuggccugccauuauaucccauaaccaguuauuugguauuuaccaccaggaggccuggccccucuuggacagaggaggaacaagaaugccaagcugacugagaacugaacuguaacuucggauuugucuaaucucacagugaaauggucuuucuuuauacccuugcaacuuucuugccaaucccuuuauaccacuuguggaucucauuuuacaguauuuaaaauggugaauuugaggcccaggucuucuacuacuuuuuucuaaucuuuuggcuuguuucagacuauuauugugggcugaaucucuccuaaucauaucacuagugauuaacccgccuguccuuaagauauuuauaucuuagacuccaucuuaccuucccuaaccuuucucuuugaaguuaucaacugauaucugagauuucucucucccuccuuuucuucccccccacacccucuuuccugcccugucuucucucuucaucuucccuucccucccucucuccuccuuuuguuucacccucucuuuuucacucucccucuccaccaucaugauccucuuacccuagccuuucaaguacuuggauugaaggucugcaccaccauggcucuugagauuuguuuucuauuuucucauuuuggaaagccaguuugggauuaaaacuaguuacaauugauuuuagcaucaacuuaaacagaaugugauuuaugucucccuaaaauccucuccgcuuaauuuuccuaagauaucugaaacauuuguuucugucucagcaucaguagugaccugugucuuacuuugauuuuaccuaguccucacugauaaguucuuaugguuaucacuuuauagucacaggcuaccucacuuuacccuucuuccauacuugauuuuuaauaucauggccaaauauauuuuaauuuacauaguuuacagggcuuggggcucuauaaagaacaaaacagauuuuguagaaugcugcugacagagaaauuuugaacaagcagaaaaguucuaguuuaaaauagauuauacaaacaaucucauuuuguucaccuucgugcucugaccuguuaguccagcuuuaggaagauaaacuauaacaaaauuacacaauguucagucuuuaauucacaaucaagaggaugcacuugaacuuacuuucuuaacccagagugcaacugguuuauaauaugguccuacuccaaguacuacaaauggaggugcuucuuuccuuuaauaugccaaugugcuuugaucuuuagaaguaugaggaauuacaaauuaaauuagcaaacaauuccuaagggaaguaagugauagccacuauauaucauuguccuucuuaauuaaguauguuacuucuaaaucuugaacugaaaguccucucuauaugacauacauagauacaaacuacuuuuugauuuaugcuugcagaugcuauuuguacagucugccacugccuguaugucucuguucaacuuguggucagcuaaaagccuuucuccaaaaaaguuuccaaauuccauauuagauugcuagcuggucucuuuugcuauuuuacccagcaacccacagcuaugcuguguuauuugaagcuaugcuuuagugcauccuuuacaaugcgucuuauguucugccuguuugugguuaugcuauaaagcucgccauaccaaagaugcuugaguauccuucugucauugugucuccacauaugucaccaaugaacauagcuuuaaugcugauagaccagcugaacuuucaaaaucccaguaguggugguccucucuugccauuucacauuaagcaugauucugacucuaacaauagaauagaucaaugagauaaaugugacaucugugcugguuauggauuucaaagucauauaaaagcugggcauguuuguauuguccauugauacaaaucaguucaagaagcuugucuuuuuccaccucuguuuugaacauaggauauggaaaggugaaagcacugcauuccucccucuuucauuaguagucaugcuuuuauaauagcccuccuuucccccuugauaugcaucauaagcagauuucacacuuguccuacggacaagucuaaacauauucugaacccucuuugaggugccuauaaagagaauaaaauuuauauuaaaauauauaaagcauuauuuaauaaagguuagguaacuuguucaagccaaaacugaguaagaaaaaaacuaaacauugagcugguuuauuaugcaauuuaacacugauaccacacuaagauaaucucccuaagcagagguacuguacuuucuaauuuuuuuuuuauuuuucaguaacuugcauuguuugacauugauguuuuuuagucaggcugccuaggaagcaguauccagagacugcauuuagcucuaugugugaugaaaguguucauucuguuuagcuuuacuacauaauuucacaugccuuccaguggaucuauugaauggaugaaaaaaaccuagcauccccaucagagauacucaaggagccaauuucacuucguguauaggcacacugcuaccacugccaccccaacucagcuggugguaucuccuaugggaugacgcuuugaucaauguugaaugcccuuguuugcuuacucccagaaaguagcacacagcacugcacucuguucagcagucagcaaauacugugccuuucuucuuaccauugaguuggaaacauuuuuaucuccaauuaaguacuaucauuccacuucaaauaaauugugugguuugcccuuuuucuacauauguuuagaauauugucuaauucagaaccuuucaugugcuauguacaaaauguuuguucaaaagacagcacucggguccgagacccgccgaacuuaggaaauuagucugaacaggcgagagggugcgccagagaaccugacagcuucaggaacaggcagaagcacagaggcgcugaggcagcacccugugugggccggggacagccggccaccuuccggaccagaggacaggugcccacacggcuggggaggcggccuaagccacagcagcagcggucgccaucuugguccgggacccgccgaacuuaggaaauuagucugaacaggugagagggugcgccagagaaccugacagccucuggaacaggcagaagcacagaggggcugaggcagcacccugugugggccggggacagccggccaccuuccggaccggaggacaggugcccgcccggcuggggaggcgaccuaagccacagcagcagcggucgccaucuugguccgggacccgccgaacuuaggaaauuagucugaacaggugagagggugcgccagagaaccugacagcuucuggaacaggcggaagcacagaggcgcugaggcagcacccuuugugggccggggacagccagccaccguccagaccggaggacaggugcccgcccggcuggggaggcggccuaagccacagcagcagcggucgccaucuugguccgggacccgccgaacuuaggaaauuagucugaacaggugagagggugcgccagagaaccugacagcuucuggaacaggcagaagcacagaggcgcugaggcagcacccugugugggccggggacagccggccaccuuccggaccggaggacaggugcccacccggcuggggaggcggccuaagccacagcagcagcggucgccaucuugguccaggacccgccgaacuuaggaaauuagucugaacaggugagagggugcgccagagaaccugacagcuucuggaacaggcagaagcacagaggcgccgaggcagcacccugugugggccggggacagcggccaccuuccggaccggaggacaggugcccacccggcuggggaggcggccuaagccacagcagcagcggucgccaucuuggucccgagacuccaaggaaccuaggaauuuagucugcuuaggugagaguuuguaccaccugggaacugccaaagcaacacagugucugagaaagguccuguuuugggccuucuucuucggccaggaggagguccaaauacaagauaucugcgcaccuucccuguaagagagcuugccagcagagagugcucugagcacugaaacucagaggagagaaucugucucccaggucugcugauagacgguaacagaaucaccagaagaacaaucucuaaacagagucaacuauaacuacuaacuccagagauuaccagauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagacggaagagagaaucucaggugcagaagauuccauagagaacaucggcacaacaaucaaagaaaauggaaaaugcaaaaagauccuaacucaaaauauccaggaaauccaggacacaauaagaagaccaaacguacggauaauaggaguggaugaaaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcauuaucucuccacgaauccagcccuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaacuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcgccucacacaauaauagugggagacuucaacacaccacuuucaccaauggacagaucauggaaacagaaacuaaacagggacacacugaaacuaacagaagugaugaaacaaauggaucugacagauaucuacagaacauuuuauccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauuaauagucucccagccaaaaaaagcccaggaccagacggguuuagugcagaguucuaucagaccuucaaagaagaucuaacuccaguucugcacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauccuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcugcauauaaaauuaacucaaacaagucaauggccuuucucuacacaaagaauaaacaggcugagaaagaaauuagggaaacaacacccuucucaauagccacaaauaauauaaaauaucucggcgugacucuaacaaaggaagugaaagaucuguaugauaaaaacuucaagucccugaagaaagaaauuaaagaagaucucagaagauggaaagaucucccaugcucauggauuggcaggaccaacauuguaaaaauggcuaucuugccaaaagcaaucuacagauucaaugcaauccccaucaaaauuccaacucaauucuucaacgaauuggaaggagcaauuugcaaauuuguuuggaauaacaaaaaaccuaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaucuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaaugaaaaaaaaaaaaaaaaaaaaaacaaaagacagcacucugaaugacccucuccagaccuguuuauaaucaaagcguauuaaguguccuuaauaagauuaaaaauguguucaguaccaccuuuugauucauuuucuaucuaagauguguuaaccaaguucagugcuucacuaauuacuacaggaauaccccuaucuugcuaugauggaagcacuugaagauuuuguuaagcauuuaaaauacagcuuaguaguagaaugcuugccuagcauguucaaaguccugcucaaucccuagcacggcaaggggaaacaacucacauuucagagaauaaauuaucuuauuuuuaaagcuguagaguguguguguguguguguguguguguguguguguguguguguguaugugugcacgcgcgcacacucacgcacaugcacacacgcacacacacaccuguugaguuucaaagagggcaaaugauccccuggaaugggguaauaggcauuugugagcucccagaaauuggugcagguaacuaaacucagucuucugaaagaaaagcaagcgcuuagccacuaagucuucuccucaggcccucagaacguaugacauuuuaauguuucagaagucucagcugauuauugauagaugauaaugaugaugagaugacauuggcuauaauaggaaagauagauuaaauaaauuaacuccagaauauugaaagagaaaacuuuuuaaaguaaaugauguacuaauuuuagaaagucugauaugcacaugucuccuguugagauggaguauugacuuuuuauaaccugauuaagauugacagaagaaaagguaaaaaaaaaaaaaaaaaaaccacuagcuguccaggaacccuuuuuuacuaaggaaaagaaagacaacuuaaccuuuucagucuagguuauaaacuaguuucagaacacacaauacagaagucucuugaaauguaucucagugauuauguguguugcgauccccuaaagagcaaauuugggucagguucuuggauuucacuucaggucuacacaaucuaaacuuaguggaggauggggauggaggccugggauucuauacuuuuaauauucauauguagugauucugaucaagaauguauaacacucaccuacaaagucucucaguuuuagcauccuaucaauuucauucauuauuaaucauauaagauuuagccugucccuuccugguuggucuccaaaacaggcccaauuagaaugaaaucauacuguggcuucaagaaguguguaauaauacaguuugaauguggagucccuaaaauuucagguauugcucguaagaugacaucaucauauggcaggacucuaagauuuaauuaggccaugagaguaccuuccuuauaaaugcgauuaaguccauauaaaagggucuugguaaaacagucuguucuccuucccuucuucuuucuaccuuccagcacacaguauuccuucuggaggaugcacuaauaaggcaccaucuuggaaaugagugcaaugcucaccagucaucuuaacauuaauuuugccuuuucagcuuccagaacuaugagaaaaugaaguucugugcuuuauaaauuacucagguuuaagugcuuuguguuagcagaaaaaaaaaaacuugacuaaaaucguuuagauuauucucuuaacacggagauauuucuuaggggccuacugugugcuaggaccaggucuaggcacuaguuauaaaaaaauuggaugagcugugcuccuucccucaaaaggcuucugagucauuuccugugaaucagcuaguacaauccaguaucuuugcaaugaaauagaaaaugaauuaaauucaauucagucuaugucgagugaaaaguauccaauaaauuuauaggguuugcuauuagaaaaaaaaguuuguaguaguaauccuuggagagucacuacaauaauguauguagccuuugugucucacuguuagcaaauuguuucuagcugugaucccuguaaucugcaggugcuguuuaccauguaauuuuaccauaagaaacaagaauguaaucacauaauaaaguguaaagaauuagauuuucuuccccuugagcaaaaugccugacuguggccaacauuccuggugcucucuccuugugcaauaggaaagcaauaugcugaaagagaagacuauuuuguucauauucuacaacgugccucuggagaccauacuaaugaaugcagaacuaaagcuagaauucaggauucuugugugagaagcuacugauggguuuuuuuugucuuuaucauuauucuauauagaauauaguuucccuccugccuuuaauugaggcucaaauagggcacugugaauagggaaacauuuugauuaaaacguguuuuguguuguuuucuuucguuguuugagaaaauaugacauauucaaagaauuuucauguucaagcaaucccuuucuaaugaauacuugacuuaugaauauccuauacuaucaacagcuucucuuugagggacuuugagauacuccuacaccuguggaaauuggaauuguuucuguugauugcauaaauuugucucucccccagcacuccuguuuuggaagguugaauucuuguaagcugucaucagacacuuuggaacaagugugaacaacuuuaauaugugaaugacuucucuuucugccaccaccaggauauaagaacgcacaaaauuccauaccagaccucacauagaaguugugcuuaagaggaaacccaaagcacaugaagccaugucugggaguguaguuggcaaugguaaagaggugcuccacuuacauuuggaguccuuuaucccagaaauaccauuguacuuuaauaacauacccuucuagaauuuggguauagacagacucauauugcagccacaauugaagcaguaagcaaauggucucuaauacagucaaugugcaucuuaugaaagcacuauucaaaacuacacugcuucuuguuuauuguuuuuacaugagcuuaaucgguuuuuaauuagaugauaugccuguagccacaaauuugaaggaucuagagaauacauucuaggugggugacuugaaaucuaguaguugacaacaaggugacaguagaaaagaaaguuaagaacucaaaaaacagucauaaugaauguuucauaucuaucaugaaugaauaaaauaaaaauuacugacauuaccaaguauuagugaagauggaaaacaccaagacucacauacauugauggugggcacauacagugcugcaaucacucuagaaagcaguuuaguaccuaucacauaacccugagggccaacucuuagaugucuuuccaggaaaaaugaagauguaucugcacaaaacuuacacauaaauguucacaacuagaaguaaccgagauguacaucaguaagaggaugcacuuaaagagugauaacccuaugcugcaaacucggggauauuuuaauaucuuggaaagagggguugaaagaacaugugaguucuggaaaacacuuuucuggagaagacauggauauaacacucaugaacucauagcaucugcaguuaccuacauaggaucuauaugacacaggacccauuaacauuccagcauggaugagggagggccauagauaaccuuaggagcuauugguaguucauggcuacuggaugagaaggagucuuuuuuguucaggguuuagccacugguaagaaggccaaacuccauuaguaacaccacacccauguacaugcaggcaaccccaaugaaacucaaaagaguuaaaaagagaaauaagaaaaagaaauacauaacacuaggaauaggacauguggggaaaagcuuuagaaagaauaggaaggcaauaagagaaagaaaugggguaaauagaauggaaauacauuauauacauguaugaaguugucaaagaaaaacuuuuaaaaauucaaaggacagagucuuaugauaaaauacuacuaauuacuaaaaacuaauggaaugcuuauacauauaacaggaauuaaugucauaggcauacugaaugaaaaauuaugcauaugcauaugugaaaguuuauucuaggaugggagaaaccaaacugugacaauagaaaucagaacugaagucaacuuggggcagaagauacuagagaaugacuaaaaggggcaaaaaggaaacuugucuagucauggaaaugaucuauauuuugaguugaguagagauuauaaggauuguacauuugucaaaucucuugcuuuaaaauaacauuuuuuauuauagguaaaauauaucuccauuuucacauggcaagaauuuuaaggaagaaaaaaaacccuucaccugacccccuccuguugauuuggcauaaauuccuuaaccugauccaaucccauaacgccccccuguucaucucucaccauuccucucuaccuccuauucuaaguuacaaguaguuuuacaaacuguguuuguuuuucuucuuggaauuucaauacaauguuccuuucaucuggaauuccuuuuccauuuguaauuaaucauuaaauccuuuccaucauucagggccuaugauguuacaucuucucuaagaagccucauuuauuagcaaucuguaguaggugcuucccucuugcucaccaggugaucucaagcuccuuuuuaacaaagcauguauuuauuuguaaugugauuauaauaacaaaagccccucaagauuguaguagacuggggucauuuaguuuacaagcaaauaagccuucacuuauucugcaaagccuugaaauaaaaguaaauucuauccaaaauagcucagguucuaguacucaaaguuauagaaauaauggauaaauaguuagguagauagauggagagauagauaaaaaaguacucaguguuaaaaauaauaaauaaauagguagauagaauaaaguacuguuauaaaaauuaaauaaauaaauguguagauagauggauggauggauagauagauagauagauagauagauagauagauagauagauagauagauagauaacagcuuguucuaucccaagauuauuggcagucuuucugauucaggaguuugcuuugagucuuuauuuuguuuauuuauuugauuguuuguuuguuuuccagacccaguuuuauuaagaagcaccugacacuggguuuaugaucuucugucucagccugcagagugcugggauuaugaauaugggccaccacaccuggcaagaucaagaucuuacuuuaaaugccaguuugauuucauauuauuaguguuguauuagcucauuuauauggugguuuaaguaacauuucugugggcuuaaccagauuuuuuuuugauucuauggaaaaaauacauucucuauuacagucaagugaccccaaaauacuaaccaguugaaccaugcgaguaugcauguguggaugugugcacguggaagcuccccagugcugggauacguauaaauauacauauuuagaaggcaacuugacugcauguucauuuagcaaaacaucaaaauaguaagcuuccaucuagggccuaugauuuccccaauauggacuuuugagcacguuugcaguaucaagcaugcauuuccuccuacgagguaggccucaaauccaaucagaaaacaacauguugcccucagcuaaugcaccagugggcaaaucuugucugaauagucaguuuugcuacaugcaggguucuuagcuggauaagaccauugaugacuuuucucccuaaauagccuguauagcaucuuucaauacuacgaaagcuacuaccaagcaguaugcuucuagcuaaguuccaacuucauuucucuguguccucuaaccuagguguguucugucuucaacaacagggucauaccaucuacuucugauagguaauuaagagcaauuggcaauagccuguauuguuuuaggggagucuguggguucccuggagaauagccacuucauguggauaaauguaaauguuuugaaauguaacaugauuaauaauaugcagguuacauauauucauuuauucauugauacuuaauaaaagaaucuauucuccuagaugacugugcuuaagucuacuggauauaguuguuugauauaaacaaugaaucauaggaacuuaaagaaaguuuauauagacuguuaggguuuccauggggccagcccauuuuuuuuaacuaauaaaugcaccauacaugcagauucaggaauuacuauuuuuccagcuggcaauagaaugaaaaugcauucauuuuaauuuucaaaaucauuaagguauuuaaacauaguaauaucuaacuuuuauugaguauauauuauaugagauagguccugugaugguccaauaacugcuuuaggaguaaaaugcuauuuucaaaugaggaaauggaagcuuaagaaauuuguccauucuaaggaagaaugaaguauccacccuuuugucuuuguucuugauuuucuuguguuuugcaaauuguaucuuggguauucuagguuucugggcuaauauccacuuaucagugacugcauaucaagugacuucuuuugugauuggguuaccgcaccgcacuaaggaugauauccuccagauauauccauuugcccaagaauuucauaaauucauucuuuuucauagcugaguaguacuccauuguguaaauguaccacauuuucuguauccauuccucuguugagggacaucuggauucuuuccaacuucuggcuauuauaaauaaggcugcuaugaacauaguggagcauguguccuuauaaccaguaggagcuaagacgaaaggauggaccauccagagacuacccaacccggggauucaucccauaaucagccaccaaacccagacccuauugcauaugccagcaagauuuugcugaacggacccugauauagcugucucuugugaggcuaugccagugccuggcaaauacagaaguggaugcucacagucagcuauuggauggaacacagagcccccaauggagaagcuagagaaaguacccaaggagcugaagggaucugcaaaccuauagguggaacaacaauauaaacuaaccaguacccccagagcucaugucucuagcugcauauguaucaaaagauggccuagucagccaucacugggaagagaggccccuuggucuugcaaacuuuauaugccccaguacaggggaaugccagggccaagaagugggaguggguggguaggggagcuggguggggggaggguauagggaauuuucgggauagcauuugaaauguaaauaaagaaaauauaaaaaaaaagaaauaaaaagaaauuuguccaagguuacacagcaguaggguacaaaucuaaaccucugugcacuguuuaccuuaugcgcaucuucucaccucaaguauauacuuaaugaagcuaugguuaucauuagugaaaccagacccauucacauagcaaacauauaagcaaugauuagaagauagcagagggccaaauaucaaaaugaguacuuuuuauacaagauuuauuuuauucagauacauuaucuuauaaaaacauuaguaguugaaugagaauagguuuauguuuuccuuaaaaacugccaaacagaaugggaaaaauaaucaacuuuuguuuuucgcuaaaaugagucuucuagacuacauguucuggaguuugggaaaaggcagagaguuguuguauccuuuaccauaucuuaacucccauaagacaacugacauacugguacccuaguauuaugcucucugcucuagaaacaaguuaaaagcagagcauaaauaacaugacaaaaucagauguaugugauaaucaaauccaagggguaauagaaaauccaaggcuaauucuggauagcuaucaguaauguggaagaaaaauuagaaauuuauugcaaaucccagaaguuuguggacaaauguaaccuacgggacuucugauagugcuauucagagcaaaauagagaggcuucagauauuaaccaaaacuucauaccuacaugauaagaacagcggugauuaaagucauuugaaaaguagaaggaaagggaggcuuagacuuuagauauaugaaauguaauggaaagauggaauauguauugaaagcuaguugguugguuuuuuuauguaggauauagcuaacaaaggccaaccuuugauacaucuacuuguuaauuuuacagauggcccuccugaauuucuucuuuccugaugaaaaggcauauucugaagaggaaaguaggcguguucgccgcaauaagagaagcaaaaguggugaaggagcagaugguaagucuacucaagugaucuuuuuuccaugauauacuaauaaaaauauucuucauucucauguauuauccaaagaucauggauuucuccagccuaaccugauaaucaaucuuuuaacauagaacuaacaauagaaggauccuucauccucuaauuccagauaccuucagucuuuuucaguauguuuggaggccaugcuagcauuuaugucccucaagguuacucucaacaaggaccuccucucuccuggggacauaccauaucagcuauguccaccaagauaauuugauccuauuuuuguaacugauaguguuuucccaugcuggcaauuuauaguauguauuguuuccaaugauaauuauaacaguuuugguaucuguuacuauguccaaaucuaaaccaaagcauguaacauuacucuggaaguuccuugaggacaaagaucccuuccccuuacauaacccuauaauauggccuaguauuugucucaccgguaguaucguaauguaacuugacaguguuuacugucccuuuggcuaggcagugauucaccaaggaaaaccauucccauuauggguguaauagcuuugaguuaacuaguaguacauucaggggaugacaaaauguugugggagcuccugggcagggacuuugaaucgcuguauuucaguguuacucugucaguugacagaaugcuaccccuuuggcacagagguuuauaggauacauagcucugggcuguugaaaagccaucuggauucaaagacaaugugucuggcuacaucugcugaugauaugugucuguaggggcuuacaaagcaauaugauuuuauaaagaugaaaaugagauuuuuaagcugacauuugucagugugaguaagggccaaugauggaagcaguuccagaaaguggaaacaauugaagaaauggaacuaguacugccuuagaguuaaggauaaagggugccaggggauugugaaaucgucuaagauacuuaaccuuucaccugggaggcuauagaagcauuucuuuagaugugaugagugucucaaugaguuaaaagguagcaaagcaauccaacuuuccuuuuggaaagcuauucauguuauuuugcuggcuauggacaguguuugucaaaugcauucuaaaaauauuuacugaguaaacagauccaauuuauaucacaguaggauagaaaaacuagaagaagaucuguauuuguuuaguuaauguuuauauucuuaccauguagacaaggacaugguacaugacagacuucagugaauauuucugguuccccauggggacuucauuucuagugcagagauaaacagaaaacaaagguuguggugguaagggcuguaaagaaagauacagcaaagaaacagugaaagggguaauggaguauacugaacagugauggggugggggucuuugugaaaaggggguggcugaggacagcccugagugaaaugaagggaaagcaaacggaagaaagcaaccaaaaguuuuuuuuuuuuaaaaaacccucugaaacagagaaugcaugauauguuucaggaaaaucagugugacugggaucauaggaagagaaagaaaggagaugagggcagacaguaaaacucauucuacagccuuguaagccaaaggaaagguccuagugucuuauucugcauggacuggggaacuauauuagaugaguuugaguagaugaaugacaguauuugacuuacauuuuaacagacuccuucugacuucucuaaugaaaaaacagggagacucaaaggggguaauauccaggcaagagaugauaauagcuuagaauaggguggaagcaguauaguuaguaggaagugcuaugacucuagaaagauuuugaaggaauggcugauaagacuuagggaucuauaaaaggauaugaagaugacagacaagagccaagagugaccucgagaguuugggauauaaagaacuaaauggcuugaauugcuauuucugagauggagaaggaaagggagacguguagagaugugugaggaaagaguuaugaauuuagaaaucagauuugugaaaggaggauauagauagaagaggggguaucagugaugaauagaguucaaguuuaugacauauuugaauuugucuuucugaagcuaaugacuauguacaaugacuauauauuaguauuuuaauuaaaaauaccaaaacauaaaagaauuuaacuagaccuguuaaauuugagaugcccauuuagauagccaaagagauauaauucaacaucacuaucucaagauaaugagcgaguucuguuuuauacaaauaaugaaguuccuaauaaagaguaagccuauuaguaauuaauuuuaagucuaucguuauuugauauuauaaugcaaguuuagauuaucuaucucaaguuugccucacaagugucaaagaaaaagcgauuugguguucgaaccugccuccuggcagaaguugugauccacucacagaggacaugguacuaccagaagauccugcaauaccucuccugggcauauauccagaagauguuccaacuaguaagaaagaaacaugcuccacuauuuucauagcagccuuauuuauaauaaccagaagcuggaaagaacccagaugccccucaacagaggaacagauacaaaaaaaagugguacauuuacacaauggaauacuacucagcuauuaaaaagacugaauuuaugaaauuccucggcaaauaguuggaccuggagggcauuaugcugagugagguaacccaaucacaaaagaacucaaaugauauguacucacugauaaguggauauuagcccagaaacuuagaauacccaagauauaaguuacaauuugcaaaacacaugaaacucaagaagaacgaagaccaaaguguggacacuuugccccuucuuagaauugggaaaaaaacacccauggaaggaguuacagagacaaaguuuggagcugagacaaaaggauggaccaucuagagacugccauauccagggauccaucccauaaucagccuccaaaugcugacaccauugcauacacuagcacgauuuugcugaaaggucccugauauagcuaucucuugugagacuacgcuggggccuagcaaacacauaaguggaugcucacagucagcuguuggauggaucacagggcccccaauggaggagcuagagaaaguauccaaggagcuaaagggaucugcaacccuauagguggaacaacauuaugaacuaaccaguaccccagagcucuugacuccagcugcauauuuaucaaaagauggccuagucggccaucacuggaaagagaggccccauuggacuugcaaacuuuauaugccccaguacaggggaacgccagggccaaaaagugggaguggauggguaggggagugggggggaggguaugggggacuuuugggauaguauuggaaauguaaaugaggaaaauaccuaauuaaaaauuuaaaaaagaaaaaagaaaagaaaagacugcuaaaaaaaagaaaagaaaaagugauuugccuuaaauaguuaaaaauuuauuuuuaaaaaacaaaacauuuuucaaagaucaaaaacaggacuaagggccagcaugauggcucaacaaguaaaggucuuacugcaagacugacaaccugaguucaacuccucaaauccacauggcagaaggcaagcaccugcucuugcaagcuguucucugaccucuacuugcaucauagcaggcacaugcauacagcacacacacacagacaugaacacaggaaugcaugcauagauguacagacacuaaaaaaacagaaacucauuuaaaacauagcagaaaaacaguucuaaauuucuauuaguuuuguaaucuauugauauccucagauuggauuucaauucccaaacuauuuuacuguuuguuauuuagugagccuucuacauacaauugaaaggaguaaaccaugaaccaggccucagagaaguuuacagagaagcucugguaaaggggcugguagauuuauaggcaagaggugagggugaagcacauauauaguaaugugguagauuccuagaguaucauauaauauguugauaacauuucuccucaaaagagagaaucucagcuaggaaaauauuuccauaaccuugaccuguaugcaagucucugggguacuauugcugaugugggagggcccaguucacugugggcagugccaugccugggcugguguuccugauuguugagcaagccauucuuucauggccucugcuccaguuccuaccuucagguuccuguacugaauuccugaccugacuucacucaguuaauggacugugaccugaaguaaacccuuucuuacccaaguuguuuuuagucauuuauguuuuauuacagcaauagaaaccauaacuaagggacugacuuuccuguuccauuggucuuuuauacuagaugauuagaauuauaacauaagcaaucccuguuuuaucuucaaaacaaaagcagggccaucaagauagcugaaaggguaaaggcacuugucaacaagucugaugaccugaguucaauguucugaggcaacauuugguagaagagaacugacuccugauauuuguuggcugcccuucacacaugguacacauguauacacacaugcacacaugcauacccaugcacauacacacacacacacacaaauaaauucugggcuuggagagcuggcucaacaauuaagagcauuugcugcucuuacaugaguaccuagauucaauuccaaguacccacaaugagcaacucacaaccauguauaauucauauuucagacaaucugauaccuucuucuggccucugagggcauuuccauccaugcaguccauuacauauacacagguacacauagauauacauaaaauuaaauaauuagcauaauaaauguuagcuuuuucuuuaaaaagauaguagcuaucuccaagauguaucaguuuuuucuaaccugcaauuuaagaaugacuacauucuccacuuucucaguucugagugcucuguaagugggggauugacucguaaauaguaguuacaaacacaacguuacuuuccccaauauaaaucuuauaauguuauuguuauaacaacucuuaaaaugaauuucuuuuuguuuuuauauuuuacauguauagaugcuuuuccugcaugucugucuguguaccauuuguguacaguacacauggaaaccagaaguggagucagguccccugaaauuggcauuacacaugguuauuauaugccauguaggugcuaggaauuaaacccacaucaucaugaguagcaagugcugagccagcuuccaagaccauagauuaauuuuuuucuguucuacauagcuauauaucugcauuaaauuuauguguuuugauggccagaaauuuuuuaguaguuucugaauucauuucugcuaauuaacgaggcuuuuggguuacuaucauuguuucauuucauaguguuugcugaggcacaauacauaagcaaucugugucaaaauuuccugauaaaguuuguacucugaagucauaauugcuccaggggccaucucuuauaggcuacaacauggacuguggaauggauucaggagcucaugagggaaaaagugcagugugguauaaaagaaaagguacuugagcaaguuacagucuaaggauuacaaauccuaauauccccauauauuagcugucaugugaucuuggagaagucacaucccucugagcuuuccuuuucuuguugguauaauagagacggugagccuggcuuaagacaugaaguuacuguauugauccaaagugccaguagauuuuuaaaaaggaaaaaaauuguaaauuacuaaauguuauuacucaguucucucaaacauugucauuaucuuauagacaaacauuauaacucagcagugauguuauauuucagcaaaauucuuucuucucauugguacuguucaguaggguagcacauagcagccauagggagaaaacucuagaccucauauucugaccuacuucaucacaacaaagauugaucacaacugcauauuuuguccaugacaguuccuugcucuaucugcuuggcuuugucuaucuaccuauuuguuuaucauacccauauaugauaaagacauagagauagaaauauguguguauguguguguaucuugggauuuuucuucuuugauaauuacuuuugaacagauaaaagaaguuaguauccuuuucuacuauuauaaauguguaaaaaugaugauaaauuaagauuaaaauguaucuuuuguuuuuaauuucuuaaaaauaagaaugauuuaggauauagccaccauuccguugauacaacugaucauaaaaggcuauggcaucaaagaaaacagauguuuuguuuguaaaugguuagcuagaauuaaaaucgccuuuaugcugguauugcuacuauauuuauugcuuuucagugccccaucacugagcuagugucaaaugagaaagacuagaaucauuucaauaacugauaggauuucagaggcuuauucacaagaugaaauuuaagcuuuugaaagcuuaccaugugugcacuugaagaagauucuugauuucaguuguagaauccccaagguugccugcuguuuguggcugccaacagcuuaagggcccgcaguauaacacucuagaaaguggcuuuauaucaaauaaaacauuaaacaagccaaaauaucuuagcuuguucauacuccaacauagccuuuaaagcuauauuuucuuugauagaacuagccccacaguaaaugaucucaauaggccaucaacauugacacuugguuaacaagcauuuuucgaauaacaacuauuuuagacuauccaguaagacauauuucuaggcucuguaguugguauagcuacaaaacuccuauucuuauuauauauaaacuaaauugaauugaauauaagagguuaaaguuugucucauaagacaaauauauauauauauuuguuuucuguuuguuuauaguucuuaacuuuuauauugaugcaugaaaucacguacauacaugggaaaguaaaaauaaauguugaagaauguaaagagggcuaacaguagcggagagaaggaagagaaagaggaguaggagagcauggugggcagaacuugcucaacauauaguggauauucauccacaacccuugaaaguaaauuuauaaaaguagaagcuguuuaaaaauauuuauuggguuaauucuaggcuauguggagaacugaacccaggucuugcaugugcuagacaaauauuccacgacugagcuacaucuguauuccauguucauagaguuuucacgguuauaaaaauaguacacguucguuguagaaaacaaaacauuacauguaaguaaccaagagccaggcuuuggugaggcaugccuguagugccagcuguuuuggaggcuauaauucaagucaggaguuuggaaccggccugaacaauagagcuaaacucuaucucagguaaacaaauaaauauuaauaagugguuuaagcaauacagaaucagguaaaguaagcugaauaugacauaccagccacagaaguacuauaaagauaauuguuuacuauuugccugaagaagacaacauacccagauauucugagauucucuaaagguccuuccagucuugcuuucacuauaacuguuuguuucucaauauuagggagccuugugaucacuaagccaagaaacuuggauucuaacccccaugccauuaauuguuuacuaguaacucuuauuucacucaucucaguuuauuauggaucaucucaguguaggaacuaguaguuccuacacugagaugucaagaguuucaaaaccauguaaggaguuuuucuucuaaguacaugcaauucuagaaauucuagucacuguacaccaugcugagaaaacucuagugggguagguacuguuccugaugaaaauuugucauaucccucaaauauauaguguuacaaaaaagaugcugaauuacuacaauagaaagucuaauuaucuccuuccaauucuaauacaauuucuaauacaacuucuaacuauuucugauuucuauaauauuguaauaacauccaggcuaguuuuaaccaauuagaugguaucugaaugauuaaauacucaggauuucuauuuggauggucaaugagccuuuucauuaguauccaugaagaggcucacuaaggcaugagagcaugcaaauggcuuuaagaagugaaggauaagaauguuaaugugucagcuaaguggugaaguguuccuguauggcuccucaaaaugucauaaacagauggagauguguaguuagaaaguaucuguuggcucacccugccuuacuuuagacauucuacaucuuaaccuucugggccucuuuggccugaaaaauuacagaacuucuacacuguguuguuuuuguuguugauggugaugguguuguuuuuauuuguuuuuuauucauuugaugcauccuuuauuaaguacaauguuuauuaaucauugcucuggauacuagggacauggugauggauaagauuagccccaagaucuccuucaccacauucauaauaaacgauuauauuguaguguacuaagugguacagugagguaagcauaagguguuauuaaguacacuggugccugaacuaaaccuaggaagucaggaaaguucuccuaacgaguguaacaucugagcuacaaucugaaaaguggcagagguagccaagagaagacuugagggaagagugaaccuaggagaaagaacgucagugcuaaaaagccuugaguaagcagggaacuugaaucauuuaaggaacuggaaagaugauguuggcuguggcugucacauguagcaucuauugugcugagauauguucccuccaauucuaccuucucugggacuuuuaucaugaagacauguuggauuuugucaaaggcuguuucugcacuuacuaagaugaucagguaguuuuugucuuuaaauucacuuacaugauuuauuauauuuauugaugcauauugaaccaucccugaaucucugggauaaacaacuugguuaugauagguagucuuuuugauaugugccuaugugcaguuuacaaguauguuauugaagauuuuuagaaugauguucaucagggauauuagccaguaguuuuuauucuuuguuguaucguucccuaauuuggauauuggacaaccuuugugggaguuugucacuagaagcaaccaguucucucucucucucucucucucucucucucucucucucucucucucucucucucucucucucucucucucucuccuccccccccucucucucagcagucauuggccuauuguagcuccucaucuagauguggaaccaugugaaauuuccucuguuggcauuuacaugucauuaugcuggucuuguugggacagccauauuguugagaguucauaacugcguuaccuagcaacaagugcccugggcucugccucuuacaauuuuuccagccaucucuuccaugauuuucccugagcuuuagguuuagggguugcauuacagauguaacagcugggguugggaaaccugcaguuacuuauucuaugaaauuuccaguuuauaugucuguaguagucuucauuaguugcaaaaggaaacuucuuugauaagaggcaagagcuauacuuauuuguggguauaaggauaggcauuuagaaaacaguaagaaacuauauugguuuaggaaacugguaggaauaaguucugaaucugugauuuuuuuccagcuaugaguaguuggcuaaguuuauauuacuaggcaugaacucccuuaugaugaacaggucuuaauccccaagauaaaaguuccacuguuuuaccauugugggcaguuuguaaguccagucauagugcuuuauaagcugcacagaugggugggaucauuauuugcuuuucuccauuggcagcuugcauaacaccucaauacuaugaaagcugcuucucaggcaaacggcuuuaaggucaguuuccgcuugauuccuccaaguccaaguuuaaagugugucuuuucuuuaguaauuuggccuuagcuucaaauucugagagucaagcaagaaaaauggcaauaacuuauauuguuuggguggacuucuuagacuagacacaugcacauacaagcaaagcuaaaugcacucaacaggauauauaaaugugcauauauacauauauacauacauucauauguguacauauguagugauaguaaagaagagaucauaaaucugaaggggaggagcugaaggggagaagagggaacaggagugauguacguguaaugcuuguguauaaaauuaccaaaaauuaaaccagcccuaucucuuuaaaagggaauaggaaguuugugugaguacaguauagauccaaaggggaagugaugauaaaugagcugucugauaugacuagaucauucaggacucuggaauccauuuuauggagcucagaaacuccuaaaggcaauggagaaucacaugaucaaugccaagaauagauuauaugacuugugucuuuaaauacuaaaugcacauaaucugauccagcaggucuaauagaucuauuucuagauauacucacacauggaagaucauuucucaaaaaagaucgucuuugcuguacuauuuguaauaucauaggacugaaaaucaccuaaauguccauuacugagaagcugguuuaaaugugaaaaucugggacauaaagaguuucucaucgacaaaaggacagaccaucuagagacugccauauccagggauccagcccauaauuagccuccaaacgaugacaccauugcauacacuagcaagauuuugcugaaaggacccagauauagcugucuguugugagacuaugccggggccuagcaaauacuuaaguggaugcucacagucagcuauuggauggaucacagggcccccaauggaggagcuagagaaaguacccaaggagcuaaagggaucugcagcccuauaaguggaacaacauuaugaacuaaccaguaccccggagcucaugacucuagcugcauauguaucaaaagauggccuagucggccaucacuggaaauagaggcccauuggacuugcaaacuuuauaugcccccauacaggggaacgccagggccaaaaagugggaguggguggguaggggagugggugggaggguaugggggacuuuugggauagcauuggaaauguaaaugaggaaaauaccuaauuuaaaaaaaagaaaaaagaguuucuuaucaagaaaaucaaguuuuugcaacacaugucagaggaagcuaacuuaauguccauuuuuuguaucuuuucauuuuuagcuuacauuucuaacaaauuuaaaauaaauaauaaauaaaauuucaauuuaaaaauaaaacaugcauagcaugccacuuuucuccccagaacuaaacagucuggcaacauuaucauaacauaauaacauauacuaauuaagaaauagaaagcauguuuugguagagaaaauauagguugcuucaaucacuuuguauauuaaucaaauuaaauaucagaauacuuuuggccuagaacucaugguuaggugcauccuacaaaaaugggaauacuaguacacaggucuugaauacaaggauauugaagcaccaaaaggaggaaucauuuuaacaacuaaaauaaauuaguaaaugauuacauuaugauauauagccaugcuauuggcuguuggacaauuaugaaacuauauguagaucugaaggacugacaauguucuuucuacuacuggacuuuuuaaaagagcaaauuccagagugauguguauguuuccaucuucagaaaaaaaagggggggaggaucuuuuaauccaucaaaauguuugcacaaaaacagucauagaaagaagcaacaucaaacaaaauacugauaauuucagauugaaaggguuugaguagaaauggaauagacugugaaguuacuauuuauguaguucuguguuauuucaauuacaaugagcauaaauacuacaaugcuauggaaaauuaauuaaaaauugauaaagaagggagaaaauggacugaaaugggcacaaacaaaacagagaaagcuauaucaccaccaaaaggaccgagggugaauaaauuagaagagcagagggcuggcaagauggcucagugguuaagagcgccgacugcucuuccaaagauccugaguucaaaucccagcaaccacaugguggcucacaaccauccguaaugaaaucugaugcccaaaaaaaaaaaaaaagagagcagaaauggagacuagcaggcagauuacuuaguaauuggaaacauuaaagauugguugugugauugaaagaagacaaugaugucaaggaagccagguuucuggcaagcuguuguaguguucagugagauagugaucaagggaagaauaugugugguuuuagacagguuggagcuacaggcaccuuugggaaauuaaagagacaacuauaagcagucugagauaugcaucuuaagcucaggaaauauaugcaggcugaaagcauagauauagagauccuuaguauuaggacuccauuaguuccaagugaguguuggucuaaacugguguguauguguguguguguguguguguguguguguguguguguguguguauacauauauauauaugaaauaaaggaggguuuauugaagaccucaaugcagauagcuuugaacauuacuuaaccuuggggcauaggugaugucauuaggacuuuuucuucuaugccuccuuuagacauguuuuaucucuggaauagcaaaaauagcuguuagcagcucugacuuuaucuuaacaauuuaggaaacccaguggaaaguguaugcuucauccagcugaauucaaugagaaagauguugacaacauuggugacaaugguuuuaauagagaaguuggaacauaaagguucaggaugaaaccagaugaugaagaaaauacuaugguuacauagugcuuuucacauaguagguauuuaauaaauuucagguuauuauuuuguucuuucuuuuccauguauuucuagcaaaugaaguaccaaguucaaaggcuaaggauucccuguguuugcuucuuuuggacucuuaggggcuugaaauaaacaccaaugaaaaauauaacuacugaacagagaagaaaaacaagagccccaaacaaccaagggugcuuuuaaauacccauuauaauuuguuuaaaaaaaugguguuuuaaucccaaauuaccuugguauugucuuuaccucacuauuccuuuccucuauucuccauacacuugauauguaaacacuagcaaggugaagcaaaaauuuccauguuacuaaauagaagauuugagcuguguacaaugguuauuguuggcaacaguguucaccuuugaucuucuacgugccaaccuacagaaaagggaaauacgauuagagcuauucuauaauuuagaagcaacaguuaauccuacuucauuuguuguucaggacucucaacuuagaagagauagaucuuauauaauuuacauguucacaaacauagucagagcuuuugaaauggcaaaguacuaaggaagcuuugcuauagcuuucugaaucuugucugcauucuaccacuucuuuagugaccuagugcuguaauuuauuagggcaguuguuuauggguccaaccacacggaauucucuacauauuaagccaggggucuaaccagccugugcuuugucaagugguauucuagaagaaaguggcuucauacauaccuguucuccuuguagcaaaacaaaucaugggccuggccuggugccagaaagugcauagugcauagugucaucuuuacagaugaaauucugcacauuguuaucuuauauuuugcuagaagagcaggaagaaaacugacuugguaauuugcuacauucugauccuaaucugcuuagaaauaugacuucuuuaaaaggaaaugggaacagaauauguuucucaugauaaccucauaguaucuccugaaaggauguucaguuauuguaaauacagaaauuugauucucucuuugaauuucagauauauuucaucuuuuaaaaauaagcuacauugucaacacacagacauugcaaucacaaagucacagcaguugcagauaccuauacagggucugcauaagaauggacccaucaauagacugacauggauggaaaggagacuauggguggcccuagcccucacugaugaacuagaugcuacaaauaaauucaaggagaggaggaaucagugacuucaacuguguuccaucucaugauuccaauccaauggucacacaaagauaugguuaaacuaaaggauucccagaacaaaacaaaugguaucauuguaggaaaacugacaggauaggaacaaguuaaaucaggauagagggagaagauaaucgguaaucagaauaugcuuuacauguauauguaaagggcuuuguuggagcaccugggggagccaccuuggcuaccggaucccucugagacuagucuaugcaggugagagugugaacuacagaagcuaacaucuucugggauaggcagaagccacacagauucugaggcagaccccauuuugggcuccagacauucgggcagcuucccugccagaggagagguguccaccaugcccaggaggucuuugcuggagcaccugggggagccaccuuggcucccagaucccucugagacuagucugcgcaggugagaguguagacuacagaagcuaacagcuucugggacaggcccuguuuugggccuucaucuucugccaggaggcaggucugaacgccagauaucugugcaccuucccugcaagaggagagcuugacugcagagagugcucuaaccacugaaacucaggagagaucuagcuacacaggucugcuaauagaggcuaacauaaucacaggaggaacaagcucuaacgagagacaacuauaacaacuaacuccagagauuaccagauggugaaaggcaaacauaagaaucuuacuaacagaaacaaagaccacucaccaucaucagaacacagcacucccaccucgcccaguccugggcaccccaacacauccaaaaaccuaggccgggauuuaaaagcauaucucaugaugaugguagaggacaucaagaaggacuuuaauaacucacuuaaaaaaauacaggagaacacagcuaaagaguuacaaguccuuaaagaaaaacaggaaaacacaaccaaacagguagaaguccuuaaagaaaaacaggaaaacauauccaaauaggugauggaaaugaacaaaaccauacuagaccuaaaaagggaaguagacacaauaaagaaaacccaaagugaggcaacacuagagauagaaauccuaggaaagaaaucuggaaccauauauacgagcaucagcaacagaauacaagagauggaagagagaaucucaggugcagaauauuccauagagaacaucagcacaacaaagaaaaugcaaaaugcaaaaagauccuaacucaaaacauccaggaaauccaggacacaaugagaagaccaaaccuacggauaauaggaguagaugagaaugaagacuuucaacucaaagggccagcaaacaucuucaacaaaauuauagaagaaaacuucccaaaccuaaagaaagagaugcccaugaacauacaagaagccuacagaacuccaaauagacugggccagaaaagaaauuccuccugacacauaauaaucagaacaacaaaugcaauaaauaaagauagaauauuaaacacaguaagggagaagggucaaauaacauauaaaggcaggucuaucagaauuacaccagacuuuucaccagagacuaugaaagccagaagagccuggacagauguuauacagacacuaagagaacacaaaugcuacccaggcuacuauacccaaccaaacuuucaauuaccauagauggagaaaccaaaguauuccacaacaaaaccaaauucacacauuaucuuuccaugaauccagcccuucaaaggauaauaacagaaaaaaaaaacaauacaaggauggaagccaugcccuagaaaaagcaagaagguaauccuucaacaaaccuaaaagaagacagccacaaaaacagaaugccaacucuaacaacaaaaaauaacaggaagcaauaauuacuuuuccuuaauaucucuuaauauuaauggacucaauuccccaauaaaaagacauacacuaacagacuggcuacacaaagaggacccaacauuuugcugcuuacaggaaacccaucucagagaaaaagacaaauauugccucagaaugaaaggcuggaaaacaauuuuccaagcaaauggucugaagaaacaagcugaaguagccauucuaauauauaauaaaauugacuuccaaaccaaaguuaucaaaaaagacaaggaggggcacuucauacucaucaaagguaaaaucuuucaagaggaacucucaauucugaauaucuaugccccaaaugcaagggcagccacauucauuaaagaaacuuuaguaaagcucaaaccacacauugcaccucacacaauaauagugggagacuucaaaacaccacuuucaucaauagacagaucauggaaacagaaacuaaacagagacagagugaaacuaacagaaguuaugaaacaaauggauuuaacaaauaucuauagaaccuuuuauccuaaaacaaaaggauauaccuucuucucagcacuucaugguaccuucuucaaaauugaccauauaauuggucacaaaacaggccucaacagauacaaaaauauugaaauugucccaugcauccuaucagaucaccauggacuaaggcugaucuucaauaacaaaauaaauaauagaaagccaacauucacguggaaacugaacaacacucuucucaaugauaccuugaucaaggaaggaauaaagaaagaaauuaaagacuuuuuagaguuuaaugaaaaugaagccacaacauacacaaugaaaagauuucuaagagggaaacucauagcucugagugccuccaaaaagaaacuagagagagcacacacuagcaguuugacaacacaucuaaaagcucuagaaaaaaaggaagaaaauucacccaagaggaguagacugcaggaaauaaucaaacuuaggggcgaaaucaaccaaguggaaacaagaauaacuauucaaagaaucaaccaaaugaggagcugguucuuugagaaagucaacaagauagauaaacccuuagccagacucacuagagggcacagggacagcauccuaauuaacaaaauaagaaaugaaaagggacacauaacaacagauccugaagaaauccaaaauaugaucagauccuuuuacaaaaggcuauacucaacaaaacuggaaaaccuggaugaaauggacaaguuucuagacagacaccagguaccaaaguuauggggcaugauggggaaggaggugugggaugugaagcaguuagaggguggauggggaggagcagggaaaggaauauggaguguaaaaaaugaauuacaaauaaaauuagauuuaaaaaaaagaaaguggggaagagccuugagcacaugggcacagaggaaaauuuuccugaacagcacaugaauagcuuaugcucuaagaucaagaguugacaaaugggaccucauaaaauugcaaagcuucuguaaggcaaaggacacugucaauaggucaaaacagcaaccaacagauugggaaaagaucuuuaccaacccuaugucuauugaauagagggcuaauauccaauauauacaaagaacucaagaaguuaaacuccagagaaccaaauaacccuauuagaaaaugggguacagagguaagcaaggaauucucaacugaggaauaccaaauggcugagaagcaccuaaagaauuagucaucagggaaaugcaaaucaaaacaacccugagauuccaccucacaccagucagaauggcuaagaucaaaaauucgggugauagcagauguuggcgaggauguggagaaagaggaacacuccuccauugcuggugggauuugcaagcugguacagccacucuguaaaucaguuuggcaguucaucagaaaauuggauauaauacuaccagaggauccagcaauaccacuccuggacauauacccagaagaugcuccaacauguaauaaggacacaugcaccacuauguucauaacagccuuauuuauaauagccagaagcuggaaagaacccaguucuuuuaucauacuacaauaauaauguuguuaacaaauggcauaaccaaaggacaacacuguacaauauucacaauauuccuuuuucacuuuuaaacauaaaugaagaaauauauuacaguguauacuauuaugccauauuuacucucuccacuaacucccuuguuuguauugcuucucugagguauaggaugggacaacugaccuuuuauuggcauaauaaacaucuugaauaacauucccauacuucuggggguuuuaguacauuuuucuagucauugcccauaacuagacauacuuuuuauuccuguuccauaaaaccuaucagaaugccauuauagaaauaauauuauauguguuucaauuuuaaaguaaaucauuaaccuuuaacacauuuuuaguaagaaaguacaacacauuuuaauacuggaguuguaagucauuggagcaguaaacuggacuuugguuucucauuugagaauuagcauucacauugcagguuugcagcccaauucccaugaaaucuuaaacauguuuauuaaucucuuggcuucacuugccauaaaaugccaauaauguugauacuucgcuggcuaacugugguaaugaaauaaaaugguuuuugaagacugauuuucaaaaaccuguaaaaaucucaguucggauuccccauaugaaccugccuggucucuccuuggcuucagccuugaacugcuuuuauuuccuucugauccuauacgaacucuucagaaucauuuccuuagaggugauccaccuaauaggcccuaauucacaauguuuuuuuuccauuagaacuugcuaugugaagcccuaguucuuaagguauuuauuauugccuccauacucuuccacuuuaaugcacucugaaauagaaaaaaauagaauuuucuaucuuuuuaugcuccaaagucaaacucuucuuuucuccucccaguaccuccacauauaaucaaguagagaaagauggcuuaguaggccaccaagaacaaagaguuuuaaggauaugaaaacugucgcugggccaccccuggacagcacagaugggcauaugggacugggcugaccugaaagaccugagggucugacuggccugcacuaugcugguacgaggcuaaccugcugauucugcagagcugagaacugcuauggagagcaggugcuacggcugugcuguccaguuuacccucuucaaggaguauggcuguaagaauuguggccaagccuucuguaaggacucucuuagcuucaguguucugcuaccccagacuggcaacacauaacagaaagucugcaagcagugccacacaguccugaccagaggauccuccaagugaucgccaccucaguauaagaaguguguggcagccuuggaagacaagaagaagcccagcacuuccuagagccaaggccugacccacaaagacaaagacauugcugagugccuagcaggaauuuggccggaaaacaagcccaagucaguacccucacaagcagagauagaggcacagcuagccacgcugaaggaugaaguccagggccccauuccuaccacacaggagauggaggaucagcuugcagcauugcagggcacaguccugcuucuucacacuuugaggcuggcacaccaggcaccagauaucaggacccaaggccagcagaugcagaaucugcuaacacaguugacagcugagguggauauugaugaaagcuggcaaccaagagccucagcccccucccccuccauaaugaccuuaacaagggagcuacaagaaaucagcacacaaauucccaggggcaggccacccggucucuggaggaagagaagaacaagcugcuagcugaggcagcaguugagcuacaggaggagaacaaccaggcaggaauagauccuggcucuugccaaaagauugguuauguacaacagagugacccuccaggacgaucaacacccaaacagugaugaggaugaagagacagccauccagagagucauacagcagcucacugaagaagcugcccuggaugggacaaguggcuuuaacauuccugaggaaccagcuccaggaucccaggcccaacccugcaaggcagagacugaggguccccaggcugaggaagaacuccccuggugcuguaucuguaaugaggaugcuacucugcacggugcuggcugugauggagaccucuacugugcucagggcuucuggaagggccaagauaacuuugaucuuaaagaacaucagacuucucccuaccacccccaaccaccuugccaagaacacugaggauaaccuaaugaucuccugagguggcagugccacagcaaccagcagccugggaagaaaccuggggccaagucucagagcauccagggggacagcaaacccugcucuacugauggcaaacacaccccuuugugagcuacccagucccuggaaggaagaaagauaauaacgcugagagggggcuggugaaaggaagagucagggugcucuucuaagaggcuggccucaaacagagacagauggagaagagaccagacugaagccaagaauaauaccugaaaucugcuucccaggcacaacccuggccuauaguggagcuaauaaaauguguugaaaaaaaggagaugaaaacuaaauauaaaacguugagacaagauuccagcuuuuguuuuaaaugauugguucccaaggguuuauugcauuuuuuaaacuaacuacuacauauaagccagugugaauuaagaucuuuaaauauaaaauauaucccaugcuuaaacccccccaaagcaauguaaacuaucuaauuaauauaucuacauugauuccauaguuaaaugaauguauuuuaaauauaugcugcucaguaaaaagaaaguaugaaaacuucaacuguguguguauauauuguauuuauguauagugcauacauacauguguauucagguuuacaugcccaaguagggacaagaaaaggauuuugaauguuuuguucugugacauuccuccaccuuauuccuuucagacaagaucuccacugaaccagagcuaugcaagcagcuagaaaauccccagaaaucuucuugucuccagcuuucucacauagaguguugggguugcaagcgcacucagccacacacagcuuuuuuauaugggaucugaacuugggucaucagucaccucaaaucugauuuuuauuuacuaacaaaauuauuuaagguauuauauaaaauuacugcuagauacugugaauaaagcuuaugugaaauauaauugaauauuauauuuagacuucuguccauucccaacuuuauuauauauaugaagauguuccacaaucugaaggaaaagaggauccaaaaugugaagccauucuagucccuacauauuuuggauaaagaauaucaaaucuuuauaacaauucuguaacacugcucuuuguauguauacacugauauuuuuggcuaaaaucuauuuaguuuauauuugaggacuuaguaacucuaauguacuuuaucuggggccuucugaagccuugauugaaacuuuuaaugacuacaauagcaauaugugcuucuucuaaaacagaauucagcauuagaaaagcguguauuauaacacaaggaaaucaucaacccagucucagcuccuacacacugucaauauuaacaauuaaaugaguuuucuagauauauucacucuaaggucuuagaauuggaguguuaacauuuuugcuauuccuucucacuuuaucugauacuauacaugcaauggaaagcuguaagucuaugugugaucaaucauagagauaaagcagugguuuguaccacuagaauagaauacucuauuguucguuuggauuuauuuuccugaccguaucuucucuccccucagcaaaagacaugccauuuggcuuguauuuaugcuaaaaguacagugaauccaaaucaauguugcaagauuuucuuaauacccuuugggggaaaaaaaucagagaccuagaggcauacuauaaaaccagaacuaaaaaucacuguuuuaguguauugaucuccaacaaaguaccugaucauuucucccaguggguaugaaacaggcuucugaggggagcauaaugauuuggaaacaucacauguauccauuucaccuucagucauaggcuucucucuauucuuaggaaucugcuuaacagggguaguuuagaagggagagaaaagaaucuaaaugugaguuugggacuaugugcugcaucuugacauuuuucuuuccaaaauucccagagcucuauacaaaaaacauuaacagaaaaacagcucaguaccacaggcauuacagaagcuauuuucuuugugcaugcuacugacugacaaauuaaaggauuuuugcauacuuuuucuuuacuagauaccaaauaguuauauuucccuuuucuuuccaauuaagccaagucaucuauucaacaucauauucucagaaaucacaaaaauggauuuuacaauuuuaaaccuauuuuuauguauauggguauuucggacugcaucuauggcuauguacuauguuuacacggugcucauggaagccaagaaggcaucggauccugccuugaaucccuggaacuggauccaauucaagccucuuaaccacugagccaucucuccagccccuaaaauggguuuuuaaucauaugcuauaugaucccagucccagcaauaguugagaccuaaaagaaaaauaaauuuaaaaaaauuucuuauugcuauucuaaugaguuucucuucccuuucccuuuagaaaaaaauggcacacuuaaaguagaaauuuguaccauggcuuuucucuaaccuaacccuauuuacucagcacuuccaguuuauuuuuguuauauauauguguguguguguguguguguguguguguguguguguguguguguguaaguacuauaauauacaggcuaagaaaggacuccuuagaauuucuauccauaaacuguuuuacaaauccuuccuggaaucaugguuauucacuguuauaugugaucccauguaagaaugcuaggcuuguuccaaaacaacaaaaagauaaguuggaauuagauaccaaaaaucacuuucaauaauuuuagauauaguaguaauuauguauuucuaugauuucaguuuauuuuugcuauauaaaauuacuggauuuaugaagcaccaugugaucaugucuauuaaacagaaugauuguuacacagaacaguuagguaaaaauauaucuagaaugcauaucuaauuuagccauuaauuggccgugaugcuuagaucaacccagguuaauguugaaagcacaggaaggaaauggccuaacucuagucuaacaaccauaaagauauuaucaagauuaauacaucaggaauauauuggauuauagaguacuugcuuagcauauggggaacccuuuguucaaucccuuuuccuauagaaaaugggaaaaguauaaagaguugccagaaaaugcuuugaauauuaaacauuauguacacauacggcucuucagauaugauuacauuuucagcuucaacauucaaaagaauauucauuuccuguucacuucccuuguacugugaagauaugaccacaagguccucugagcuugucaguauaguuagaaaugccagccuuuguacaaagauauauuuuauuugagaaaaagaauauuguaucacauuaucucuuauaaaaauuaaaauagaacauuuuguuaaaacgacuagacaaauagaaaugcuauauuauauguggcaaaauuucuagguaccugaauaauacuuugcuuacugaaauauaaugaggauuaugauaguuguuuccuuuuuugucuuuuuaaauuaauuaauacaugcucucacccagcauggcaugauguuuuggucuagauguguauuauacagagauuucauugagauaauuaaacauaucccaccaacuuaagauuuugauggugaaaauguuaaauguccauuuuaacaacuuuaaaauauauauuacauuauuauccauugugguuacuauauaauauaauaaccaaaauguauuuccccacuauaaucaagacuuuuuuaauuagguauuuucuucauuuacauuuccaaugcuaucccaaaagucccccauacccucccccacccacuccccuacccacucacuuccacuucuuggcccuggcauuccccuguacuggggcauauaaaguuugcaagaccaaggggccucucuuuccagugauggccgacuaggccaucuuuugauauauaugcagcuagagacacagcucugggggguacugguuaguugaugcucacagucagcuauuggauggaucacaggacccccaauggaggagcaagagaaaguacccaaggagcuaaagggaucugcaacccuauagguggaacaacaauauaaucaagacuuuuuaaaacuaaguuucugauucauuuuuugauuugugugcgcguguguuuguguguguguaugugcacacaugcacacauguacaaacaccacuguacagguauggauuucagaggauuacuugcagggaguugauucucuucuccuaucaggcggguacuacagaucaaacucagguccugaagcuuggcagaaagugucuuugccugagucaccuuacuaacccuaaacugaaaaguuuauagccuuuguucacuaucuuuccuuuuucauaucucccucuugggugaagaagguacccaucuaccucuugcaaccccuuuuccucuauguuuuuaugaauuccacuguuuauacucagauuguacaguguucaccucucuguaccuggucuaugucaugucacuuagcauaaugaccuagggaaaauaccuauauauaacuuuugaaaaaaaacuuuguuuacauauguguguguguguguguguguguguguguguguguguguuaacccucauuauauauggucacuacaugcaugccuggugcucacagaaguuagagggcaucagaucccccuagcacuggaguaaugaauggcuguaagccaacaagugggugcugggaaaacaacccaggccuucugcagaaacaauauguuuucuuaacugagccaucucucaaacccccagaauuucuuuucuaaagcuguauaguuugaguuuaucucugucugucugucugucugucugucugucugucugucucucucucucucucucucucucucugugucucuguggggggaggucacacagggacauuagaggucagguggggugggagcuggaggcauccacauggagacagggugggguggggaggaagugugagauguggagcagugggaggguggauggugcaggaaauggaauauggagcauaaaaaauaaauuaaaaauaacauagcaauuccuuugaauauguaaccagaaguagaauucuuaggccauacaguaaauucuauuuguaggguuuuuuuuuuuaagcuuccauacuauuucccaaaauguccauaccaguuuauaaucuuacgaaaaacauguaaggguucuuuuauucucauuuucucuuguuugccagcauuuaucauguauuauuauguuuauaaaagcaacccugcaguaguuugugauugcaguuuuuauuuucacugucuucauagagacacugaauauuguucauguacuuguccacuuguagcuuucuauuaaggaauguuuauucaaauucuggccuuacuuugaauuggguuguuuuguuguuguugaguccuucuagacuuuacccucuuccuagcuaugugguagguugucccugcucucuauuguuuccuuugcugagagaaguucucuauguccucacaaauacuuguucccauccuuuuuuauucuagccauccuggugaugugaagugugucucacuguagcuuuguuguuauuuuguuggguguauugugaugcugaggauggaagcagucuuguuggauguagggaagcacccuaccaacuggauacauccauagccucauuguagcucugauuuacauucuguaauaauuaugccaaucaccauuggccaauuguaucuuuggagaaauauaaagacaaggcacaauuaauaguaaacuaauuacaaauaaauauacaucagaaccucaacucauuuucaaaugaguuauuacuguuucuguggugacauaagaaagucuacgguauguuucucacuguaugauuugauguucaguaguaacucagaugguucucugauuuugugaugaauuuauagcucuguugcuucuugacaaaugugagccucacuuugccaucuuccuuucuauuucguuugccucccuguggaacuagauaguaugaacuugaaacaagaagucauuauuucaucgccaugacacuucuaugaggaccauuucuuucugucuuacacuuaacaaagaugaaacaauauuguagucauagagguauaucugugccuuaacaguuaaccaacauauauauggccucuuuaauaauuuauugaauuucaaguuuaggaguguaacucagugguugaaauguucacaaggccuugggauccaucuccaguacugcuaaacaauugauggaauuuugccuguagagucuauucuaugauguuagcugguaggcccuagcaaccugugcuuucucugaacagcuuaguuaucgaaugccuuggcaaaaggaucugcugauugcuuuaauauaccaaaucucugccaagacaaaacuguuacacauuuaaaucaaaaaccuuaucucucaaccaugaacuuauaucacuuuuaaguaauguuaaaauuaauuuauuaaaaaaaaccuacuugacaacccauugcgucggauaaggcaggugcuggugacugcguugugugcgggccauggggccgcggccugguuagggcccagagauguccagcuacacacggcagcagcggcggggugugcccccacuaucacagacauggagccgcgugguuccugacaacuuuggcuauggaaaggggaaauguacuaaacaagguccgucgggagcccaugagacgcacuuuggaggugacaaacuugaagaccuugaaaaagccaauccauucuccuucaaagaguauuugaaaaccaagaaccucagccugucaaacgaagacauuaccaccagccgaauuuaccugaaggaagccucaaggcacccacugggacuaaagcacagcuccccugccuccaagcccaugggauauggccuagauuaucagcagccauuuugugaagacccaacaagagccaggaaccuagaagaggaugaagaaaauggauggaauagaaccuaccugccaccugcucuggggcagacucauuccucuagagccacacagaacucgucaccccguggcaccuaccuuuccuuuuucuccaacacaucagagcuggcagguccugagucuuugccuccauggaagcugagcaacaccgacuccaggaucucuccaguauuuccagcugggauuccuaaugcagacuuugcagcucaugaagacucccuaggggacagacaccugcggacgcugcaaaugaguuaugaagcacugaaagaugaaaacucuaagcucagaagaaagcuaaaugagguucagagcuucucugaaacucaaagagaaauggugcggacgcucgaauggaaguuggaggcgaagaugaucaaggaggagagugacuuccaugaccucgagucagcaguccagcaagucaaacagaaccucgaacugaugaccaaacggacuguaaaagcagaaaaucaugucuugaggcugaagcaggaaauaaauuugcuucaggcacagcucucaaacuugaggcgagaaaaugaagcccugcaaucagaccaggaugccagccuuacuguagugaagcagagcauggauguggccuugcagaaccucaguguugucaugcacagugcacaggcauccauaaagcagcuguuaucuggaggagagacacugaaccuuguugcugaacuccuuaagucuaucgacaaaauuacugaaguuaaagcugaggcagacucuuaagaaguucuaccugccaccgggucccaucaccucugcaccgaaggcaccacacaucuuccaaauguguuccuaucuaugccguccucaccaaagcauuccacagccuaagcgugugacuggucaucugcaguacggggcuccuuucuaccaguugcaccuaacaguuuauaugaaaucccacuguucaauagacucacugauuuacuggaagacauuuuuauaagacccagaaacuuuuagaaaccaauaaagcugaaacaacaguugugcaaaaagcuucuuucacuguccucucaaauuuagcucuaggaugaggucgggcucagccucaguuuuaucgaggggaacacuaagugagccaguguguaagugagcagccuguacagagacgcgugccucacugaggcagcaccacuugguaggugcugcuguccucucaccaggaccauaggaccaaggucacacacugugcacauugcaaagcuucauacacccucuacugugugcugucagcuuuggaaagccauuuggggcugucgguuugaugcagguuaaugugucugugugccuuuugcauagugcaguucagacuggaauuaaagcacacacccaccugggggcucagcaccagcucuuugggcuggcuggcugguuuuugaaggauaaacaagauagaagcagcacccugugcucugcugaggggucaagguuuagggcacacuuuccuauaguuuuuuuuaauuuuccuuuuccccuccuguugagauugacagcuuucuuaucuaaauaaauccugaagaucauuuaaaaaaacauuacuugacauaccuaacucauuuauucuuuaaucacuuaucuaagaugaggauuaugagugacaauaugaaucucucuccugaaaccacugacaccauaucucuuggccaaagaaugccaguaaguaaaagucaccaguguacgacugagauagagcuuaguagcacaaugcuugccuggcauccauggauccauggguuuuauucugagcacugcaaauaaaaaacauaaucacuagugcagagagaagacacacacggggguggggguggggcauucuugccauuguuuuuugagacuuagagcucugcuauugcaagcuccaaaaggacccugcucucaccaacguuaacuucuacucuacaguaauugugaaugucaaaacuugcuuuagacacaaggagcuaaaguuuccugacacuuauuucuuuuauuagggaaaaacaaagagcuuuacaaaccuacaaagaaguauuguguagaaaagaaaguuggcucagaccaaaaaugaucaguuuaacauucaaaaaauuucuagugcaugccuuucuagucuagaaaaaaaaaucuccaucucugaauuuccuuagaaauucuuuugcuaucauuuaucccuucaacuauugcuacugucacagauaaccuuaaaaguuccugaaaaugcauucugaggguguuugguucucugcugaauuauaaauaaauaaaaagaauaaaaaugcucugcucuaaauuaaucgggcuucugcaucauagccccucuuucugaagcucaggaaucuuuauggaagagagggcugagaagacuguaagaacuggaagccauggaagacgauaagaaaguauuuuguggccaugacagggcagcugcacacaugaacucauggccacuaugauugccuucacaagaucaagcagccaaauucuagcacauacacuggaggggagcaugaaguccugcccuagguaaagagguauuagcaguugguagcugcuagggaaggacauguugguuuucuucaggaaugcgacccuuggcaggucaugcugcaguggaugaccugcgucccuaugcauacacuggcacugagaggacuaaugaguuuucaaaaagaaagcaaucaaagaugguaaagcaagaugguaggaaaauggggaacauuuuggaggggaagaaauuagggguggaauugacaaaacacauacauguauggacuucucaaacaguaaaagcaacuaaaaacaaauacaauaguccagcuauaucacaaaagcaaggcugaauguuggaaagaggaagcagauugcuguuuuguuuuguuuuguuuuuuagcaguuccaugugagguuuauugagaaagaaacgggcaaggugguggcagaaagaggaaggguaguggggagagauuuugaacuugagaaacacugugauguuaggcuccauggguuuccuguugccgccaagauaacucaguaggucuguacaggauccucccauccaaccaccaauaggcacagaagaaaaacugcuuagaaaagcccaucuuuuauauccaaaggaaagcagauauggguaagauuacaacaagaacauuuuuugccaauaccuguccuaccuggucaaaaaccaaugagaaaaaaaucuaauuuuccuacugcucugcaguuucuuuuucuuuuuuuuuucuuuuuaagcuuacuuaaaacauggaauuuuuaauuuuuucuuuuuuucuucauuuucauuucaaaugcuaucccaaaaguccccuauacaccacacccccccccgcacccugcuccccaaccuacccacuccugcuuccuagcaauggcauccccuguacugggauaaucuuugcaagacaagggccucuccucccaaugguggccaacuaggccaucuucugauacauaugcagcuagacacaugagcucuggggguacugguuaguucauauuguuguuccuccuauaggguugcagacccuuucagcuccuuggguacuuucucuagcuccuccauugggggcccugugcucuauccaauaggugacugugagcauccacuucuguauuugccaggcacuggcauagccucacgcgagacagcuauaucaggguccuuucagcaaucucuugcuggcauaugcaauagugucuggguuugguggcugauuaugggauggauccccagguggggaagucucuggaugguccuuucuucugucucagcucugaacuuuguaacuccuucuauggguguuuuguuccccauucugaaaaggagcgaaguaucuacacuuuggucuucguuuuucuugaguuucauguguuuugcaaauuguaucuuguaucuugcgguauucuaaguuucugggcuaauauccacuuaucagugagugcauaucaugugaguuccuuuguaauuggguuaccucacucagaaugauauccuccagauccauccauuugccuaauaauuucaugaauucauuguuuuuaauugcugagugguacuccauuguguaaauguaccacauuuucuguaucuauuccucuguugagggacaucuggguucuuuccagcuucugacuauuauaaauaagacugcuaugaacauaguggagcauguguccuuauuacuaguuggaacaucuucuggauauaugccuaggagagggauugcuggaucuuuugguaguacuauguccaauuuucugaggaacugccagacugauuuccagagugguuguacaagcuugcaaucccaccaacaauggaggaguguuccucuuucuccacauccucgccagcaucugcugucaccugaauuuuugaucuuagccauucugacugguaugagguggaaucucaggguuguuuugaugugcauuucccugaugauuaaggauguugaacauuuuuuucaggugcuucucagccauucgauauuccucaguugagaauucuuuguuuagcucuguaccccauuuuuaauggggucauuugauuuucuggaguccagcuucuugaguucuuuguauauacuggauauuacaucccuaucagauuuaggauagguaaagauccuuucccaaucuguugguggucuuuuugucuuauccagaaauuaaucuucuacauggcucucagaagcuuguugcuagcaugugugagcagauagcuggucuuuucccacuacugaccaaaacaaaacagauggcaccccauucugcugcuguacuguguuaaauugggcuaguggugagcuaaguugccauucacacugagcagcaaggcaagguuaguugcuacuaaacuucacaacacuaucuuuauuucagucaguacugauagaggcaggugcugggcuuucacccauccccucuagcaggaagaguaugguaaguucccugauuuccucuacaccuagugucagaaaagcccagugaagaguugaagcuccguacucacgggcagcaaagaaacuaagaggcagcaugaaguaggacuacccagcacuccuagccccaaccucugaggucaaaagcuaaaaagacccacuggggaaucugagcuucuaauucaguaaggcuuaaggugguacaagguagaacuacuuagcauucuucauucugcauauccugguugucaccaaagcauagcugggagcugagcuugcgcccugccuuccgaagcugcagacgcuuuggggguuauucugcuaucacuugccuuacugucagcacagucaggaguggcugaacucaugcuuaacccauuugggacaacaaagcaaaauuuaguugcagacggccacaagagucugagcauacugcauguacagacuaccugauuuuuaaagauuuaaauaugauccagaauuucaugauacaguaucuaaaaugucaagguaacaguuuuaaaacucacucuccaaucagauuauaucugacagggagauauaauaauaucaacgacaaaauaacgcacuaacaauaaaaaauucucuugaaacagauacacaaaaucucaucaaauaaauagaaauuauaaaacuaugaagguugggaauuuaaaaaccucaguugauagacugcaucagcuagagacaacagaagauggaaucagugaucuuaaagacagaucuguaacuuuaauucuuucaaauccuauuuuuaaugaugguucuuaaaugcuuuaaccucccuucuagcccaccacccaccagagguaguagaaaagaaaggauacagggggagaggggcguggaucuguuuagaaagguucuuuggagaaacucccaucuguguugucuggaaauccgaaguucaguucacaggucagcaucagcagcuggauccacucacauacacuuuacagauacaccagcaguccgguucuguagaguaaggauagcaaauacgaaucaguagugauggcacuaccuaccaaagacagccgggcuucacucagccuuggcucaagacagcaggaggaacaccgggagaaguuuuuucucagccaagcaaagaucagugaagacuggaaacccacaagcauugcacagcuaacucuauaagcaagccuaacucuaauauaaauaaauaaauaaauaaauaaauaaauaaauaagcaagccuaacuuagcccccaugauuguccauugaauucuauuuauacgcccuccaaacaucacaugcccuccgugugucuugcuucagcaccuggugucugucucagcugacaucacucugccuaucagccugagccugcugaaguggcacaccaccagaaguagguuuuuggcauguuucucucuauaguaucccuacaaaugcagcucaacuaugaaauguaaauuggaccaauauacguguguuguuagcaaagaaucuuucaucaugugucuuuucacaugcuugcuuuagcagaacaucuucucaccugugucugcuucagccaaauguuccuccuugagucugccuuagccuuucaccuguguccacuuugagaaaacacuccuuucauguguuugccccaguagaacacccucgaacacaacugacuuuccaaagaacccuuaaguuuccacuucacagaucacccaauaggcuuauauacuugaaugcuuagucaccauggaguggcacuacuugaaguauuuggagguguggccuuguuagaggaaguaugucccuggggguaagcucugaggcuucaaaagugcaugacaggcgcauauauaaucaguguccaaaggauaagagaaagagguguauaguaaggacuuguaaguuaauggauguuuuggaaagggaauucuggcacauacaaugucaauaaaccuucaagacauugugcaaagugaauugaggcagugaaaauagacaaauaccauacacuucuauuuauaugacauucugagaauagucaaauugauaaagagagaucaugguggaggggaugacucaguggcuaagggcaauugucaccaagccuaaagagcaaaaauuaaugcccaggacccaugugguggaaggagaaaacugacucccagaaguuacccucugaccuucacauuugggcuguggcacacucccccaacacacaaaaagguaaagaaaaagaaaacuuuuaaagagaaaagagaaugaugauuguaaggagguugggguuaggggguauugcaagaugaaaagaguuuaaaaauaccaauauaaauauacuaaacacuucugaucuauacccauaaaauuguuacaaugguaaaugauauguauuuuaucacaauuaaauugauugcuuaaaaauaaauuuuggcugaaaacgccacaaacuuggcaaaauaaacaguuacaaauuuaaagagcugagugauaucaaaguaugauaaaucuaaauaacucaaugcuaagguaugucauaauuaagcucuuugauuuuggggggcuuaguuuauuuauugauuuaucuauaugucugucuauuuauuagacgaucuggcaagcugucugugaacucccuagguagcccagacugacacuaaacuugcaaaucucuuggcacagcuuccuaaaugcuaggauuauuauauugugccaccauguccagcucucauaauuaaacaucugaaggcuaaagguaaugaaaacuauugaaauaauccaggggaaaagaugcauuaguuauagaggaauaccaauuuaacaaugaacauauucuuguguggcauacaaguauugaagccagaagaaaaugucauauuucucaaguguuaaaagaaaacagcuguuaauugcagauucuauauccauagaaucccuucagaagugaggauaaaauaaaugaauuucugugcaaagaaccuucagaguauuuguuucuggcaaauauauucuuaaagauuaaaacaaguuuuagaaacaagugauaauagaagagaccucagaacuucaaaaagaacaaugcugaaagaguagauauaauagaauauccuaguucuaauaauuuucauaaauuauuuugaugguugaaacaaaaaaugugccacuaucugaugaaauguugaacauauagaggaaauaccuacucauaauaccuagaguccuaaguccauaaauacacagaaaauuaaaaccauuauucaaauaaauacuugugcauaauuauuccuagcacuauuacuuauacuauuuccaaaguagaaacuacccaaauaucuauccacuaauaaaugaaugaauaaaaugugguauaugcaugcacuagaacacuauucuucagaauaccaauaugugcuguaauguccuugaaccugaaaguauugugcuaagugaaagacaccuguaacauauuguaugauuccaucuguuuaugaaauacucaggauagacaaauucauagagacagaaaguagauuagugcuuccuuuggggugaguauagagguuggaagaaaauuaggaguuugauaaaauauagaauacaagguuucuucucaggauaaugauaacggucgaaacucuauuauggcaguguuugaccgcacuaaagucauuaaauuuuacauggggcuucuuuccuucuuucucucuuuuuucuuucuuuucuuuuuuuuguuuuuguuuguuuggauggcccaggaaaugucaguagagaacucuaacaaauauuagaauuaacacaaacuuuguccaaucucuucuagaaaauagggaaggaaugaacauuguaucauuuacuuuaugaguuuaaugucaccauaauaccaaaaugagauaaaacaugacaaaauguagaaaaaauaaggaccaaaguccuuaucaaauuugauauaaaaauuaucaacaagauauuaauacuacaauuacaaaacaguuguacuucaugauaaaguggaauuugccccaggcuuuaugcaagacuaguuuggucuuuggaaguaagcaaauuuagccccacauauugaaaggaccagugaaacagcucagugaguaagggcgcuugacuucagucccuggaaccuccaaugggaaaaggagaaaauggacucugcaaaguuguccuaugccuucacacaugagcugucucacagacacacaggucuaguccagagagacagcacagcaguuaaaagcacuugcugcucuuccagagggcccagguuuuauucccagcacccacauuaggcagcguacaaucaucuguaacuccagcucugggagauccaauaccucuggccuuugcaagcagcugcacucagauauagcuaaaaaaaaaaaaauuaaaaaguacaacuagcaucauaccuuaugaagaaaaaaauagugacagcuuccuuccuaagacugaaagaaacaaagcacuuguaauuucuuauuguuauugacacaguacuagaaaauacuagccacuucacuaaaacaggguguagggaaagacuacugguucaguucagguuuagguugaugagagcuuauaggugucgcuucugacauuccuaggagacaaaucucauagcaaacucccugauccucuggcuguaugaucuguccacucccaacuuccacgaucaucccugcacacucaaugguuauccaauacuaaauggucagcucuaaaaacauacaugcaaguaacaugauacgacuaagcagguuguauuuauguauuuaggaauauuuguuuauuuauauauuauauauguacauuauauauauauauauauauauauauauauauauauauauauaccacaaagauuacugaaaagcgggccauggauuugaaaaaaaaacaggggaguauaugggggguuuuggagggaagaaaggaaagggggaagugauuauauuauaaucucaaaaaugaaauuaacuuuuaaagguauaacuggugguuuuuuuuuuuuaaggaauggagauuuuugcuggauggugguggcucaugccucuaauccuagcauuugggaggcaaaggcagacagaucuuugugaauuugaugccagcuuggucuacagagcaaguuccaggauagcuagggcuccacagagaaauccugucucaaaacaaaaugaaacuaaaugaaacaaaacaaaacaaauagagauuuuuguguggcuaaagcuugagcagauucugugucuacucucaccacugcugugaguucuuaccugcuucucugcugucuugaaaccaguuuccuauaggccucuacuaccucuggcuucuacagucuuucugacaccucuucugaagugaucccugacucauuggaggaaagaguguucuacagaugucccacugagggcugaucaguccauggucucuuauuuucugcaucuugaucaguugcagaucucuguguuaauuaccaucuacccugaaaagaaguuucucugaggaggguuucaaagaucaacugaucuguaguuaaauuguuuaaccauuaauagucagcuuaauuaauacuguugucuaucuugaaaaguaaugguaguauguaccccaccuuagguucuuggccccaauaauuaugccagguaugaauuucaacuugcagaucagaccucaaaucaaauuagagagugguuguuuagucccaugcuauuauugccauuacugcaccagucagacaugucuuggagguaagcacuuaagugcuacuccuuacuaaggaacuauugaguuugguagcuguuguaagaugauuaaaaauguggccccugguaacaucaaccaugcuccaguagaagagcacacauccacacaucgcaaaacaacuuuuauuuaaugagauuuuuaugaagugaagcaauguggaacaagcucucacuguguaguuguagcuuuccuggaaacuugcuguguaaaccaggcuggccuguaacucauaaagauauaccagccucuaccucgcaagugcugggacuuaagguguaugccacaugcuugaugggguuuucuuaauaauuaaaaaaaaaaggccacaaaguuaguuguauagggaaagagggguugaucuaggagaguuggggagaggcaugacuaugacuaaaauacauuuuaugaaauccucaaugaacuaauauaaaaaugagaaaaaggaauagaguugauaugcuucucauuagaaaagaaaguaaaacugcuauuuuugauuauguguuugucuauauaggaaacuucaagaaaucuauuuuuuauuuuuuauuuuguuauuacauauuuucuucauuuacauuuccaaagcccccuauacccucccccugcccuguuccccaacccacccacucccacuucuuggcccugguguuccccuguacuggggcauauaaucuuugcaauaccaagggccucuccucccauugauggccgacuaggccauccucugcuacauaugcagcuagagacacaagcucuggggguacugguuaguucauaauguuguuccaccuauaggguuguggaccccuuuaguuccuuggguacuuucucuagcuccuucauuaggggcccuguguuccauccaauagaugacugugagcauccacuucuguaucugccaggcacuggcauagccucacacgagacagcuaugucaggaagaaaucuauuuaaaaaaaaaaaaacccuaagaauuaauauuaucucagcaaauuugcagaauacaaaauaaaagcacaaaaucacuucaacuucuacaugcauuugucacuuauaaaguuuuuuuuguuuuuuguuuuuuuuaauuagguauuuuccucguuuacauuuucaaugcuaucccaaaggucccccauacccacccacccccaauccccuacccacccacucccccuuuuuggcccuggcguuccucuguacuggggcauauaaaguuugcaaguccaaugggccucucuuugcagugauggcccaucuuuugauacauaugcagcuaaagacaagaagguauauaaaguuuuuacuuaaaaaaaaaaaaacgugguuaaguuauaggucuuuguuugccuugaguuucgauuuuugagacauggguuugcuauguaguccaaucuggccucacacucacuaaguagcaaaaauggaucuugaacuuauagucuuccugcuucaaccucucaugugcugcugcugcaaucuagcacugauguguggcauggagguuaguaucucuauauuagaggcuucaauccaccaaauguuacauuuugucauuuggaauuuuauuuaucuccauuuugcuguuuuauguguuacaauaccauuucagugcugcaucauggguguauuucucugucuaguuuugugguggugguguguagauagauagauagauagauagauagauagauagauagauagauagauaguauuauauaaugccuaugaauuuauuauauaauacaugugaaacaugccuuuguuaaagucaucauuuuacuuccuuaugcaaagguagaaaucuuaccacucuuaagucccuucauuuauacaauacauucuaauuaccuuaauauccuuagcauaugucaggagcuacaugacacaauauugcagcuuugauuuauuuauuuaguucuuugcuauacuucagaaaacaagaggaauaacauguauuggacuuuaucuauaaucuuccuuuuucuguagguuccuaugugguuaugcaagauuccuucuuucucacuuauuuucuuuuuuagaccauucuucgggguaggccaacugguagcacacucucuuuguuuuccucugucugauaaguuuuugguauaucuuuaauucccacuuugacuaggcagagcuaagacuggaguuuaacaggucuuuugacaguugaaaaaguaugcagugcuugcccguggccuuccuaguuucugauguuguauacaauuagcauuuagguugcuuuuuuacuacacauaagacuucauucuccucuguacauucaagguuuuaaacuuaugguuacuuuccagaaauuuagagauuauaugucugcucuugacuccaucaacuaaguuuuuuucuguuuuuuuuuucuuaaacucuuuuuuuuuuucauuuucauuucuguuauuucaauuugguucuuauuuguagcuccaauuucuuuacuaagacuauuugugagaugacucuuucaguuguaucaacuguguucauaauuauucacugaagcauuccuuugauggcuacuuuacaaauaugugucauaugguccuauaauaucugucaucucacaagugccuucugguuuuaauuuuuuuuuuuagcuuaaguuagacuuugugguauaaugugugaguuaauugaaacuucaaugguucauauuuuauucaauguucuagacuuuguuuaaaaucuuuugccuuaauugucuuuacaagacaccauuccaguaggagaagagaaguuuuauaccucauuauucccaaguauagguagaaacacaggucccauucuugguccucuuugacacuuaagggagaaggggcuuuuuauuacucauugguaaaaauggaaguucuagcuaccaguaacuugacuggagucuacuuaccugcugagcaugaaagugagucuacacauauauauguaugauuguacacauauauauguaugauugucacauuauuacuuacagcccauuucuuuguuuucuaauuuuuaauuucuuucaagggaauuuauaauugaucaguagaggagugauuuuaugauggugcuuugaagcuuagauagucccaccaaucugauuuauggcaguauuacaucaagugacuuuucucauuuauguuguuauaugccuggucuuuacuauagauauuaauguauccuguacagugugccuauagauggcuccugacuuacaauacuuugccuuauuuuuuucuagcuuacagggauucaaaagauauacacucaauaaaacuauauuucagauuuugaauguuggucuugcccuaagcuagcaauacgugguauucucuugaugguuuucaggaacagagaaacaaggcucucaguuaguuauggaaucacaguaggaagcaaccaguguucuacauucucagugugguuaugcuggauagcguuucuccucaugauauuuucaauuugcagugaguuuaucauuaaaacaccacuggaagucaaacaggaccugugcuauacuaggagacucuuaacaaaaauuauguuuuccccugaaacauuuuuggguguagcauaucaauccuggucuauuuuuuuagaacaauuuaguagagauggagaauauuccaucucugcugguggcuauaaaaagaaaaaaaaaacauaccuaauugugcuaucuuuugcugcuagggaaagagucaauagacaaagacuuugagucuuucuacuagguuaagguucgggagucacugaaagugauuucccuucuggggcucauuaaaugaucaggagacaucaggccuugguugcuuugaacauugaguagaaauuuggcagauaccuugccuauauuaucugauucugcuuagugguggguaagggcccauuaggucugggcagacaguuauaaagcacauggacauauggcacucuccaaugcaaggcuaccugcuucugacuggcccagagcaaagaccagauuccuugaguuccaugaguucuacuuuguuaugaacagaugaugacuuugccacuggguaaaaguuucucucaugaguuccuauucaucuuccccauuccuuucccucugacagagcagauauccuacguucccccucuauuuuugucugugcuugcugcuaguaacuacuuguagacccauccaguggguacccaggcuggagcauaagugucaaagaaagaaaacccaaggacuucacccuuacauaguuccuucuguaugaaauccacgacucaucuucaacuuucacagucuucuuaugauugucugcuuuccuaagguaccuaccuagccguaauuacaggagaggaaccauuauuccaaaaccagaagucuaacuuauauuuguuuuaaauuaugauaagugauagugucuuuauauuuuugcauuuaauucuuuauauaauaucaccauuuugaaauccauuucaucuugguaaacauagauauauauagugcauucauuuuaaauacuguagaauuugcuguugugugaauaugcagcaaguuguuuauuuguucuccugcuggugggcagugaagccgccauugcuuuauaaacaaagccaggauaaauguucccauacaugucuccuuggauacugacuguauuuguggaaaguuuaucugagccugcaucucaaguggaacugcuaagccauaggagacauagagcauugucaucuucaucagauauuaccaaacugcucaacaacugugcaugagauacuuuguuuugucacugaaaccuguguuaaaauagucaauuugauucuccuuuaacuuauggauuggguuuugacuuguuuaaaaaaaaaucauuccauaaacuaaggucauaaaaauaucuucaguauuugcuucuacauuuacuccaaauuaggucuuuagucuuuaucuguaauuuacuuuuguguauaaucuaauaaaggaauauuauucuacuuuuuccaaugucgauagcuaauuuuucaacgcaauuaauuauuuauuuagaauuccacuucaaccauauaucacacucccauuuuacuuauguugauccugaaguuuacaaauaaccccaaaugauauuagcuaaaauauugaauuuaaauacauguauuacaauaaaauaaaauaaaaccuuauucuuaaucccacuuucuauuauuacuggaacaaaaagauuaguacugauuaagucccuacuaacaucaauuaauuacugauuaucuauuagguacugcuaggcaaauuaaugcuaggauaauuuuaauuuauuccuuguaacaacauugaggagccaugaugucauuuuucuauuacagauaaaaaauacaaaaauguugaaaguccuguugcaaguugcauguuguaguaguaugauugcucaucauauacagggacuugaggucaaaccccaauuuuacaaacauacauacauacauacauacauacauacauacauagcuugucuugguucacacagugaaauugacagaguucaaauucagcuccaggugauuguaaguagugcuuugucuugcugcuuuacugcacuauuauauuaguuacuuuucucauugcuguuacaaaauaccugacaagaagcaguuuacagaagcaagaguucauuucagcuuacaacuugaaggcauaucaugguggggaagucauggugccaagagcuugagguggcuggcccauccacaguauauccacagucaggaaacaaggagaucaugauuuucauguucagcuagcauucuuucuauccaauccagaaccucagccccuagaauguugcuacccacaguuaggaugugucuccccaccucaguuaaccuaauccagguaacucuucuuagguauaccaggaagcuugucuccuaaguauuucuuagagucuaucaaguugaccacacuagccaucacaacuaucuuuaagagaaaugugacaucccuccacugagaaagauacagauuuguacauuauaaguaaaguauauuuggcaaguaguauugugccuugaaugaccaaguucaaagaaugacugucuugcacuuuauauacuugaucauuaggaaacaucugccuaggaugaauucuugguuacucuuccaucaccucauuucucuaucucucuaucccuuacuucuugaaguuggaauauauaauuucauugucaaugcaccuccugcuaagaugaagcuuugaggaggaaaagggcaaaaaaacguaugaugguugaaucacuuauccuuguuguaauuuuuauacaagaauggauucuauccauuaaaggcaccaaauguagugcugauaugauaacagccuuugcaugauuuuaucauauuaugauaauugauuucuuauugagcuaucauuuucccucauuuaaaaucaaugcccuaaucuaagacuguuaagaaguuauaauaaguagcaaaaauaagggauuuggugucagccuuaaaugagccuuuuacugaaagauccuagagcucuucauguguggagcaaguggaacccugucaccagacaaaaacuaagaaggcugagcugauucaaaacgccaguaauucucauaucugagaauacuaggcguuucaucuacuccugacccgguuucuguccuggagcaugugaccacaacaccccauaugaggaucgaucaugacaacuaguugaguagcagagcacagcauucuccaugcuaaugaggugucuagaugggcccugagguuuuagcaaauaagggaacuuccaggacauuccuuccugcaaaagguauuuagucucuggucuacccuguguaaguaguaugcauccacugcaaauaaacaguuuaguaaaucaaggacugucucucucaucaagagaaggcugugggcaaagccuucgucaugcagagccauguugccuaagucucugcgcuccagauacucacccuuaagcuaaucuggauuccucuucccccagagcuuaugguuggcccacgggccccuuaauucucaacuccuugugguuuccagcugggugcccaggagaaugggaaccccaaccuuguccucagccugugaugcuucucacccaggcugggaucuugggcaguguucugccugaccauuccucaagcccagcccaagauggaauguagccuagcaccucccccauuuugucugccagagcagcguucacacaccccagcggcaaggcggaaccacauucauagagguuuaauuuuuuaucuguagacuggacaguaaucgaaaggcgaugcuagaauuaaaucaaauggcacuugaaaauguacuuuauaagauacugcaugcugauguuuucauguaucuacuguuuucuaacuuacuuuuuauauaugucuaccacuaguacccugcuacauggcccuaaugcugccaguuucauaguaaucacugacuccugacccuugucuucagauuuuauuuaguagaucugagaugagucucagaaaucuuuuuuuuuucauucucuccaaauaaucccuuaaacacaaaccagauaugaggcagacacacuuguucuggaacacuuagcaccauauauacaagaaacaauuuacugccccugacugggauucccagcuaaaagcagguuacaauaagaaguugcaaaccagcuuuccuuaacgcuccaaauuccuaccccuccuagguuauaggaaacccagccucaugaucucuuaacaccccccucccacuucugugacuccagcugcauccugaguacuucgaagcaaagacugguaaauugagccagcaauuauugccuuuuaaaaugauuuugaggguuuucuuugaaaagucuuagucaauaggaacagaagacuaugaauaacaccaaaauauuuagcugucuauugaaacuucuuuacaguaucauguaaaaugggaacagaugcaacuagaccaaagcuugguuaguagguaacagauuuauggacuugcucauuuuaaaaauuaagguuauaaacaacauaugucaaaauccuauaaaacugcucuggaaagcgucuuccuagaaagcccaaaucccuguuaauguucugaauuugcuuucagaacugaaagaugacauuguauacauaugcuuaaaacaaugcuuccuugaaacaaaacggacucugugugggugugcauucaguagccacacuaaaguuucaagcaccuagucucuucccagaauggaaucuauccaaucccuugagagaagaaagcuuuuucuauuuacaaauacaggugguguugccaugaguuacaguuuucuggaagccuuugcacauagcucaugcuuuuaagacaaaggaagucauaugagagugaaaucaccaggucuuuggucuauccugaagccuagagacuugagaagaaucucaauuggcuccuuuuccuuuuacugucacaucugcaagucuccuguugaagcucucuaguccacuguucccucuaaugaagucauguucugugcucagggcaguaauauccucagaagcagaugucucccauaaagcaugaccucauuccuuggaaugggaaaagcccgcagucgacuguugggguaauauugggaaggacuuuguuuaaaaauaguuucuguaaauaauguguucaacuuuuuauauauuucuauuaaaaggcaaaucuaguuuguugcuguuuuuuuuuguuaaccuugcucgucucuuccagaaguagcagucacugagcuagaaguaacaguccucacagagcucagacaauuccacccaguuguuggggcagaugggcaaaacuuaggaugucuagauguuaaaucuaugcucuguaugagaccccacugagucacaaccuacauuucauaauaucccuggagcuuaggaaaaacaagccaaaguguccaaggaaaguuacugauccagauguucccaggaaaugaggcaagugagagggucacuagacaaggaaagaacugaggaaaagaacaacaauuggaagcaugcagcuuaaagcuaauacaaacuuguuuagaaacauagauauaugguaguuccuagacacuggccucucaaaucacuucagaaaacuagaauauagaaauagaauauagaaaacuaggauauagacauagaauauagaaaacucggacgcccauagccuuuuaguuacaaccugcaaaugccggugugcuccucacuucucuuugugucugugaauaagguaaaugcaaaagaggaauaaaaggucuaaauauugaauuuacuaaauauggaaggauuuuacaggaucauaaggcaauaaaauacauaucaguuaagcgugauaccugcuacuuguaaauuaauuacuauauucccauaagaugucuguuucaggaacaucuaugcauuaaaaaugaagaaugcuaauaauucuaugaauauuaauugaugagaauaaauauugaaaauacauuuccuuucccaauucccauauuagucaccuuggcuagcaaccagucccuuuccaaugaucuauuaaagcugcauccucaccauagugcuuuuccauggcaaaccucccaagaauccauuucuccuugaaacuuuucuccacacucucaccuuucaucccuccuauuucuaaugucgcuggagauaacauuggcccuugauaagaaagucuuagagaacauuuaaaaagaaaccaugacagguuuuuuuguuguuguuguuguuggguuuuuuuuuuuugcugcugguggugaugauauuuauaaguguguguguguuugacuagcacgguugagagaacuguuaaaaauguaaacuagacuaaaacuguauaccauuuaucccucagaaaagugcaacaaacuaggaaaaacagaauuguuuuuauuuuuugugauauuagagauugaacacaaagccuuuugcaugcuacacaagcacuauacuguugacauguauacccagcccuguuugcauguguguguguuuuguguauauguucuuguguaugugcacacauguguagauguggagaucagaggucaacguugggugccuuccuuaacuacuuuccaacauauguuuuugagagaaggccuucacuaaaucuugagauggacaauuccgauagacccaggaaguauucugcccuugccuccacaauucugggauuauaagcacauacugucauacccagcuccugcaugacugauggaaaauggagcucagauccucaaaauuguacagcaaacacuuuauuaacugagccaucucaguuaauauuauuaaauggauauuauuggguuuuuuuuuuccuaccagggucaugcacuacccaaugacauccuagaaaacaggaguuauacccaaaucaaucaaguuguuauaaaaccaaacacucccaaauacuauaaacuguuacaacacauaaauaaagaauggacgcuuccuggcucauuuugugaaauggauaugaccuugauaacuuguuuccaagaaggaaacuuaagauuucucacauuuacaaaaggucuuaaauaaccagucuggcaagacauagcuacugauacacuauugacaugaauaucaugggaguaaccaucuucauuagggguuucuauugcugugauaaaacaugaugaaaagaaacuuggggaacaauggguuuauuucaucuuacugcuuauaguccaagcaaauccgaacaggaacuaaaggcaggggaacugaugcagaggccauagaggagaggugauucuuguuuauucuccaaggcuuauagagcuuauauagcacaggaccaccuaccugcccagaaguggcacccuccacacuaggcuaggccuucccauaccaaacacuaauuaaggacauguaccacagguagaaggcauuugcucaauugagaaucccucuucccaaaugacucuagcuuguaucaaguugauauaaaacuagccaccacaguaaccaacuacuuucugauuagauuuaagguucacuccacagaaggaauccauaccggguaccauuaucaggagcaaaaagcccauggcuauauagaucaucaaccuagggaagagcccaaugcuauuauuacuaugcucaaugaacauaguaugaaaucaacuccuagugaauuuuaauuauaccuaugaauuaguguaucucucacauguuaucagagguguugcuuuuuacaauagauuaugauuaaaaucugagacccacaacuggucaaggucuagaaaauaggagacuauaaaaugcuuagcccuuaauuggaucacaccuccuccuccacccaagacuuggggaucauugcagaagaaggagcagaaagguuguaagaggcaguagaugacuacgaggaaauaguguuugacagagcaaggcaguugcccaaaugagcucacugcgguuguaacaacaugcccaagaccuacauaugcucaagucaaacaaaaguccagcauggagaggguaggugggcauaaauucccaccccuagcuaaagagcuauugguaacugguaaguucuaggagaggaaaagucaguuuucuuuuaggauguugacccuugguuagucaacaaagauccauuggaagaccacacacccaggaguuuauaggcagcacauauuuuauuugauggguuuucucuuauuauuuaaaaaaccaacguggacccagaggaaguuggacaaagggugaauauaaucacaaauacuguauuaaauacucaaaagaacuaaguuuuuauaugugaaaaagagguugauagacauuauagaaaaauuucuagagauuuuaagguuauuuucuuugucuuccaauaaaggaauaauuuauaaaagccaucagaaaaaucugaaacuagcaaaucaauccugaaaaaaauauucacuguauuauaugucaugaccauuuugugcuaggaauguaaagacgauucaaugauaugaaaaaguuuaauagugcauuacaucaacucaaagaauauaagucaaugaucaucucagauaaaaggcacuugauaaaaauuuagcauccuuuuaugauacuucuuaguaauugcagcauaucuuggucuaauaagcguggugcuuagaggccauauuacuaaaguugggaugcucaacauuauucuugaauucuuuuuuuaagauuuauguuauuuuguguaugugaguguuuuaccugcauguauguauggacaccacauugacaucugaugccauugggggccagaagagggcaucagaugccuuagaacggcaguuacaggugguugugagccagcauaaggugcuagaaacuggacccagguccucuggaagaguggcccaugcuuuuuaacugcugagccaccuugaauuucuuauuaauacaaugaaagaaguagaaauaucagagaguuacauaaacacuccucacuuacuaaucaaauucuguagcuaguaaacacaagaaauguaacugaaaagauacuguaaguagaaagcuccaagguggcuaggccagaaguguccauuucuuauaggacgaggacaguaucagcaaaccuucuguucagaaaacauuuguaaguugaauauaguugaaaaacucagcuggaaaauuuuuuauaggcaguuagauccuuuaaggccauuucagcaucauguaugccuugagaucaugacccugaacagcaauugguauuagauaaaaaggccugguuaguugagcuuucugcuuacuuagguuuaaacugauugauguuuguacuagauuuuuccccauagugaugaguuuauaguuauuuaauguccagaaacuauuuuauccacuuuuuguuaucuuguauaauccuuaaaacaccucugucaaguaaaugucauuaucccaguuguacaaauguggcugcacuaacucagaguugcaaccauuuccucauugucacacagcacuugguagagaggagcuucagcuuggauguaauucugugacuucagagaccaugccuuuuccaacaccaguucccauccgugcgcacagucuucccuccaaguauuuccuggaacguaauuggaaaauguggcaagaucaguaaugaaaacagagaaggcaagaagagaccuuguugaagaguaacuaguuaccucuacucuagggcagucacuaaaugacuagaguacgcucacacuggacagcagaacuccccuguugauccacuguaagaagaauccaguaagucucagaauaagccucaucucugguuaaagugaaacagcaugcacagcggcagaagaacuagccaucuugaacuguucugggacccaaucuagagccauauuguagaaaugugguucucaguguaaccaguuugugguuuggcugcccagcaguugcggcuguauuccucaaaggcgaggcuuacaaaauuacuucugggaacagcacauguuaccuaccaucugggauccuucaacccauggauagguuuaaccuguccacaggaagaugguguagcuuugauuaauuacaucauguuccaacaguagauucucucugauuccugugcuuuguugggcaggaauauuuggaugauggauugcuauuauaaccuuuaacauauuuaaugaauuaacacaucucaacuacuaaagcaauccauuugauucauaugcaugcagcucaaaauaauuccuugaaucugcuuaacacuucacacuuucccaaauuguuuuuauuucuauugucucaucgauccacagaacugaaagcuuaauaccucagauuuugaacccagauaaaggagaauagugcaauuaguacucagcauuugaccuaggucacgguugucaacuccagccaggcaguagagucuccagaagagcuuuuacauuguuuucaugcccacccagcaggcugacagcaucagaauccucaggacgggagucugugcagugaaagguguugacucucuucagguaauucaaaaguguagccaaauuugaggcaaugaguuuaaaucuaaguccugggugacaagaacacauucaaauuucagugucaccaugguagucagaggcugggauuuagaaaguagcauuuucuauaaggguugaaucuuagaacagacuguacucaugagaaaguauggagaaaggagaaaaacaggagccugaagacuaaccuuuaauauucauagugguuaagaauuuuacgucuguuaaccuagcuuuuuggggaaaaaaaaagccgcaugauuucauaauaagaaaaacacacacgacuaaucagaggccuuuguggagagaacugugcaugugucuaaggggaucaaugggaauaauuuauuuagacuuucaaaaugccucuaaguggcguuugcuagcaaagguuauuaugcuuuacguugugucgccaugcacuacgaaaucagaggggccauccagggaagaggccuugaaaggcaggaauaacgggcaggaugaaugcauaucuuacuagagugagacacauaaacaguagaguuuguaaucugcuucugguuuuaguuaacauuuuuaaauacugauugcauaaaagacugcaguaaaaucuuuaacaaacuccucagggcucugccacuuauugcugugugaccccuggcaagucucuuaaccucucuuguucuauuuccucuucaccuguaaaguaguggcucuggaucuaaaagucuccuagaaauucuauagaugagcuuaucuuagcuccucucucugcaucugaaaugaaagcaacacaugaucaaguucugucauugauuagagcaaugguaggaagugacuagcacagggucaaggaccagaggaaccauuuguuauacagaauuaugcacgauaugaaguucauuguaaccagauuggcaaagcacucuuucugccagccaucugcuggaacauaaaaauagcuuuuuauauaggacuguucuuuauaauuggauuuaacguuuaccaccgauuucuuuaacaaucaauaaauuuauaaaucucuuagagcauuuuauaguugaagcuugugagacauuagaggaaaaaguuaucuagugcauauguacauuuaagagaauuguaaauagaugaagugauccaccuaaggucagagaacaaaaauaacacuacagagauguaucucuggacaacuuguuuagcucucuucaccuucuuccuauacuugauuccaaagcaauaaauauauggcuuuagaaaaaguugaguccacaggacagacuuaucuuuuggccauccuuuuuagcuagguaugugguuugguaauggugguaaugacauaugaauaugaagauuauaguuaucuaugagugcuuagauauucuuauaugcuauacauuuucucacuuaucauuucuuuugagauagauacuauuuuugagaauucuacaggcaaauauaucacaucauuuccaucccucuugcucccacucccacuccuuugcccccuccacucucucuaaaauucaugacuucuuauucuuuaacuauugagcuauauaugcauacauauuuguguauaaucugcuuauugcauuuaguauugugcauauguauauauauuuaaggcugaccacuugauauuugauaaccucuggagggaagggccuggagaaaaccgauucucccuuucucgguagacauugauuguaucucuuccucuagaguuggagucuggugacauucugcccguccauauuugcaugucgacugucacucucaucauucaggucuuuuucaggcaaucauauuguuaagauuucauguguucagcuucacuaucauauauagaagacacuaucuccaagcccucauauugguacucugcugucuuucuguccucucauccacaauguucccugaaggguuguguuguagauguuucauuugggauuaaacauccugugaucuguugcuuucuacauuugacaaguguggauuccuguaguagucuucauaugcuucaaagauaagguucuucagugaagaauaaaaaugacaggguauaaguaauuagaauggguauuaguaauuagagaaugcaauuacaaauuacacuagugaaaguagcaguaguagauucucccuuaggauccaugaccucaacagccacagguaguuagcuaaguuuacauuaccaggcaugaacuucuaccuauugaguggaccuuaauugcaauuagacagcuguuagcuaccaccaagauauaagugccacuauccacccuugagaauaucuuguuaggcugaaggcuauuguaguacaugggcuuuauacagguauuacuauuauuaauuuuuaaguauaacugauucagagagcuaaaguaacuugcccaacaucauguagguauugaauguuagcacuagaaaucaaagcugguucagaaaggauaacaagguuaaugaucuuucuacaauccaauuuucccaaagaguauaagccagaguauuaacucaacaaaaaaaaauagauaacucuuggaaaagauucuugaccaaacaaguuugccuuuuugucuccauuuccuacugcugaauuuauugaaaauuuuugagaagccuucagcugaaaaaauauguauuuuucuuuaaugcuauguuucuuaaacucuuuuuaaacagguauuuauuuuuucaagaacaucugcuaauaucacaucucuuucauauucccuauaauggaggacuacaaaauguauaaaacuugggagauaaaaacaggaggaucaagguuucaagaccaaccucaacuacaugaaacccuaucucaagaugccaaaaacuagggauacaaaagugacuuaguaauguacuccuugcacaagcaugagggccugaguuuggaccccuagcaccuauauaaaaucuggacaugguaguacauuauuguaaucucagcacuagagagguggagacaacgagaucccuggaacucacuggccaacuagccuaacacaaucagauagcaucaagcaccagugagagacccuuuaucaaaaaccaaaauggggccagcaagaugauucagcaaguaaacacacuuaucaccaagccugacaaccugaguuccaacucugcaguucauauaguauaaagggaggacagguaacuacagauuacccucuaaccuccacacaaaugcuauggcacacgugucccugugcuuauacaagcagucucucacagagaaacuccagcaauaaauaaauguaauaaaaagaagagaaaagaaaagaaaagcaugguggacagcccucgguaaugacccugacauuggccuguggccucuacgugcaccugcacauaugcccagacacgugcacauaugaguguacacacauacacucaagcaugcacacacacaacuauuuaaaacuguacuacuucucaauucaucuucauagauugcauccuaggccuagcuuuuuucaucuuaaccacuugugaccaaagacucaauguugcagaauguuucuuuagcaagagcacaugcuugucacuuugaguaugucuuugauaacgagaacaaaccuaucccuuauggaacuuuaaggcacuauuaaacuucugaacugucagcaguuaguggggcugguuuacuguugcccuaaccacaguaauauuuuugagucuuucccaaaccaagacagaagugagccagaaaauuucauagcugcuaauaaguuaagucauguuuguagagcuugagacccagauauggaccucugcucuaaagcauauaaaggaaauuauuggaugaaagauucagacccucucacaucagaaauaauugagauuagagugggauggaguaggggugggaucaacuugcacgguccuaccucuucuggcccuuucccucaugcucagagcagauguuggaaucauaaucuggguucugagcauggacauuccaugugguuuacauucagaauucucacucuucuuugaagcuaauggcuuccaucuucuacaaauguauugggcuugccacgcuuaucugugcauucucuguuuauaauucuuaugguauaaagaaaaauauuaaagaaacucuuaagauuucaagauuugaagacauaaacuauguaacuacuuguuguuuguuuugugguuuugguuccuugggcuugugggacuaggaauugacccuaggcuaucacuugaccgcugaacuauacaugaagcccccugcuuugaaauaagaaauaucucguuguauacuuacucaucugcuauccaucccuuuucuuuuuuuuuuuaaucucuuuacugacugguauuggggaacauuuggucaugccuagucccugguguuauucucuacauaaagaaaagaagacuaccugugcaaccaacaaacaauaaaauguacauuuauuugaguacuugcuucacauagaucacuuucaguaauuuaaacuggaaaaaaaaugcaauugugccaguuguacagauggucaauuuuggaaacuauuugucuauauacuugguacuaugguuaauucaauguaauggaaggugaaguaaguuggagucugaagaaucuugauucacaucuccaauuaucaccuccuucagccauucauuucuucaucaaacaaucaguuuuuaacuccuauuauaaaaagaaaugcuuuaggaacuaaagacacagaggugaacaauucauagcucuuacccucaaggaguuaacaauauuguaagcaaaacaaacacauaauaaaagauuauaaucugagggcuggauaaauggcuuagaaguuaagagaacuagcugcucuuucagaggaccaggguucaaauguucauaacuccaguuccaggggauccaacacccucacauguacauaaaggcaaaacagcaaugcccauaaaauacaaaauaaaaauauuacaaugugauaaauguaucaguacauuauggaauacagaagaacugguaucuagaaggcaucuuacagggugagcaggcacuggaagagaguggagcugaagaagggcauuucaggcacauacaauggacagaggcaaaagguguugcauguugggggugugcagcuaaaauccaugcugaauuacauauaguaugguuuuacuuuaaaccaguauuaauuuuauuaacauccuuuuaugauuauacucuauuuuuagaaagccacgauccacagaaaauuaaacagaaacaauguucuaaaauauauucucucucucucucucucucucucucucucucucucucucucucucucuucuccuccuuggcaaguauucauuguuuaccauuucuccaaugucacgugguaguacauagacuuuucagccuaguuuuuuucacuuagcaauaugcauuuaaauuuucucugaauccuucuguaacuugaaagcucauuuuucuuauugaugagcaauauaucacuguauagguauauagcaacuucuuuauccgucauuuguuaaauaauuguugacaguuugagucaauuaugaauaauguugauaaaagccaccuguaugcaaguugugugaucacacauuucuagcucuuuugaguaauauuuaacacugugauuucugugccaauuucuacagaauuaccaaaccauuuucccaaaugugccacuuuacauucacccaccagugugacggcaggaccuguugcuucguauucugucacaaauuaguuaucaguguuuuacauuuugccauuuguggacugcucucuccucauauuaaauugcaguuucaucauggcaaauaauaucuuuuuccccaucuuaauuaucuccuuugguuaagugucuguucauaucuuuugcccauuucuuuuuguucauucauucauccauccauccauccauccauucacuuuacaaccagauuguagucacaguccccccucccaggcccacccuuacaaauccuucuccccauuacccuguccucuucuacuuagaugaagggaagcccuccuuggguaccauuccacccugggacauccagucaccuugugccuaugugcauccucucucacuaaggcccaacuaggugguccaguuaggggaagugguuccaguggcagguaacuaagucagagacagcaucacuccaauuguuaggagacucacaugacgaccaagcugcacaucugcuacaucugugcagggagagcuagguccagccccugcaugcucuuuuuuugguaguucagucucugugagucccuaugggcccagguugguugaauuuguaggucuuuuugagguguccuugaucccuccagcuugcucacuucuaucccccacucuuccuuaauacuccccaagcucuaccugauguauggcuaugugucccuucaucugccucucucccuugcuggauaaagcaucucaggagacaguuaugcuauguucuugucugcaagcauaguaucacuaauagggucaggaguugguuuucuuauaugggguguguuucaaguugggccacuuauugacuggccauuuucucaaucucugcuccaucuuuaucccugcucaucuuguaggcaggacauauuuggaguugaagguuuuguggauagguuaaugucccccucccuccacuggaaguccugccuggcuacaggaggaggccacuucagucuccauauucccagcugcuagaagucucagcuagggucaccgccauagacuccucagagucucccccaucccaggacuccaguuacucccagagaugccucccauugauuucuguucucuuccccaguccucuaacacccaccucuccccacacccaauccucauccuugucccccuccucacccuaucucccaccaagauucuucccuuucugagugacauucacccaucaucccuugggcucuccuuuuuacccaguuucuuugggucuguggaguguaugcuguacuuuauggcuauuaucaacuuauaagugaguauauaccaugcauguccuuuugggacuggguuaccucacucaggaugauauuuucuaguuccauccauuugccuaagaauuucauaacucauuauuuuuaauagcuuaguaguacuucauuguguaaauguaccacauuuucuguauccauuccucuuuugaaggagaucuggguccuuuccagcuuauggcuauuaugaauaaaccugcuaugaacauaguucagcaagugugcuugagguauaguggguguagcccauuucuuaauuugauucuuucuuaauuauuagguuuucuguuuagauguuugccgguuuuguuuuguuuuuuuucccuuggguuucaaagcuuuaauuucaaauaucuuuuggauagaaguaguuauaugacauguuccauguguuuuugcaaauguuucucaugguucuuguuuguuugggaguuuuguuuuuugagacaguguuucucuguguaacccugccuguccugaaacucauuauauacaccaggcccgccucacucgagagaucuucaugccucugcuuccauggugcugagauuaaaggugugcauacauugccaugcuuaguagccacagcuuuuuuuuucuuuuuuuuuuuuuuuuuuuuuuuugguuuuuucaagacaagguuucucuguaguccuggcuguccuggaacucacuuuguagaccaggcuggccucgaacucagaaauccgccugucucugccucccaagugcuaggaucaaaggcgugcgccaccaccgcccggcuuaguagccacagcuuuuuaaaaguucacuuaaggauaccauuuucugaacaaauuuuaauuuuaaggaaagccaaguuaacuuuuuucucaguuguacuucuaauuuucuaccuaaaaacucguuacaauggggaaaguugacuagagguuuauuauguugugucaugagauuuuuaugguuuuuguauuuaagguuugaccccuuuugaguuaauuuuguuaaaggcauaaaagucugugucucuauucacuugugugcauguagaugcccagguguuccaccaccauguaugaaaauaacucucauuuuuucuguugaguugccuuuuguccuuugucaaagaucaguugacucuauuauaagucuguuucuaugcucuguguuccguuucaccugugugugcuauuucaccaguaccacacugguuugauugcuauaacuuucuaguaaauuuugaaucaaagaauggcaguucuccaacuuuguuuuuauuucacaauauuauauuugacagucuguaucuguuaccuuuguguauaacuguuugauuuaguuuguuaauaucuacaaaguaacuuccuaagauugcauuuuaucuguauguuauguuuggaggaagugacauuucugcaauauuaaguucuuuuccauggacaugggcuaucuuuccauuuagaugcuuauuucuuaaaucaaaaauuuuucccauauggauacucauauuuuguuaaaucuauaccuaaaugcuacccuccucucucauuuuaagguaaauagugcuguaaucuuuuauaucgaauuucagcuguucauugcugauauuuggaaagaauuugacuccaguauauuagaguuuaaccgugaaacauuauguuaauugauauuuaguuccagaagccuuuugugagauuuucuaccagaaaguuaugguauuuguaaguagacaggauuaauucuuccuuuuacuuuauuucuuuucuuaacuugucacaugagcuaagauuuacagaaugauugcugaauuauaguguugcgaauggacauccccuacucguucuuggaucuaaagggauaacuucugguuuucucaucacuaugcuauacaggauuucuuauagcuuucuugauuaaauugaggaaugcccuugacuccuauuggguggaauuuuucaucauaaagggauguggaauuuuauuuaagauauucucuacaucuagcgauaugacuauuuguuuuucuucuuuagcuuauugauauaagguagauucaauagauuaauuuuaugcuauuccagucuuacauaugagaaauaaauccuuccugguuguggucucaguacauuuucugcuauuuuaaugaaauaccuacagcuagaaauuuuauuuuaaaaacuuauagaaauucauuuguuuuguuuugaguuaguaucggcauguauauaauggugguuagcuuuuguuauccugacacaaacuggagucaccuagagggagauaaucccacaagccaguaagcaauccugccccuucucccucuugaauuccugccuugacuucucuuccgacugugacugagauguguaaaucaaauaaaucuuucccuucucaagcagauuuuggucagugucuuaucauagcuacagagaaacaaacuagacuagaaaucaaugccagagagaguagguccuugcugggaaggaucugaccaugugacuuuuaugccuuggaauguguugugggagaaauguggagaauuuuggagcuuuaggcaaggaaaaccauugagugauuaagcuuaaugaacuguaucgggaauuuagaagauacugcuaagagaaauacaggugguggaggucuggcuugcgaaguuucgaagggaagcaaagaccuuuaacaaggcuguucauaugauaguuuggauuaagaauuucuggaaguaaaaccuuuguuuaacggaaaaugauaucuauauuucucacccugcauaaaaaauaaaguccaaauggaucugggaucucaauguaauaccugaaaauuugaaauugcuagaacauguaggguguaugccacaaaacauagucauauguacaggauuucugaauaaggcacuguuugaucagaaaaaaaaaagacuaacaauugacaagugggacucuauuaaguuaaaagaguggucagcaucuguagccaccaggcaaaugcaaaucaaaccccaccuugagaguccaucucaccccaguucuagugguauguaggagaaaaauaagcaacaaccaaugcugagggugagggugucggggaggagacuguugacagggauggaaacuuauacaacugcuguggaauccagcauuguguuccucaaaaaggcuagaaauugcaucuaccacaugaccugaugacuagaccguuccuggguguauguccaagggacucucuauucuccgacagaacuaccugcccaacuauguccauuggugauuccuucacaacagcuaggaaaacaaaucagccuuaacagugugcuggcuuauuuuuuuaaacuugacacaagcaggagcuacuugggaagaggaaacaucaucaacaaaaaugccucuaagcagacuggccugugggagaauuuucuagaacaaugaugaugggaguggacccauucuauggcagggcaaugccaccagcgagcauguuguccugaguuauauaagaaagcaggcugagcaacccaugagcaauaagccagugaacaacauucucuauggccucugcugcaguuccugccuccggguucuugccuugagccuugauuucccugagaguuguaagcugaaauaaaucguuuccuccugaguugcuuuugauuauaguguuuuauuauagcaaugggaacccuaaauaaggcauaugucaaugauaaagugauaaugaaaauuugugauacaguugcaaaacagaauucucuauaaagcacuaaaacauguaauuaugaauuuuuuaggaaaguuggugaaacuggaaaaauuaugcagggggaaaggccuagaaagauaagcacugcauguuccugcucauuucaaaauuuuagauuuuuguauuuaacuuggaauauccagagagcaagagguuuuauaauggccauggguugggcaaagaggcuugaauggggcaaacagugagaacucauguuaauuaaaguacagagggaagacuacuauggugguaagguuuaaaugggaagggguuguaaaggacaaaggucaggaggagguagagacagggaguuaaccaaaacuaagguuauaagaagacauguagacaucucccuauguggccaccuaacaauauaggcuguuaccauuauucuugguugcccaccagaacuagacaauaauacucuauaccugaagacaucacauaccuccauuucaugacacagacaaaucaauuuggaacuuaaguagaagcucccucccuauuggcuaauauagauugugucaaaaaugcaaaauaggcugcccggggaggaaacucaucaauacaaaacucaucaauacaaaacucaucaauauuuucagccauauguggaccuugugcccuacaaugccaccugccuaccaacacaugcccacuggugcaaaugaauguugugagcacagcuucagacucugugauaaauuugagaccugcuccucagaaggaaauccaugccugguacuauaaaccugguuuuaaaaaacaaaacucauggaguuugcuaaaugaauauggcaucaaaccacuuucuaaauauuuauacuuagauuuauacagauacacacaugggauucucagcuuugaguagagaaacuuuuuauaaugaauagcagcgagugaaaacucagggcugagaguaauugacuguugaguacucaggccuaagcaauaccaccucuucugucucagggaacaucaugacccaaggguaaaaagaauauaagaaccagaugauagggagaagggcugugaaaugcuaccuucuaggcaugacacagucuuugcaguugugaacucagcagcugcaaguugccuauacuggaucugcacaagacugagccugucagcagucagucaggaggcagagaaguacaugagcccacccccaaccccccccccccccguucccugggaagcuauuggcuuuuuacagaggcucagggaggggagcugucucccauuguguagcugcugaugagccuacugugcuccaguggauccaauguccauggucacauggcagcccuggcuaucauuucuuccacagauccuuaagcuauaaauaaggaauauauauuugcuauuauuauuuugaacaaaaguauuaucuacuaaguugagauuaaauaaaguguuuaaggcauauuucuuccugaagcuuauuauuuuuagcuuuuaaaaauaaaauuuaaguacaccauuuucucccugcccuuuccucccuccagccccucccugggccuccuuaccuugcuuccuuucaaagucaugggccuugucagagcaaccuacuuaguccauugagugcaacuuaguguugcaugugugcacaugauuucaggucuuggauaaucaacuaagagacucaucgcuggcagggacuaguucucauccucucagcggucauuucuuugucuggaugaugccuguggacuuuccccuucaucugguaugucuguugguguuacacgucuucagaucuccuuucuuuagcuucccuuaucuggucuucuucuuuagauccaaacuucugcccugugucauacucguucucuguuaacauuucuuuaaaucuacugucaauaaauuuccucaauuuuuauguguuaaagaguccauuucucccguuuuuaaaaagauaauuucaugugauacaugauucaagcuuguuaguuuuuuuuuuucauugauccuaauucucaaauaaagauaaagugugugguguucccuaauggagcagacaaagaaugagguagaaacucacuugccuuaggguuauuuuguuuuuagcuguuuguuagccccacgucuaucauaaggcauccuuuuccuaaugucugcauauguuagcaaagccugucucaucuccacuuuacuuuuaccaaagcagucugaacuacuuuacagcuggcugucccacucugauaugucuguggaguuuugcauguagaaaauaugguguauaaccuccccagccugaaaccuguuugcucagguuucaguguuagagagcauugucguucugccacucccacugccucugccugucccuagcuguuccagagccaaacacguggucaccugcaacuuuacuccagggugauuuggcgggaaucgggccccuuccccugcuucauaaccgagugucagaagaguaaaaucgagcuuugaucagaaccuaguuugucuuagcuucguucuuucucucgucugccuaggccccucuucucuuccagauuccaagaugccauuccagacuagaacccagacuugugagcugcuggccagccgcaacaaucgugguuacaaauagagggaaugggaggauauagaaauguugguucuuaucaugaaagcaacacaugaugaugguaguacuauggauuagggaagaauaagguucugaagcauauuaagaagacggaucauuuuaucuuaaaaguuauggaauugaaaagaaauggucucuguuacuuagauaccgcuaguaugggaacagcucuagcucaccagcauuuccucucuagaaacaggaaaccuacagugaccucaaagagaaagggauacaugugacaauuaaagggaggaauuuugaaacucauaaaaaaugauuugcuggccauaguaaucaauguuagaacaaagaggaauccuuauauuguugagaggauauacucauuggugcuuguaggaaauaugauauauuguaauaauauuaugugccccccccacacacacacacaagggauaugacauuugcuuacuaagcagaaguucuaugggaguccuucugugaccagaagugaaguagaggccaggauuuggagcaucaguucuauaugugaccuuuauguuauagccauuuagagaaaaagaaaaauuuggcugguucuuuaccuccucacauaguacaauauaauuccugccacauuaaucacaauuuagaaaaacauaaaaaagcuagaaaaauauccaaaaaugauacccauguauuacuuuagggaaagccuacuaagcaugaaaacugagggcaguaaccauauauacuuaacuacauaaaaggaaagcuuuuauagucuuugagccaacacugcuauuuauaaugacacauucuuuaaauauuuugauaagugaaugaaaugauacacacaugaaaacauuauaauuuuuaagcauuguuuauaauuacaauuuauaaucaugauaaaaacaaagaucauuaauuaaaugccuccauauuaaaaacaacaauguaguuugaaagaguagcagggagacaaaacaggguaauggaaguagugaauggauccgaauauguuauguacauguaugaaaacagcauaauggaaccauuaugcauaauguauauuugcuaauaaaacuuuuaaaaaagaaaucaguugaaaguauauuugaaaaauggauauuccaaugaaacacauauaucugaauauucaaaacuaauauccauuggguggacuguaguagcacacaccuaccacucaggaggcaaaaccaggaggagcucugugaguugaagacuggccaggucuacauagcaaguucuagaccucccaaaguuacauagagagacccuguuucaaaaaaaaaaacaaaaacaaaaacaaaaacaagggcuggagagauagcucagugguuaagaguacugacugcucuuccagagguccugaguuuaauucccagcaaccacaugguauaacucaaaaccaucuguaaugagaucugacgcccucuucuggcaugcagguguacauacaaacagaacaauguauucauaauuaauaaaucuuuuuaaaacaauaacaacagcaaccaacauccacaaacgacagaggaaaauacaagacaguugccuuucugagucugaguuaccucacccagaaguuuguuugccugcaagugucaugguuuuguuuuuaacaguugaaugguacuuuguuguguagaugugcuacaguuucauuauccauucaccaguugauggacaucuagguuguuuccauuucuugguugacccacugaguguaauuugugcuugccaaaauacuguguggagcacuggaacaagguagaccuaccaggaccacacccuuaaaacugacucccccaugacaccuccaugcugcauuguugacuggcuuggucuucuacagaugcugcauagcugcaaugaauuugugaguacaacuguccugucacauucaacaaaacaccucguguucuuacagucuuuucacaguccucuucuaugauggacccuggguguuauggggaaggggaaauauguuaaauaguugucuuaguuaggguuacuauuguugugaugaaacaccaugauggagaggaaaggguuuauucagcuuauacuuccacaucacaguucaccauuaaaggaagucagggcaggaauucaaacagggcagguaccuggacacaggagcugaugcugaggccauggaggacugcugcuuacaggcuugccccuccuggaggaccaccagcccagggauggcacuacccaggaugggaugggcccuuccuccaucaaucacuaauugagaagaugcccuacaggcuugccuacagcccagucuccuggaggcauuuucucagcugggacuccauccuuucagaugacuguagcuugugucaaauugacauaaaacuagccagcacaauaguuuguggcugagcucuccacuaacacuuauucccugcacuuugaccacuuguaaguuucugcaauaaccauccacugcacaaaaacauuucucugaugggcucugaaagcagcgccagucuaugguuaaggagauagcaauuuagagagcagugugauauuauaucuauuuaagaaagcaaauaguagguagauuuacccuggagucuaugagcuccccaaccauagaugcucggcaagauuuuuuuaaauauuuuuauuagguauuuuccucauuuacauuuccagugcuaucccaaaagucucccauacccuccccccccacuccccuacccacccacucccacuuuuuggcccugguguuccccuguacuggggcauauaaauuuugcguguccaaugggccucucuuuccagugauggccgacuagaccaucuuuugauacauaugcagcuagagucaagagcuccgggguacugguuaguucauaauguuguuccaccuauagggcugcaaaucccuuuagcuccuuggguacuuucucuaguuccuccauuggggacccugugauccauccaauagcugacugugagcauccacuuauguguuugcuaggcccgcucggcaagauuuauaguagaaaucuuuuuuuuuuuuuuuaaauucucuuuccuaagucagaugcaguguggcacaugacugcaaaucccaacacuugggcagggagaggagugugaagcaagaggauugcucuaaauuccgaguucaagaccacuaugggauacaagugaauuccaggcuagacaggguugcauagcaagaccuucuguccaaaaccaaacaaaugaaacguguccucuuucccucuuaucacccguguguuuaaggugaaccuguuuuuaaguuuuuuuauuccucaacuaacaagcaugacucccgggucccccuugaaugaaaaauacuaaaagaaaagaaaaagaaagaggaaaggaaauauuacuguuccuaguugugguguaggagaaaguuuacuguauauaaaagguagaggcagggacuucugggagaguggacaugacccugagcugggcuacguggggagagggaggagaaagggagagaguggggagagucuagccagaugcagcacccaggaagcccaaagguacaaaaagagcagguaaccaaaaugucuagauuguauagggaagagcagcccagcccccuggacuagaguucagaguagggaguggggagggguaugccagccaggagagcccuguaacagguagggacuaagggauaccuggagaaccugauggccagguucuauuugauauguuaaauaggcacuucagccauuugucccagguuugaaaccuaacacuccuauccaacuuguaaguucuaugaugaugguguucuggcacuauuuacugugcuaccaccuuccauagggauacucagaaaagaccagcugacuggugauguccuggauugccucagaaucuggugcaacagcucuauccuuuagcuagcagaaaugaccaaaaaguagagcagggauaugccaccuuggcuguaagggcagggcagcugcaguagccaccaccuugcuuaugaggcuggaguaacuaacuggccaguugguagcuagcugguggggaugugcccuuucuguguaaauccuuccuuaaacagcuaucuuauucaagaacaaagcgcuucucugguuauguuguuguuucucacucagucauagccauccagaaugcuuaaugcuguuuugaaaaacaacauacaggagccagguaugccucaugccugugccccagcucucaggagacugaggcagguggauuacaguucaaugccaaccuagacuacacauuuaaacaauaucucaaaaacucagagcacaaauaaagaugacaacagagggagaaaaggugugaggagacagaggauauaaaaagaggaaaaucaugaucuucaauugcuccacugaaccugaaacaucuucugcacacugcacacaauuccuacugcugcacgguucuuuuugagagaaaucuaaacagacauugagguuuugaagggacauauuugcucuggggccacacugaagaucuuccagguuagagacucuauuagcuuccuaugaaaccugauuucauagguggaaaucuuucuauacuuuuacaagaaucaaguuagauaauacacagaagcaugaaacaaacuguagacuacagaacugcuccuaaggacauuggcugugguuuagagcuaggcuauauuggcuucauggcaguuuggaaaagaauuuaagugccugugucuaggggaaguuauauucauccaaagaaagaaaaagccugaguccccaugaauaaaaaugagcucuguugauuaaaauggcuuucuuuagaaacaauacaugagaagacacuuccgacucuacuacaaaagaagcuguugacauuuccuuuagagcacccauuaaguuauggcaaauugugggagugcauguggccccacaugaauguauuacagcugcaugcuucuaauaacuaacaaguuaaaucacaauaaggaagugacugagaaggaacuacuauuguucugcuucuucuauaagaacacugccuuuucucuucuagugucccaaucugaaacuuugcaucacuacuuugccugaaugcaugacucuacaaccuuaggacuugcagaauuaaaggaaugccguccugagguuguugagcugugcguuucugggccuuucaucucuacagaagaauacccuucucccuccugacuaaagugggaagaauuguuauuuuucaagggaagcauccuucguguauuuuguucuagucucuauaaucagcaaacaaggauuuugauagauggaugguagcuaccuuggcuaaaaucuggaccaugacuaugggcuccuaaauuugcagugccucuuacuggauuuuuagagaauaaccauuuuuaaaaugaucuacuaacuuaaucuuccaucuuuuauuucuaauagguccuguuaaaaacaagaaaaaggguaaguugaguuuugugauuuuauuaaauugucaugucauuuuuaauuagaaaaaaggaaugagacaggauuuugcaugaauuucuuucaacauagauugcccauugcuucauucaaucauucacaugaguuuugcacuuuauaaagaacaagaauuaguucuucaacaacaagccauggaagguagaauugacucuagcaauacauacaaguuguccuuguagaaucauuuauuuauuuauuuauuuauuuauuuauuuauuuauuugucuguuuauuuguuuguauauuuauuugcucuguguaucuucuuccucuugcacuggggauacaauccaggacuucugcccuaagaauauuaggcagaagcuuuaccacugcauucuacuccaagcccgcauugugguucuucuuucuuauuccuuuuacaucuguuuccaguucauauuuauuuccuucucuugcucuguccacugccuucuguuuucuucuuuccuuccuuuaucagaucaguugucaggcauuaaugaagaccuaagacuguuuauagagaaaagaaacacuaccuauggaaagguaccaucaaugauuugguccuucaccuuaaagcugucaaagaugauaccucuugcucugagaauuuagcaucauuugcucagugauagaaauaagaaucuaugccacuguguuacucugcuccuguccuguuuuuaaaguagaugcuaguuggaacuauucacugugcuguccuuaguuucuuaaguccacuuuguacuuaacaagggacuugcuaagggcacaugaaguacuugcuugcuugcuugcuugcuugcuugcuugcuugcuugcuugccuaaagaagauaauccaacgagaaagcagguuguauuguaaagacuaggcaaauaaaauucacccuuugcacuagaaaaaaaaucaacuguaaaaucaguuuauguaccugucuguuucuggguucugacauuaaaggaagacagagauaauaugaaacuaaugaguuucccuuuagaaauacuuccuuuuugccuuugucuauaugauacugggaauuuaacccagggcuuuacauguacuagucagauacucuauuauuggacuacaucacucacccucuuauuacuuucuuugaaugagacaugaucucacuucauuguccaggcuggccuugaauggacucuguagcucgaacugaccuugaauuuagugaucugcccucauaagccucacaaguagcuuagauuauggaccuuacaguucuuuaccagggguacagacauaacuccacuguuaagagcacucauugcucuuauaauggacuugggugugguuuccagcaucuccuugauggcucacaaccaucuguaucuccaauuccagggaaugcagugcugcuuucuguccuccucagacaacaggcauguguguaaugcacauacacgcauaccugcagggaaaacacuuagauaccuaaaauaaaauaaguaagcauaagaaaggucuuuaagugauuuuugucuguuuauauuuauggagcauuccaaacugcacaaaauggcuaacuacagagguagcuuggcgauccucugagcaguaggguacucuuaucacuucagguacccuuagcuacgugucaaacucauguuccuacugaaaaagaaaagcuggaaaaaugcccagccuucugacgaccugaauugagcaaaguuaguaaacagcagagagccagagugagugcagaauccuucugcuguuuccugggugcucacucccaggaugcuucaucuuuuaaagaaguaaauuugaguuuagaguauuggguucuugagucuuguugcaucccuucaagauagaaauuauagcucgugccauugcuuagcauugccaccuucuguauggaacauuauugagaagaaaauguguacaagccuuaaccaucuacuuuauuuaaaagugauuuagaagccaguuaauauggguuuccuuggacacagugaauaggcacaugcuugaagagggaaauugaacuguucacuuaauuuucacccuuuaauggaauuuuccuacucacauaacucucucccucucuuuucacguuacccccaccaccaccaccaccaccucccuuuacucaguugcuuuccauuguucuuucaacauuuagaacuuagcugaagagguuagggaaaugccccuuugaugaaauuuggcucugaaaugauauuauuauuuuaucuaagacugcacagcuuacuuucucaguauaaacaucucuaggcuuuuguaucaugaaguauucugucaaaguuaggaaaucuaaagacagaauucaaucucuugguccagaggucauuuucugcauacccuucucugucccuaacuuucuuuuucuuuuuaauuuuuuuauuagauauuuucuucauuuacauuucaaaugcuaucccaaaaguccccuauaccuuacacccgcccuacuccccuacccacuugcucccacuucuuggcccuggcuuuccccuguacugaggcauauaaaguuugcuagaccaaggggccucucuucccaaugauggccgacuaggcuaucuucugcuacauaugcagcuagagacaugagcucuggggguacugguuaguucauauuguuguuccaccuauaggguugcagaccccuucagcuccuugggugcuuucucuagauccuccauugggggcccugaggggcuuccuuguccaaguguugagaaucgaagagggccagcugcagaaacagacuucagcacaggcuuuuucucagaugccuucuaacauuuucauaagggaucacucucuguuuacacugcaaccauuauucucuuggacuagaggaggcucuggauguaguucuucuaaaaugacauuaaacaauuauaggggacacacauucuuggagcugaaguuugugauacccacagcacccuuagcuggaaaaucucuguggagccugaaaaugcugcaacccagcacauccaacuucugugucuacuccaucuauguuuuugugucaauuucuuugucucuuccaacuggaaaauaaggagggaggcagacacuuuacauccaggcuuuggaaguuuucccagcugacauuaguucagucuuucuuguggaaccucagucucaagaagagacauaaagcaccaaggccaagcuccuuguucuuggguuccgagugccuguguggaaggacuggaguuuacauccuuaucuccagaguccagauccuguguuauuuccacuauacuaacuagaauugaaauuugggugccgaauaagccugaauuggaagcuacacaaauucaaaaggagaugauuuuccuauucagcaucuuaaaauuggcuagaucuagaaacugggcagaucccaucuuaaccacuaagcucagggccucuaagucuuuaaggcccuauacgcccucuugacgaaaugcucucagaacuacucuuucuucucugaagaggaagucugugauaguuuauauauucuuggaccagagaguggcaccauuuggagguauggccuuguuggaauaggugugaccugguuggaguaguugugucauugugggugugggcauaagauccucacccuaguugccuagaagucagucuuccacuagcagccuuuggaugaagacauagaacucuagcuccuccugcaccaugccugccuggaugcugccaugcucccaccuugaugauaauggacugaaccucugaaccuguaagacagccccaauuaaauguuguuuuuauaagacuugccuuggucauggugucuguucacagcagcaaaacccuaacuaagacagaaguugguaccagggccugggguauugcugugauaggccugaccaugcuuuuauuugaaagaauguggauuuugggacuuuggauuuggaaagcaguggaaugcuuaaagcauuuaaaauggggcuuaaugggucaucuuaguaggaauagggaagacuuuguugcugggaguaauuugaacuguguugaccuggcccaagagauuucaaaggagaacaauuucagaauguggcauaaagauuguuuuugugguauuuuggugaagaauguggcuacuuuuugcccuugucugaaaagucugucugagacuaaggugaagagacucagauuauuugcauugucaaaggaaguuuuaaaaaagcccagcagagacuuuguucucugguuaagucuuaugaagagaaguuugaacaagcauagcaagcuuagaaaggaaaaauauaaauuauaugguucgaguauuaaaggcauaccaggaagugaaauggagcaaaaucuuguguucuaggagauaacagauuaagggagugggaccuuggggcaagauccuacccagcuaaauuuagauccaggcauggugguacacaccuuuaaucccaggagacaggcaugcugaucucugcauucaaggucaaucugcagagcaagauccaggauagccaagcuuaggcagugaaggguuuggaaaacauaaagccagugauaguguaauaguacaagggugucauguucuaguuccugcaagcagcagaacucggcagcuucagccauguggcucuagcucuagaguuaagagugaaaagaacuacugggacaauugaagcugguuagcuggagcuaagaaauuaagaagagaccaacaucacuaaggugaaaucuucugggaauuguuuucugggagcacaaagaaguuguguuccagagauagccaagguuguaccucaugcugcagcuggauuugguaauguguaagagucgcccaggugguacuuguuuugaaggcaugaaguugccaugaagaacagcugagguuuggcacugugagaggucauggaaggccauuggagaagguguagccucggcucggcuguaguuugauggcccaggacgaaggggucaugcaaaggauuugaggcuuggcaccaugaagagagccuaugagaggauauuggugaagccuaguuggaguggaauaccccaguguauugaagaugucaguaccauggaaugaucaccaagaacagcagccauaguggaguggaucaaccugagcauagagugcuacagagggcagagauggagaagugaugccagcccuuaggaggaguccaaaagaucaaguggaaucccagauacugaaacaagaagcuguaacauugagauugccuuggagacucaaagauguuaaauaugccagagccaugggauacaugcugaggaaagcugcuaacaggaaguggaaccagcccaggagaaagcaguuuguugcaaucaacaaaagugaaaagggaguggagaucugaagacugcuuugacaucagccauggagaugcagaguuuggaguuugcccagcugguuuccuauuguucuuugaggauuacaguuaagugauuggaugaaucucagaagagaccuugaacuuuguauuuuuaacauuguugagacuacuauagacuaugaggacuuuaaaaguuggacuaaaugcacuuugcauuaugcuauguuuaaguaugcccccccuagacucauguuuuugaacaagucuaugagggucaaggaguggaaugugacaguuuguguauucuugggccagggaguggcaccauuuggaggugugaccugguuggaguaggugugccucuauggguguggguuuaagauccucacccuaguugccuaggagucagucuuccacuagcagccuuuggaugaagacauagaagucucaggucugccugugccaugccugccuggauacugccaugcuaucaccuugaugauaauggacugaaccucugagccuguaagccagccccaauuaaauguuguuuuuuuguaagacuugccuuggucacggugucuguucacagcaguaaaacccuaacuaagauaaggucccauucugacccacuguuucauuccaaaugagcaugugguuagauguggauagcuggccucuuugugggccuuucuuggauucaugguggguuuuuuagauauauggaauuauucuguuuucuacuuuuuaacuuuuauugauucguugugaauuucacaucauucacccuaaucccacccaucuucugccccuccguauccaccuucugcccuugcaaccuccccccaaaagaaaccaagcaagcaaacaucucuccauugugucacguagucugcccuuuuacccagcuuugcuugcaaaagaucauugcagugcgucauuggucugcuuugaggccucugggugagaguuauuauucuuaaaggggggguugauaaaucagggcagaauucacuaaacuaaaauaucuaaggaaugaguuguuuaaagggaagcugaugugguugccauuguguuacuguugcuguuguuugauucggggauuucauuuguuugucaacgugauacaaaucaaaguuauuugagaagcagaaccacaauugagaaaaaaaaaaugccuccaucggauuuucaguaggcaacucuguggggcauuuucuugaccagcgauagguuuguguaggcccauucaugguggauagugacacccccugggcaggugguuguauaagaaagcaggcugaacaagccauggggagcaagccagugagaagucuuccucuguauucucggcuucgguuccuacguccagguuccugccuugcgcugcuacuuugucuucccucaaaggacugugacucaguguauauaagcaaaaaggaaacaaaacaaacaagaccgcaccuucuuuccuacguuguuuuuggucaugauguuuacuguagaaacucuuaagacaaaagguaaagaaauuuauauuugaaauugagaaacugucucaggagagaacauuguaaaagauuuccaauccugggacucccauuaaaauucuaagacaggagaacuuagagaaagaagccuacccaugaccaccuauaguccuuugguuagucugcucaaaagagaacaagucuauaggaggaacaguuaugauccacuuaccaugacuacagccuagaggaacuguuagaaggacuagaauaugaaaugggagggcugagauuguucuggaaagacagugagagagaaaggaggaaagguugguagacaggauaaauaguagugcauuugaaaauacagccucuaaagaaaaucucggggaagguggauuguuuggccugcaaugauagaaauugauagguaaccuaauaucuuugagcauaugaaguuuuauguacauggugcuaacuagucuucucuagcuacucaaaaaauagaauaaaauuucaaacggccacaguuaaauauaccaaagaacuuccuaaccgugagcagugaggggugaucaacucuggaacauguaaccaagagaguuugcaaaauuucuguucucagugaucuuuaaaaauagaguuuagagaggucagcugagaaagcagagccugccgccucugucaggugucucucucugccugugauuccuucuuuucuguuguuucuugauaucuucagucucucacccuaucucuccaccuccauuuccaaaacuccuucccacuccucuuuucagccagugcugccccuauccauccccauguccugcacaucugacuccugacaaaucuuccuggagcugaugguguuccugagaucagacuuccacuauccuuugguuaauaguagcaagucugugcaauugaacagcuaaaugaaguccugccaaugaugccaaugauaguauuaccaaugauaaucaaauucuaaaaagaaucaugaagugaccccuaagucugaguuucuaauaguccuuuggacucagaucagaaccuccuuuuugaagucuugccugaccuguuucagcauuuggucugccucauuaauguggcacucuuaauaucuuagaacauuuucccuacuaugcugggcuccuugagaacuguuuauuucuguguccucuaaucuauuuggaaauauggugcagaaaagggauuauaagcauguccagcucuucagcaaaaacuagauggcugacuuggugucauugaagucucuagaacucccugaaauuauacuccugacuauacagucuugacaguaacuaacuccaaauauaacacugaauccuguguuuuaggaaagaaggcagggccaccugggcccaacggccccccaggaccuccaggaccuccgggaccccagggaccuccagggauuccaggaauuccugggauuccaggaacaacuguuaugggaccaccuggcccaccuggcccuccugguccucaaggacccccuggccuccaaggaccuucuggugaguucuucugucucccaccccuuagaaaacuuuucauugcuuuuguagaguagaaacagauaaucuucagagaauuuucaaacaguggcaaugugcaguaagaaaucccuagucuaguguagagguggaaagugaacaagcucugauagugucuggccugcucuaagucuuguugaguucaagcugcgccagacaggccaucuguucuugccccaugccaauccuuccaucccauuccaucuuuggcucuaguccuucauauagugagccaauaagcucauaugagccaaaaacagagguaugagaaagaggucccagccauucacuggaguuccuguagauauagauuuggcuuacucugauuuccagcauagaguaccacaugacauuugcauggaaauaguuugugggaggaauguuggggacuggacaaaaugacaacccuauuauaaugucuuuccauguacuuugagacuccuugccuagugguguagaaauagccccuucuagucgagugguuagaaauguaugaaucacucaagcugugucuaacaaaaccagacaccaagaccacccugucccuaagccaaaugugucucacacuagacccuuaaauaaccaugcugcucguuuaaaugccauuccaucccuuugccuuuuucuccuagcgcccaguggggcaugcaacagguauagcugcagauccaauccuaccuaauuagaguugacaggaggaagacggccugaacucaugcuacuuguuacauuuuucuccugcuccccuccucuaucuugagguuuucuuaaacuuaauuuccccaggucuaagaauucagcagcaggauucagauucuuucacuuguaauucaaacaggcucagcaguguuaccauggccacaagagauaaaaguuuuuuuuuaaacccaaucauuccacaaauauuaauugaacaauuucuguguacaaagagauacauugcuaaguggucccuguucucauagaguuuauuuccuagagucaaagagacacacuuaaagaaacaagaucuuuauaaaugacaguggcucuugugaaaucaguaagaagagaacaaagagcuagaaaagcaagugccauuguuuuaaggacauacaaugacacacauagccucucuuuccucucugugggugcucaauggggcuugccuugagccaauauuggccagaggccaacuucccugcugggaucuagacccucugaagaagauggucgguagggacaggaaugggaaggaggggauacucucucccaucaacagccccauguuguacuaugacucccuccagcuguaaggccuggagaaggaaauuccuacagggcuggcuguggaauccaggcucuggagcccuggcugcugaaaugggaaagggaaguagaaaagagcacagcacucugacugccccauccuauuuugcaggugcugcugauaaaacuggaacucgggaaaaucagguuggcuggggauuacugucuuccuggggaggagggauggccucaggcuuggggucaccuugaaguccuuugccuaugagauucccagaggcuuuauuugaugucguacuggagggucugagguuuucacgggcagccguugccgauaccuaugaauuggaaagguucgcccuaaggaugugcuuuuagcuaaaggaacacaagucuugccuggaccauuuuacucauuucgugagugacagagggucauggcagccagauccaauaguccauagaaauaaccugccugucaggcauaugugugugugugugugugugugugugugugugugugugugugugugugugcauguguauauauaccuaggccucugacuuccaagccaccucagaugccugaagcugccuagaaucugaagcugagaguuuguguguccaugaaaagcagccaacuagcuguaggcugaggccagccugggcuucccccuuaauggccuuauagguuccuuccuaguccuugaguuuuccaaucugugucuuuuggcagguucuacugccuagccuccuuaccuugcuccucccagcaacuagccucacuacaguuauuuggucacaaugauaaaucuacagaguugcacaggccuuacguuuuuguaggcaauuuuauauucacugccuuauuagaucucacacugugagagugaccagcagagaguccuauaguucccgcuuuacaguugggggagguaaagcucagcagccucccacuuggcugaggucggagugaagacguagagcucuuacuauguuuuaggagaaauagagcuagggauagcucaagacagagggagggggccagaaaugggcuacaaagucuagaagccagagguaaaaacacaggacugcaugacacggcaagcagucauuauagugacucucuucuucucaucuucucagccagcuguggugcaucugcagggccaagggucagcaauucaagucaaaaaugguaagaaucaaaguagaaugucucccuccuaggaguuucucccuucccucauucccagccuccaaauaaucagccagccuaacuccucccuagucccugaauauccuuggcauagaagggcauuuccuacuccgucgugcccucuacugguuguccgaaguaacugcuugcaccaagaccagaugcuacacccaaauugcguuuaauuuugcuuuuugcaguauaagagggcaaacccggggccucgugaaugcuaaccaaacauacuaccuuugaacuacauccucagccccuaaauuacauuuugaauccacuaaugcgggaucugaaaaggacuugggaaaccaucuaccuagacugcuuugauguuuauaucagccaccauggaaauauguguaauuugauaagcacuuucacaguggaaacuaaggaaguuagaacuauauuaaauaaauuaucuugucugauugcucuauacagaaaauggcuggagagagugcuucucccagagaggggacauguuagugucuaggaaguaagagacacuaaugucuaucaaaagcaaaagcauguuaacggggcuuagaaaugcugauuuuauguuauacccucauuuaugagauggggggacagaguuccaaagagacuagaaauaccaaagaaaaccauacuguagccuuguguuugcguggugcuuuagaauucccaaaugguuucucuuuuuauuuaaccuucacaaccacucuaugagguagguguugcaaugcuccuuuguuuuguuuuguuuuguuuuuuuuaacagcaacagaaacuaaagcucagagaacuuaauuuaaguagcccaagauuuuguagugaaguuaggagcugagauucaaaaccauaucuuccuagcucucagcgcugugcuaugcugcuccagugauguguguguacacuccacugaaugauuugguucauuuucuucccccaaagagacaugaacauucauuaaagaacagcgcuuuuaaauaauguccagucuccagggugcccaaagccuaaaaugcaugaacccccaggagucuuggaaagcagcaagccagcuaacauagcagcuacuuacagagcuuggaguggaagggaggggcugugagcagacacuguaaaggaagguuacaaaaccucuacuuggggacagcuucuaagagcacagucaguccugaagugccugugcugaguuccucucaccauugggcuuagcuacucccuugacugucacuugaauacccagccuaauagccucgcaaguacaagucggaguagaggaagaggaaaacacuagcagcccugugggaggccaagcacuguaggacccagggucuuaggugggcgaucgucaccauccuuccuggaggaauguggucagacagaaaauagauuuguuuggguaucuaagugguggccuuagaggucauucuauagcagaagcuguucaaauugcccccacuaccauaaaagagcaagauaauuuccagucccugcaggcaaauucccaguaguaguaucugcugacaggcagacaagaggagcaaggccacagugagaggacacuaggcagagcaguccacugaaguacuggagccaggacuuagauggcuuucuuuucuccaugcaucagagaggcagaccuucugagacugaccaagaauggaugcuuacaacauaauguuuuugugugaagaacaaauggcugagagaaaaugccucugugaacuuaguuugccucuucuuauuguaggaaggagcaacuuucuaucugcaggaugagaggagaaauauaccuccauccucucaugcuucuguccccagcguccccagcugaauuaaggauauaaaacaaaggcuuugccaaggcugccucaacuccuaggcaauucagucuccugaaaccuggcaggcucucccccagcauuguaaagcucacccucucuggggccugguuaccggaggucacuauccccagcugccauggggucugagugccaggggagccugauacugaauuaucaccaacuaguucucuagacagauggauuguuugauuaagugguuuccuggggcccucggaggcuucccagaaaggaguggguguggaggagccauaaagaagaaucuauuaagaagagacaaaagcacaggaaccucugagacaagagaggaauucgggugauauugcuagcaaagugaaauugaauacaaagacuuagccugccacucagugucuggacuuugucugugcagucaccauaacaacaaagaaaauaugguucugugccuacucuccucuuucaccaucgccaccucagauuccaacuagaagguaaagagcuuuauugauggaacggucaagaaugcaaggacaaagacugauacguagguccauagguccccaggccagccuagaagccacuuuacaaacaguacaccuuuccugcuuccaaauguucuuuuaaaaucuuggcccuugaaacuuuuguggucauugguauuagauaggguugauggggaggggggugguuacuguugguauuuauuucuguugcccgaauuauuuugacauguacugagugacugcccuucucucauacugagaucuuucagguggagugcucaaugacuggucucgcaucacuaugaacccuaagguguuuaaacuacauccccgcagcggggagcuggagguacugguggacggcaccuacuucaucuauagucagguagaagugaguacggucuuaggccuaacucuucuuauauccagggugcagauauggugcaggccaccuaggggcacuguggagcaagccaaaaccauccaauggcuaacuucucgcagugcuggggaaaggcguggccgauuucacacugggagggaguugaagggagggaagaccaauaaacccauuucauuuuuccccuagaaaacuaucacugaaaaacuguaaagaggccucuccaacacccugcugucugauccccucuugcaggacccaaggcccucauuuccccucugaguuguuugguuccacagacgaaccugaccuugcucuaaguuuuuaagacuaaguuccagagcugcagagaccccuccccacaauacugcuagcuugggcaugauaaugaacagugcuccugugaaccuucucucuaccucaagaagauuucugacugucuuuccuuccucuuucucccauuuguuucugucuguuucuguuguugucaccuccuucuuacugucauucucccagaccuugcuccccuccacuuuuguccuucuccuguccugggcccauuccccacaggucugccaguggccauucauuuccaucccucauugcgugccuccaucggggcucuccucagagcuacaaguacauaggccuugaggucaggguuaccaggagguaggcagcaaaaggagaugaacagaaggacuaugcaacugucaaacagcucucaagaaaaaaaaaaugaauagagaaguuggguuaaccagcacuaaucuggcacacagaguauccguucauugcuugguccugacccaggagaugaugugccauuuaaauauguuacuuccaaucaaagagccuguggagucacuuuuaugaagugauuuaagguaucaaaugaaggacaguccccauuccuauggggcacugugggcauaaccccaauauccuguagacuaaauuccauuuaguaguggugaaaaauuggagcugagggugggaugugcuggcgaaagguaaugaaggaugaagauuaaaugucuggacucaggagaggauuaggagugaaguccaugugagcuaagaaagucucuaugaggccaggccauaggcuauacuuccuccuggccacagaaugaaguuaggugccuaggauuugcauccagugucucacuauauaggccagcuccccaucucucaggaucugcuucuucagucagcaagagaaagggccgagcugugcugagucugggagaggacugcaggacagaagaguacacugugagcuuaggaagcuccuguucacagccuagagaagugagaagucaggacuucgaccucccuggggcaccggggaucucuaaguguauuccuaaauugucuuuagugugggaacuggaaguuggugugucccgagcauugauuaagcacccaaggagugugaagcacugcuucgcgccaggguuauggaguggagccagugaaauggcucauaaggcagcucucggccucagggaguccguaagaaagguuugcucagcccucugaacccauggaguaggggaagggcagugugauccugucacccugcuguucccugccgaccaacaggcacaguuucggguggcacugccccugcacaggguauacuggcagcucaucugaggagguucuaucugcucaccaggggagggcccuacccucuuuuuuccucucucccccaaucccuucuuguugccucucacccaggucuacuacaucaacuucacugacuuugccagcuacgagguggugguggaugagaagcccuuccugcagugcacccgcagcauugagacagggaagaccaacuacaacacuugcuauacugcaggcgugugccuccucaaggccaggcagaaaaucgccgugaagauggugcacgcugacaucucuaucaauaugagcaagcacaccaccuucuucggggccaucaggcugggcgaagccccugcauccuagauucucccauuccauccuggcccaugccccugccccagguuugggagccaggacucccagaaccucuaagugcugcuguguguggaaugagguauacuggcguugcagccacaaagagaaaugccccaugcuauuuauuccccagugacuccaggaugacaaggccuaugugacuucccagaaagaccuugaguugccaggacaguugacggagccccaggguugucaagaagcagaaccuucuuaggcucccugcugacuggcuuauggugacuccucaacccuuaggucccucaucagauguaucauuuguugcacuaaaaugaggauccaagacaguaggccacaaaaagaaaaggugcacuccagauucuaggggugauggggggcuucuucucuccuggcugggggugccauuagguugcaacuuaaggagagggucaggucagaagaaggcaaguccuuguggcaaagaccugggcaauaaccuaccaagucaauauccuugacagaagaggcauucuugcugcauugcacuauaaccuacuagaggcucaaagaaaacuucccacucaggcugagagguauacuguggcagcuugcuggacuccagagcugggaacuuugcuuuggcuuggaaucaugcaggaaugaccacaugcaugccuauguaagaagcuauauuuggggucaugcaugucucauuguguuuacagcuauguuccacucucagaaaacuaccuggagucuucccaccugucaccacccaccccagucugacuagaaauucuaucuucuuucuccucggugccuaccucugcuuuagacaggugcuucacaguguacucuuuaaauuacuugggcacaaagaauuuuccauuuauuaggcauacaauucuucuaauucuaaucaaacugugucugggaacagaugguuaaacuggauaaccuccaaaagccccuuagaguuugaagaucgguggcacucagcaguuaccugccacaguaaauuuuggaauucccaaacccuacacucccuugggcaucagcacaguauagcuuuucuaccuuucccagggagggggagaaaguggggauagaacaggaaauguuguccacuuuuguugagacccaagcucuuaucugaaagagcagcaggccauggcccacuagcccagucuuucugcggugcuuuccuagagcaucugucugcuauugagcagggcucucacaccuacuucagauccaaaggcaccuccaccaguuuuccugcauugucuuaugcuagguucaugagacuucuuuccaauugccuagcuucaggguaccaggcacagccuaaagcuggaaggaucaaccugguccagccgguuccucuugcuccugaaauguauuucuuuuugaggagaugggaaaugcaucccugaaaugcaucaagaauaucagguacugaguucucagcuguaccuccauuucccaguagccacauugcuugguccuucacgggucaggacaagaggugguaggccaggacucuuuuauacagugcuaaugacagccuuacaaccagaaaugaggucgauuuuagacaugcaucugcccuuggaggccuugaacaaucagcagugguagcaagaacuaacagacccucuccuuaguguuugaagguugcuuccucuuaauuuccuuugaagaagacggggcagagaauuaucacaguuaccauuguauagguacggcugggagagaaagcacuuucauuaagaacucacccauaagucacagaccuuagcuuuuagugaggucugacucccgagcuagugucuuaccacacacuuaccacacacuguguggaauuuggguuccgaaagaaaaauuaaaagugaucacauggaacugauaucauggcagaguccuagggagaaaccuagcaaugcuaugguacugccuagucucuuggcugccacaggcucuguggaagaagucuuggauguuuucuaauccugaguugagcucugggacccacagaacuuggagccuucaugaccuuucacccaucugauaaaagcagcaaccaucacacaacgagcugcuauguggggcaaggucuucugucuuccauuccugacccuagcuacuaguucugggagccagucugcuuccugggguuaggugugacuccuccucuccuccugccauauuacaaaggccuuaauguugccagaacaucuuccucuguugauguugagagguugcccucccgagaauggagggaaaaccuaagagcaccauuccaaagccacauggcuauggagaaauagaggaaguuuccuaacugugccccugcaggacaugccaaccccaucauaugcucugugcuuggagaucauaggggaagugggcuucucacuacccugucuucauccugaauccucacaaggagccccagaugcagaaggcugggggaggaaauaagaaagaauggggggccugcugugcuguacucauuggcaaaguaaugaagcauuuacugauaggaaaauagggauauagauuuacaguuuggaauugucaugaugugaaguuaucccaagguuagcauagagaaugggauggggacauguuuguguaagcagaugacauguuagaagaaaaauugcaccgcaggagccucuaccagcugcuugagcuucaaaagccaagcuggcacaaaauuguaccugcuagauguuauguggcuacugguucccuggaagauguaucauuuugccuuaguugccccuggacccauccugagccuaaucucugcagcuuaguaagaaaaggcuaaggacccuagagaugagggcuuugguccucaugugagugauugcauuuuaugcgucuucuaguggaugcaaacagauguagagaaaucuuugaccuagaaaggcuuuuagagggaaugcagcccaaccuacaucccauccuguuacucauaugcaauugauguccagacagggaaacuggcccaccuaggacagugugcaggcaggcccccaccuccagacucagcaggagaaggaggcaaagcaaccugucccauggggccuccucuuucauacacccacagaaucaaagcuagaaguguuuaucucccuucaggagccuggugaggcagggagugggucuacaaucuccaucacaacuugccuccccacacauagucccccaagauauuugugcaccuccugccucugggcuggaagcuuuaggcuggcucugagccagacagauuuuaggcuucucuuguguugccugaggucccacccuugccugggcuuucccugggccaugccuacuacagaaccugauuuguuuucuuaauucauuucagggcucucuccaggagagcgugaggugugucauuucuuucuucaaaaagcuuccagcugaugaggauaaggggagaauggccuggagcaggcccaaugcugcuuuggggaaucagcauccugugugagauacuguguauagaaacuauauauauaauguauauaaacagggauguaaguuuguguaaauuaaugguuuauucuuugcaaauaaagugcuccccucaccauc

SEQ ID NO: 9642 - RNA, 875 nt, Mus musculus
gaugucugacaccgagcaggaacuccaacgggugauccgucgccacuaucgcgaaaaaagggagcuacaagcacacauccagacuuugaaagcuuccgucccaaagaacgacaagggcagacggaagcagaugcucgcggacaucucccgccucgaggccgagauggagcagaggcacaagcaggagcuggagaaauuuggagaaaauccugacagcaguguggauucgguuacagccgaccucgaaaagaugaaucucgagaauaugccuccacgcccacccaaggcccagaaacggcgcgaccgaagagcucaccaggagagacggcaccaggagaggaugccugcggcccaggccgaacaacuggcugccaaccgucgugaggaggaggaaaaggucgcugccauucuaggggcuaaaaauuuggagaugaagaccaucccagcugacggccacugcauguaucgugccauccaggaucagcugguguucuccgugacaaucgagagccuucgcuaccgcacugccuacuacaugcggaaacauauugaugacuucuuaccuuucuucaccgagcccgaggccggcaacuucuacacccgagaggacuuccugagguacugugaugacauugugcacaaugcuucguggggaggucagcuggagcugagagcccugucgcauguccugcagacccccaucgaggugguacaggccaacucacccaccauugucaucggggaggaguacaccaggaagccggucacgcuggucuaucugcacuacgccugcgacuucggagagcacuacaauucggugaagcccauugagguugcuggagcauuuggaggaauggcaccgcgccucuucuaga

SEQ ID NO: 9643 - RNA, 12999 nt, Mus musculus
augucuggacaaaaugauuuauuagaguguugcagugggggcuuccacacagaauuaucagagauaggcuaucggauccucuuaacucugucugcuguuggagcuuucuagcucugugucuggcuguugugcugcauaaacucuucgaugacuauguccuccgagcuuucaggagcagcaaaggggaauggagaguuaucaacccccuuccugggcuucugccacguucuugagucuagagagguaaucccuucccugcuucucagccuuccccuccaugccccauggggagggcguguuucccuucggaaucugucuagauaauggugccaaggaccaaggagcaucagaagggaaacaacaacagaggauggggcagagggaaaggauuaaaaaaaaagaugagggugaugcggaaaaggugggggggggcacaagucacagagacggggcaaccaacccaguuuugccagggagugagggaucacaaggacaacuuagcaacagaauggguuuugggagggaagagaagagggggaaaaauggaagggaggagggagaagaagaauuccaaaaagagcagcaggugacgggcagggaggcagggaaagagggcuuggaaaacaccagacugacaugaagcuaaaccauguuucuggugcacaguccugaaagcaacacuuugaggaagcuuuuaaaauuugcauccuaaaacagcaguaggcaagggggcaggguggagcuuccaggccucaugcugacuuaccugguagccacuguggcaagcaugaagagagaugaaaacacggaacugaagcucacaaguggcugugcagauccaugacuuguuucauucuuccuccucacccccaggccuuccccuccgcuguguccccugaaaaucuagacaucccaucugccuauugucacuccgucuuaagccacucuguucugagaaccguuuagccccacaacucgcaggauaauaguuccugguagccucaccugcucucuccccaggagauggcuuuggauggaucaagaucacgggcagcuccacaccaacaucacugcaagcaucccaaaguggaguuacugauguccuuaaaggacucaaucaccgaccuuccuucaguuuucccaauccccagaggcccuuggguucuucugaggggaccuuuagucuccuuaugcccucuuccucccuguccugccuugguccucucacccuagcuucucaccuggcuggcagaccuccuagaaugcugugaauaaaaugacaucccaaauuaguagcuaaaaauggggaggagucaacccaguuuggcugcggauaagguaccaccaggccaacuuaguaacagaauggaacuuaagcagggaaagagacuugugaacuuaguuuggaaaaagaggaauaccuugaauggucaauccagugggggggggggacaagcgagaaacucuuggcuuccagccccugcccagaccaacuggaaauccucacuuaccccccauaggacaccaccaaguugacucuaacuuuguaggacaccaggauccccagaagcuccuuguucauuccaggucgaagacuugacauuauagcaucaauugggggguguuaggaguauaauugaauuuaccuccccccaaauccuucccaugcuuuccuguuaucauguccccauugccuuuggcuuuucccaaaagauaucccaggcuguaauuguuucuacccaauugaggugacauuuuucuuccuaaaauuccacuugaucauguuacuaucuauuugaaggccuaauuuuugaacauaacuacucugcuuggcuuuuagaagccgaagcaaucuagcuucaucuacaucucucuuuucugcccugacucccaaacaccuagaaaacagccucugcagaccugucuucccacugugcuccucaaaguaccgugugggauuccugccuuccagcuucuucucaugccauguucccagucugaaauguuccuuucuucuacuauugguauccagauuuuacacaguuuuuuuuuuucaagaucuagaucauccuuaucuccucgaagaaucccuugccagcuauuuuggccuuuaacuucuauuggacucguaauauaaaacaggugcaccaacaauuaacuguuggauuacauuugcauuccucucuguuccucauccaggucauauauugacugaaggaaaagauugucuuaaaagucuuuguauauccccaucauauuacagaggagugagaauuuaauaggugcucaagagaaaccuacuguuuaaaaaauaagauacggaaagcuagaaggaucuuaggguagucuuugguugcuuugggggugcugauccccuuucuccaaaauaacacuauuuggauaauuucuaaagcuguuucuaugaauaacacccguagauacuugacucaucaggugcggggagaauugguuauuuaugauuguagaugguagacaaauggcuuuggugggggaggauuggucauuuaugauuguagaugguagacaaauggcuuuggugagaaacccauuuaaugcuaaucuaaaggcauagagccaaaugaaugccauggaagaauuuuaucaauuccugccauauaauugucauuacacauccucucuuuccaccaucucucauugccuaaccuucuacucuauucuacuuucucuagauaguaacuauuguagagaucacaguguuuagagccaguuggcauauaguagaauccuguuugucacauacuuaugcaaccuugaacaaaucccuugccucugagccucagaguccucauguguaaaauugaauaauguaucaccaggguugggggcacaggcccugaguucauccucugaaucuuagaaacaacaacaaacccacccaccuggccaguguacuuuaaugguauucucucuuuucucuuuucuuuuucuuucuaucuuucuuuuuuuuucuucaagucagaguuucccaguauagcccuggcuguacugguccuggauauguagacuauacagucucacagagauccacuugccucugucucccaagugcugggauuaaaggcaugugccaccacugccuggagauauucuuaggaauauaauaauagauguaagaccucugugaauugugucuuguuuauaauuuuuuuuuauccuugcauuuucguucauccauguuguacuccugcacauguguggggguggggggcccauggugaacauguggaaagcagagaggaauugguucuuuccuuccccagauguguucugaggacucaaacucggcuuaacagcaggugcccuguuugucucucucuuuuuuuuuuucuuggcagggucuugcugcauagccuaagcaggccucaaacuugugauuccccuaccucagugcugaccacuaagugcucggauuacaagcgugcauccccccaccccacucccaugccugguuugcacugugagauuuuauauaacagagguuuucuguucucugcauuuuccuuucucauuaccuaaagccuaaacuuacuauuggccccauaggcauuaauuuaacuugagccuggcucugagacuugugagcacacugaacccuggcugaggaacauuuuaaaggacaagucggcuugacugaagaugaaaccuuacagccguguguauagcauguggcuuaggaguaggaaggagaaauucuaaauuacauaugagcuuacauugugcuagaggccagauuggugucuucaugcuugaguuugccauccagugccaggcccugcuucugacaguuggcagccaggagugggguuacugcaaaggucugggagaagcuggaguuagcagcuacugucucucuuugaaagagaacaagagaggaacuuaggccaugcuggccaacuaaauguacuuuuacucccaagaguaucucacauagucucaagaaccaguggaaaauauacagagaaguggcauaucuuuggagaaugggaaaaugagcucuggugggaaagcucugcccuagcuuugucucggucuucuucugaugagucauagccccacccauaguucuccugagagucccuccccuugugggcuucaacccucaccuugacauuccucaucucuuaguuauccuugcuauuucuucuuuuccaaaagaaauagcaaggaucccuucucugucuguuggccuucuucccaccaucuaaccccuuugacuuucuccccagccccagccccagccccagcucacgugaacuccugaacaaacacagucuucguguacuugucuagugaauacaggacaacaucuguggucuggacaacugaaaaagucagggaaaguaaaugaccaaucaguuggucucccacauggcuccagcuuacugcucuuugauaugaucuugugugguaagaugagaccacauauuuugauaggccuguuuuggaaggaaaacucagauaaauauuaauggguaagauguacagcuguuuuuuagaaccuguggcuugcgggccagaugcagagcaaaggaagcuuaccugcaaucuugauucuucugaugaccuuguugguauaguuguugauagaaacauguacagaaauagcuucuccaugguaaugaaccugaagcaggagaagccuaugacaagauuggaaggaggacacccagaccuaaaucuaaaauucccauuuccuuaaagucguuguugcccuggcuccgggcucugccuauccauccacauuaagacaucaguagaaaggggaagcagcagagggggucuaagguagggaauaggauaugggaggagugcuaccaaccucccuguccauccaggccugcaguuguaggggcugagaugacaaaaagaagcuucgaauggucugugccgaaggaccagggccggguuccagggcugaaaacugcacuuuccguacaaccagcugcacagaaucacugaguaaaguccaaaggaaaagcuagaacaucuuauucuggaaacacagacuaccccccacacacacacacacacucacuacccuuaaagcgcuguguuuacuugggugugggagugggcguggccccuuagagaccucccuugcauccuugauauuccauagagcaaggaauugcaaauugccccacuggcuaaaucuguccucuuucuuguuugucuguggccugcagucuaaggaugaugaauacaauuguaaaugguuaaaaugaaucaaaaagcuguauucuaugacccacagauauuacauaaaguccaaacaucaguguucaugaauucaguuuuaacacaucaauuuuuuuuucauuucuauagugucuguaacugcuccagcacuacagugacaacagaguuacagaguugcaacccagacuugauagcccauaaaauguaagggugugucuuuuagcuuuuuacaugucugccaacgugagugaagaagacaagugaaauccuagggacucagaacaggacauccaaguugguggcaguggugcuauggugacuagaucuguuuuugcccuaagagaagggucugugguuaaggccugaggcagauauuugggggaaaccaaagacuaccucuuagggauuuucucuuccagauuuucugcacagaaacucuucacuucaaagucaaccccacagggcuauaaaaaaaucagagacaaagagaauguaguuccaguucccucccucccccguggaacuacaugaaaaugucucagucccguagcuguccauuucuucaauccuguccauuugucuuccuucccaggccccgcuguaauuaccugucuaucugcuacuguucagaucugaaauguacccuaguugguuauggaucaaaggcuuggccccagcuugugguucuuuucuuuuugagauggggucucguuguguagccgugacugaccugaaagccacuauauugaccagguuggcuucaauuucaacagagaucugccugugucugccuccuaaaugcugagauuaaagauguguaccaccacacucagccuagccaaugcuucuauuggggggugguaggaaauuugaguugagaccucuuaagagcaauugaggaaguuugguuuuuggagacaugcccuucucgacauucuguuugcucccugggaucaaaccucuucugccaugugcucccaucaucauauacuauauuuccaggagcccaaaucaacggaguuguauagccauagacugaaccaugaggaaaaaaaaagaaagaaagacaagaaaaagccuucccuccuuuugaguugacuaggucauugguggaaaggucauuagcuaauggucuuccuuaccuuuccugaaucuucaggcccaggcugcaguguuacugaacagggcagguuagcaaccaucuaggaaaucagaaggagcucagaaaaauagggacaacucucucuguucuccuuuuaucucuuaaucuucccuggaaacuuugcccaagacuugaggucaguaccugaaguguaaaaggauaggcauugaccccgagcuugugcagaagccgcuccuguaaggcugugagggggcccuggaugcugguggguucagcuggagccacuugcuugguuuguacauagagaucuuugcgaaaugucagaccaaucacauccaagucaucacggccauagcgaaaagcacaggucaaccugacaaacacugcuggcaaaagaggaagagagugagugacuugucaaacuugugacaaaggaaauccuaaauggggggaaaggaagacccacagaggcaagcuaguauaaucccaaaaguauagucacaaagaaauauuugguuacauuugauugcaauaguauuuuaaaguucucuguguuacaagguucacaaagauaaaaggaaauucagaguucaaguguuugaaacacauauaacuguuuagcauuuggaauguugaaaggccgaggagauaguucaguuggcaaagaauuugcugccaaaguauaaggacuuggauuuggucccaugggaaaagguggggagcaaugguacaugcuucaaucccagcgcugcuagguggagacggguagauagauuccugaggcucucugaccaccuagucuggccugaucagugggccccagaacagagagagagggggagagauccacucucaaaaaacacccaagauugaccuccggccuccacacauaccuguacacacaugaacaaaauaacuguuaccaauugguaacacacacacacacacacacacacacacacacacacaccaaucuaaaagugugccaagaacgcagguggauucuuagaagcacauguggaauggccaaagauuuguguagucucaguaguaaucagauacauccacaugaaagccacagugggaugacauuucacacagaucauacugucaaaaauauugaagccagacauugaguguucaugcugauguggcucaguuggaguucaaaugcacgacuggucggagcuacugucauaucaccacaaauggaaccuuuucucaucuucauuuaugaaugguguuuagaccuuuauuagagaagccuuguguagcauccaucuuuuuuuuuuccaguucaccuucugucaccuauguacacaacauuccuccccucuggagggcccagcaauaaggcccaauuuugcaugcagagagcagccuuuacagaaaauugaacaugcuacucaccuuaacuuggauuugccuggcuacugaauagugagaaaguaaauuucuuuuccuaauauauuaucuaguuuuggguauuuugguacagcagcauuagucaacuaagaaguauaugaauaauuaaaugauuaaauuucaaaaaaaaaauucuagcaccagaauuaaaugugcacuguuaauuuuauaugcagauuaaaacuguauauaacaauguaaaaauugguuguagacacagaauguuaaauauaaguauacaagcaucauggaccaaauaaacacuaaauguaggauagugguugccuggguaggagaaaagacaaggauagggagagagacucaaaaagaagggcagaggaagcuuugggucuauacuucuuuucaaagcuaggugguagauauauuuuuuuaugccugaaauauuuaauaguuuaaaagaguuaacaagaauuagggucagauaccagcaagauagcucaguggguaaaaguacuuguuccauaagcugguugacuuuauuucaauccccggaacccacaaaacacuggaagugguaguuugcaucuauaaucacugcauucagaaggugagaugcgaggcagaggcagaggcagaauuggccagacauucacguuacaaacuuucugugaaacacuagcucucugggaauucagccuaaagagcgaauuggauacacacaacggguugggggaugcagaguuguuuauaacagcaaaauauguuaaaacaaauguugaaaugucgaaaacauguugaaaacaaaggaaauguccaacgaguggauuuuuaaacgcagcuucauagauuauggauucauauauguugacauagacuuaaaagaaaauuauaagguauuuaugggauuauaaaauuauaaaauagggguuuuugcacaaaaaaguaaguagaugaaagcugaaaugggguuaggaguaauuaaauuauaaucccuucaucugugauggccuugaacucacagagaucuggcuaccucugacugcuacuuuugcuggcuguguguugauuauagggauuaagccuaugauuuuuguaguauuugauuuuauuuuuuguauauuuauuuuugagacaggucucucugugaaguucuagcuggccuggaauucacuaaguagaccagacuggucucaaacucacagaaucucaugcacacuagguagccgcuuaucuuucuuuguacuuucuuauucugaggccucagagaucucucuaaauuugcccagccuacucuugaacuuuuugugauccuccugccugagccccucuugcccaggcagcugggauuacaggccugcauuaccaggccuggcagguugcuuuuauuuuccucuaaaaggcaacaucuacucuaaauguguccauuuugucuuaaugauauaaauuacauacacauuuauaugagcaucaaaaauauaaucaaaaagaaaaauucaaagcucuaccacagcaccauuuuugcagagauaagugccauguuaucugcucugaugccuucuaaauugcuuuguuucuacaacuaaacacaaggcaaucucagguacuuauaacuguuuucucauuucuuuuccgaaauuaaacauuuaaaaaaacuuuugugacuacuguuuguuuauacaguaaaauuuugcaguugcaaagaauagcacacagagaggccagauagagugcuauuaaacaguaguguguguguguguguguguguaccauaccccacaucuuucgccucacuugacuuuaccacucagugcauagaaaaggaugguuuacauuaaaacauacaccugugauggagaaggacuugaaaaauacggucaaagcaagaugauguucacaaaguaacagagcauacaagugggaggaaaugucagaaauauauaagauugaaaugaauaauaagucaaaacucuaccaaagagacauaaaaaacucaaauauaucuaauuucugaguaagccuguaauuuuugagagauaaguucuuccuauauaguuuucacaggccucaaagucacuuugcaugccagccuggccuuggacuugcuuccucagccuccuggguguugucguagauguuagucaucaugccaagcaacaugcagucuuuaaaaagugaauauuucuuuucauagguuauucugggaaauuuuagaagugcgggaauaaaaccacuuagauuuuagaaacagaguauuuguuacuuauaaauaaguuggcuaauuugugccuauucugaaaaguuucucugacauuugaaauuguccagagugcuuauccguggugcuuaaucucagaaaggaaagcucuuucauucccaguaucuaaaggcuauuucuggacgaguagucaccaacugguucugaaucuuuucuccaguugaacacaauuuucaguccaguuggaucacagugggguuaauccauagugagaauuaaaaggggaaaauucagugggaaguaguucagugcaaucuugaacuagaguucggcugccggagggcugugcugucuccugcugguauugccugugcuuguuauuuccuugguuuuuguagaauacacguuuaggcccucuccuucucugucucucucucucucugugucugucucucucugucucucccuuccuuaucucucucccccacauacacgcaugcacgcacauacuuggcacacacacacacacacacaaaacaaacagaugaagaaaaaaaaaaccuuguggaaugacauauaucaaagcuuuuaaaauggaagcccaagggacacuucggcugcagaaaaaaaaaggggggggggaauauuugaucuuuacaaaucuuuuagugaguuguuaacauuuggaagucaagaaauguauguaaaaauauugauuuucuguguauugguucauuccauaggcagucuaagccaaauugaaaccaguagucaagcaagaccaccauagcaguaauggggaaacccacaaauuuuauuaagacauuaauuucaacacagaugcuuguuuuguguaauacugcagaguauaauuguauuuguucuuuaggcauauaguuauuuugaauacuauuuggggaaagaauacaaaaaaaaagucuuucgauauuugggaccuauaaaguacguagcuugagcuccacuugcaauacuuuuuacuaacugaaagacugcggccacccugagcugaaugucccugcugcuuucugcuuccccaugcuccucugcucuaagaccacucacucauuugccuaguuugcauguguggcauuucaguugggacuccugcugcuuuacagaaaccaguaaggcuuucuacuuacacuuucgaccuucuaaguacucggggucaacaaggacgacuccaucugcagagagagggagagauggcacacugcucaggaaaacuuggagggugagugaaacaaaaguugauuccugaaaggauucuuuccuuucuaccuuucaauuggccucauagcucugcauggucaugccuggccuuuccuuuucuuccuggcucccacucccuucucaggcucuuucccacuuuggacucacuaaccaaugggcuccacaguguccacaucauccacgaagucucguuuccccagguagauggaaaacuguuguggaacaacuugcuacaucagucucacaguuaucuuugaaggaauggucccaaagcccccagccccgcccaccgagaugcugaagaauggacccauucauccucauugcccuuccauucggacagaugggccagguucucuuaccuucccauuggagcuagucuucuuaaacacucuguggggugaacagucguaaagaaggauggucagcagaacaaaaaggaagccagaaaaggaaggaauguuuggggaacaggaaaaauuccuaggaagaggcguggggaucaugagauagagcaaagguagagaaaauugggguaggccaaagcuauaaaccccuccacgcaaaaggcaaauacucaggcuuggauaaggaauaauucacagauccagagcaucagaagggauucuuacguggacaugcuggccaguugaaucuuuccugagaugaggggaagaggaacacucaguuauuuaauccuuuuuuuuuuagugcacuauaauauuccauaaugauacaccuaguguaauauaaauuaacugccugagauaccacaccaacacucaaugcuuccuuuuuuuuuuuccucuucuuagggcaacucuucaguuacacacuuacccaaccauugcacuacauucucuuucucucuuucucucuuucucucuuucucucucucucucucucucucucucucucucucucucucucucucucucucucucucucucauucucucucucucucauguguaugugcaugagcgaaugccugugcauguauccaugcaugcacaggugcaugugugugaaagcuagaggaauguccagugucuuucuugauugcuccucaucuuauuuuuuaaccccuucuauuuauccuacuugcucauacuccaucucuuaaauacguuccuugggcugcauugauacugaacuucaacaggcacacagucaguuaacuauaugaauaaauaaaugaauggaugaaauuucuuuuugucccuguacuggacuugacccugaauugggaugcuuuugaccuccagcucagaaggaagaacaggggggaggugggggaaagaagagggaaagcuguagaacagaaaggguugcgcucauacuuucuugggggguggcaguagaagccucuguggaggccgaaagcccucuuugcccuuacucaucaucucucuugucacuuuccccaaacauuuccauccuguccccacgcuuaaggugcuagggaagcauagagagggaaaugucuuucuggugcuuuccuucaaaacauaguaggcuuggucagagggaugaguugggggggggugcugaguucuagaagucucuuacaucagccugaaaaauccauugcuugcaucagaaaagaugccccucuccuccuaaagaagaugcuaaaggcaaaggagguggacuuaguaugggcuagaagcagagagauuuagaauauuaccugagggaagagaugaagcucgcaucagccuccagcucugguugcuaagcuggccucccagccucuuauauccacaauccucugaaug

SEQ ID NO: 9644 - RNA, 6999 nt, Mus musculus
aaggaaaggcacgucuggcagcccuccuuaaucucuuucgagacgagggggcgacaacgcagugccacucuuacgggaauccccuucaccucuucuuucaugguaccagcucagcagguguccgugcugggugaagccggcucucccaggagcccccggaggcuggcaggaguggaaaggcccuucucaggcggugggagagcucggaacucgcugaugcacucucccucccagcgggaucacgguguccugucacucuuggccaccgccuaaagguuugucagucccaauacugcagggcgaagcggcgucagcaauaaggaaacuccagcagagacagcaaccgcgaccccaagcccuaaagugcuccaaagcgcagaaucggagcuaacgcggugcccggguaacucaccaaacuaaacgucccucucaccgaccuucccuggcgcccuguuccaaccggagcuuuaaccgccaaguuucaaauugaucccagaggcgccagccaaucggagcgcguacagccugugagaagcagacgaacuugagcacgcacaccgugacgcgcaaggaggcuggagcucuggcucgcccaaagagagcuccgccccggcagggugguaggagcauccgcuuccgguuccgacgccgaauuggcugucgcugaccgaggccuucuuaccggugagguggcccugaguuaaguggucgcgagcgcgggauucgggcggguugcaggaccuggaucuagaagguagcccguguagacggaacccgucuguggacaccacguuuacuaagcaccucuagagauugugucuggccccaaucccuaugggauaguuaagaguuggcacucccuugcuguuuuaaaguagaucuuuguagauguguagauucucuuuuccuagguuggaaguggugacaccuauuguuuuuuguagaauugugagaaaugcaaacaugccauuagagugcuuaaaaaauuaauuuuuuugucuuuuguuuuuguuauuuuguuuuguagccugccucuccucccuacccccccuccccaaucuuaacaccuacuugugggcuagucccauaaaggaauggcccucggcuggaaggcuuucuggaacuuagagugcuugguccuuuuuaaaaucauuuucguuuccuuugauucguccuuuucagggcuuugccugaaauggacaaccggauucccuaugaugacuacccugugguuuuccugccggccuaugaaaacccuccagcguggauuccuccucaugaggugggcgccaucugcauuccugaauaaucaugagaucuaugaaagaaaaaguagcagggcuaggaaacucaguggagaguggaucuuaggugaauucugagcaacagugacccacuggugacuucuugcagaaucaccaugccagaacccuucacacuggugaauucugaaaauucagagccuuaauuuccauccugucaauaagaaaggacuagggaucuauagggccacuaacaugucccgagacuaaacagccacuccucuggacuguuuuaucugugcuuuguaaacugagucaauggcuuuaccaauuccugacauauaucugguuuauugguauucuaaaagaagguagauguaacacaucuaagacugggaauaagauuucggggauugcuguaucuugcagagaguguaccacccagacuacaacaaugaguugacccaguuucugccccgaauuguuacacugaagaagccuccuggugcucagguaaacuuauaggggcucuuauuccaguaacguuugguccaugccagaaauuggccaugguugggguguggauguggauugggagguaggugaccagaaaagcagagguggcacuucuacagcaucuccuuuucuucugaguacauagaugucccuguucuuaugucucugcugagucugcauccuguguccuuuugucuuucaguugggauuuaacauccgaggaggaaaggccucgcagcuaggcaucuucaucuccaaggucugugugaauguguguguaugauaggcuguauggcuagcuacuuuguuaucauauuaaagugcacugguggcccagcagauaaaaaaauggaugacccgcuggagucauaggauagacauaauggaaauucagccuuucccuuugagaacuguacuuggggccaguaugcuggggcaugugggcaugucaguacucugagaacucgagaggcagaagggggaagauuaggaguagguaacaaucuauaaagucaaggcagacaauggugacauaggaccuuagucccagcacaugggaggcagagauaggcagaucucugugaauccaaggccagucuggucuacggagugaguuccagggcagccagggcuacaaaagaaaaacccugucuuuaauuaagaaaaaaaaaaaagaaucucaaaaaaacaaacugagaaccaaauuucacuagcaagccacuuaaucucccggcgguaucaccaaaaauaacacauuugaagagcacugaauuugcccugcagucuccugauuuacuccaucacaacuacauaauaccucuucacuaacaggugauuccagacucggaugcacaucgagcaggacuucaagaaggggaccaaguucuagcugugaaugauguggauuuccaagauauugagcacagcaaaguaagcauagcacauggacuauagucaugcacgaagccaucucagguaggacagguuggacccgaauagccuuaucuguaugaaagcaucucuucaagggaaauguaccagaagagagcagcuaucagugagcuagauggggcgcauuccauugcuguauuauaguucuuuccugaguaauagcucuucauuuguacaagcugccguguuccuuccaggcuguggaaauccugaagacagcccgagaaaucagcaugcgugugcgcuucuuucccuacaguaaggcacuuucuuuuuuucuuuuucuuuuuucuuuuuuuacuuauauggcagggcucuagguaaguagaagucuuugaaauauggauaauggcaagccccagaaguugagaacucauccugaaaaucaugugcuguguucuuucuuaccccagauuaucaucgccaaaaggaacggacugugcacuagagacuugcagcccacagccuuccgugugggaucugccaggacaagcuggcuagaccucugagaaguuggagaagucaggaaauuguacucuccacaccguccugguuuaguggauggggaggauggggugacggcuuaccagcuguauuauguacuguacuguacuaggaguucccuaguuugcuaggugaguuucauucuggaaaaggagaaagauagugaugucuagaugccuguagccuguggggaaaagccaacuagaaaacaacuggcguuuaucagguaccuuagauuggucacuuauacagcuaauuuuauucguagaaaucaguagaaaaaaaaagucuugggaaccuuccaucugauuugccuggccaugccauccaguccuuguacauauauaccuuggagucccauacacuuaggaaacuccaaggagacacguccugcucauccccgcccccacccaaaguaaaaacacaauacugaauaaacguggcuugagugauacuacugcuugaauauaaaaugccauugaggaaaacaaauacaucaaucaaacacugggagaaacagcaacgucauacuuacuuuacaucucuaucaggccagaauacuugggagcuuaaaaaacacuagccaucgaauacccgagggagcugggcagugguggcgcacgccuuuaaucccaagggaggcagaggcaggcggauuucugagucugggccagccuggucuacacagagcaacccugucucucaauacuaagggaucccuagagucaagggcucuggguaaaacugccccuuccccaggaguguucgacuuggugcuguagggguugguguugauauauuuuucccacauucucugaucuggaacuuaagccaaggaaguggcauagauuauuccuuuucacagauagcaguaggaaagugguuucccacuuguaguuagugggaauuaccaacuuccuccuuuuucugacccuacccccaaauagcuuuccuuuguccuagugacugaacauuacauaucuuacacagaucaugacggugucgucuccauugaaugacauuaaaauacccagucauaauugaaagguuuuuuuucucuggaggaggugcugcuacagugaaagcccaacauuugacuuaaaaagaauccuagggagagcagagccaucgaggggacucucugggcugaaaggaugccuucuuccaaggcugacaaucugaguuugaucuccaagacccacaugguggaaggagagaaccggcucccaaaguugucuauucuucgccugcagggaguggcaagcaaacacgugcaagaauccuggagcuggacagaaucuccuaccuuccucuggagagugauucuuuucauuugagagagaacccaggaauuuaccuuauuuauuuauuuacuuacuuacuuauuugggauuuugguuuugguuuugcuugguuuuguuuuguuuuguuuugaagcagguuuucucuguguagcuuuggcugguuuggaacucacucuguagacccucuugaacucacagagaucauuugccucugccuccugaguacugggaucaaaagugugaaucaccgcucccacccccacccaggcuggaaucuacucuuuuaaauaagcaagauaacauuucaacuggcugaaaugugggaacuggcucuucccaugaguccuaccucagcuguacuaaaggcaugacuagagacucaguucuaugacauuguuggugcugaaccuucugagcagagcuggagguaaaauuagcuuaagucuuccuaggaauucuauacuucuauuugcucugcugacccccaguggccaucagggagagaaaagcuuggcuauuuccacaaaacuaaucgcugugucugcugaacguuaaaguccuauuuccauaguuauuaaguuaccaguucuuuuuuuccugagguagguucuugguacauacuucaagcuggccuuggacuuguggucuuccugcuucagcuucugaaguucagaggauacaggugcauauagaccccagcuguggguagcaggauugauuuuauuuauuuuuauuuuuuuuuuuuguaugugaagguccaaaguugacauuggucaucuuucuucacuuuucaucuuauuucugaagacuggaucucucacugaaccugaaucucuuauuuggccagguugucuggcaaggaggccucaggguuccuccucucucuaccuucccagugcuggaauuacaggugugagcuaccacauucacaauuccuuuuuuuuuuuaauauaaucucuguuuuguagcucugccucuuccuggaacuugcuagguagaccaggcuggccuugaucucagauccacuugcuucugcugggauuaaaggugugugucaccaugacaggcacccagcauuuuaacuacacuaugggauucaaacucauguucucaugguuguguaauguugacaucucuguagccuccaguugagauuuuuuucccuuaucauaauuuauuaauucagcagucauucuuuuagcagcacuuaaaaguucuacacccuaucugagguccagggaacauugcagaaaaaguucagggguggaaauaauagagccagaggauaaggaggaaaacuaccuuucaucuucuccauaugacauagccacuguagucacaaacacaccaggcugcgguucccugcacaagaccuuggagauucauaaugcugagcuagaaagagacccacagaaguuucuuguaaagaucuugcucuaggaaagcaguuaucaaccugugggucaagaccuguuuggggaagccuuaacgaccuuuucaacggggucgccugagaccaucugcauaucagauauuuacauugugauucaaaacagcaaaauuacaguuaugaaguagcaacaaaaauaguuuuaugguuuggggucaccacaacaugaggaacuguauuaaggggguugcagcauucagaugagguucacagguauucauucuuuucauuuuacuaauaugguucuuguuuugaauaauaaaaauucuucaagaccuaguagagugacacacugaguuggauuucagauuaaauauuauuuaauaauucagguggcuugcagccuaagaaacugggaaaggagauccaacaauucccgguuaauagcuuuuaagacaauaugggccaaugacuuggcuuaguaagcuaagguacuuagugccaggccugaugcccugagcuagauccccaugauaggaaaacagacuucuguaggacauccucccacacacagccacauguaugccauggcacauguguucauauacaugcucacauaguaaguaaauaauaaacacaaaaagcaacuuaucugagaaguguagucaauauggucaaaaguuccagccauggagacuggagagaucccucagcaguuaaaagcacugauggcucucccagagaacacagguucaauucccagcaccuacauggugacucaaaaccaucaguaacugcaguucuaggggaucucuaugcagacaccagguauguauguggugcacauacagauaagcagguacauacaccauuuuucaaauuuauuuuggggaucaugauuauaucauuucuuccccccacccuauucuucuaaaccuuuccauauaucucuccuugaccucuuucaaauuuguggccuuuucuauauucuuugauuaauuucuuucaucgauuguuauuguguauaucuuuaggguaccucauucaauaugaucguuucuaguuccaucca

SEQ ID NO: 9645 - RNA, 3057 nt, Mus musculus
uggcuuccuaggccaguaaaaacugccaugguguuuccugucaaagaaaauggaguagaaaauggaucgcugcgacagaaaggccuguggagcagagagagaugcuguagagauuuguguuguacuugaucucuuuugaggccaaaguugacuuggacuugggacucccuaaaagccagcuacccuccaagaucuagagacuuucucugacuccuguauuaucuaguacccccuuucucaacuuuguagggaaggcuggagcccuugcuccuccaagcauccuagacuuccugguuuuaaagccuuccuuucuuaacccuugugcacacugauauuuuccuggaauaggaaagcauuuuccacuugcuaaucccuguauuuuuauucaaguauuagaagaaggacucaaggaagccuuuuucccccucuugcaaauuagauugugggacugacagagaagacugugcugguggccucggacaccguuuccugucuagagcaggguaacaacuccaggacuguggccuccacagcuaugaacucccagucaucucgaucucaugccaucuuuacaaucuccauugagcaaaggaagaagaaugacaaguaagucagagcguccuaacugucuguguucuguguucagccgccugccagguggcugcccagguugauuugacauucagacuuuagaguuaugagcauuaaugacccccggagcuacuuugacugucuuuuaaaagacaugagaacugagccagucagcucugauagcucagcuacuuuuaagcuuaucuauuguuuucaccgugucuuccuguuauuaucacagaaauagcagcuuucguuccaagcugcaucuuguagaccucgcuggaucagaaagacagaagaaaaccaaggcugagggagaucgacugagagaggguaagccaauugcggucauaacuaacucuucggcaaaaacacacaugcuuuuuuuguugcuacuguugguauuuugaagggacuauuucacuucaucuucuaagugucuacaguucaaauuugagauuacuuucagaaauagugaaaaaaugauuccuuuuccuugcacugauucacaaauucaagugugaaauuagaaucucuccuucaguugguuuucaucugguccaguaaauucuagcuuuaauuuaucucuagugacuuauaauuaaaauauuccaguucaaccagguguggugguacacaccuuuagucccagcauugggaggcagaggcagguggauuucugaguucgaggccagccuggucuacaaagugaguuccaggacagccaaggcuauacagaggaacccugucucgaaaaacaaacaaacaaacaaacaaauccaguucauuguuccaugugcccgcugccccuugcagauguuacuguguguaaaccuuaucagcauagcuuucauaucuuggcucaagucaccugaaaacugauguuacauacuucuaauaugacaguagcccagugauacgcccgagcuacuuccuucuucagcaucuggcuuucauuucuagaugaguuaguuuuauacaugcccuuuguguuuuauauucacacguugggcuuuagccuucuuuuuauuagauguuugauucugaguugauuuggggggauuuacauaauugaaauauaacucacauauuguauuuaaaacuguacaugucaauggauuucauauauucagaguuguguaggcauccccacugccucgucucagaauauuuuaucaccccaaagagaagugccauaacccauuagugcccaccccccauucccaucuaucucuagagaaaauaauaagugauuuagauacuaauaaaaauagucacuuuuggugacugaugucuuucacuuagcauaaaaucauauagcauguuaaucaguacuucauucuuuuuauugcugaguaauauucaguugcauggauauaccacauuuuguccuguucaucaauuuucuaguguuggcuguuuuaaguauuauucucugagcgucucuauguaaguuuucauacaaacaaacugguuuuguuuuuguuuugagaaaaggucuuucuauuuuuggcucccccagaauucaguauguagaccaggcuggcaucucauagggauccaccugccucugucuccugagggccacugugucugaccucagacaaacuuuuaaaucuaucuugaggacauacauagggauggaauuguuggguuauugguuaacuccacuuuaacuuucuuuucuauaaaaaaauauacagagugaauuuuaguauauucacaaggaguuguuuaaccauucccaaaauaaauucuaggauguuuuuacuguucccugagcaaagcugauacccauuagccgucacucccugcuccugucaguuugcuucugcccuggcaauaacaaagccucuccccuucugcaaauuucacucuuuugagcagcucguguagaaagucuuauaguaugugcccuguuuucaucgacugauauuucuugagcagguucuugagcauacuaauccugagcuacacuagcucuuccuucauugacuguuucucgaaaagcauguuuuccuaauccauccauguuauagcauguaucaaugcuucguuccuuuuuauugggaauuaauuauuccuuuuauagaaauaacacauuuuauugaugcauucuuccuuugacagauguuugagugguuuccaaguuuuuuuuuugucuuugugucuuugguuauuaagacuaaugcugcuuguuuguuuguuuguuuguuuguucaaucaguuaucauguagcccaggcuggccuagaacuuacuauauagccacggcuugaacuuuugaucuuucuacuaccucugccucccaagugcugguauuauaggcaugugucacuaccauauuggcuaugaauauuuaugcacaaauauuucuuaaauguguauguuuucauuucuuuuugguauauauguauauauauauauguauguauauauauauguauauguacauacauacaca

SEQ ID NO: 9646 - RNA, 6815 nt, Mus musculus
gacggugugcgugugcgugugugugcgugugugugugcccgcguguacacaagcgaguguguugguauugaaagacccccgaagggagacccucacucaagucucgggaacgucgcgcacccagugggacacagagaccggacuuugugaucacacgaggaauuuuuauugaaagcgagacagaacgagagcucaggccagcaugcuggggucgagacucauacaccaagcaaggaguagaggaguuucgaccccggccugaaauuuuacagagcuuauaaaggcaaaaaccacaaaccagggggaggaaaaggggaaauuuuaaaaccauaaauuuucuuaacagcuaggugaugugcuaccuuaggcaacgcuccuggggcuuugagacauuccacacgggucguuggaacauuaugauugauccaggaaagguaagguaucuuccgggauuggcugaggcucaaggaccaaguguuuaugacccaaguguuuaugaaccuaacagguugcuagugauuuucaacucuucaguauguauauuguguugugugucauguguagggagagggcuuagggcugggaucccaugacguuacuggcuccuccucccggugaauauaaggggcgcuuggcuugcaaggacccugagcugcggcauugaagcacacccaacccaacucgacugaagucagccucacugaaccggaucugagaaucuucucucucugggcuugccagggcucuccgguaagccuuuggggcuggcacgugugucagaguggggagagggaggcuccucuuuuaccuaggcuuuucaggcaaccagggcuugcaauugcaucagcgcaacugugaccuguugcugguaagacccuagcccaggagccagggcucccuagcuccagcgcauuuccagauuguuuuucuucauggagccauaaaaaucuagaugcugagucuagggccaccgggcgggaccccuaaucggccgagagggaagugcuagcgaucucgggcugguuuugccccccaccccccaggcgcaucucccaauuucagagaccgaagccccgccucacugcuggugcucacuggucaucguagccuagccggaggagguggggaacauuugcuuucuccgagggcaaagaaggcucagguggaucgccggggcuuggugagaagggauaagauugaggucaguccccucuuccaggcguagccacgucucugaagcucucugggcgcucacuaaaagggauguggguaauggguguaaaaaaaaaaggguucuuucagaguugccccgaguugaguuccgcuugauucaccaggagccauaggccggggaaacagaaauguuagguuucaaggcugcugggcugggcucuaggguaaaucccauagguucuugggcaggaaaagaagaaaccuaauguccuagcacuuacuaaaggccaaccacugugcuauacagagcuuucucuagccuuuucugaaauggguccuuccaccugccugggagacacuguaauccccacuugcauuauuauuguaauuccuacuugcauaugaagaaaugguaauuagagguggaaguggcuugcuuucuccucuucugcccaacccccuuugucccuguaacucauucaccugguggagggaguggguuuuguaauucacuuuuggagcuugugggggacaaugagacccauugaagggcuuuugucuuguuuuucaccagaaccuagcuagcauccucuucaauuccaacuagaaugcuguggcaggcacuucgaagauuuggucaaaagcuggugcggagacguguguuggagcuggguaugggugagacccgccuugccagaugccugagcacccucgacuuaguggcucugggugugggcagcacauuaggugcagguguguauguccuggcuggagagguggccaaagauaaagcaggaccauccauugugaucugcuuuuugguggcugcucuguccucuguguuggcuggacuguguuaugcugaauuuggugcccggguccccggcucugguucugcauaucucuacaguuaugucaccguaggugaacucugggccuucaccaccggcuggaaucucauucucuccuacgucauuggugagauagaugcuugggguaggaugggagggauggaugauuacacaaauagcagagggauuauggauccagaaauccgagugcaauuucagugaagucuaaauugucuuuauuuuuccuaguaucucaauacuucuagaugucuguuuguuuguuuauuuauuuauuuauuugggguagggguauagggaggguuugaaggugcaguacaauuguucaccuccgucugguguucauucauuaagauguuaguuagggucuuuaaaauuaauaacaggagcugggucuagaguuguacaccuauaauuccagcacucagaggcuaagguaggaggaucaagaguuuguuaagucugaggccaggcuaggccugagcuacauagagagaacugucaaacacacacacacacacacacacacacacacacacacacacacacacacagaguaagguggguaauuauggcaggaaucugugaggcagauguauaggagggagggaauuugaucuuauaauauuccugaguauugggguuaagguagaaaauacaauugcuauaccagguacagccaguguggcccgggcuuggagcucugcuuuugacaaccugauuggaaaccacaucucucggacucugaaggggaccaucuugcugaagaugccucauguucuugcagaauauccagauuucuuugccuuggcccuuguguugcugcucacuggugaggcaaggggcagggugaaugaugggagggguugggcuugggaagcgcucaaggguaaugaggggaggaaaggaagcugggaaggaaagagucugccacacagaggcagaaaaaagggaaagcaagcguggaggaaggauuuuguccucaggauccugaacaauuuucucccacaggauugcugguuuuaggggcaaguaaaucagcccugguuaccaaaguguucacagggaugaaccuuuugguucucagcuuugucaucaucucuggcuucauuaagggagaacugagaaacuggaagcucacgaaagaggacuauugcuugaccaugagugaauccaacggcacuuguagguuagagagccacaaagcugggaccauaaugggggaggaggaggaauccagaaugggaaugggagacaaugaacagcugggcaucagaaaagggaugcacuuaacugaacacucuuacggauucucuuccuucuugcacucuagcuuggacucuaugggcucuggagguuucaugccuuuuggcuuggaagggauucuccguggcgcugcuaccuguuucuaugccuucguugguuuugacuguauugcaaccaccgguaacagucacacaaucuuggcuggucuugggugcaaugugugaacuuacagauuugggguggcagaggaggaagccuacuucccugguuuagaacacugugcccuguguuuucuuacaggagaagaggcucagaauccccagcgcuccauccccauggguauugugaucucgauguucaucugcuuuuuggcuuacuuuggugugucuucagcacuuacccucaugaugccuuacuacaagcuucauccugagagcccucugccugaagcauuuuccuauguuggcugggagccugcccgcuacuugguggcuauuggcucccucugugcacuuucuacuaggucaguguuaaauauuucuuugccccguggcuguaguuuccagcuauguccauuuugugccagagaauguuccuuagaaaggcuaggaaagggagguggaaaugcuguaagcacacaggcugaugaacucauuccccuuggacauugucuuuuuucagccuuuugggcucuauguuuccuaugccucgggugauguauucaauggcagaagauggccuccuguuccguguccuugcuaagguucacagugucacacauauacccauuguggccaccuugguaucugguguuauugcagguaacaaagccaaaucaaacccaccccuuuuuguuguuuccccaacucuguuaacuucacccuucacucacuugcuucugccugcugauuuuagcauucauggcauuccucuuugaacucacugaccucguggaccucaugucaaucgggacucugcuugcucacucccugguguccauuuguguucucauccucagguaagacuuguguuuguaugucucggugaggcaggauauuaugcccacuccuuccuucugucauccugacucuccuugaguaauguggccauuuggcucuauccaaaagagcacccccccaccgccuguguuuuuuugcauauccagguagauacauguacguguguauguguguguguguguguguguguguguguguguguguguguagaccagaggucagacuuaggugucugccuacaucccucugcaccuuauuuuugagauggagucucucacugaaucuggaacucacugguugccuagguuggcuggcuagugaauucuagaauccuaucuagcuucaacucacuagcacuggggcuacaagacaccuggguuuuauaugaauguuggagaucugaacucaagucuguuugugugguaaacacuugaauauuaaaaccucucucucucucucucucucucucccucucccucucuuuguguguguguguguguguguguguguguguguguaucugucugccugucuauguguacccuuggaggucagaagaagacauugaauccccugaagcuaguuaugggugguugugagcuggccaauggaggugcuaggaacugaacgcagguccucuucaagagaaguaaaaacuuaacugccaagcugucucuguagcccgcugacagaugcuuuuauaggcuaagccaucucuccagccuaagcuuguagcuuuaauggugauaaagaagcuaccuaaaaagaaaguaguggaugguaaggaauuauucuuaaaauuguuuccuuacucuugccacagauaucagccugaucaggaaaugaagaguguugaagaggaaauggaauugcaagaggagacacuugaagcagagaagcugacuguccaggcucuauuuuguccugucaacuccauccccacacuccuuucuggccgaguugucuauguuugcuccucacugcuuggugagcagcggauuuuuuucuuuucuuuucuuuuucuuuuuuguuuaggauuuauugauuuuuuuuuauaugugugaauauuuugccugaaugaauguauauguauugugugcaugccugguaacuacauaggucauaaaaaggcuucugauccuuuggaacuggaguuauagaugguuauaaguugccauaugagugcagggaacaagucuuccgcaagagcagcaaguguucuuaacuguuaagccaucucucuaguuccaagcguggccuuuuucuuugggaugauuugaugagaucaguaagguaggguagauauugugugguggcauuuggugaggucuagcaagaggguaacccuccuuggaaugggaugccuuacaucuuagcauauugauuucaagaguugguuuugaugucucucaacuugacuuuugaagccguacuacuaacuguucuuugccuggugcugaccugguggacaacuccacuucguucuggagacccagugugggucacagugguugugcugauccuggggcucauucuugcaauuucuggggucaucuggagacagccacagaaccgcacuccccuucacuuuaagguaaaugauguuucuuacccccucaccaauucaucuugggacaauuagggcuugcagcuuauguucuuuaauuggacacaagaagguaaugucagagcugguuaggccagacuccuugcugauauucucucacauucuggauuugaagagucuaauaauauaagugauaaaugaguggcugcugaaauccagagugugaguagggcuugaacuugaccuguucugcccccaguaggguaaggaucucuuuguaggucauugaguuguauaaagauuuaucuuuguuuugcaggugccugcuguuccucuacucccacuggugagcaucuuugugaauguuuaccugaugaugcaaaugacagcuggcacuugggcccgauuugggaucuggaugcugauugguaggugucugcuuugaagaguaagccucuuaggugaccuauccugacuccucucccucuggaucuccaguuguaaaccucaccuuacaguugucuaucucuacuaggauuugcuaucuacuuuggcuaugggauccaacacaguaugaaagaaguuaagaaucaucaaacucuacccaaaacaagggcccaaacuauagaccuugaucucacaacuuccuguguucacagcauuugaccuaaccauaccuaauuguugucuuguucuccuauacaauaauggagaguacucuugaccccacgaagagcugggccucucaugugguguuagugacggauaugaaauaaugcucuguauuucuugugaaaugauggcuaugucuuugcuguuucucauuuguuuuuaacuuguauacuuugaaauagucucuguaguuguuuccuggcuuugaaaaaaauguuauuaaaggaaaauuguaaaaaaaaaaccaaa

SEQ ID NO: 9647 - RNA, 3875 nt, Mus musculus
aaggaaauguauggguggggagggcuugugggagagugguucaggguucugacacagacuacacccagagaaagaagagcaagcaccauguugaaacuauuauugucaccuagauccuucuuaguccuucagcugcuccugcugagggcaggguggagcuccaagguccucauguccagugcgaaugaagacaucaaagcugguaggaaaccuaggaccagagggaguuguugagaggaaggcuauggggaaagggccugcuagugcucacuauaaugacuaaaacgaagugugcagagggggaggggaaggcucucugccucacugcugcuucuucugaccaagaauucuuuuucuuucacuccacuauuucauuuucuucccaaacuuagauuugauccugacuucuacagccccugaacaccucagugcuccuacucugccccuuccagagguucagugcuuuguguucaacauagaguacaugaauugcacuuggaauagcaguucugagccucaggcaaccaaccucacgcugcacuauagguaugagaagggggaggguagcacgggaagaagaaaagggagguuagcugggagagacugcuugaggacccaaucaaguggguagccagcucuucaggaacccuaccaguuucucaugggaugcauugucaguucagaccagaugaggcuagcuaaugggcauaugcaugcccauguuuggcccaucauucuuuugccuuguaacccuucucuagguacaagguaucugauaauaauacauuccaggagugcagucacuauuuguucuccaaagagauuacuucuggcugucagauacaaaaagaagauauccagcucuaccagacauuuguuguccagcuccaggacccccagaaaccccagaggcgagcuguacagaagcuaaaccuacagaaucuugguaaucgggaaagaaguagccaagagagcagggagcuuaaagacacuggaguuuauagauuguuggccaugggcagaaaagagaagauagggggguugggauggggaagggaggagggauaaggggaauuaccuccaagauccugacuugucuaggccagggcaaugaccacacacauacauaucuccagugaucccacgggcuccagaaaaucuaacacucagcaaucugagugaaucccagcuagagcugagauggaaaagcagacauauuaaagaacgcuguuuacaauacuuggugcaguaccggagcaacagagaucgaagcuggacggugagugacuuggcguuguggaugcaguggcuaaggccaagcaagagaagaaaugguucaacuagccagacagaagaaucuaauaccaggucccaguucucugccccccaacuccucugucuucacuuucacuuuuuuuuucugaucucaccagugagcuuucacuuugccucucccaccauccucuuccugauguuagacaaaaaggaagccagugagugggucuggaggggagucaaguuagagaaggggagcaguauguucugauuagucgggagaggagcaaaguacaacuaggagggaccagaacuggaaagaacaagaaauuagaagagccggguguugguggcgcacgccuuuaaucccagcacuugggaggcagaggcaggcggauuucugaguuugaggccagccuggucuacaaagugaguuccaggacagccagggcuacacagagaaacccuaucucggaaaaccaaaaaaaaaaaaaaaaaaaaaaaaaaaaaaaaaaaaaaggaaagaaagaaagaaaugagaagaaucugaagaugacacauugagguauaggcaugaauguucccauucuugcuuccuuuauugauaacgaucuaucccucacccuucuucuuccuaggaacuaauagugaaucaugaaccuagauucucccugccuaguguggaugagcugaaacgguacacauuucggguucggagccgcuauaacccaaucuguggaaguucucaacaguggaguaaauggagccagccuguccacugggggagucauacuguagaggguaaaguggcccaaaugcaugaccucuaaaucauucagccaguacccuagccuuuguaacaacacacugucacuaucguuugcuuugucucucuagcccuaagccucuacccccccccuuaacuguuuaaccucagucucuaugaagcaggguuuucuauggagggaugagaaggggugcagcugaaauaggaggccaaaggaugcucuagggggauaugauauguguaagaggucucuguaggauuccauagacucugcagaguggagaugagcuuggaucugggcugcccucuuugauuuagcuuauucaucuguaaaauguagauaaacauuguuccucccucucaggagcuguguggaaaguaagcauaaggaguguguuuggcguggugccuggcauccaugucuuaugaguaccacaaugcaagggucauuuuccuuguuuguuacagagaauccuuccuuguuugcacuggaagcugugcuuaucccuguuggcaccaugggguugauuauuacccugaucuuuguguacuguugguuggaacggugagauuucaggaagcccuuaaaaugagguggggguagugggguuauuucaagaucuccaggguagaucauuuaagagcuaugauaagaguguugagaggaagcuagagguuccaugcuggccaguuggauaaaggguaauaaaggaucuuucauuuaaugcugcuccuucuuucucucugcucagaaugccuccaauuccccccaucaagaaucuagaggaucugguuacugaauaccaagggaacuuuucggugagaacacuaccauacacauacuacaguuuaucaacugccaacugccagucagcaagacagacuugggggggggggcagugcacagcggagggaggaggggcccuguaccaucaggauguggcugaccaaauggagggugggcuaggcagagagacggagccaaagagauuugugugauacagacggaaacuacagggcauuaggagcccuggagcccagauagcccuucuguaaucacaaugguuacagauuugugagagauccguuggcccagagccugggucuuuugcuuccugccccuaauugaccucugaccuggagcuaucugucuuuaggccuggaguggugugucuaaagggcugacugagagucugcagccagacuacagugaacgguucugccacgucagcgagauuccccccaaaggaggggcccuaggagaggggccuggagguucuccuugcagccugcauagcccuuacuggccucccccauguuauucucugaagccggaagccugaacaucaauccuuugauggaaccucaaaguccuauaguccuaagugacgcuaaccuccccuacucaccuuggcaaucuggauccaaugcucacugccuucccuuggggcuaaguuucgauuuccugucccauguaacugcuuuucuguuccauaugcccuacuugagagugucccuugcccucuuucccugcacaagcccucccaugcccagccuaacaccuuuccacuuucuuugaagagagucuuacccuguagcccaggguggcugggagcucacuauguaggccagguuggccuccaacucacaggcuauccucccaccucugccucauaagaguugggguuacuggcaugcaccaccacacccagcaugguccuucucuuuuauaggauucucccucccuuuuucuaccuaugauucaacuguuuccaaaucaacaagaaauaaaguuuuuaaccaaugaucauca

SEQ ID NO: 9648 - RNA, 19278 nt, Mus musculus
aaaugaaaaggcuucaaauguauuuuaauaaggugaugcugcaugacgucuccauuucucagaaaacuuuccaaacugaagguaucuggaacaauucauaguauaccaauaaaaaugcacagcguagcuaccuaagauaggcaagacuaagagcuacugucagaccuucaccacacagcaacccuguucccaagauuguacuaggccuaucaagaaaagcugugaacagcaacaucagagacacaaaguguaguccuuacccaagaaaaagauggaggcaagguaacacaagauucuuuuaagauauacuaaaaugaaaaccucuaagagaaaaugucuuccuuaggacaugaaggggucauauaugagauauaacacaaccguacguaugcuguaaccucuguggacauuugucugaauucuuaccugggagugaauggagggauggggcuaggucauuggaggauguuuaugguuugugguauauauggcagugucucagggguugaggggaauaaagaugagaaaguaauuaaaacaagagagagagaaagagagagaaggaaugaucaagauuaauggagcucugaguucauuuucccaugguucuccaggcccucaacaaucaauauaguucaggaaugcaccagacagucuugauaaagcaauauaccacagacuuugacuuguugaauaccaccccucccuugccccucugccuucaagcaugcucccuagaguaguacaagcagggaaggccuaucuauugggaagaaccccuaacacuuuuccaggguagaauucuggcuaguccaaaaagggcccuucuuuuaagggcugcaggaaacuagacaaugcaacuuuaucuaauaucggcggcguuuauuuggagcaaauucagcucccggagcuggacgguugaaugcaggaggaguuccaccaauugcuccaauuccuuccauuguugcagcuuggccaaaacguucaguuguugguggggucuuaaaaaagagaaagagaacaauguuacaguagaaucuaucucugcagguucuagcucaucuaagguuucuucccacuacaggccauuucuacuuaacuacucaagucuccuccugacuguuaggagacaggcaaccaagucuguuuagagcucuaauggagaacccugagaggaaaggcaggcuuuacuaguuacggcuccagucagucauccauccaucuuuauuuagcuuucuauccacauuuuacauacaacugacauuucgagguugcauagguucuagccaauuucuuuuucaugagccaggaaaaacagacuauuguucuuuaggaaccuuacaucuauccaguuuuggcccauuccauuuugacauuacaaccagaacaacuucaggacuuuaugaagcacaaggcccuuggauucacaucuguuauauauacaucauaauaucuaaccuuccuugacuucccccauguaaagaacaaccugcuggccagacauggugguauaugcaaugggagggaagaggcaggaggacugaggccagcuggucuagacuacagagacccuaccuuaacaaacaaaacccaaacaacaaagcaacuuguuugggcuggagagauggcucagcgguuaagaacacugacuguucuuccaaagguccugaguucaaacccagcgaccacaugguggcucacaaccaccuguaaugagaucugaugcccucuucuggcauaucugaagacagcuccaguguacuuacauauaauaaauaaaucuuuuuaaaaaagcaacuuguuuacagaggauagcaauaacuaacaauuaaucagaucacagucagaggcuauaguuuaaccccaaggcuaaaacagcauauacuagauuuucucaagaguaaaaacugaaagaccaaggauaugggauagugggacaacacuuguugccuagcauauaucacauccugucuucaaucaucugcaccauuuuaugaauaccaauagucaguccugaagaucagcaucuguaccaaagucagagggaggaaaugcugagaagauagcuuaguuggguaaaaugcuuguucugcaaguuugaggacucaaagaagggggagaggggcaaggcauaguggcauguauuuguaauggcagcagcacuggggaaaccagaggauuccugcgguucacagaccagucagccuagccuaacuggcaacuucaaggcggcauuaugcucaugucauuuauugcucagauggcaccugagcaauaaaugagacaagcagcugaccucuagcucaccuauauguacacguguacacacacacacacacacacuagacaucccugaaauuuauuaccaauccaaggguuccaucuggcaucauaguggcagguccuggaggagcuggaguaccagguggcacaggagcagggggcaucgcgccucuauuguuuaugcccauagcaccuaaaguagaguaguauggucacuauagggggaaaacauuaacacucucuuccccuaccaaagggagcaauucaguauguagucaauccccuacgcccagccuauaagcccuaauauucuuggaaaugugaugucauuuaaauuuagacuagguggaagcucuauaacgcagauuaagaaagaagagaaaggggcuggagagauggcucagcgguuaagagcaugucugaagguccugaauucaaaugccacaugguggcucacaaccaucagaucugaugccgucuucuggagugucugaagacagcuacaguguaguuauauauaauaaauaaaucuuaaaaaaaaaaaggaaagaaagaaaaagaaggcucugcaagcaugagaauccaauuaaaaacccagucugcacaucaaaagcugagcauuguggcucaagcuuuuaaucccagcacuuaggaagcagagguagguggaucucuuuaaguuaagaucagcuuggucuacauagugaguuucaggacagccagggcuacacaguaagaacaugucucaaaagaacaaaaaaagagcugggcagggcuguacaugcuugcuaccccugguuuugagaggcagaaacaggcagaucacaauaacuggccagccaaccuaaaaaccaaaaccaaaaccagacaggcaguucuuugguuccuggauacuugcugcucucuacuuuuuaacuaccuuuuauucccacccccaaaaggcaccagaacuauuucauucuuucuuaacuccuuaccucccauagccauuuggcccauccguaucucuuguucucucugaaaaacaauauacacucaacacaguccaagacaccauuuacucuauuacaaugcacugaugacaacaaagggaaguaaacagugaugacauacuaaugcccucuugcuauuuguacagugauuucagguaacaaauuauaauuuucuauuagaaaauuauauuagaggccacaggaggaagaaauaguuaacuucuuagagcugcaaaccauguaauuacaaggguagcaguacauuagcagaagucugcuccaggacucaaauuucucuuaucaucacuggaaauaagaaacaaaguagucccggauuuccauccuaaauuuguuauauauggcaagagcucucucucccucaaaccuuaccucaccuacuaccaacauuuuuuuccuaaaaggaauuucauaauauagaaaaguugcucauaaccuaauacccuuacagacauuucauaaucuuauaugaugacuggccuaccacaucauaggcacaugggagauauaccgcaucagggaagguucccuugaauccuuccugcugucggcgcaucauuuccucuugcugucgccgcaucucuuccucacggcgccugcguuccucuuccugccuauagaaucaucaagguauuuuaagauaagacauaccggaaaaaugaguagaccaguugaauaggaagaagauuaaaagcuagcacagcuugccaagaauaagggcaauauucaaagaaauuaagagaccagcauugaguucuuucucuuuaaggaagcccuuaggcaauuccuagaaccaaugcagcucuaagugaauaaaggcauuugcuauuaaggcuaaugacaaguuuaauuccuaggaccauuugauggaaggccuccacacauuguggcaugaaaccaggcccaaaacaaauaaauaaauguuuaaaaaaaaaguuaccugaguucuaacugcuuucgcuucugaaccucuugguuaugcagcuccuccauucuccgaagcucuucuugacgucucaucaaaucuagcaacagauugagaauuuugaacucucuuuacauauauacaauuucccauaaauauccagaaagcaaagaugccaagcaagauacaagauauagucagucuggaagaggaaaccuugauuggccaguggauaagccuacggugcaauuucuugguugauguggaaggggccagcucaugguggguggaugagcaggcauggugguacacaccuuuaaucccagcacuugagaggcaaagggcaaaaaggcaggcagaccucgaguucaaggccaaccugcucuacagacuaguuucaggauagcuagggccacacagagaaaccaaggaaaccaagccacaaacaaacccccaaaaacaucaacauccaaaaauaaacaaagggggggauggacaagcccuggguaacaaucuaaucaacauuaguuccugccuuagcgucucucagugaccuaaauuuuaagauaaaauaaaccuuuuucuccuuaaacugcuuuuggccaugcuucguguauuaucacagcaacagaacccuuaacuaagacaauauauaaucccagaaggaucaugcaaguaaacucaaacuuaaccauuucuuucuucauugacucuucuaguauucuauacccaucuccaaauucaucucccuacuaggauaaacaaaguauuucagggaauaaaaacagagacuuugucuuuuucuacuaagaaauaaagaaauuacugaacaaaacugguauuugauauguauuccacuuucccuacuuacaggccucuacucacccugccucauuagcauaaccuggugcucaugacgugcagccuccaucuccaucuccagcuucucacgagccuccuugauguuccgauccacuugauccugcuguugcuucuccaucucaaugagugccuuccagcgcauggcauacucauacucaaaggagccagguugugcaaaucuggguggcuguucucucucccuauagacaauacacauuauguaugauaauacuuuuguccaagauuccauagaaucacucucuuuuaaaggccaagcaaacacagguauacagcaaagacaugccucuuuuaaccaccccuucaaguuucaagaacagaaaaauaacuacgggaugaaguguaagacaaauauguuaagggucuggguucaacuaccaacaccacauauauaaacacacaucccaccccuccccagaaauguauaaaagucaacuacuggaccacacacuuguggaauugcugguuuuuuauaaccaguuucucuggaagucccucuucaucaucuaacugguccauaggcuccacagucacaggccgaggaaaucugggugauagaagaaaguuaguguuaaugaggccauacccuaacaaguaugcucccgacaccugacauuggcacgaggaacuacuuaggaauaagacuggacaacuaucauacuuuagacaggaaaugagaaguuggcaaggauucagacuguaaacugggccagucugagguuaaugacacuccugcuuuagccucccaaguacuggcuggaauuauggauaugaaccaccacaucuaaacauauuucuaaagaauuuuauaccuagccccaaguaaucgagucccucuuaccagcauuaugaauaauuuggggauaacagcccagauggagccagguuucagaucucuguaauagucucaaaaaauguuaaaggaguaggucgaguuaucuaauguacuugauaacucuagaaaaugaaggaaaacacuaagagaaaguacauucaguacauuuaacagauucuaagaggaaaaccuuuuuuuuuuuuugcuuuuggagauaguuucaccuaucccaggcuaacuugcaacuuauuauauagaugaggacaauuuaaacuccaagugcuaggaucacaggcaugggcuaccaugcccaaugaaaccaugugcgugaguuuuucccagauguauaucaauguaccacuuccacacccggugccuauuuaggcuggcaucagauccccuagaacugaaauuacagaugagccaacaugugagugaugggaauccaacucagguucucugccaagagcagccagugcucuuaaccacugaaguacuuuuccagccuaaaaagcuauccucguacuauaccaugauggauacagacacaugcaagcuagauacccugagcuugguccuggaagacauguaaagguggaaggacaaagccaacuucccaaaggugucccgacuccccaauguacaccauggcauauacaugcacuugaauaccuaaguauuuaggacuauagugaaaacuacauuagaaaagcugaguuagcacuaaauuuuuaaaugaaaauaagaacaugguuauuagauguuaauguuccaugccaaagaaagaauaagggaccccaaaccauugucugaaaauuacuuacguagucagcaagaaggagccuucacugcaucuguccagagcuuuccgagcagcuggcuucccugagaacucaacaaugccuuucccugagggccuuccucggucauccacaaugacuacagcccucuccaccuggccgaacacagaaaaggcuucuuccagcaguucguucgacacguacugaggaagguugcggacuguaagggaugcacugugacaggcaaagcgcacucgcagcugcuucccacggaggggcauguuguccagcuccacuuuggcaauuuccgcuaggguucguguuuccuggggaaaacaaaaagaaaauuagaauuugacaaaagaccaaccaagcaaccaucaacaaaaugccucucaaaaaacgugggucgcugacaccauugcauacacuagcaagauuuugcugaaaggacccugauauagcugucucuugugagacuaugccggggccuagcaaacacagaaguggaugcucacagucagcuauuggaugggucacacggcccccaauggaggagcuggagaaaguacccaaggaacuaaagggaacugcaacccuauagguggaacaacaauaugaacuaaccaguaccccggagcucgugucucuagcugcauauguaucaaaagauggccuaguuggccaucacugcaaagagaggcccauuggucuugcaaacuauauaugccccaguacaggggaaugccagggccaaaaagggggaguggguggguaggggguuauggggguggauaugggggacuuuugggauagcauuggaaauguaaacgaggaaaauaccuaauuaaaaacaaaaacaaaaacgugggugugguggcacacaugcauuuuaauucuagcacuuaagaggcaggcagguagaucucuaggccagccuagucuacauagugagauccagggcagagucacagcugcauacuuaacaauacagcacuugcauuuuaguuuccacuaacauaucagaauuacuuguccucaaugaagaauccuuauuuuaugagaauaauguuuugauugcauguccauuuaugcacaccauauguaccuggugccuagagaaguaagaacagggcaucagauccugugagcaagaagcuuacucagaaccagagaacacugacaggacaucucuucccuacuucacagaacuaagcaaggagcuugagaaaaaugacuugcuaugguauuaagugagcgggaaugaaaacuaguuccagccaucacuuugcgccucauuuagagauagauuuagcaucuauaaaaugcuucuuucuuauguacuauucccaaacacaaucagauuuuagaaauaaaaucuacauuuuaaauuggaaaaacuguugaguacugcugagcaguaguucaguuaucgaauguguccccaacuaccugucucagaaaaaaaaauucacaaaaauaacuuguccccuccucaagguuuugaaaaguaaaauaacacacauauaagaacuuuggaaauaaaauauguaugccuugguaaucacuaaaauaagcuucauuuucucuuaaaucaagcaugguaaugaaugccuggaucauccaaagccucgaaagcagaggucuucaaguucaaggauagccugggguuaaaaaaugcgaucugcugggcuggugagauggcucaguggguaagagcacccgacugcucuuccgaaggucaggaguucaaaucccagcaaccacaugguggcucacaaccauccguaacgagaucugacucccucuucuggagugucugaagacagcuucaguguacuuacauauaauaaauaaaucuuuaaaaaaaaaaugcgaucugcaacuaaaaaucacccgccaaacuauuuuagcccuuuuauuccaggcaaguaaggucaggugaugguggugcauaccuuuaaacccagcacucaggaggcagaggcaggcagaucucuugaguucaaggucagcuuggucuccaaaguaaguucucagauagucagacuccaaaaauuauuaccauauagacaauccauucuuuucacugcuauuuuuccauauucacuccccagguuucccuaucucucaaagcauaugccccaaagcucacacucaccaagcgaauaaagccaaagccuuuauccuuaugaaugaaaacuucgccugcuuuuccauauuucucaaauaguuuccucauuuccuccucagugauaucagggggaagauugcccacaaagagacggcuacgcuguguaaaggucuucucuccugguuuccuaaaauucuucaggucaauagucaagccuucaucugaaagaagacagucaaucaaaagacuggguagauagagaauuagucagucauaccuucaacacuguuucuaugaggggagacaagcaccacuuuccaauguauccuacucaaccagcaaacugcaccucagaaugugaaagcagccaugaagagaucaggggacuucuuagcagcccuacuauaauccagaaacuaagguagcuaaucagagacaaacaaucacaugauauagcaacuuggcacuacuacuaaacuggucuaugcccuaaggaaucagacuuuuaaaacugcucuuucuuaaccaguuaccaaccuucacaaccuugacagguugcacauaaagaaaugaguaauauaguuuauuuaagacacaggaaggggaguugggaaggggggagaaagagggagaggaggagggagagagggagggagagaagaauagaggcuggccaugaacacguggagagaggggggaggggaauggggagagaagggacagagagggaagaggguaagagagaagaguaauaacuauuuuuguaccauguuuugguauuuaucaucagguauauaugauauacaugagcaugcacguguauggcacacacgugaaggucaggggccagcuuuuaggaguugggauuuuccuucuacaguggguuccaggacucggguccucagguuuguacuuuuaagaggcucaucugcugagcccaauuguuuggcuuuuuaaaaaaaauaauguguaugcaugucugccuggaugaauuauaugcagcagauccuccuggaacuauaguuacaaaugguugagucaccugaggaguaucaagaacaaaucuguaucuuaugaguauauauauguguuaauugucacuaugugccacaugugccuggguacguacccguggagucagacaaggaugcuggauuuccuggaacaggagcuacaguugguaguaagauaccucauguaggugcugggaacccaacucaaggcugcaggagaugcucuuaaccacugaaccaucucucuaguuacccucaccucaccagauuguuuuuuuaaguacucaguuuccugaauaaugacaacauacaaaaccuuuuugcagauuaaaagugggcugggcacgugacaccaagucuuaauggaguuaacucuccauuaaaccuuaaaaaguucuccuauauucucugacgacuaacuauauauaaacauuuguuugggaguaaaauaugccaacauggcagaauaaccuauacuccgccaauaucugcuccuuuguuucaagugaucaauuucuuuccuuuauaaaauacagauuaagaaccaaauagaagaagcuaaauagagccgggcgugguggugcacaccuuuaaucccagcacucgggaggcagaggcagguggaucucugaguuggaggccagccugguguacagagugaguuccaggacagccaggguuacacagagaaacccugucuaggaaaaaaaaaagcagcagcagcuaaauaaagagcuggcugagcaguuaagacuacuucucaaucuuucaggacucacugauccccagcaucaacauggcaacugacaacaaucuuaagaaaaaaacaaaacacgcucuagacccaggagauccaaugcccucuucugaccuccaugagcacuaggaauacacauauauguaggcaaaacauccauacauauaaaauaaaucuugcuaacucaaaccagaauaaugaaacauggcagcaacgcccuuaauuucaacacucaaaaggaaauuagaggaaguucuaagccagcacccaggguuagacauugagacccuaucucaaaaaguuggagggguaguacccaaucccaacacuggaggcugaggcugguggaauucuaaggaaccugccuacagagugaguucuaugauaguuagggauacacagagacccugucuugacgcucucucggaaaaaaaaaguaaaaacaaaaguaugcuaccaaaggccuguucacuuauaauccuaagagauuugccuaaaaacuauaaaaucauucccaggggaaccuguuugcauccucccaucacccagcagcuacuuacucuggcugcuggccugcuggccauuugcagguauugguggggguggcuguugcugcugcugcugcuguugcugcugauggugcugcugguggugaugcugaugaugcuuccuuggaguaugauucugcuucuccaaguuaaaggcuuuauugcucugcauuuuuguacccuaaaggaaaauguggaaugucaaaaacccaggaucaggauucagucaguuaccuuccugaugguacccaucauuaaaacuaucuugggccgggcagauuuacuaguuuuuacuaguaaaagggugguggugaugcacaccuuguuaacgccagcacuucagagacaaagacaagcagggaaaccuaucuugaaaaaccaaauaaauauauaaaucaaccaaaaaaaaaaaaaaagucaagaccaagcuggccuugaacucaaagaaaaauauaugccugccucugcugccuccugagugcuaagauuaaaggccuaugccaccacuaccuggccccaguaagucuuucaaaaauuaccuauuuuuguauuuuaugugcauuaguguuuuguugguguguaugucugugugaaggugucaagucuuaggaguuacaggcaaguaugagcugccauguaggugccaggaacugaaacccacccaguccucuaaaagagcaaucagggcuuuugaccacugagccaccucccuaggccccaguaaauaauuuuugauuaugcuaguaaaauauaugauuagccaaauaaaagaaccaacacaucacaggcacucaagggggucagccuaccucugccuuccaagugcugggguuaaaggcaugugcuaccauaccauguaaauucucacauuucaaucacaguucucaccaauguuacagaaauuguaauaauauaauauacuuacuaacaauucaaguaguucggcccccuaagacccuuauacuugaagcagagaacugacucucacacuuucuccucugaccucauacauacauacauauacuuaacuuuuuugagaccagguucucuauguaguucuggcuauacuggagcuuauuguguagagcaggcuagcgcagaacacaaagacuaauucaucugucucccagaaugcugagauuauggacuuacaugcccagcuguuuaaguuugaaacaggguccauguagccccagcuggccuggaacccacaccuggccucuaaauuaaaaaaaaaaaaagccacaaacccaaaacagccacuauguggcacauuccuguaguuuuagcacucuaagaggcugaggcaggaaauuaugaguuuagggguaaccugggcuauagagaccaggagggagagagaaaacaaaaaaagcaacccuggucucaacacccacuuuggacaauucacaaauaccuguaacucccacucuagggaaucagaggucucugacccucuuggguacauaaccacauagagauauacauuaaaaauccucacacuaauaauagcuacuguuaaccuuccaguauacccuuugugauggauauuuuggguugucaaccugacuacauuuggaauuaacuaaaacccaagaggcuggguauaccugugagggauuuuugcuaauuaaaucaucugaaguggaagauccacuuuuaaucugggccauaccuucugguggcagccuauguaaaggauacagaagaaggaagcuugcuuucuuugccugcuugcccucaaucuggauggcaaguccauuccuugacuaguaucaaggucuacuucaucaggauuccaguauuuacugaagaucagcugagacacccagccucauuagcagagaaacuacuagauucuuggauuugacauugguaaacagccacuguucaacuauauggaccacagccuguaaaccucucuaauaaaucuccuuuauaucuaucuaucuaccuacccguuuucaucccaucaguucuguucuuguaaagaacccuaauacaaccuucuaaucaguaauacauauuccauuuucauuauauuuaucucugugguuuuggguaugaaaguauagugccugaagacugaagagagcacggcagccccuggagcuggaguuucaaaggaguaaugaagcuaccugacaugguugcugggaaaugaacucagguccucugcaagagaguacgugcucuuaacagcugagccaccucuucaguucccuucaguuucuaucugaaguuguacauuaaaagaaaccagauuugcaaacuuuauaugccccaguacaggggaacgccagggccaaaaagggggaguggguggguaggggauugggggggugaguaugggggaccuuugggauagcauugaaaauguaaacgaggaaaauaccuaaaaaaaaaaaagaaagaaagaaagaaaccagauggagcuaggcgugguggcgcacaccuuuagucccagcacuugggaggcagagacaggaggauuucuaaguucgaggccagccuggucuacaaagugaguuccagggcuauacagagaaucccugucucgaaaaaacaaacaaaaaaagaaacuaguugggcuggagugauggcucagugguuaagagcaccgacugcuccuccaaagguccagaguucaaaucccagcaaccacaugguggcucacaaccauccauaaugagaucugacgcccucuucuggugcgucugaagacagcuacagugcacuuauaauaaaaagaaagaaaagcaaccagcuaugggaggcuaaugagaugcuuuagaacucguuguucuuacaguucaguucccagcacgcacaugguacgucacaaccaccuguaauaacucuaauucuuccauucucuaugggcacaugugaugugaugcagacacacaugcugcugaaacgcccucacagaaauaaaaaaacaaacaaauaugauuuaaaauagguauaugccaagcagugguggucacacuuuuuaucccagcacuggggaagcaaagacagguggaucucucuucaaguucuagguuagccauggcuacacagaaacccugucucaaaaauuaaaacaaaacaaaaauucccacccccaauuuaaaaaaaagggggguuuauaaccuuucuuuuucacaauacauaaugagcaauuuucauguaacuaaaucuuuaacagugccaggcauggcggugcacacacacuuuuuuuuuuaaggauuuauuuauuuauuauacauaaguacacuguagcugucuucagacacaccagaagagggagucagaucucguuagggaugguugugagccaccaugugguugcugggauuugaacucaggaccuucggaagagcaguagggugcucuuaccugcugagccaucucaccaaccucgcacacacacuuuuaauuccauaauuaaggaggcagagacagguccauauagcaagcuagaggacagccaaggcuaauagaaauccugucuuucccagucaccccuccagaaaugaaggcuaacaugaauggauuaacacuguuagccaaacuccuauuguguuggacacuuuaaguucgaauuuucacuauuagaaucaacacacauagauauucucuuugggcucaucuccauucaaauaauccuuuuaccacuuccaacucugcuuauuuauauccugagauauuuauauccuuugauauaccauuugauguucagauuuuccucauuucugcaaugucaacauaauuguaaaugcccacacaaaguguguguggcuagacacuaauuuauuaaacuaccauuaugauuuagcucucauuuuuccuaagauuuuguuuacuuauuaggaaacagaaucuagcuuuguaacucuugacagcauaguuuuucaggacaaccauauuuuuaaauguuuucaacggguggaagugauuuaaugacaaagcauuuucaaaacaauuuuuugagacagggauucucuguguagcccucgcuauccuggaauucuagaccaggcuggccucugccucuugugugcuaggugaguguaccaccacacauggcuccaggaaacugaguaaggcggguuauuccuguaauucuaaguagccuuugccauuugaagucagcacgggcuacagcauuaaccuguccggaggugggaagauauacaagcaagaugugauggcauacaccugcacuuuccgagcuguagaggcugagauaagacaguuucagaaaugccuuggcuacguagcaagacucaacaccccccuccaaaaagacaaagaaaugaaggcccaucccagaaacagguugagucaaagcuuuucaugauuuaaguccagauauuacaugucuccgucuauccccaaguagugaguggcagguuuaucaucuucacagccauuuaucccacagaaucuuaccuuuucucagauuaagaaccaagaaacauuuuuccuccagucuuuaauuacaaaugaauggacccagccucaguggcuucuaucacucaaaggaauccacauguaucuccacauuaauagaaaucuuuauaaaagcugagcuuaguggcuugggcuucaguggaugacccagguuucaggccagcuugggauacaucuuaaggcccugcccccuaaaacaaaacccugggcauccuaguuuacuuauuuuauuccagcacaaggaggcaaagguagguggaucucugaaagauguaagucaacccggucuacauggugagugccaggccaucauagugggggagacccugacuccaacaaaauucagacaacuugcuacaccugcauuauuucauucaguguccccagcuguucuuuuaaaugagaaaacagaagccccaaaccugcuuuacccacccaaggccacaccacuauauggaauggaacccagaucucuugaccucuaaaagucaaaaccaucauacaucaaaugagccuucaaguuaaauuccagcaaacuuauuggcuaagacaccuaauuugugcacccuguuaugauggagaugaugagggugaauaaacaguuauugagcuuacagaggugguuaaaucuaaggccuacgugaacuacuacuacaaagcaucauuuaacugucacucaggaacgaugaagcguuugcuccaaaaaggaaacuaccauuccuagucucaagaaauaggaauguaguagggcuggagagugaucagcucagcggcuaagaucacugauugcucuuccaaagguccugaguucaaaucccagcaaccacaugguggcucauaaccaucuguaacaaaaccugacgcccucuucuggugugccugaagacagcuaaaguguacuuacauauaauaauaaauaaaucugugggccagagugagcagagggccugaguucaauucccagcaaccacaugauggcucacaaccaucuguacagcuacaguguauucauauacauaaaaaaauaaauaaaucuuuaaaaaaaaagaaauaggaauguaaaagcuggacagugguggcgcacaccuuugaucccagcacuugggaggcagaggcaggauuucugaguucaaggccagucuauagagcgaguuccaggacagacagggcuacacagagaaacccugucucgggaggaaaaaaaaaaaagaaaaaagaaaagaaagaaaaagaaacaggacuguuaaacagaaugucaucaucagauucucccuaacuugucaauauagaaaaaguauaaacacccaacaauugaaucuuucucuuucuuucuuuuuuccuuccuuucgacccaaucucgcagcauagccuuagcuguccuggaacucuguacuccagguuggccuuuaacucucagagguccaucugccucugccaccaugucugaccauggagaacuuguuuucuuucuuucuucccccccccccccacacacaggguuucucucuuucucuguguagccuugguuguccuggaacucagaaauccaccugccucugccuccugagugcauggauaacguguaacaaccaaauuuauuuuauuuguuuuugaauaaaaauccccauggugacagauuucaaaaucuuucccuuccauguagucuucuccauaaguuuccauuuaccaaggaagguuagcacugcccaaagaaucuaaauuaccacuguauacacagcaaguaccaagcaugaaagaaauguuccuauguuaaaugcaauaauauaauuuugcagaaauaaacuuaccaaacccuaacuacagagaucagcaguuaggauuucugucuccuaucacguccuaagauuaaccacaaugaaagagacuauagcuacugugugugauauaccugcagacauguucaggaccauauuaaucacagguaucugaaaucuaaaucaagguccucucaauuuuagaagagucaaauuacuaaaugaaaaacugcuagagaaauccagugugaacuugcuaggcugauaugguugccuggugggcgacuguuaaagcuguagaauacaaucacgguaaaggcggcugaguuucuuaggacuuuuuauuuaaaaaacaaugaaguggacaaacauaaauuuaagcacuaaccccuauuagaacagccauaauuagggguuauaaaaacaaaacaacaacaaaaaaaaaaacccacaccacucagucacauuuuaguuucagauucuaaaaacgguuuagcuuaaauaacaugaaaagugccccccaaauuaauuucucaucuguaaaaucuguauuaguuaagcauccugcacuuuaccugaugacccuaccuccugcaccuaccuugacuuggauuugaacacagcaaagugucugccucgcaguccucacuaaccucgacugcuguuaaaaacacaaagaaaggugucagcuuacaguaagacguccgcaaagugaaaaauacucgaaaguaaugccacagaaagcaacauuuuuuuuuaauuuagaaaagcgaugccuacaaaugccuaggaaaagcuuaaggagcaagggguucggaaaaaaggcgcgcgcgcgcgcgcgugcaagggugggguggaggguguuucaugaacuuagcaccaaaagccaaggggucugaacuagcaaacuucccacuuucguuucaaauaacaaaacaacaacaacaaaaaauccauagcuccaggggccccacaggcccucuaggaauuaauggccuugaaaggcuagggaggagcauccgacaaagcaaagcgccuccuccucuaaccucgacuucagggccuuaguauaauagaccccacacccuguggcccagggcguucaagaagccaacaacuuagggccacuaaaauugggggugagcagcacaaagagucugggcaaggaagcaagaaaagcauuggcuaaugcccgcggcggggagcagggagcgcucuggcccccaugggugggcugcgaaggccuugugcggagggggaaaggccucccgggccuucggaacccauagcccgugugcaaacucggccucgccccaaccccucccuuuccagagugucgcaggaagccccaccgcaucccuaagcaaccaaagagccauccccaaacucacccucuggccacaguucuuugcucggaguaugggcgacgcugcacggccuccaccgucccgagaaaagagcgcgcgaccgccggaaacgagccgacggagcucgguaccucccgaggggggggggggucaauuuuggauucccgauuggcuaugugaacugccagucaaaguuuaucucccgagaaagucucauuaguccgccauuucuuaacguuuauuggcuaccgacugucaaagccuuggguucgugugaacgacagauggggacaaagagcgaggcuucguagcuuaugcgcaugcacuagaggcgccgagcacaagacggaaaaggaagggggagggggagccagcaguggaagguagggggucggaaggagaggcucacccggcccuacggaaggacugaaaaccuagcggugggaggaggagagaagagaacuugugcg

SEQ ID NO: 9649 - RNA, 1828 nt, Mus musculus
cauggaggcugucuaccugguggagaauggggugggccugguacuggacuugcugaccuugauguuggaucucaacuuccugcucguguucucccuccugguuacccuggccuagcuuuuggccuucaucuacaaucugccacacacgguacugaccagucuucugcacuugggucgaggauuccugcuuucuuugcuggccuuaguugaaguugugguccgauuuaccuucggaggacugcaggccuuggggacgcuccucuauagcugcugcucuggcuuggagaccuuaaagcuacuggggcaccuggucucccacggagcucugaggagccgggaauuccugaauaggggcauccugaacauggccaugcuuugcugcgccaggccugugacaucugugcuauugccaugagcccguuggccuaugugaucaacagucuggucaacaucugccucaucggcacucagaacuucucccuugugcuggcccugugggaugcugugacgaggccucuuuggaggaugacagacuugguggcugcuuuccucgaucacaucuccagcaguaccguggccauggccauucuccuguggacccccugccagcuagcacuggagcuguuggccucagccggccgccugcuggccagcugugugguuuuccaccucacuggauugguguugcuggcauguguacuggcagugauuuugauuguguugcacccagacaaaccuugaggcuggccacucaaacucucagucagcuucaugcccgcccauccuaccaccggcuuugggagaauauuguacggcugucuugccuuccacuaggucuggaggcuuggugcagagucuggagccgcagccuacaacuggccagcuggccaaaucgggaggagcaccaggagccccccaagguggccccaggaggguguucucagccaggauccagccacaggacacucuucccaaagcagaagaggcggucaucagagcugcaccagcuagaggccgagagcaacucaacgaggacaagccuguagcugggcaagacccauggaaguugcugaaggaguaagaagagcggaagaaguguguuaucugccaggaccagagcaagacagugcugcuucugcccugccggcaccugugccugugccaggcuugcacugagauccucaugugccacccuguuuaccaccgccaacugcccccucugccgccacagcauccugcagaccuucaaugucuaccucugaagacccccucccugccugcccauccucugcuccacacaccaggacagcaucaacauuuugccucuggguucuggccugagucuuguuugucccugaaggcaacucugccaagccucaagccauauauccaggacauguagcuggaauacucuggaagacuccagucuggguggaacagaguaacacuuucucuaaacccuguguggggacccgagaugcugaggguggugaguaugucauuaugcaagggccaugagacucuauggugggcucuucugcugcgucugccagggccuacccagaugccugccucuagggcuguccuucucugcuucuggcuuuuuuuguuggaguuuuuaguccuuucccccaggccucaccaugccacaucaguguuguuugaggauuuuggcaacucaugggccuuagagugauuuugauucuuuuuucucuuuuuugcuuuuucuugguuuggaacaaucuugaaccuuuauguucagcccugguaggucugggaguagaaacucucaggugcucuuagagucacuucugccugucacugucuu

SEQ ID NO: 9650 - RNA, 69057 nt, Mus musculus
uuuuuuucaacuuccgguagccucugguugggucagggagcgcugcaagucacccgugugcgacugacguauuuuuucuuucccgcccaugggcccggggugggcugggcugcugcaggacaaggguggcgguagcccuuccgucgucauguccgacacagacagcgacgaagagucggcugguggaggcccauuuucucuaacuggguuccuguucggcaacaucaauggagcagggcaguuggaaggcgaaagcgucuuggaugacgugagucgugggccuggggcggcgggugcuguggcuagggagaacuggagacagcgcgagagggcucaacucggaggaaggacgaagaggaaaagucuuaagugucagucacugaugcugagguguuggcuucgaagguaacauucuccuugccugguaggaaagauaauaguuaacucuaguaagguuaucagaaccgccacuguggaaggccuucuuaaagacccuuggaacucugcuuuuucuggcuuuugcugauccuaauggcuccaaagccaggacuacggauggaacguguguuguucggaacugaucuguauggaauuuagcagauuuccuauauaguucuugaaugugauguuucuuugagcagcacuucaugaaauaauuucucagauggauuugugacuuuguuaugagcaagggaaauauacuuguguaggaccuucagguuuaguuguuauuuucgacccucaugcuguccccuuuucaggagugcaagaagcaucuugcgggcuugggggcuuugggucuuggcagccugaucacugaacucacagcaaaugaagaauuguccgggagugauggugcccugguaaaugaugaagguaaagugugggccauggggaggacaguguggguggggggaggagauuagccuguuguacgcuuuucaguggggauuuucuaaggaagugauaauuacuugcuuucucuugagacgucucccuuuuuauccauaggauggauuaggaguagagaggaugcuguggacuauucugacaucaacgagguggcagaagaugaaaguagaagauaccagcagacaaugggaagcuugcaaccccuuugccacacaggugauucucucuccgcccccccccccccuucuuguuuucuagcaaugggucuuucaacauagcccugccugaccuggaacucauuaugcaugcaagauugucccaaacucauagagaugcauuugccucuguuucccaagugcuaggauuagacauguuccccacuacgcuugguauucuuuaauguugcaaaauuggcaguuuaguacauuuucuuccugaauaagucuguuuugggcucugucuuguauauuuaaucucugccauuguucuugccugccaauacauuugcucuguaugcuguuuccacugucaauucagugccaaguaguagguauucucuuaccaaauucaagcuuuuauuuuuauaauguucggucucaaauuguugauuaaugacaagggugaaaaugauuucuugucaucucauauauuuuagugccuguagauuugauauaacuauucuuauaugcuuuucaaaguuaaagaugaaaacaaacccacucuuugcccuuaagauuuuaagauuaagaaggguuauguuuauaaucucaugucaaugagcaaauguauuuugacucaaaucauuccccuauuauacuucuuuuucuucaaaacauaaguauuuucccugcuguauuuuagaauaacagucucagaaucggaagagguuuauuuguuuggccucugccucuggaguguugggauuaaagucuuguaucaccacacucugcuuuuauuuucuauuuuugaaacuuuuaggccucaaaauugauuacguagcugagguuuguuuuggaacuccuuugauauuccugcuucuaccuaucaaguuuugggauuauagacauucguaacuugggagagauuuuuaaaauuuuuauuuauuauuuauuauauguaaguacaauguagcugucuucagacacuccagaauagggagucagaucucauuauagaugguugugagccaccaugugguugcugggauuugaacucuggaccuucggaagaguagucaggugcucuuacccacugagccaucucaccagccugggagagauuuuauuauuucuuuuuuuguucacuuuuguuucauauucauaauuucauuagcuuaguauauuaaaaacaacaguagcguauaguagcaaugcucaaagcuuucuauaggaggaaauaacauuuuauuagggaagacauuagguggccagucagguugcaaugcugggugaaaguggagaucagcauuucaaaugcugcuugaggcuguccaauugagaaagccauugcuugcaguaaauacucugguagggacacuccccaguguucuucuugugcuucuccccuugucugaugagcauaucuaaaggguagaauuuccauucgcaucccagcucacugcacacacacacacgacuucucgccaguguguguucuuucuuagauggucucugaugagauaaaacacuuucuggagguugucuuggggacaaaggacaaggugaaugaucugaggauuccccuccacaucaccugaggauggaggauaccagcuggccagagugguuuuucuuuuuucuuuuuuuuuuuuuuuuaaggaaauuuuuuuuaaagacuuuauuuauuauuauaguaaguacacuguagcugucuucagacacaccagaagagggagucagaucuuauuacagauaguugugagccaccaugugguugcugggauuugaacuccggaccuucagaagaacagucgggugcucuuacccacugagccaucucaccagcccccagaguaguuuuucauaguucuguucuguucuguucuuuucuauucuuuugguuuuucgagacagaguuucucuguguagcccuggccguccuggaacucacuguguagaccaggcuggccccaaacuuagaaauccgccugccucugccccccaagugcugggaauaaaggugugugccaccacuaccuggcugauuuuauuauuucuuaacuuucuauuagguaagggaaaugugaacucuggagaacuuuaaaaauguguagaacuuuuaaauguucugcacuuagcacaacuugacugacuuaauaagucaguucauuagacauugaugguccggacauuuggcaugugugauaaacuuugauaugcaguuuaguuccaaaagguaaagucuauuuucugaauuuuagagucugugaucuggaaccucuagcuguugguuaugguuuagucuuuaaauugcuauguagaacuucacuacucaaaacuuagaugaugguguucaucauuuaccucuucaaguuagauuuuaugcugcuuaguuuuagauuaaaggccuucauaaauacuuaauuagcccagggcaugguaauguaggcugguaaucauagcacuugggaguuagaggcaggaggaucugaaauacuggguuuucaagcugugaguucaagaucaucuugagcuaucugaaacucugucucaaaaaaaucucaaaaacaaaacaaccaaccaacacccccccucaccuuuuggacuuagcuuuugaggagcaguuaauggauuuguguguuaccuucucccuuaguccuucuucaacucuuuuugggagacaacgucucacugcguugcucaaccaucuccaccucaggcuuuugagucgcugggacuaaaggugccauuucuucggguaaaugcugcuuauauaaacccaccacaugcagcacuaguaauucaugaaacacaaguaaaacaguuauuucuauuaaggccuaagccaacuauaagcucaaauuccuuuguagacugucauaauuaaguuuuaaugagcuaccaaaauugucagucaaacuacauaccaauaauuuuucgcauccugacuuaggcuaaggguaggugguccaucucugguuugcagugagaguugacaguuuggggucugauuuacugucuuaacuagggaagguaaaguggauggaugggggucagauucuaugaauuaacauccuugaaaugggugcuguauuugauagaaugucaguuuacuggugugcuugcuuccagguugucuuguccuuuagggaugccuucuaguaugcuauuaguucccaucuuucuuuguaccuauccuuucacauugauuuacaaaugaacuucuuuguaguaauuggaagggggucaagguaauuaagacuuugaggagguaccagaaggugguggcgcuugccuuuaaucccagcacuugggaggcagaggcaggcagauuucugaguucgaggccagcuuggucuacaaagugaguuccaggacagccagggcuacacagagaaaccugucuugaaaaaacaaaaaacaaaaaaacaaacaaaaaagacuuugaggaggugaaaaauuuuuuuaaagauguacaccaccaucccuggccuuuacugucauuuuuauuguuguaggguuuuuuaugauuuauuuauuuuauguaugugacuacauugucgcuguuuuauggcacacaagaagagggcaucagaucucauucuaguuguuugugagccaccauaugguugcuaggaauugaacugaggaccucuggaggagcaaauggugcacuuacucacugagccaucucucuccagccugaggaggugaauuuauagcaaacucuuuaugagacaggguaucugugaugguuucaauaagaauggccuccauagucucauauauuugaaugcuuaguuaccagagaguggcaguauuugagauggauuagagaauuaggagguauggauuuguugggcgaaguauguuguuggggaugggcuuagagguuucaaaaaucucacaccauucccauccucuaaguacugggauuacaggcguguacuauuuucucugcccaaauauucuuuuguucuacauauuuccuuuuucaauaaucacccuuaccagccaguauaguggaacauguuuguaaucccagcacuuggagucaggcuggaugauuaggaguucgagcccaugcuuaacuaacauaccaaguucaaggcugcucuggaauaugcugccucaagauagcaacaacaacaacaaaagaucucaagggaucuggcgagauggcucaguggauaaagacaccuaccaccaauccuaacaacuugaguuugauccucaggaaccaugagguagaagaaaagaacugauuacuucaaguuauccucugaccggugguuggggcauaugcuuucacacacaaaacaauauauguaauuuaaagaauaaacaaaaauagaggcuggaccaauggcucagcagaaaaagcaacucucguucuuacagaaaacuuguagcagcucacaaucuucccuaacuccuaacuccaguuccagaggaucugacauguucgucugaccuccaagagaaucaggcacauacaugguguacauaagauaaauacgggcugugggcggugguagcacaugccuuuaaauccuagcacucgggaggcagaggcagguggauuuuugaguuugaggccagccuggucuacagagugaguuccaggacagccagagcuauacagagaaacccugccucaaaacaacaacaacaacaaaaaauacauacaggcaaaacacccacacaaauaaauacaucuuuuaaaaauaugauaaagaaacaacuauuuuaaaaggcaggggguuggagagauggcucagucauuaaaaguacuggcuggcuuacucuuccagacaaccugaauuugauuucuaguagcuacauguauuguuuuuaugcuuuauuugggauuuuuuuuuuuugagauagguucuuacuauguagcccugcuugucuucagacucagagaucuaccugcuucugccuccugaguguugagauuaaaggcauaugccacauacagagaagacucuucuguguuuuuuuauuuuguuuuuuguuuguuuguuugguugguugguugguugguuuuucgagacaggguuucucuguauagcccuggcuguccuggaacucacuuuguagaccaggcuugccucgaacucagaucuucuguguauucuuaaaggauauauaguacuucuuauuacuucuguggugcuuuaaauucuugaaauuugaaggaaucuuaaggguauuguauagcauucuucauauuaaggaguucaucuugguuuugcuagauuaugaugaagaugacuaugaugcugauugugaagauauugauugcaaauugaugccuccuccaccuccacccccaggaccacugaagaaagagaaggaccaagaugauauuacuggugguaaguuaaaaaaaaaguauacuuccuuuuaggaaugaguuucuauucauaaagucaggcuuugggcaugcuuaaggggcuuuuagaaauuuaauaauaguaguuagagggcuggagagaagauggcucagugguuaagagcagugguuacucuuccagaggaccuggguucaauucucagcaccaacaugacagcucacaacuaucuuuaacuucaguuccaaagaauauaaugccuucagacagacagacagacaugcaggcagaauaccagugcacauaaaaguaaaucugaaaauaauguuagaaaaggauuccucuucuuaaaaaauuguauaagugccaaauacugauauuggauagauauuuuccuuacaaaauguuaaguaacacauaguuaagaaguauuauuuuaaauuaauuuagugcuccuuucucaaauuagguugccaucacaguuacuggagugaguuucccaugagcauuuuuuuugagacagggucuuacugugaagcaccucacaggaauuuucuuuacuaggccagacugccuuuaaaccuguagcaauccuucuguugcugccuucuuagugcugggauuacauguaugagcuaccauacucuguucccccaagacuuucugauguaaauaauuuauauacucucauuuagaacuuaucuguucaaaaagccaaaccuuuuaaucuggucaugguaguguaugccuauauucucaguacuuugaagacaggaagaugacuagauugaggcuagcuaggccuauguaacagaaauauuaugucuccaaaaucaaacaacuuucuggaauggagcaucacucauauugaguuguuaucucaccauccuuaacccuguaacaguaauaauccugccauagguuagauaaacagcacuugucuuuuuuuuuucuuuuaagcaaggcuucacuguguaucccuggcuagccuggaacucuauauaaacugguuggccuuaaacucauagagauuugcuugcuuuugcuugcugagugcugggaucaaaaguguaugccaccaugccuugcccugguuuuuuauauuuugagacuaugguaaccuaaauuucuucaguugguacuuugagccauuuucuuuaguuugcaagguaaauguuauuugacuuuguauguagacuuuauuuuuuguuauucuguaggcuuuaacaauucuucaucuuauagaucuccgaacugaucauaacagggccugauuaaugucaaguauuaguauaauuuuguuauuaaucacaauauggacacaguauuggucauuuauggaaaguaguaaauguaguaauaguguuuauuuucucucaucacaacccuaggguaccagguccaaggugaguuuggggauggugggaaguaauagguuggaugaguuuucuggccugcauacuaguaaccugggugcuugggacuauaucuccugccacagaaccaugcauauuagcuuagaaggggggugucggcugaaucugaggaaauguguucauaguuucaugccaaagggcuuucuuuuccuuguugcagugucugaagauggagaaggcaucaucuugcccuccaucauugccccuuccucuuuggccucagagaaaguggacuucaguaguuccucugacucagaaucugagaugggaccucaggacgcagcacagucagaaucuaaggauggacagcugacccuaccauuggcugggauuaugcagcaugaugccacgaagcuguugccaagugucacagaacuuuuuccagaauuuaggccuggaaagguacuuuguacggauaauguccauaaugaaaacagacuuuuuucagauuccaaguucuguuguuauaaagcuaaauauauaguuaugagucaugagacuaccacugccaugauuguaagucaugagucuuaaucguguucuuauucaguggcagauaauuguuuguacaggaacuuuuuaugcuguauuagaucaauuuuuugaaguuguguguaggaaaugugcuacccuguugccaagugugguuguacaugcuuuuaaugccagcacuugagagguagaggcagguggguaucaguaaguuugaggccagauuggucuacauagugcguuccaggacagccaaggcuauguagagagaccugccucaaacaauggcagcaacaaacuuguccuguugguggcucgugagaugguucauuggguagaagcacuugaaugcaugccugaggaucuuaguuugcucugcagaucucacaaauuggucagagaaaaccaacuccugagacuuguccuuugaccuccacccacauguuaugacauguacaccuacauacacacacauaaacacauggcuaaauaaaauaaauuuccuguuagaauaaaaaguaaacuaaguauccuaguuacuguucaauugcuauagauaccauggccaaugcaacuuauaaaggaaggcauuuaauuggaugcuuguuuacaauuucugagguuuaaucaauccaugaacauaugacagggagcacaguggcaggcaugguaccuaagcaauagcugaaugaaaacuuauaucuggaucugcaggcagagaaugagacugggucuggccugggcuuuugaaacucaaagcccacccccaguuacacaccuucuccaguaaggccauacuccuugagccuucucaggcaguuccacuaacugggaacacaacacucaaauauaugagauuauggaucauaccuaguaguauagaccuuugaccccagcuccuagggaggcuaaggcagggggaaucacaaguucaaggauuucugggcuucagagugaguucaagaacaaucugggcagcuuagugagaccuugacucaagaagcuaaagacuagccagguauggugguguuugccuuuaaacccaggcagaggcaaguggaucucuguauuugaggccagccuguuguacauagaaaguuccaggucacuccuauauagugagacccugucucaggaaacaaaaauaaaacuaaggauugggaauguagcucauugauagaguacaagucccuagguucaaaucucaguaccacaccaaaagaagaaagaagaaauaauugaccuauucagggauaauacuuuuguggucugaacuuagcacaccuucauuuuuuccccugcaguugaguagaucacuugagaguuuuucagacucugaaucucugacauaaaacuguguucuauguucuagguguuacgcuuuuuacggcuuuuuggaccggggaagaauguuccaucuguuuggaggagugcucggagaaagaggaaaaagaagcaccgugagcuuauacaggaagggcagguccaggaagaggagugcucaguggaauuagaagucaaccagaaaucucuguggaacuaugacuaugcuccuccuccacuuccagaccagugucucucugaugaugaaguaggcaaaguagacaugagauuaaagucuacaagggggcauguagaaagcuuucuagcuuaugucaaauuuguaacuaacacuuuagcaccaagaguucuuuguaauuaucagugacuaauaaugagcuaaauccaguggucucacuuuucuuguaauagaaaaauauuugguggggcaaggcagaguugaugaugcuacauugcuaaauauuacucauggacagagcaugucauguuauauucagguaaaaauguucaggaaucauccuugugguuccucuacgucacuuuauaguuaauucucuguagccuuaggucaucuggaauagggaaacccccaccucuacaucucugacuuuguuacagaucacaaugauggcuccuguggaguccaaguuuucccagucaacuggagacacagauaaaguaauggauaccaagccaagaguggccgaauggcguuauggaccugcccggcugugguaugauaugcuagguguuccugaagauggcaguggcuuugauuauggcuucaaaaugaagaagacugaacaugaaucuacaauaaaaugcaacauaaugaagguaagcaacucugguauaugagagaggaaucaucagugugcauaggguucuaucauuuuuacuauucagcuggcauuuauuaaguagaaucuuuaguaggagauuugcauaguagggccucauauaacuaggcccuauucuaaugaugcugucuuugaaauuccuacuguuggaguuggagaggaggcagauuucuuuucauuaucagguaauuugcacaaguaaaacaucacuuuuuucugugcuggagagugacuccuaggucuugcacauguuggggaagcacucucuuuuuuuuuuuuuuuuuugaaacaggguuucucuguguagcccuggcuguccuggaacucacuuuguagacuaggcuggccuuaaacucagaaauccuccugccucugccucccgagugcugggauuaaaggcgugcgccaccacgccaggcauggggaagcucuuaucacugagcuacauugccaauccuuggcuuuugaaacagagucacacuuuguauccugggcugacuucagacuuggaauucuccuuucagucucgcaaguguuagcacugcagguauuugacacuaagccuggaaaagcaccacuuccugagucauuuaggaucugcauugggaccuuugauuagugacugacugguugauucuucuuucuacuuacacagaaauuaaggaaacuugaggaaaacaguggcgucgaucuucuggcagaugaaaacuuccuaauggugacacagcugcauugggaagaugauaucauuugggauggggaggaugucaaacacaaaggaacaaaaccucagcgugcgaguuuggcaggcuggcuuccuuccaguaugacuaggaaugccauggccuacaaugugcagcaaggugugcuucuaugccaggaauaucuaacauccaggcuuuuaucuccgucauuauaaguaauccuacuugugcucuuuuaagcuucugagagaaagugaaaugcuucaaaucuaaucucugauuuuuuuuucauuuuuuuguucauaaaggcacuuuauauuuaucauguuauaauuuuuucucaaccagguuaaaauaaaaaauacugugcuuagcugggcaguggugguucuugccucuguucucagcacuagggaggcagaggcaggcugaucucuaugaauuugaggucagccuaaccuauagaaugaauucugggacagccagugcuacagagagacccuguaucaaaaaaccaacuagccaaacaaagcaaaacacacauacacaaaacugugcucaacaucaugaaaacaaugucaaaggaaaaauucugauauucuaaagauuaucaauuauuaauuuucaggguuuuuuuuugagacaggauuucucuguguagccuuggcuguccuggaauucacucuguagaccagguuggccucaaacucagaaauccgccugccucugccucccaagugcugggauuaaaggcgugcgccaccacgcccagcuauuaauguuuuuuuaauauuuuguuuucuacaaguauauuguuaagcuuaauuaauaaauguugagacaaggucuugcucuguaacugaagcuaaccuggaacucaacuguuuaccucagguuguccuuaaacucaccaucuuccuaauucaggcuuccuaaguacuacaaugccgguguuuguugccgugccauucaaguucaguguuacaaugcuguuuuguuuuguuuuuuuaaagauguauuuauuuuauguauaugaguacacuguagcugucuccagacacacuagaagagagcgucagaucccauuacagguuguaagccaucaugugguugcugggauuugaacucaggaccucucgaagagcaaccagugcucuuaaccacugagccaucucuccagccccgcaaccucuaaauuauucuuggugaucuugauaacccuuucaccaacucugaggucagagggggcauauuuaaaagucaccuugauuuauuggauuuuugagaaaagauuucccuccuuauuccuugcuggccuaguacuugccaugcauguuucagucuugccuugaacucgaaguaauccuucuaacuuagccucuugaguacugugauugauccaguaaaugccaggaaauauuuaaaauauaaagaaaaggaaauaggaaacagcauauuugguauuccauuuguaaaaaugaaaaacauagcaccauauaaacaaaaaucugacaaaaauauauuaaaguaucagcagugguuauuauaguuucuucaguuuucuuuucuuuucuuuuuuuuuuuuuuugguuuuucgagacaggguuucucuguguagcccuggcuguccuggaacucacucuguagaccaggcuggccucgaacucagaaauccgccugccucugucucccaauugcugggauuaaaggaauguaccaccaggccccgccuucuucauuuuucuuuauaccauuuuguauucuccauauuuucucaguuacccuggauucauuuuauaauucaggcaacacaccaccaccacugccacccugccauugauuuuuuuuugauccagucuuacuauauauaacucagguuguccuuggacucaguauccucagccccuaccuguugagugcugggauuauacauauacaucaccacaugcaacucaaaagagccuuaauuuuguuuuuguuuuuucaagcuaggguuucucuguguagccauggcugucuuugaacuuucuguagaugaggcuggccucaaacucagagauucaccugcuucucgaauucugggauuaaaagugugugccaucaccaccuggcuuaaaaugccuuaauuuaaaaaaucuuuugaaaaaguuuuucucuucagguuuaguuaaauacuuuauugguugcauagucucucuuuuaaauuuuuguuuuuuugagaaaaagucuugcugugcaucucugacgggcuacuuccucucucugcuucccaaguucuaggauuaaaggagaguauagcagcucaguaacagaguguuuugauacaugaucuugguguguagccauuagccagcccucaggcucacuucacaguccuucuuucugucucugucuuucugucuccugaaugcauagcagucuuaauucuuauuuugugcauaauauucuuagaagcauguuuuccuugcugaucauugcuuuacuugcuaauauaguuuaauagcaauauugaucaucauaauuuuuaaaugauuuacuuauuuuuauuuugugugcauuggaguuuugccugcauguuugucucugugagggugucaaaucccgggaacuggaguuauaguuguaagcuaccaugugggugcuaggaauugaaccuggguccucuggaaaagccaccaguguuguuaacugcugagccaucccuccagccccccaccauaauuauuuagcuagucccuuaguaaguaggcuguuuaaauuugaacuauuauaaacaguauuacaaugaacauuuuguuagcagugguuucugucaaagagagauauacgugauaucuaguagguuucguuuaaauaguuacaugaguaccugcacuaauauuuuuuuucuguuugcuaggaucauaacugaaaggacaauuaauguuuuguuuguuacuguuuucucuucuuguuuggucagguuuuacagcuacauuggaugaugauaaaccuugguacuccauuuuccccauugauaaugaagaucugguauauggacguugggaggacaauaucauuugggaugcucagaacaugccuagaauuuuggagccuccuguuuugacacuugaucccaaugaugagaacuugauuuuggguauguugauggcaggagccaaugcuccuuaucuuugacaucuuauuauuaauggcaaaggucaagaggauauaaaaauguuagagaaggcaaaagcuagaaacuuuuaggugaugcuuuuuuaaaagcagaguuguagcugccaguuuuuaguguuugaauauuguuuaggaaaaacucauguagggauauuuaaaauuguaucuucaagacaucauuagacauggcuugggcaguagugguaaacaccuugggagacagaggcaggcagaucccugaguucaaggucaaccuggucuauagaguucuaggacagccaggacuacauagaaacucuugaaacaaagaaacaaaagacaucagauauagucuagcuggagagaauugccaacuaaaaguagucuggaagugaagugagacaucuacuuagaaacuccaaaauuaucaguggaaaggugaauuuuagcuggaccuaguagcauggaucccagcuacuuaggaggccaaagcaagaagacuauaaauucaaggccuuucuaaguuacagauuguguuccaggacagcauuaguaauuuagugauauuguaucuaaagauaauggaaaaugcaggucagagggcugagaugcagcucaguaguagaauccuuaccuagcugugucauauuuucguuucaauccuuaguauuguauagagggauggggaagaggguaggagaaagggaagaagaagaggagaaaacaggaggaaagaacaaaauugagcauuuccgaagucauuucuuguuauauccucagagaucccugaugagaaggaagaagcuacuucuaauucuccuucuaaggagaauaagaaagaaucaucucugaagaagagucgaauucucuuaggaaaaacaggagucaucaaggaagagccacagcagguuugcgaaaagaaaaggacuugguauuuagaagaacaaagaaaaguauuaggaaaguguagucugaccaauacuuauuugaucuaucauuaucauuagaacaugucucagccagaagugaaagauccauggaaucucuccaaugaugaguauuacuaucccaagcaacagggccuucgagguacuuuuggaggaaauauuauccagguacaaauagcugcuuuguuuugacagaggguauagguaaagauugccugggaaggaguuaguauuuacuuuuaacucuucuguuuccuguuuagcacucaauuccagcuguagaauuacggcagcccuucuuuccuacccacaugggacccaucaaacuucggcaguuccaucgcccaccucuaaaaaaguacuccuuuggggcacuaucucagccagguccacacucaguucagccuuugcugaagcacaucaaaaagaaggcaaagguauaaaugaauccuuguuagaaaaauaguucuguaagguaauugagguacaaauugggggguuauacuggauauuagauuauauuagggauuauuuauuuucucagaugugauacaauuuuauuuugguuauucagaagaauguccuuauucuuagcuauuuuuuuaggagcugaggauugaacugagggccuugagcuugcuagacaagugcucaaccacugagcucaauuucuacccucuagaagauuucuaugaacauaccuaaggcuaaacuauugcagcuucuaaaacugguucacuaaaauccuauagaaacuguacagauuuaguagggaaaaugcuuaaauagugagagcaaagauguucagaauacuuuucuuucaguuuuagagguauguuugaaaguuuucacaaugaaauugaaaaaaauaacauguaaaaaacguuuugguauugucucagauuggaugauaucaguguacguguaguuuaucuuucuguugggaauaagcuauauuuucuucauuuuggacagaugagagaacaagagaggcaagccucgggugguggagagauguuuuuuaugcgcacaccucaggaucucacaggcaaagauggagaccuuauucuugcugaauacagugaggaaaauggaccauuaaugaugcaaguuggcauggcaaccaagauaaaaaacuacuauaagcgggugagacuguacucaaauacuuuuuauguuuuuuuuguauguguuuguuuuuaaauacucacuucauguguaugaguguuuugcugcauguaugaauauaugcaugccacauacaugugccugagaaggccaaaagagcgugucagauucccuggagcuggaaguauggaugguuguaagccaccauaugagugcuaagaaucaaaccuggguccucuguaaaaauagcaaauguucuuaaccauggagccaucucuccaggcccugaaauuuuuauuacuguaacucuaauuagguauguaguaauaaucugugaacauguauuuuaccauauacauuucuugggagaaaggagugguaucucuuguuaauagcaaaugcuaugcuuauggaagauuacauguauguuuauugguuuuauucugugaguuugagcuugcuauguuucuucuagaaaccuggaaaagauccuggagccccagauugcaaauacggagaaacuguuuauugccauacaucgccuuuccuggguucucuucauccuggccaguuacugcagguaaagaauucuuuccugucuuuauucucuucuaaggaaauugacagauaaggagcaagucugcccagaaaggaacaauuuugguugauugagguguucauguauuagguauaagguaguauaauccacugggaguaauagugggugugauggugcaaaccauuaauuaaucucagcaccuuaauuaaucucuugaaaaaaacagucagucaaucaauaaauaaaagaaaagcuggaguucaaaguuacucuuagcuauguagcaaguuucuauccaguuugguaaauaggggacuaucuuaaaaaaaagacuaguauaauaauauauuauuauuauuuuuuggagacaggguuuuucuguguaucccuggcuguccuggaacucacucuguagacuaggcuggccuugaacucagaaauccgccugccucugccucccaagugcugggaucaaaggcauguggcaccacugacuggccauaauuuaaaauuuaaggcaagauacuuccuugaaaauaauucuguguuaucuuuuagaucuuuagccuaaauauaaaggagugagguuguuuauuguuugauuugugaaggggugucuguguguuuugagcuagguucuuacucuagcacaggcuggccugaaacuuacuguuuagcuuagauuggccucagauuggccucaaacuuuggggcaguccucagccuuaugaguucuggaauugcaaauaugagcaugaguuacuauaaaauguuuuuugaaaauacacauugguugggggcagggauggugauggaugccuuuaacuguaggaaggcaaaggcagguggaucucugugaguuugaggccagccugcucuacagagugaguuccaggacagccagagagagguguuguuggugaugccugcuuauaaucucaguaguaggaaggcacaggcaggaaggucauaacuuugaggugagccuugguuauagagcaagaccaugucucaaaaaugaaaaaaaacaaaaacacaccaggaaguccaccuagaauuaagguaggauaugaguguuuuaaauucuuuaugugaaauuaggauguuugacggacuagagaugaagcucaggaguagagugcucaccaaaccaaagcucauuguucaucucccacugugugugggcucauaguuauacuccuucaucacagguccuuucauguguucaagguccuggguuugugucuaccacugcaaaaaaagugguacauuuuaaagauuuauuuauuuauuauacauaaguacacuguagcugucuucagacacaccagaagagggcaucagaucccauuacagaugguugugaaccaccauguaguugcugggauuggaacucaggaccuucggaagaacagucagugcucuuaaacacugagccaucucuccagcccaauauccugcauuuuucagcuaaggaaacuuaagcucagaacuucauacagugacuggcaaaagcuauuucuucugaaucuaaauuguauaguuuuuuuuuuccacuuuuuugagucaaggucuuucauauagccucuguugccuucaaauuugcuauguggccaaggauggcuuugaacucuugguccucuugcuucugcuuuucaagugcugggauuauagauagguauuauaauaccuuuuccuccaauaucauuaauuaauuagcuaguuaauuaguuuguguguaucucuguguguuuuauaucuauguauagaagccagagaucauuguugguugucucccucuauuacuugcuaccuuacuuuugagauagcaucauuuuucauagauccuagaguacaguuuugucuagacuagcaggcuagcaggcuuuagaggaucuucuugucaccacuagucuucuccuugccaccacugggauuacaggcauauaccucugugcucagcuuuauaugugagugcuggagauccaaacucauguuuucaugcuuguacaauaaguacuuuaccugcugaaccaucacccagccccguuuuuuucuuuuuugcggggagggaggguccucaugcaaucaggcuggccucagauuuacuguguagucaaggcuggucuugaauccuaaccuuccuguuccuccuaacaaggacugggauuacagaauaugccacuauguccagcuuugacucaauuuuuuugagagauaguuucuuuccauagcucaggcuagccuggaacuacuguagccuaggacggccuugauccuccugccucagccucuugaaugcugggauuagaaguauauacugcuauuccuggcucuauuuuuaaaguuuuucuuccuuuugucuauuagguucuaaaagacaguggguaaaaaaaacuaaaaaaaaaaaucuugugugauauuccauauuuuacucaucuuauuauauagacuuuagagcuaauaaauauagguaaaauuaaguuuuuuucccuuuuuuaauaguuggcugaauuuucuaaagauucucuguaaauaacuuuugugguuuacuuucauuaggcauuugagaacaaccuuuuucgugcuccaauuuaucuucauaagaugccagaaucugacuuccugaucauucgaacaaggcaggguuacuuuauucgagaauuaguggauauuuuuguuguuggccagcagugucccuuauuugaaguuccugguccuaacuccaaaagggccaauacacacauccgagauuuucuucagguaagaugggagugugggaguugggcuaagaugcacaugcuaauagaacgaugaaaacacaucugagcuuaguuggagaaggcaccuugguaagagcuuuuauccuuuauguaauaaaauguauuuggcuuauuggacagguuuuuauuuaccggcucuuuuggaagaguaaagauaggccacggaggauacggauggaagauauaaagaaagccuuuccuucacauucagaaagcagcauccggaagaggcuaaagcucugugccgacuucaaacguacagguccucagugugacuucuugucuucucugaugcucuuguacuccuaaagaauuaugacagucaguuaaaagaaauuauaacuaauagaauagaaauugaugguuguaagagaagguaccaaaccuuguaacuagagacuuugauaauuugaugauaauugguugcuaguauaguccaagugaguauuugcaugucuuacauaagauguaagaaaccugacagcaagguuucuaaauuagucauauuuagggcauuucaugguuaagugucagguaacuauacuguuacuuuuggguguuagaauucagaacaguuuucccugaaucuuuuccagggauggauucaaacuggugggugcugaagucugauuuucguuuaccaacggaagaggagauccgagcuaugguauccccagaacagugcugugcuuauuauagcaugauagcugcugaacagagacuaaaggugagccucuucuugucaggcacugcuuaugccuaaauuucuuuucagaaagauagaagacaauucuguagagauuauaguuacuagauuauuaccaguuauucaacauuuuaaacuguaugagguacuuuguguguguauggauucuaaggaaagcuacaguauagcuaaguggcaaugugacgcucagugaggaacuuaaaucauauugccuuccuuuaaaaaugauagcacaauugagugaugacuguuuuguaaaacaagcaggaaaagggcuuugcagcuucccggggaggcagagaugauagcuggaaguguggcuuauaaggcugucuuaguuagggcuucuguugcugugcagacaccaugaccauggaaacacuuauaaaggacaacuuggaauuggggcuggcuuauaguucagagguuuaguccauuaucaacaugccagaaaacaugguagcaugcaggcucuaaagagguagcgugaaguucuacauccaaauuagcugacaacaggaagacagagugacgcuagggccggcuucagcauuugagaccucaaagcccaccccccacugacagauuuucuccaacaaggccauaccuucuguaauaaggccacaucucccaguagugccacucccugugagcuuauggaggccauuuucauucaaaccaccacaaaggccaaaacagaaaaaguccaacugagaaauucuguagugagaauuuuucuuucucuuuagcuuagauugcuugguuuuaaaauggguccuaagcuauucacacauccacauaaguuccuugaaaauguuuuuugucugagggcuagagagaugcucaaugguuaagggcacuggcugcucuuccagaagacuuggguucaauucccagcaucuacacagcagcucacaacuguuuguaacuccuguuccagggaucugacaccuucacacagacauauaugcaggcaaaacaccaaugcacauaagauaaaaauaaauuauuuuuuaaaagauucuagaaaaaaacuuguuugaacccagggccaugcacauguuagacaagcauucugccucugaacuaaugcagcaaauuccuuggagucuggcauaucuucuaggagcucaacgaucucaagggugcucaacaggaauauauacauuaaaaaugcaggaucuauuuucuaugcagaauaugguuugguauuuuauauuuggauuugguauucagcaaaacuguuuuuggagaaaauauguuuuuuccuuugaccuuauuuaugcauagaauugucuucuuucaggaugcuggcuauggagagaaguccuuuuuugcuccugaggaagaaaaugaagaagauuuccagaugaagauugaugaugaaguaagauuuuacaaauuauuuuuauuuucugaggcagaaucuugcuuuauaauccagucuggccucgaacuuuaaaucuuccuaccucugucucccaaguguuaaaaguacagacaucccaauaugcccagcaacacuuguuuguuuguuugguugguugguugauugguugauuuguuguuguuuugaaacagggcuucuuuguguagcuguccaggaacucauucuguagacuaggcuggccuugaacacagagauccuccugccucccugccuccugagugcugggauuaaaggcauguaccaccacuacccaucuugaaauuuuuugucuuuaauuaugugucugugugucuguguguggguaugugcacauaaguagguguguguuggggcugaagagauggcucaguggcuauuaauacugacugcugcucuucuaaagguccugaguucaauucccagcaacccacaugguggagauggugacucacaaccaucugugacagauuugauacccucuucuggugugucugaagagaguaauagcuucccucuuuuagaaauuucuuuuucuuuuauugccuuuuuccacacaauauauuuugauuguauucuuuccccucucaaaacuccuuccaaaucuucugaugaaccucccaacacauccaauuuuauguucuuucaauaaaugaguauuuuauguacucauauacaauuaaauaaauaaauaaaucuuuaaaauguaggugaguauaggugccuauugaagaucagcuacauuggauuucucuguaggcggaguuagagauggcuacauuaugugggcauuuggaacugaacccaggucuucugaaagcaguuagcuuucuuacccgcuaagccaucucuccagucugcauuauauuuuucuucccuuuuuuucuuuuuuccucccccuuuccuccuuccucccccuuuccuccuuccucccuucccuucucuucucuucucgucucauuccuuuucuuuuguuuucuuuucaaaacagggucucucuuuaugucauccuugcuguuuuggaacuuauauguagaccaggcuggccuagaacucaaagaaaucugccugccucugccucccaaguacuuggauuaaagguguguaccaccauacccagcuauguacuuucauuaauucaaagaaaacuuuuaaagauuuacuuuuauuuguguuuguaugugugugugccuguguacaggguacaaaagaggggaucacauagaucccuuagagcuggaguuuuagguauuuguggacaugggccuucuuaugugggugcuuggauccaauuucuaguccuugugauuguacaccaaauguuuuuacucacugagccaucucuggcccucaacacuuuuuaaaucagugcuucuuguuaucuuguuuaaaaagaagguuuugggcuagugagaucuguaaucccaucacucuugaagcagggggaucagauauucaaggauaagcuuuacuaccuagggaguuucaggcaaccuggucuagggacccuauuauaaaaaaucaaaauaagggagccaugacaaucaaauacagauguccuuuuaacugugagcaucaugaguguggguacaacacuaccuucugaaguuuuauggaaaguggagugaagaacaucauuguuuccucauauuucuuauccugguuacacucugaguaucucuuuaauaucaugauauaaguaccauagaagagagccaggcauuggauagccacuacauuuaacuugauaauuuaagaaaucaugaaaauuacccugagaauccuuuccuuuaucucagguucguacugcuccuuggaauacuacaagggcuuucauugcugccaugaagggcaaaugucuccuggaggugacuggaguagcagauccuacaggcuguggugaaggguucuccuaugugaagauuccaaacaaaccgacacaacagaaggugagagucuagaaaucaaaauggaaggacugaggguugagcagucgaugaauagaguggagggccuggacgugcuucauuuaccacaaugucauagaugcuuacuguuaggaggucagcuucagauuuuuauuuguuucuguuugagacaggaugauaaagagccucagccagugaaaaagacagucacaggaacagaugcagaccuucgucgccugucucugaaaaaugccaagcagcuucuucguaaauuuggugugccugaggaggagguagguuuagaagaggaaaacuccugguaagagguuuuguaugcagagagaaaagguaggaagcuagaaagaaucgucuggagcuucauaugcuguagaggcuuuaccaaaacuugugaaacuucuuuuaggcuuugauuuuuuuuuuuuuucgguuucuaaucauggcccuguuuuguccuuuaacaucccugaaugaguuacauauguguaguucuguguuucuuucagauuaaaaaguugucccgcugggaaguuauugaugugguacguacaaugucaacagaacaggcucgcucuggagaggggcccaugaguaaauuugcucguggaucaagguuuucaguggcugagcaucaagaacguuacaaagaggaaugucagcgcaucuuugaccuacagaacaaguauguuauauucauucaguacuguuuaaaguuuaagcuagaauauggacguuuccuagacaugcuauauuuugaacuaauaaugcuuuuguacaugcaaaucacuaacucuaucucccgcucucagauacuauuuuucuauuuuggaaugagauagcccugcugaucucgaacuugcuaugugggguauguuggccucaaacuuuugauaauucuauaucuaucuccuauguucugggccauagguauccaugcucuaccagauauuucgaaagaagaggauguuacuuuaaaaaaguguaacuagguuguuggguaucugaaauaucaggcacugucuguaauaauacugccagaguaccuauuccugguuuuuguguguguguguuuuuguuuguuuguuuguugguugguugguugguuuuuuuucgagacaggguuucucuguguagcccugaauucacucuagaccaggcuggccuugaacucagaaauccaccugccucugccucccaagugcugggguuaaaggcgugcgccaccaugcccgguuccuauuccuguuuuuaaagacaaggcuuuacuaugucacucuggcuagcuuugaacucaguauggacacccagcggcccugaauuguaaaaaguaucuuuuauuccucugauguaauuguugucuuggaagcuuauugccucagucugcuaacccaggccuucuagccccuguacaaucuuagcuaggccuagaauguuuucagccucugagacuuacuucugaaugagcucacccuuucuaguucuuucugagcucugacuggcugguucaacucaacuguucugacucaaacucuucucugaacugacugauuuaaucuggcuucucucuuuuggccucuccugaauuccucugcuuguccucauacuaacuuuggcagucugcucuaaucuucugucuccuuauugucuggcuuuuucugucuucaccugugucuagcuucuucucucuaaccugucuguguaaaacucucccagagaaaacugcuuccuucucucacggccccuuaaggagcuucccuuuccucuuuucucaugagagucgggcagauccuauucugucaugucuuucucugauuugucacuuugucugccacucaauuagacaucacuuucaaacaugggugccuucuucugccagguaacuuuaccuucauuguuugggacuaaagguguguacuaagggcauuccagccagagggauuaaaagugugugcccuuagcugaaccacaccauaacacaaucuugggauucacagugugaucaaauauccuucagcacugaacccaucaccugccuguuugccuccugagagcugggauugauuaagggcauauaccaccauggacaacucuuuuuuuuuuuaaagcuuuuucuggagacaggaucuugcaauguagccuauauggguuucaagccuuuggcuugucuuugcuuccccagugcugaaauuauaagugugucccaccgugacugcugaaccugcuguuaccauaguaauucagcaaagaauaauuugaauaucacggacugcuuagcuugaucucuugguucugugacaguucuuguggucuacuugaacuggacuuaguaguuuuaagugugauaaugggcauauuuuuucuuguagugacuuaugaaagaauaguagugugcuguuaaaaugauccaugaaagcugggcagugguggugcaccccuuuagugucagcacuugggaggcagaggcagguggauuucuaaguuugaggccagccuggucuacagagugaguuccaggacagccagggcuacacagagaaacugucucgaaaaaccaaaaaaaaagauccaugagucuaaauguuguaguguacuggggagcugagcuguguuugggagacugggacaagaaggauaaacaauucaaggcauaccuaggggcaaaggagaacacacacaaacagugagagucucuuucuauuuauuuguuuguuuguuuguuuguuuguuuauuuauuuauuauauguaaguacacuguagcugucuucagacacuccagaagagagcaucagauuucguuacggaugguugugagccacugugugguuacugggauuugaacucaggaccuuuggaagagcagucggcgaucuuaaccgcugagccaucucuccagccccgagagucucuuucaaaaaaaaauuauugcaauuuugcaaauaugugaaaugucuaucaagaugcaguuuuucuguuauagguuuugugucuguggagucugcauauaucuuuuuaagguugauuccucaauuuucuucuucaguccuacuuuguacaccuguaucuccccugucuuuaacuuuuuuccucucuugcuaggguuuugucaucaacagaggucuuaucaacugacacagacagcagcucagcugaagacagugacuuugaagaaaugggaaagaauauugagaauaugcugcagaacaagaaaacaaguucucagcugucucgggagcgggaggagcaggaacggaaggaacuccagcggaugcuacuggguaaggggacuucuuaaaggaucaaaaccacaacuuagauaacugcaaacuagcacugacuccaagcugaagacaaaguaaggaaugaguauagagaaauuuguagaugggauagcaagauuucuacagaugacuccagucugugaggauaaaauugaagagaugcugccagcuuauugcuuccucuuucuguguuagguaccuggcuaaacuaggcuauuagugcuguacaugaaaucaaaucagcuuucuaggcuuucauccaaaguaacaggguuuuuuuuuuucauccaucugucugucuguccauucauuucauucauucaugcaugcauucauacauucauuuacucacuuaacuuuauaucuccauacuaggcauucaucuucccauuccccuuucuuuuucucugagaaaguggaggccccucugaauaucacccacccuggcacauuaagucacuguuggacuaggcacauccucucccacugaggcacgcaagacaaggagacucaguugagggaaugggauccacaggcaggcaacagauucagggacaguccccgcucuaguuguugggggaccugcauaaagaccauacuacauaucugcuauauauaugcagggaaccuaugucuggcccaugcucacucuuugguuggugguucagucucugggagccucuaggguucagcuugguugacuuuguugaucuuuguuuuaaaaauauagaaaguaucugauagguaugguggcagauauuuuuaaugccagcacuugggaggcugaggcaggaagcucuugauuuaaaggccaaccuggacuauauaguaagacccuaucuuuaaauaaaguacagaaucuuugcuggaugaaguugccagauugucuuugaacucucugaauuuauauuuaaaauuguaugcagaagauucuuaaagaagucuuagguacuaaaaugagcuaaaaccaccaucaaaaguugcagaagcugauggugagggugauggauaaugaggucuccaugauguuucucauuacagauaucaucgagcagguagugaauguagauacugagaggaugaaguccgaggaugaagauuagagugaccauuuucauccauacuagucuuagcuuuguugcccaucucugugaagcuuugaaaaauuuugugucucuggcuacuuuguaaagauauauggcuuauacaauuauaguccuccaguucuuugcuaauaugacccuagaacacagcauguacauuaauuacaugaacaguuguuagaaagguagacucaucuugagccugagcucuccauaccuacugaguuuaguuuauauuuuuacaagaucuccagugaguuccuguucauauuaaaguuuuagaagcauacguuaucuagauccuaagacugggcuuaagcacuccucuugagugcuugcuuggguguuuucaucaacuuuuugcugcugggaguugcugguuuuuuucgagacaggguuucucuguauagcccuggcugucguggaacucacuuuguagaccaggcuggccuugaacucaaaaauccuccugccucugccucccaagugcugggauuaaaggcgugcgccaccacugcccagcaugcugugaguuuucuaucacucugcuauuugguggaauaguaauauuuagcuauugcuucucugucuccaguaggaagcccaauacucugagguauuucuagaacauuuguauguaggaaaauggaaaugggcagugguuaaaaaggaguuggaagggcugaugagauggcucagugccgacugcucuuccaaagguccugaguucaaaucccagcaaccacaugguggcucacaaccaucuguaaugagaucugaugcccucuucugcugugucugaagacagcuacaguguacuuacauauaauaaaucuuuuaaaaaaauaaaaaauaaaaaaaaggaguuggaaaagagcacuuugagauguucuuguggcuaguagcaagucuacuuuuaguagaauuguaguuccaugauauauugaacaucucuguucaaccccaagaaguggcuauuuggguguuagggggaaugauuagaaauuguuuuuuaccuuacagcagcaggcucagcagcagcaggaaacaaucacagagaugaugacacagcuucagugaccagccuuaacucuucugccacuggccgcugucucaagauuuaucgaacauuucgagaugaggaggggaaggaauauguucguugugagacaguccgaaaagcaacuguuauugaugcuuauguacgcauacggaccacaaaagaugaagaguucaugugaguuugauaugcugcuuuugaguauggcagagaaaauaauaauguaugugaguuguagugauuccauugauccuggaauucugcuauuauuuagaaccugcuugucuuuagaucuuuggauuugaacagagcaaaaucacuagagaaauaaccguuuuuacuacauuuagauggugguaguuuggcucugcaaaaaucuuagaaaaguuacuccuauaagguuuuuauaaaggagguuuuggcaggaggaauacagguucuagaccagucuggguugcaaaaaaacuaugucgcaaaagucaacagcaaaaccuuaaugauuauuaauuaguuauucaggacuagacagagaaauguuacucuauacauguggaggacugacuaacaaggaagaugaagauggcagacaguuucugucacuucagccuggaugaauuacuuauauucugagaugguagcuuucaggguagucauucuugauuuaagcugcuuauggucuugcuuuuuuuuccccguuacucagucgaaaauuugcccuuuuugaugagcaacaccgagaagagaugagaaaagaacggcggaggauucaagagcaauugaggagacuuaaacggaaccaggaaaaggaaaagcuaaaggggccuccugagaaaaagcccaaaaaaaugaaggaacggccugacuuaaaaguaaguauauugggcuggugagauggcucagcggguaaaagcacacugacugcauuuccaaagguccuaccuaaguugaaaucccagcagccacaugggggcucacaaccaucuguaaugggaucugaugcccucuucuggugugucugaagagaguggcaauauacuuauauauaauaauaaauaaaucuuugggucugagcgagugggacuaacuggaguaagugaaguuaaccagagugagcagagguccuagaaauucaacucccagcaaccacaugaaggcucacaaccaucuguacagcuacagugcacucacauaaaauaaauaagucuuuuuuaaacaguaaguauauuaagccaggcauggugguacaugccuuuaauuccaguacuuaggaggcagggcuacauagggaaacccugucucaacuggcccccaaugaugucuaguuuuguuucucccccacugcauauguauuucauucucauuuugacauccuucacccugcuuaccucuaacacauugcuaucuuuuucuguugcaguugaaauguggagcauguggugccaucgggcacaugaggacaaauaaauucugcccccuuuauuaucaaacaaaugcuccaccuucuaacccuguugcuaugaccgaggaacaagaggaagagcuggaaaagacagucauucauaaugauaaugaagaacuuaucaagguugaagggaccaagaucguuuugggcaaacagcuaauugagagguaagggauggcagucagagagugcuguagcaaagaucuguucaagguugaugauugggccuuucgggggaaauguggugugauuauuauuugaaguggaacuagggcuuauaucaacuuugaguuaucacauguaauuuuugcugguaaugaaaauuccagugagcauuggggcuuacuacuugcuuuuacauauuauguuuucggagucacuaucuuucuucugguuuuauuugguugguguuuuuuguuuguuuguuuuguuuuguuucaauacagagacucuacauaccccuggcuaucuuggaacucacucuguagaccaggcuggucuugaacucagagauccuccugccucugccucuggagugcugcgauuaaaggcuuuugcuaccaagcgaggcuaagucuuaauauuuauacaaguacccuuacugggauagcuuuuuguucuguuuuguuuuacuuguuuucugugguacugguagguacaguggguaacauccucaaacccuugcacaauuguuuuaagacuuugcuaaauuacccauguuagccucaaacuuucugucuuucugucucagccucccacauagcuaggauuacaggcauggagcaccacaccugucaugaggguaguuaagauaaaaugagagacuauaaagcaaacuguacuuaugcccaauuuucuugcccuuagagaauuuaauagauaaaauagagauguuagaaacuggagagauagccgggcggugguggcgcacaccuuuaaucccagcacuugggaggcagaggcagguggauuucugaguuccaggacagccagggcuauacagagaaacccugucucggaaaaaaaaaaaaaaccaaaaaaagaaaaaggaaaaaaaaacuggagagaugguuccauaguuaagagcacuggcuauucuuccagaggaccuggguucaauucccaacacccacauggcagcuuguaaccaucuguuccagggaaugugguuccuucccacagacauacauguagucaaaacaaaauguacauaaaguaaaaagaaauaauuuuuuaaaaauggagauguuaaaauuuuuucccauuuuaaaauuauaaacuaaggugggcuuugguggccagagauaaaggcuuuacuauacauaucacugcguauacuuccuauacauaauuaaaaauaauaaaaaauaaaucuuaacaaacagaagagcuggcgaaauggcucaucgaguaagaacacugacugcucuucugaagguccugaguucaaaucccagcaaccacaugguggcucacaaccauccacaaugggaucuaaugccuucuucuggugugucugaagacagcuacaguguauuuauauaauaauaaauaaaacguugggccagagcacgcagagguccuaaaaauucaauucccaaaaaccacaugaaggcucacacucaucuguacagcuauagugcacucauauacauaaaauaaauaaauaaaucuuuuaaaaaaugaacagaaaaagaaacuaagauauugguauugcauauacuuguuaacacugcgcuauccuugcuucugggcuuuuuauugaacagaacuaguaaguauacauauauuuuaaauuguaauuucauacuaaugcuuuaauucacauuauacuuaucccauuucauauuuguauccuuuucugauuuguuuguuuguuuguuuuuccagacaggguuucucuguagcccuggcuguccuguaacucacucuguagaccaggcuggccuugaacucagaaauccgccugccucugccucccaagcgcuaggauuaaaggugugcaccaucaugcccggcccuuuucugauucauuaaaaaaaaaaaaagauuuauuuauuuaucauauguaaguacacuguagcugucuucagacacuccagaagagggugucagaucucauuauggaugguugugagccaccaugugguugcugggauuugaacucaagaccuuuagaagagcagucagugcucuuaaccacagagccaucucgccagcccacuuuucugauucuuuuuuuuuuuuuugaagaauuauuuauuuauuauauguaaguacacuguagcucucuucagacacuccagaagagggcaucagaucucauuaagggugguugugagccaccaugugguugcugggauuugaacuucggaccuucggaagagcagucggguucucuuauccacugagccaucucaccagcccccccuuuucugauucuuaaugucaauauauuucucccuuuucucugacuuguaagugcaaaauaguuucaaaauucaagauuuauuuauuauauguaaguacaguauagcugucuucagacacaccagaagaggguaucagaucucauuacagaugguugugagccacuaugugguugcugggauuugaacucaggaccucuggaagagcagucagugcucuuaaccacugagccaucuccagccuccuacuguacuauuacuagcgcgcgcgcgcacacacacacacacacacacacacacacacacacacacacacacacagccuguaaaauagguucaggauuuuuggaguuuguugucuauguagcucaaguuguccaguaagauauguuuagagcacuugaacugggccaaguugugcaggccuguaaucccagcuaccuggggagcaaagccaggagaaucaaaaguucaagaccagcuugagcuacaaagugaauuuaagggagacagagggaaggaggagguaaagaagagaguaaugaaauacaugugaugaugaaggcugaagagaagcuauugcaaggaggcauagggggcuugaggcaugaggguuacuaguauggaaggagugaaugagaacaaaguaaaaugauauguuuaugaaaugccauaaugaaacacauuacuuuauaugcuuacuuaggaaaauagaucagccuuggcaacuuagacauugucucaaaaauaaaaaguaaggccagauguggugguguaguacuuuaauccuagcauuugcugugaguucaaaaucagccuguucgacauagcagguuccaggacaucuaguacuacauugagagacucugucucaaaaaacaaacaaacaaaaaaaacaacacaugaaaaaaacaauguaagggcuugagagauggcuuagcaguuaagagcacugacugcuuuuccagagguccugaguucaguucccaguaaguacaugguggcucacaaccacuguaaugggaucugauguccucugcugggugucugaagacagcgacaauguaaucacauacauuaaauacauacaaacauauauacauaagucuuuuuuuuaauuaaaaaacauuaguauguuauaugagcuauaugauuuauuuuauguguuugaguguuuugucugaaugcauguaagugaaccauuguaugugccugguacccacagaggucagaagagggugucagguccacuggaacuagaguuacugucuaguugugagcuaccauauaggugcuaagagcugaaccaggguccucuuuguuagaguagcaagaacucuuaaccacugagcuaucucuccacccuuguuucugugaacuauaaauaacacacuauaacauguuacugauugcagugcagaugaaguucgcagaaaaucucugguccugaaguucccuaaacaacaacuuccccccaagaaaaaacgacggguuggaaccacuguucacugugacuauuugaaugugaguaucugcauuuucuucuuaucagauggauucucauugauuuccuuaaccuucuguagcaugguucugucagugucagauguucccccaugucuacuccuugagcauuauauauauuguucauuauacaacuuauuaaaauguauauauuauuuuuuuguuuuucaagacaggguuucucuggguagcccugggacuuucuugguacucacucuguagaccaaacuggucuugaacucagaaaucugccugccucuaccucccuacuacugaguuaaaggcaugugcuaucacauccagcuuuuauguauagagaggguguguauguguacguguucauuugugcauaugccaugaugcacauguggaagucagaggacauggagucaguuuucugcuucuuuaccucaagucuggagaucaaauuauggucacugucuuguauggcaagugccauuauccacugggccaucuuacugccuauccucuuugaugugcaugauuauuuugccugcauguguauaaauaagucuacuuagaugcaugccugaugccagaagagcccagaaaagggugcacuacagaguuaguuguaagucauugugggugcugggaacuagacccagguccuuugcaaagguugcaagguaucuuaaccaccgagccaucuaucucuucaucuuaccaucucuccugaucuaacccucugccaccccccaccccucuaguacagacuagucuagaauuuacuauguaauacaggcuguucuugagcuuacagcaauccuccuaccucagcuucccaguugcuaagauuauaggcuuaaguccucuaagucuggcauuauugaagauuucuaaaauauaucaguauauuugagaguauuggguauuuuuuugucugaagcauucugauuucuuacauuuuagagaccucauaaauccauccaccggcgccggacagacccgauggugacacugucuucuaucuuggagucuauuaucaaugacaugagagaucuuccaaaugugaguucauugcacuagauauauagaauaggaaaacaaaggccuauuugcuuuuucuguuacuucagcuagauagcaguaauguaucuggaacucuuaauccuuuggaauuuuugucuguuuuuaaaugauuauuaaaugauuuaaaugacucuuaggugauggaggacaauguaggcagaaggacacaugaauuauaagaggauauaaagcuaauuuuuucuaguuucaacucaauauucuuuuuucgagauagauaugugaauucaaauuucuggguauuauaguagaaagaauuuuuuuaaaaaaauuauguguauaucucucuaugcauaugcaaauguccuuagaggccagaggcauugaauuacguggaaccaaaauuacaggggguugugaguccccagacauaggaacuggaaagcaaacuuagguccucuggaagagcacugagcaucucucuagccuccaacuuguaugucuuacaagaguagcuuuugcauuccaugagugucucauauauauggaacuagaaagacaguuuaaugguuaagaguacauacuacaguggggcuggauaguugggucagugguuaagaacacuuguugcaaaggacccagguucaauuuccaacacccacauggaagcucaccaccuccucaggcaccaggcacauacgaggugcacagacuuacauguaggcaaaauacucauacacauaaaauuauaaaaauaaacucgaaaauaauuuuuaaaaaaagaauauauacugcucuuccugaggaucaugcuugguuuucggcacucacguucucaaagccaccuguaacucuagcuccaaagacuugaauacuuugucaagugugguggcucaugcuuuuaaucccagcacaugggaggcagaagcagauugaacucugucaguuugagaccagucuggucuacaaagcuaguucuaggaaugccaaggcuauacagagaaacccugucuugaaaauccaaaaaggaaggaagggagggagggagggagggaggaaggaaggggagagagagagagagagagagagagagagagagagagagagagagagagagagagagaagaaaaagugguuuaaugcaagaaacagaauuacuacaucugaaaaagcccuugagaguugguaaaccaguaagauauaauuggcugugucaaguguucuugcucacaaacggugcugacucuuguuuucccagacauacccuuuccauacuccaguuaaugcaaagguuguaaaggauuacuauaaaaucaucacucgaccaauggaucuacagacacuccgugaaaacgugcgcaaacgccuuuauccgucucgggaagaauucagagaacauuuggagcuaauugugaaaaacagugcaacuuauaaugguaauagucccuuguuccuugacuacaaaggucaccuuucagauucuuaccccuugcugguucuaaauucagaguagauuagaaugaaggaaaacacuuuaaugugcuuuuuuuuuuugguaugcacaucggguaguguacauuucagucauauaauaaguguugcuuguuuuuaguuuuauuauuuaauccuuuuuuuugagacauggucucaguauguagcuuuggcuggccuggaacuaacugcagaccagaccggccucaaaaucacagaaacaauuuggccucuucuuccaaauuagugcuaggauuaaaucuaugaucuaucacacucagccucccacuauuuaauuuuuaauauauucucuggugcauuugaggcauuggguguggguggacucuacacaggacguucuuguagccauauuuuguguauucuaacucagucugcauuuuuuguuacaggggcuagauguccauuuuguuuauuaaaaaaaaaaaaacaaaccaggaauggcagggaggaagaagucagugugcauuaauucauauauaaguguuggcauccagaguagagauaauaccaauacagcuaggauguaguuuaacaucucaugaccucuucuguuuucucauguauaaacaggacaauaaugauagcuagauucggaagcuuucaacaagccaguccaacuuacuuaucaaauuucauuuccaaugacuagcuucuaugcccauuguagacaauauucauacucaccauuauauuuaauuugaauauuccaagguacuucuucaugucuuugcagucuuuuucccucuuucugaaguuuccuuugacugcucaaaaaacaaaacaaauagaaaaccaaaaaaaauauacuuguuuuguuuuuguuuuguuuuuugauccucuguguucuggagcacaguaaaauuagcuuuaaaacucuuauccccuaauuauguauccagccaguuugugauuugcuagaaauaauguuauuuauguugacaguucagagcugagcagagugucagauuguauacaagggaagaauaggggguuggaaaugguggcauaugucuacaaucccaacacuugggaaacagacaggaucaggaguucaaggucauccuugguagcuacauagcaaguucaaaaccagcuugggcuacauaagauacugucucaaaaauaauaaguaauaccagccaggcuccucaacagauagaagcacuagcuauguaaggcuuacaaccugaggucaauuccuagagccuacaguggaagguggaaacugacuuuuuuguaaggguuuauuuuuauuuuauauaugugaguacacuguugcugucuucagacacaccagaagagggcaauggaucccauuacagaugguugugaaccaccaugugguugcugggaauugaacucaagaccuuuggaagaguagucagugcucuuauccgaugagccaucucugcagcuccaggaacugacucaugaaaguuguccuaaucacacacgccauggcuuauggacccacauuuacauugugugcacgcacacaccaauuguaauaaauaaaaauagaagagaauuaacauaaaacaaagccccacagugggacgucuguaacucaguaguaaagcacuuaaccagcacauauuagguucuagguucaguuuucaauaguagcaaaaauggcgcacaccuuuaaucccagcacucaggaggcagaggcaggcggauuucugaguuugaggccagccuggucuacagagugaguuccaggacagccagggcuacacagagaaacccugucuugaaaaaccaaaaaaaaaaaaaaaaaaaaaaguuucucacagccuuaaauccuuuauuuuuugauucauucuucucacuuccucacaugucauuccugguaacaguggcaugaaauguuuuuauuuggauugucugcccccucacacacacacaguauuucagcuauuguuuauuccuugauacuaccgucccucccucuuugggacaggaucucuacauacccaagcugaucuugaacuugcuguauaguccagacuggccucacacuugcuauccaagugcuuugcucucuugacuacugugacuacagaguuguaacaccauagcuagcuuauuuucuuuuauggauaacuuuuagauauuaaguuaguaaauauuuuggauuuuuucacuuuaaaacuaacauaaacaguugugaacauuuauguuuaaacuuuuguguaagacauuugcuuucauuucucuuugguauaugcauaggagaggaauugcugaguuuauaggguagcuuugaccagcaucuugaaaaccuauuauuuucccaguuucuagaguagcuguaucacuuuguaguucuaccagaaauguaacauguauuucauccucauucugucuucuccucauccucaccaacgccuguuagucuuucuaucguagucauccuaguucguuucaaguggcacaucauguguauuuacgucuccuuaaugacagugagagucugcauguacuuaggauauuacccaccuuuuccuucuugaugcucucuucucuccuuuccaggaguauuuuauauagcauuuuuuacuuuuauguguauguguuuggguguauguacgugauugcaaguagagaccggaggcuuuggaucacccugaaacuagaguuauaagugagcuaccugauguagauacugggaauuggacugcaagagcaguacacacuucaccgagccgucucucuggcucuuauucuuuucuuacuacuucagcuccuauauguccacugaugccccuaucuuuugucuccaucaauucaaggcuucauagcuuuguuuccagguauuugcuagacaugacaguucuuguccuacuagcaauucauuaucugauugccuauguagauaaauaguuuugcuggcugccuaguuauacaaccuagaaauuuuagucacaauugauaccauacaccuuuucucacacucauagcaaaguccucuaaacuauacuaucugcauuuuuuaacuugucccuuuccuuuuuguuacccuugcuacuugguuaauuggagcccuugcuaucucuuguuuaaccucuugcaacaguuuucaaauaguguuuuugcuuuaauucuuccuauuguugaaguucacauccuauauauauauguguguguaucaaaacuaauuguggcccugaugaaaugcacugcagcauguuuauaugaauuugauuaauuacuucugugucuuuguuccuucucucuggaaugucuuuccuauuguaugccuguugaacuucuauucuuuaaugacuaacuaaauguuagaacaagccuucccuacugccccccaaagcagaauuuuugcuuucuuuuuuaauauacuaaagauugagcccagaaccuccagcaugcuaggcaacuacucuaccuuuuagcuauaggccagccucccuuuuaguuuuuauuuuggaaugaggccuugcuaaguugcacaggcuagccuugaacuuuucuuguaguccagcuugaauuuaaacuugcaaccuaugucucagcguccugaguagcuaaaauuaccagccuguaucaccagucuugguuuccaguuaucagauuagauauacagggaaauagaauaugguucauaugcaaucaguguauuucauuuaugcugauaggcuuuuuaaaaaaacuuuuauagaaacuaagacgaauaaacuuuaguguaccuacucauugaauuuaacaaucugucaguuuguggugagucuuauuuauuauagauuuuucuuacuauaucauuucaguuauagauaucugauaggauuacacuguccugcagugauuucuuuucaaguaauuuucuuugacuaauccaagaucuuucuauaauggaacuauuaauuguccuuauauucccaucauugaccuugucuuagacaagguauaaaacauuugaaugaauaaucaaaagcugaaauaaauauuagggcugaggcucaggcccuaggggucacuaacaagaauuagauggaggaaaauaaucuaguaaaugauacugaaaagaaguggccagauauucgaauuagagcugggugcuggugggucaggcuuuaaucccagcacuugggaggaauuugagauuagucuggucuacauaguaaguuccaggacaaccaaggcugcucagagaaacccuguuuuauaaaaacaaaaagaaaagaagaaaaagaaauccuaguuagauaaaaauguuuuggggguuucuuuuuaaguuugagaugguuucauuauauaguuuaggcuacccuggaucuccuaguccuaugguugaagcaucucaagugcugugauugauagguaugugucccaacucccagcucaaaauguuuuaacuguuccaaagaugagcuuaaaugaagcagcuauaagaagaggauguacaagaguggucgcuuaguucaagaauuuucugaagcucuuggugaggauuucugggaaacugaaauaauagucuuuaugcugaaaaucuguuuacuaagcagaaaaaaaaaagauguucauuggucucuguuuugguuuuuuuuggggggggugguuuuuuucaagacgggguuucuuuguguagcccuggcuguccuggaacucacucuguagaccaggcugaccucaaacucagaaauccuccugccucugccucccgagugcugggauuaaaggcgucaccaccacgcccggcguuuguuggucucucuaccauucuuaaccacauuguucuccauccgcagaauaauuuucagcauguugaaagcagcaauaaagcuggaucaugccuuuacucccaguacuagggagacagagagaggcaagugaaucucuuaaguuuugagacuagccuugcuacauagauaguuccuggcuagccagagcuacauaaugagacccugucucaaaaaacaaacaaacaaaaaaagcagcuguaauccaagagaauauggucacaaauaaagaacaguuaaaaaaauucauucauauugacuacccauugcuauauuaggcacugaaaaauggaguaaagacugguagugucuuuaccuugugcaccuaccuguaaucccaaggaggugaagguggaaggaucugaaguugaaggucauucucagcuacauagugaguucaagaccagccugggauaaaugagacuuugucuuagaaacauaaaaaagaaaaagacugcuauaucuaccucaguuacuaagcuggugccugggaccuuuuagguucuuuaguaaauguaugaaguguuggaaacauguggcaacuuugcuuuauaaugucuauuucuuauuccucuguaggaccaaagcacucacugacucagauuucucaauccaugcuggaucucugcgaugaaaaacucaaagagguaagaaugaaagauaagacaaaguagugggcauagugacacucaccuagaauccuagcacuugggaguuggagacaggaggaucaggaucguaacaucauacucagcuacauauugaguucaggaagagccuaagcuaaggcuuugacucaagacucaaaauaaauaagguuuuuaaaaaauaaaugcugugugguauaugaaggugaagaauaguggaguuuaggaacuaguguauuuaacagaaggaacaguacccaagggaaugacaaauauugauguauuugagggguagggauuuagaaauuauauagcacugucuucuauagacuggaaagccaaauccaaagaagaaaaucccuugcucuguaaucaugcaggauauaaaauccagaaccuaguaacucuagaaagaaugauggaaaauggcuucccaggagaucuccuguagcuuacauugcagcucgcugccaucccagcaaaacaaugagauacugacugccuuaucuagcucaggcuggcuuagaacucgcugugucuugagagcuggcuuuaagaauuaaggauucagacagugagaacacagaggauaagucaaugagaacauaagagauuuuuguaguacacagacugaagugaauuuguuuaauuaaguuuccuuaaaagagucacuaaucaggcugugguuauauauuaaugucaagucaaccuggguugcauaggauacauacccuguuagaaaaaccauuaacuagugguaauguaguucuguauucuuggcauucauuuuauguaaaaaagacaauguuauaaaagccaaauuugccaaaaauguuguagcuaaacuggugaugucuugaccuuucuauucuugguauuauauaagcaugggauguagaauaugggauuugcugacauguuccuucgugauccuuuagccaaaguaucauuuaucuagguugaccugaaaccggauaguagauaauuuagauaauuuaguagauaaacuuuuggggacuaaagccauagacagcuagcuagacuuuaaauuaucuuuaguuuucugugaauaucauacuucaugaaaacugcuuucuuuuuuuuuuuuuuuuuuuugcuuuauuucagaaagaggauaaguuggcacguuuagagaaagcuaucaaccccuugcuugacgaugaugaucaaguagccuuuucuuuuauucuggauaacauugucacucagaaaaugauggcaguuccagauguaaguaauuuucaugccaaauauugagaggauggaaagaagugcauagaguaagcauguguauauuaagagauuaagauaaauggggcgauggauauccauaggaacugggauguaauuuaaauuaucaaccuuuugcuaugugaauuuauuauuguguaaaaguaaagaugccaagugucuuugaauauuaagagauuugguuuuguuuuguuuguuuuugagacaggguuucucuguauagcccuggcuguccuggaacucauucuguagaccagguggccucgaacucggaagaacucagaaaucuaccugccucugccucccaacuacugggauuaaaggcauguaccaccacugcccggcuauauucuuacuuccuaaugucaguauugaguauuucuacacucuugaauagccugggagagcaaagcugucaacuaauaguagauucuugauuuagaaaugcucaucuacaaauaacacuuucaacauuuuuauugcauuuauuuauuugugcauguuguggggggaagcauaaaucauguuuuguguguggucaaaacaacuugguauaggcuggagagauggcccagcaguuacgagcacuaacugcucuuccagagguucugaguucaaaucccagcaaccacaugguggcccacaaccaucuguaaugggcaucugaugcugucuucugcagugucugaagauagcaaaauaaauaaaucuuaaaaaaacaaaaaacaacaacuugguagaguguagugguacaaccuuucaucccagcacuugagaggcaaaaagcaaguggaccucugaauuuaaggcaagccagggcuacacaguaggacccugucuuuuuuuuuuuuuaaaccccuugcagaauuguuaggcuucccuucuaaccuguggguuccaggaauuaaauuccggucagugggcuuguugguaaucaccucuacccacuuagccaucuagccuguucacaaaaaaaaaaaacaaaaaacaaaaaaaccccacaacaauuacucaauguuguugucccuuuuuuguuuaauuguucuuuuuuuuucaacauuuuaugguaaggcuaucauuuaucauacuaguucuguggaccauuuuauauauugguccccccagaaauucugaauuaaauuuucuguugcauauagucauaaugaucuaugucuacaguauuaaaauuuuuucaagauagaacuguggaauaagcaauuuuauucuaguuugcaaaacuuagucuuuaacacagaaauaagauuuuaguuguaaguuuagaggagggauucucacuuuaucuggauguaagaauccuuagugagauccugaaauuauaauuuugcgugcagauucauauuuuuguggaacgagucuauacuuuucaucagaaauauuuauaacucaaugaaaauuggaccucuuuguuauaaguaaugguuuucacuugacuuccugugcuuucuuuuuacuagucuuggccauuucaucacccaguuaauaagaaauuuguuccagauuauuacaaagugauugucaguccaauggauuuggagacuauacguaaggugagugauuuuuuuuuuaugaucaguggcuuuuuauaauauuuuuguauguguagcugagugccuguuuuuaucauagaauaucuccaagcacaaauaccagagucgagagagcuuucuagacgacguaaaccugauucuggccaacaguguuaaguacaaugguggguauuuauguuuuuuccucuaucaugaguuuuauguauccaacauuaauuuacauuacuaaaauuuuaaggcuuaagcagguuugagcagugauagcuaaaucaaguaacuuaguuuacuuuuuuaaaauuuuguuucuacauuuauguauuugugcuauccuugugugcuuuuggagguuaggggacaacucagagaauugguucucuguuuccaccauguggguucgaaccuagauugucagguucagggcugaaccauuuaaucugcucaguuuuuaaaguagguauauauuuuaguguguguucuguaaggaucacuauuaaagaaucauggaaaucagucuauccuuucuuuugaaaucguguaaagcauaggaaaaugaggcauuaaugaaaaucaaauggauguucccuguccuuugagucaucacuguguuucuauaagcuuugaaaagcuauaucccaaaguucuauggagcugaggcugaaguguguagcuggcuauauagaccauggcaaacuuugcuguauguaauuuugcucagcaccugaaccaauggaauaaugugugcuaaacacuuugcuagcugcuuuaacuucugauaauaaggauggucucuguguucaaguacuuuauacuucaguugauauaaacaaaacacaucuugacaagggcuauaaauagaaagguauacaaaaggcguuacuggaaaaacaauacucuaaucugagggcuaggaaaaacuucauaaauuaguaaaaguuaaagauuuuuuguuuuugagacauggucucauguauuauaggcugaccuugaaccugcucuacacaugaguucaucuuccugcucucaccucucauguuuguggggcaccaagcauggcuaagacauuuauuuauuuuauuuauuuauuuauuuauuuauuuauuuuuaaauuuuugagacaagaaucucacucuguagcccugccuggccuggaacucacuauguagaccucauagagacuggccugucuucugccaccacacucaauccaaaaaauuauuauaauuuaaaaacguuuuaaauggccagguguguggaagacagaagaagaugggucucugugaauucgaggccagccuggucuauauagugaguccagaacagccagggcucaguuaaacagagaaauccugucuugaaacaaaccaacaaaaaaaacccuguaauauuuauauuuuaauuaugugucggugugcaugugaggaggccagaagggagcaugagauccccuagagcuggaguuagaagugaaugugaggugccugacauggaugcuggaaacugaagucaggucuuucaagagcagcaaauguucuuaaccauuugagucaucuuucuagccucaggaauuuguuuuuuaacugagucuuaagggaugcucacuaucaugguuaauuucugagcaucuucuaugcugaacaauagugaagaggaaaaggaugaugaaguuccagauagccaaauagauggaaaaguacaaguaaguuuggcuugaguauagggugauggcuagguuugacuauaaaaaacaaggggaggggcuggugagauggcucaguggguaagagcacccgacugcucuuccgaaggucagaaguucaaaucccagcaaccacaugguggcucacaaccauccguaaugagaucugacucccucuucuggugugucuaaagacagcuacaguguacuuacauauaauaaauaaauaaaucuuuaaaaaaaaaaaaaaacaaggggaauauaacugacguucaaaggccaaguaagucacacuaaaccaguggagaggagagggauagaguuuuaguaaauaccauuugggaaguuaucaaauaauaaaguggaggggaaugagauuuggagacuaguaaagaaacucuuaacaguucccauguugaaaaacaaaacuuaauagccuggacaguuaagaagcagcagcaaaaaaggccuggcaugguuacacaugccuuuaacccuagcacucaggagacaauggcaggcagugaguucaaggauagccuaguuggucuacaugguaaguccuaggauagccagggcuccaaagagagacucuguuucacaaaaaccaaaacgauaugggcaauggugguacaugccuuugaucccagcacuggggaggcagaagcagauaaaccucugugaguuugaggacagccagggcuacacagaagauauugucucgaauaacagagagagagagagagagagagagagagagagagagagagagagagagagagagagagagagagauauuauauagauaguaagaaagcaaaauugauacuucauaauuggaccaugacugauaccuuuauaaaaugcucuguguguuuguguuuuaagugggacauuacaguuggacuauacaaggaaagccuugugggccaaguguggugacucacacuguuaauucuagcacucaggaagcaaagacaauuagaucacaagucuuuuugaguucuacauagaguucuaggccagccagaauuacauagugagacccuaucucaaaagcaaacuucaaagagacaauguuagagauugucuaggauaugucucaauagaauggagauauaaacuauuuaacaugaaguuuugcacugacuuuuguuuuagggcuuuuuuuuuuuuugagaugcagccggguguugguggcacacgccuuuuaucccagcacuccggaggcagaggcagguggauuucugaguucgaggccagccuggucuacaaagugaguuccaggucagccagggcuacacagagaaacccugucuugaaaaaaacaaaaacaaaacaaaaaaacccaucccauuauccaguuuucauuucauuuuaacuccuucauauaugccacauuauauacaagacuauuuccauagaauuuaaaauuuucauucugcuuuaaugauagccauguuucuuugaauaugcaguauuucuccaucuuuucauuucccauucauguuucaaaaagagcuuuuugauuuugcuuuugagauagucuugcuauguugcucaggcuaaccucaaauuggucaucuuccucaaguuccucagugcuaggauuguacaguuuuaugccucuguauccagcuuuuuacuccaauauagcuucuacugugccaaguauauccuaagugaacaagaucacauaauuccccuugauaauaggccauuuauaguccuuaucuuaaucuuacuccaagaguuagucacuucuuugaaacuguacugugaugacagaugucuucccuuuuaaaccuuuucaugccuuuuuagucuccuugcugaauauucuuacucauauauuucaacuaccaucucuuucuugaugacaguauucuagacaaagauuuaugccuccaaccaccugcuuaaaauuguucuuuuuaaaaaaucaugacuacaugucuguguaacaugugcaugcaguaucuacaaaggccagagaggacaucagauucucugggcuagagagagagguggggaggaaggaagggaggaaagagaucauguggaugcugguccucugcaagagcauccaguguucuuaacuauugagccaccucucgggccuuauaaaauaaauauuagaaagaaaggccaaugggccaaagggcacagcgccuggaaagugagguggugcuguagaaugacaaggaagaaguccaucucaaguauaagaaagcugcuaaaaucaggucuagggaguuggguuucgaaguguuucauuacuuauugaauaaaggcucaaugagcauuccuugucacucuuuaucagugguuccuuaaauacacuuuuguaguacuguaugcguuauugaaauuugaaguuugggcugggcauaauuuuggauggcagcauaacuuuaaucccaacacacuauaagcagagguaggcagaucucugagaguuugaggccagcaugaugguguguuccaggccagaccagcuagaguuacauagugaauucuaucucauuguauagcccuggcuagccuggaguagccuauguagcuacccuauguagccacuauaccuauuuuaguguuuaaggggcuggugagaugguuaagagcacugaggagcucuugaguuccaggccagcaagggcuauauguaggaccuugucuccaacaauaaaaacaaaccuaggucauaauagccucuuuuuuuaaaaaaaaaaaugccauuuuguuuguugaagacagggucucacuuuguagucuuggcuggccuuaaacucaugaagaccuacaugcuucugccuccugcaugcuguaauuaaaagcauaugcuacuacauucagcuuaaucaauugaagaaaugauuauguagacaggugagccucugcuuccuaaguguugguauuguuuucuucauguaugagugugauacuuauaggagaggguuaucucuaguaugguagaaauagcauuaagggaacuguaagccuaggagugauagcaaagcuguuuacuuagugaacagguaguugucuuuguaauuuuacagcuaucuggcaguaauaaugcuuguuugcuucuuguuacaucacugcaaauacaggaaaaaagaauuguucuaacugggcgugguggcccacaccuuuaaucccagcacucgggaggcagaggcaggcagauuucugaguuugaggccagccuggucuacaaagugaguuccaggacagccagaacuauacagagaaacccugucucgaaaaacaaaacaacaaaaaaaaagacuuuuuuuaaaucuuaaauaacauucuguuuuccuaaagcagucauuaaauuucuacuauuuaagaacaugauucgggcuggugagauggcucaguggguaagagcacccgacugcucuuccgaagguccagaguucaaaucccagcaaccacaugguggcucacaaccaucuguaacgagaucugauucccucuucuggagugucugaagacagcuacaauguacuuacauauaauaaauaaauaaaucuuuaaaaaaaaaaaaaaaaaaaaaagaacaugauucucuaagcucugcaaauccuuauuuaauuggguaaacucugaguaaauacauuuuuuuucaguaagacaguuucggucccucuggccaugauuuaauaaaaaagugaaauauacucacagguuuucuuucuucuucuuuuucuuuuucuuuuucuuuuccuccuccucuuccucucucucucuuccuucuccuccuucuucuucuacuuuuucuuuucuucuucuucuuugcuaguaaguaacuuaaucuguuggguagaaugauaauuuauauuaauuuaccuuuccugguaauuauggcaccauucuggaaacaacuaguguguuuguguguguuuccuuguaaggucuaggaaacuggaauucuauuucuguuuaauucucccucccagcagccucaacacuuuguucccagagaggccccauuaccuuuguaugucuaucuuuuuuucccuacagcucgucagcauacuuuuaguaaguuccuaguguauuuuuagguuuauggagguggauguagaccuugggauaauuuuauucuacccagaaaaaagauacauacagaauuuuguucaggauguuugugaaucucuuugcuucauuacuucuucauucaagaauugcugcuaagauaacaguaagaaaaaugucuggguauguguauauacuuaacagugguuuacccaacucuagcauauuucauuauaaagacuuaaaugcuaauuuucuuacauaguaacaaaauggaauuaaauaucuggaaacaaacuugugaacauagguugucuaaaaccagcagcaguuacagauagccugugauaaaaacauaagcaagggauagcauuuguaauuuucuuuuuauauucuagaggcauuauuuauuagugaauauuucuuuagagguauugcuuucaaaggaaguaggaagagauguuuucaaaaugauuuccagagagaaacacuacaaacguguaaaacuaauugccuucauauuaaaauuggcauguuaagaauuugaucuguguuuauauguucaaacugaaaaacacuaaaggcugaauuucuaguccauguccuuguaggcauaagagccaguauacagaaacugguguuauauuaguucauuuuaaggaggucuguagccucucuguagcuuugauuugucuguaucauuacauaaccaccacaugaagcuuguucaucugcuuauguacagacacaggcuagaagggauuugauauccuuuucucucauucucugcaucuuccuuugaggcagguucuccuccugaaccugcaaccuggucuugcuaggcaugacgccagcaagccccagcaguacuccugugucuguucugcucaaaucuggggaaugcucagaguauuaugcauauacugggaucugacucuagucuucaugauugcagaguaagugcucuuaagcacugagccagcauucuggaucuacaauaaauuuugauuaagucagagucucacuggguggcggugguguacaccuagagguaggggcaggugguucucugaguucaaggccaaacuguucuguagagugaguuccaggaaagccagggcuauacagggaaacccugucuuggggaacaggggcaagugucuugcuuuauaggcugggcaagaacuuguaauuauccugccucaaucucccaaagugcugaaauuacaggcuuaagccaccaugcauggcuugccugagaaccuuugcauguagucuccuuucugucaauauuuugaauaucaaacuacugauugauuagaacuaggagauaaaaaaacaaagacaaaaaaaaacaaaacaaaaaaacaagguaggcauagcgguacaugcacuugggaggaagaggcaggugggcuucugaguuugaggccuggucuuuagagcaaguuccaggagccaggcuacagagaaauccugucuuuaaaaacacaaacaaacaaaaaccaaaacuaggagaucaaaaauccagaaacaagcuauagcuguacuuuguauauguugggggugaggcuaggugagacaguaucuugguguuacaaguuguacuggccuccugccuuagccucuguaguacuuagauaaaaggucagugccacuacacuguucuuaaucauguauguccuuaauauuuuagugauuggcuuaagcucucuuuuugguuuauuugugccuggcauaaggauacauccucaucauccguuuuguuuuuugagacaguguuucucuguguagcccuagcuuguccuagaacuugcucugagacuguggccucaaacccacacagauaugccugccugucucccaaguucugggauuaaaggcguaugccaccacugcucagugaauuuuauuuuauuuuauuuugcauauuuuguguguggggggguaguaaagauagaaccuagagcuuugcacaugccaggaaaguacucuaccaucaaaauauauucccaacacugucugauuuuuuucuaaaguuuuaaaaacuguuuuuauucauguuucugguauguauaugagagagagagagagagagagagagagagagagagagagagagagagagaagagaaaaugaauauggguacccuuaggggccaaaagaggacauuggaucuccuaaaacaagugacuaugagccaccugaugugggcacuuagaucagaacugggguucuccguaagagcagaaagcauucuuaacuacugagcuaucucuaaccuuuagauuuuggauauaagauagaaggucucuaacuguuacaugccagccucaaauuuaacuauaguccagguuagccuggaguugaugaucugcugcuuuauccuccccagcgcugagaugaaggcgcuaucauguguggcuccauuucacauauuuuagaauagauuauguaugcuuaggggauguuuuacuugaaaaugacucaucuuuuagcuuauuuuauuuguaugaauguuuugugcuguauaugucucuauaucacaugcuaugccugguucccaaggaggucagagagggugucggaucuucuggaacuggaguuaaagaugguuguggaccaccaugugaguguuggaaaaugccuaggaauccucuacaagaacaaaugcucuuaccuguugagcccucuccccagccccugaaaaggccuuuguuauccguguaauggcuuauaauaauuauaguaguuauggcuagaaagcuuuacagguauguaugguauacuuuuuguggugcuagagacuaaacccagggccuugugugugauagguaaacuauccuacuaagcucuaucucuagucuuccucccccaaaaugguauacuuuuauuauuauaucaugguaagcaauagguaaauuucuuuuuucuuuuuuuuuuuuuuuuuuuuuuuuuuugguuuuucgagacaggguuucucuguauagcccuggcuguccuggaacucacucuguagaccaggcuggccuugaacucagaaauccgccugccucugccucccgagugcugggauuaaaggcgugcccuaccacgcccggcuaauagguaaauuucauggauuacaucugugaaagcuuuucuuauugucugggaauauauuucagagaacuuuucuagaauaaagaaagaccugggaucaauacccagcaccacauaaacugggcgugguagcacacgccuguaaucucagcacucaggaggcagaggcaggcagaugucuauaaauuccaaggccaaccuggacuauauacagagacccugucucaaaauaauaaaugaaagauaaaaaguggagcuguaaucugaugaauuuuaaguccauuagucuacuuaugaacauguuuuguaauaaaauuccucagagcuauaaccuaugaaaauugcuuggcaaaaacaaacaaacaaaaaguggagcugcuauuucuagaacauuuguacuuauaaaaauggaaauccagccgggcaugguggcgcacaccuuuaaucccagcacucgggaggcagaggcaggcggauuucugaguucgaggccagccuggucuacagagugaguuccaggacagccagggcuauacagagaaacccugucucgaaaaaccaaaaaaaaaaaaaaaaaaaaaaaaauggaaauccagccgggcgugguggcacacgccuuuaaucccagcacuugggaggcagaggcagguggauuucugaguuugaggccagccuggucuacaaaguaaguuccaggacagccagggcuauacagagaaacccugucucgaaaaaacaaaacaaaacaaaacaaacaaacaaacaaaaaaaagcaaauggaaaucagcagugguuaaauaggagucaggaaagagcaaauugggguguuuguguggcuaguagcaacucuauuuuaauagaccaguauauacucucucuugccauuuuuuauuuuuauuuuuguuuuuguuuuuguuuuuuuagacauggucucaccguguagcuuuagauugccugaaacauacuauaucucuuucucccucugccuccuaaauucuuggauuaaaggcaugugcuacaaugccuggccauuaaccuaucuuuuaaauuuuaugaaacaucaaccauuggguuuuuaucugaaaucuuauagugcauguugugcauuaguuuuuuaaauguuuucauugagauauaacuuaccauaggaaaaugcauauaggagcuggagauguaucuuugguagaguuuuugccuaccauacauaaugcucuggguucaguugcuaagaaaacaucaacuagucaugguggugugggccuguaauuugaacauugacuagcuguucauuuaucuuaauuuuauucauucuuucauucauuuuuuauugugagaaggucucacuauguaacccucccuagcuggccuagaacuauguaagccaagcuggccuugaauuuacagaaauucaccugcuucuuuuucuggaauuaaaaacaugugccaacacaccuggcuuaagggauuauuuuagauaugauacaguuuagcuuaaaaguuagguuuauggcaaaauugauugaauuuacagagguccaguauacucccuacuccguuauaccgaagugguacaguaguucuauuaauagaugaaccuccacugauccuccauauaccugcaacuguacuuacauaaggguucuuguuuguuuauuugagguagggucucuaaggauagcuuagaacuuguucuauaaagguagauugagugggggggaugcccauaauuccugcacucaggaggcagagaccaagggaucauauguuugaagccaguccagaacacaugagaucuuauauccaaaauaauuugaggagagucuggaaaauuaaaauguaaaugaaacaagauuagccauguguugauaauuguuaagucuggcuaauuaggcuaauugggguauaauuagucugauuuuauauguuuaaaguuuuuccacuuaaagcuaagugugguggcagaggcacauggaucucuugaguuugaggccauccugcucuacauaauagguuccaggacagccagggcuaucuauacagugagaccaugccuuuaaaaaugaaaaaaaaaaaagaauaaaaaaaaacucgauaaacuauuggauuaaaaaaauccacaauuuuuguuuuuaaauuguaauauaugaggcuggagugauuguucaaugauuuaagagcacuggcuccagggcuacacagagaaacccugucucaaccccccccccuaaaaaaaaagcacuggcuacucuuccagaggaccuggguugacuucccagcauguauauggcagcccaaaccauuuauuuguaaguucaguccaacagccucuucugcccucuuuggguacuagguauguguuuguuguacagaaauacacacggguaaaacaccaacaaacauaacauaaaaaauaaauuuuagcaagguagugguuuguuugguuuuuuuaacacuuuuuuuuguuugguuuguuuuuuuuguuuuuuucaagacaggguuucucuguauaguccuggcuguccuggaacucacuuuguagaccaggcuggccucgaacucuuuuuaacuuuuaaucucagcacucagaaggcaggguaggcagaugccugugaguucaaggccagccugaucugcauagcuaguuccaggauagccagggcuauacaaagaaacuucuuaauaaacaaacaaacaaacuuuaaugauuauuuuaauaaacaaauugaaauauauguauaaaaucaguauguuggaaaaauguaaaauucuugaaguuacagaggugugcauuuuacuucuuucauagggccugagagucaguauacuaagacugcucaggagauugugaacguuugucaccagacauuaacugagguaggugguagagaagaucuagcucccuaagccuuucuguuguguccuugaguuugaaaauuuaccucacuauccuguuuuauuucaaauauaauauuccaccuucugcccucauuccauuacuucuuucucugcuuuuuuuaaguuaucaucuguguucugcuauuagaauagaaauacuaugaagacugcauucucuaaaaauguauuuauauguauaugagcgcucuaucuucauauacaccagaagagggcauuggaucccauuacagaugguugugagccaccaugugguugcugggaauugaacucaggaccucuggaagagcagucagugcucuuaaccacugagccaucucuccguucccgaagacagggauuuuuguguguguguuuuauuuuugcaugcccaguaccuaaauguugaaugaauugauuaauuuuauuuguuuccuaguaugaugaacauuugacucaacuugagaaagauauuuguacagcuaaagaagcagcucuggaggaagcagaauuagaaagucuggacccaaugacuccagggccauauacaccucagguaagccaaaagaaugggaaugucuuacagucuucuaugguuugggaaaaugggagcauguuaacagaucuguuuacugagauaccauucuucucuguccuuccucuucauaugccuuucgugugcuuucuugucuucucaaaggcuaaggugagugagggccaugggucuuuguggccuugucgaauccagaagaggcaacuaugggaugaaugaguggggugguuguuuauagugugugagaacaccagauuucugacuacuauagccagaggcauccuuuaggucucuaauuguuuucuugguaaauuuuggggauguaggacauccuagaauguaggcugcucaguuacagauaggguccauauuuuucuugugccuucuagauaucugauuacccauuauuuuagaaguaugucaguauagcuuuuaucacuuaauuuccagaguuaauuucuuuccuacuaaaugaauacuguuuuaagucuauguuaaaagacuagaaagaaggaaggauaagaaauuuuuaguucuuucuggucugacugaaccuguugaguauuuccucuagucuuagaaaguuggcauauuugaaaaauagacuugaaguagaauauuaacagguccuuggucuauguuggagacacagugguggaaugaaaggacaugagguuugauguaaaacaggccugggugugagucuuaucucugcuaauaucuacuuuugugauauugggaaauuaacauuucuauucccauuucucuaagauguucuuuccaauauuaaaugaguucauuuguauggcacauuauaggcauuugauaaauauuuauuuccuucuuuauaugaaggaauuuuuuuuguaaaguucccagagacucuuucaaauuuaacugaaugcuuuaaugcagaauuccuuccaauuccuguaggguuauuucucauucuucccagguuucacuccaaacuuauaugcaccauacaugaucucuguuggauuuuugcugucucuaugucucauucguacacuuucucuaucuaucuuuuacucucucuuucaucccaaaacauagguuacugaggggccagguauaaagaacccucagauacuucuucaagguccagaaccaggaaaggcucuuggaguuguaugggcagauugggucaagggggcuugggugagugauguugcccaggaaggccuuguuugcuaauaggcucacaguuuccacaagguacuuucugguaaguuaaagcuuggauacuagccaucauucucuagcagaaccuaaccaccaauuaguaugugcuuuucuugggucuuagauagucauaaaccuagaccauuggugaaucaguguuguccuuccugagcaguagcugcuuugguauccuuagugaguuuccuauggagaauaugguauggcuagugcuacuucauucuuuucaguucaugcucucaucuuucccuucacuuauauguauaaauuuuaaauuagcuaaagucauugccuguuaacuaaaggaauuuagauuccaugugugaccauccuuacucacaaauauguaaaaucaaaacauuauuagaaaguaucuguauuagauuaaccugucauaauacaguuuugauuguauaggagcauagcauuaaucacgccauuuucaacuuccagauugugacagucaguaguguauuugcaucuggauacuucuacugaaacuugcauugagcucaauacuuuggaauuauucauuuuacacuuucucacauuccucuuuauuuuuauacuacauuuuaaauuuugcagaaaguuuauuuguaugguaauguuuugaacucuauuuuggaaaaucaaaucuucucagucaaucuucuuugcuugcuuguuuacgacacuuauauggguagacauuugggguuuuuuguuguuguuauuguuuuguguugguguuuuuuuuuuaaauagcccaggcugugaucuuccuaauugaacuuucugggugcugggaguauaggcuuuugucacuaauccuugcucauaagcaaguuuuguauuaaucaaaguaauaccaugauuggggagaauuagaagauagggcuagagagauagcuuagcaguuacgagugcuugcuguucuuuuggaggaccugacuuugguugcuagcacucauguucugugacuugcuguuuuaacuuuggcuccagagguucugacaccuucuggccucuacagacacuacacucacauguacacacccacacacugacauucgcauauacauauauuuuguuguuguuuauauauacaggguuucucuguauggccuuggcuguagaccaggcuggccuuggacucacagagaucugccugccucugcuuccuaagugcugggauuagaggcaagcaccaccauugcccagccacauaauuuuuuaaaugaauaaauaaaaucuuuuuaaucauuggaagauacaaauaacagguguguuacuuaucaauuccauuuuucauaacaucaacuacugaguauuuugaguuuucauaucugugauaugucuauuuaugucuguagauauacuuuaaaagugaaauugaugaauauuauuuuccuuguuauguuuauuucaugaauauuuuaucuagucucucuuauuauuauugacuagacuccauuuaguaaauuucugcacuuuucagggaugaaaaggagcuaucauuucuugaguaccagguauugaauacacaaagcucuuaauucucacaacaacccugugacguagauauuaucauccauguuuuacaguugaggaaaacagggugguuaacaacgguagaaccaagacucaaucccagggcuguuuacuccaaagcccaugcuuuuuauucuaaccaugccauuuugcuuugaaguaucauccacagacuuaugaacugucaaaccaucccaugcucuuuuugaaauuaauuccuuuauccaguuucuguucaugucucuuaagucaguaaaacuauaacuaauaugaaucccugagcuuaaaaacagcaaggcaagacuuagaaaaauaaaguaguuuacugaccagagaggcuguuauguuaauacauaaacuugucccuaagcuuuaugcauuucuacuuuaguuuuuaaacauauacaauagaugccagucugcuagagugaaugcuauuuaaaggauucuaaaaauuuguguaaaaagcuguaccgggcugugguuucucuuuaacuagguuguuuugcauguccuuuuguuauaaaggagaauucuuuguauuucuucuagcugcuucccuuuauagaagcuaaguuguguauuuuaugcugcagccuccugauuuguaugauaacaacacaucccucaguguuucucgagaugcuucuguauaucaagaugagagcaaucugucugucuuggauauucccagugcuacuucagaaaagcagcuaacacagguagaauguuauucuucuuugugagauugguggucugcuucguaggugaaugugcagggacggagugaucccauguauauauggaaaaugacuggauccuuuaguccagaaaacaaggcuuugaaaugugaugucuauaaaaugguugucagauugaaacacaacagaccuucagggaaaauauuugagacaucagaacagccuagaaagugacugacuagaaaaaccagcugcauucagagacagaguucagaauacuugguauaguauuuuauguaauaaaccaaauuaaauauauauauaauuuuaauuggucuuugccagaggcaucaaaacauaauucucaucuaaugcuguaccuauucucaagguuucaugauagagaauaaaacccagaaggauuuucuuucuuuuuuuuuuaagauuuauuuauuauauguaagcacacuguagcugucuucagacacaccugaagagggcgucagaucucguuauagaugguugugagccaccaugugguugcugggauuugaacuccagaccuuuuuggaagagcagucggguacucuuacccacugagccaucucaccagccccagaaggauuuucuaucucaaaagcuucgcuuaggaagaaagcauucccuucugaugacacuuaagaguggaucaaaaacuucccuguucuuugguuuuuuucuugcccugucuauuauuuccaaagaaugacuguggggaaugcacaugccuugagcuguguaaacagccuccacuagcagugggguuggcugggauaucaaggaagaacaucuguccuagguuaacccaugguuaacucuacaagcacaucccucaaugaugugcuauuuguguuccuuacucaggcucgcccgggccaagguaggcugggcgaggaauucucugguguagauauugaaggguaucaggaggaugggaaccugagacucuagccccagugaguaugcuuacagaaagcuuaugauuacauuacacauuuauaugauacaagccccaguagugcagggcagaccaaaucccaaggugauaucauagagucuccuuacagugagccucugucugacuuuaauucuugaaauaagcuagacaagucgauccacuaucauuauuugacuuguugugaggcagcaaaugggaugcgggggaaagaagguguucuggucucuuagugauggccugccaccuggacuuguuuaggaagguggagauggagauggugaucuugcagaugaagaggaaggaacuguacaacagccccaagccagugucuuguaugaggauuugcuuaugucugaaggcgaagaugaugaggaagaugcugggagugacgaagaaggagauaacccuuucuuuggugagucuagcucacuguuguaccucaggauugaauaggaaccucuuuacuauuuugugcuauuauuaaaaaaagcuaucucuuuuguuagaguccuauuagagcuguaaguaguacugaauauaaacuuagaggauguucaugaccauuagccuuaggggaagugaggaugaauagacacaggaggcauaaagguaauaguggcaaaggcagugcccaaguaggaacuuuaaaggguuauguuugggagcagggaaggaaaauaaagcaaaauaacagaaaugauaagauaaacguauuagagaugauagaaaacagguauauuagacuaaagucaaggaaauaaguugcuuaaacucaguuucuaaacuauagaucuugccacgguuggccuuugguaguuaaaggagaugccuuagaggugaggacuauaagcacaaaugaagucuguauagacuacuuuaagaauacuaggcugaggaugcuaauuaugacaaaaauuacuuuuucucauucuuguuuuguuauuuugaauuuacugucucauauauguuaggcaaacaguguaacacugagccaucuuccuaguccaucaagcuuaucucuuaacgaaccauaauuuuuuuuacagcuauucagcuaagugaaaguggaagugacucugauguggaaucuggcaguuuaagacccaaacagccccgugugcuucaagagaauacaaggaugggcauggaaaaugaagaaagcaugauguccuaugagggagaugguggggacgcuucccgugguuuggaggauagcaacaucaggugaugggcagcaauaugcucugaggcuaugguaucauuucccagcuguggugacaagggaccuagcauuagauaguuuucaucuaucaaacauuuccuuagcaccucuacuugggccaggcauugucuagacccugggaauacacagaggaacaagacauagucugccuaugaggagccauucucguagaaagauugacacaaaucauuguagaugcaaaguucuaaguaccgaagcacaaguaaguacgaaguacugagguauccccaaaaggauaaguaaucagggucaauuuuauauagaaacauuugagcuguaucuuaaaggauggauaggagucugcuaagcauauaugauggcagcaaggggguagaucuuuauagaugaaauaugucagaggcauagauauacaacaugaaguguguucaagaguaaagggagaugaauaagacuuuugaaauaggaacagacuauauuguggaggaccauaaguaacaugccaaggcauuuugauuuuauucuauuaggaguuaauacuuugaggaaaaggaaguuguuaaauaugcugacacacuucuguaaucucaguacuuaagguuugagauaggaguauccuaaauuuaaggcuagccagguguggugcugcaugccuaagaagagacaaauggaucucugaauucaaggcuagccuagucuacauagugagcuccaggccaguaaaacccuguccucccucuccccagagagaggggggagagaagaaaacaacaaaucugggcuauauauuaagguccugucuaaaaacaaacaaaagauaugugugugguuauauguuacuaugcauacuuucaagguggagguaggaagaucagggauuaaagguaauccucagauauaaggugaguucagagccagcuagggcuacauaagguacugaagaaaaugaggaagagaaaguaacaucaaacauguauguuagauaacuuuuaagggcaguaugggacagauaacagcaauauucaguugaauuuggaaauuaaaucugguaaguaaugaaaacuuucuugaggaaagaagaacaacagaaaggaugggaauaugcuucaaccaugcuggauuuacuacauaugcaguccaucucgccagcaaguagauaaaaucuugauuuuuauccuacaaguauuuguccuaagugaaaacacaagguacgggauuccuuuaaggaacugugcgccucaggaauuaugaaacagcuuaacgggcagugacaguguaacaugagacaugacaggccaccauaggguuuuucugagacauggagaaggguggggagggaagcugauuagagaaggaaacuaaaucaaacgugaguaguagguuuauauaggguaagaagcauaggggaucccagagacuuguaaagacccagagcaugcaugagacacauuuucaaaauuaguuauuuucuucccauccugaccacaguuuccccucccuccuuuccucccagucuuucccccaccucccuucccugaacugcuccucuucccuuucccuuuagaaaagaggagaccucccagggaugucaagcagcucuagcuuaggaagcugcaguaagacuaggcuagacaaggcagcccaguaggaggaaaggaucccaaagacagguaacagacucagagacagccucugcuacugcuguuaggagucccacuucaaaaccaagcugcacaagugcaacuuauguacagagggccuagggaggucagucccaugcaggcucccugauuggcaauucagucuuuguguauaggacacuuuuaaagaauacaaguaggccagaguuuuugauugauccauauaguagaaaugauucaaagaaguaguuaagaguaaauaagcuuuuuuguuuuuguuuuuuuuuaaaaagaaguagguaagaaccaaguugugaaggacguaaaugugagcaggcauuaaguaagaauaguguauagucuacuuugugcuuuaaaucuuacuuauuuuuauguauaugaguacucuguagcugucuucagacacaccagaaaagggcaucagaucucauuacagaugguugugagccaccaugugguugcuaggaauugaacuucggaucucuggaagagcagucagugcucuuaaccguugagccaucucuccagacccugauuuguguuuuacagaguuauuuauuuauuguuuguacauugcugcacuguagccuucaugugguuguugagaauugaauuucuaggaccucucugcucgcuccggucagcccugcucauuccagcccaaagauuuauuuauuguuauauguaaauacacugucucugucuucagacacaccagaagaaggcaucagaucucauuacgggugguugugagccaccaugugguuucugggauuugaacucaggaccuucauuaggcgugguagcgauacuggugaucucuccccuuuuuucuuguguauguuauaauuuuuaacagugaacauacauuugugucggggguugugaaauuuagaguaagcagaaaauaaaacacacuugcagaaaugugaauuaauuggaggagcucaauccuagaggucugaagacuuauuucagcagugcaggccaggcccaguaacacaggacuaagcaacaucagacagaggaggaauagaaagguacuagagagacacaauauauuagagaaauuauucaggacugcugacuaauuuuggauacauaggugagugaaacuaaguccaaugaaagaguggggcuugagagcauguguggucauguuagccaguaguaaguguuggucaguuucagcuucucguguauaucaaguugacaaguugauguuuuugagugggaucauuuuucuuaggggcauaugaaacagugaagagcccauuaguguccgggggaggugaaaugggcugaccccuugacaguacaaagcaugcaaaugaucagcuaggggauggugcccaagcuugagagauguuguuucucuucucaguuaugggagcuaugaggagccugaucccaaguccaacacccaggauaccagcuucagcagcaucgguggguaugagguaucagaggaggaagaagaugaggaagagcagcgcucugggcccagcguacuaagccagguccaccucucagaggacgaggaggacagugaggauuuccacuccauugccggagacacugauuuggacucugaugaaugaggcuuccuuuaagucuuuucagucagccuaggucuauuaccuuuccccccagcuuguuucuguguacauaguagcugauaaugauaucacuagauuaacaccuuaguuuuaguaguaaguaaaauaguaauuauuucucuagauuguagaguagcaaguucuuuucccuaaccacuaccaaaaggagagagcagacucacucuuccucauuacacuccuuuaauggcauuuauugcucuuguuguauaaacaugccaccauuuuacuuucuaauuggcagacuggaacaaaggaaaaccccucugcuggauuagagaauuagguccugaugagcuggcucugugccacacuuaaaauauaauccuguuagacaaacugguuguucauauauuacuuacuuggauagacaaugccuuguugcuaaauagauuacagggauguagcuauaaaucucugaaugauagguggucauguaaauguccucuucccccacccuggaaaaaauuauaggaaaaugguuaguaccuuagggcaaagacugccuuuugguuuuuuuuauacuuaggauaugguuuuaugcaaaguaacuacucaguagauguucuuaaaaaucacagaaucccaacagauaauguuacugugugccugauucauguagagcacucuaucagaccuuugcagugcaaagguuaaauaagagcuugccaucaaguuggggcagugagacuggaauucaaacaauguuaauuaaucagagaacucuaaguacaauuaagaagcuagcuguaagguacaaaggaaaaaaauuagaaucauguguggaaaagcagaguuuucuagaggcuaccugaaugcugauuguugagaaguuauagaguaccaucucagcaggguguuaacaugaagggaaaguucacagucuagaugugacagaauguguuccuuguuuguaccugccuuguuucagaaaaaggaugcuggagugacuagacaugacacugaaagacggacaggaagcauaucuucaagagcuuugcauuugagcuaggcaugguggcacaugccuuuaaucccagcacuugagagacagaggcaggcagauuucugaguucgaggccagccuggucuacagagugaguuccaggacagccggggcuacacagagaaacccugucucaaaaaacaaaacagaaaaacaaagaaauuuucagaauguugaaugaagauagaaauugagucaaguaauaaacauguaugauucaguuugucuagaagucaaaaauuggguauauaugauaugcuuguauauacuuguaugugcaaaggaaaagauaugaaagaauguacauuaaaguguuagcagugauagccucugagggaugggaauggagaggaggugguuuguuugguuuauguacaguagguaaguguuaugcuuuuauuucuguaucuuaguuuuauaauguguauuauuuuuuguaauaaaauguuaauuuaacagcaauagaaucgagagugauuuuaaguaguccaagcuaaggagguggaaucuaaaguucaauggugccauuggaaugaagggaaggggaauggcauuaaggcaucuucagaaaggggugugaucaauaggacuucauaaccaguuggcacuugagacucaaaaggagaacuagaauagguuucuagaauuuugacuugagaaauuaaauagguacaugauauucauuuuuauauugcucauauuuaauuuauauuuauuuuuaauuaaaauaaaauuauaucguuucuucucuucaucucccucccacccuucccaaucccccuucucucaaauucauggccucuugauuauagcacuuauuucuauaaagcaguuuaagacagcugggugugauggccaaggcacaucucugaguucaaggccagccuggucuacagagcacauuccaggacagagaaacccagaaguaaguuaaaaacuaauagagaacauguaauuucugauuaaaaggaucuuaaaaucugaaugagagauuuuguaaauaucaguguauuaaaaaguagucuuugccgggcguggugguacacgccuuuaaucccagcacuugggagccagaagcaggccuggucuacagagugagucccaggacagccagggcuacacagagaaacccugucuccaaaaaaaaaaaaaaaaaaaaaaacucuuugggggaaaacgcauuuacggugagaaaacuguggacucugcuugccaaguaagua

SEQ ID NO: 9651 - RNA, 2737 nt, Mus musculus
guccucauuaccuuguuuauugaaaguuuaagugagguuucuagaaauaaaauugggcaaauauugagauacugagaugggcacauucagugcugacaacgccuggcccucugugcuauuugccucucccucuucucacacagggauggcugaguucuacuugcuaauuuaguagggcgguggggcuccaggcagcuaguucuaaaacagcaagauagggcauggcagcuaaggcacaguaaugguguuguccuuguugcugagauugauucucaggagaccuggauauaugcugagcugucagugcauccuggcagcaaaguuacggguaaguucgagcuagcccaacuacaaggaggacaagcacuuggaguguguuaggacuugggcugcgcaggcuacaguuccaguccagaauuacaagcccagguaggaggccucaguugucucagaccaggaugauucucuccgugaagaugacggcugccgcuggggcccucucuggucagagcggcccaggcgcgugaacaacauccacauuugcucucugaacuucacucccacaaaggcauagagcagcggauugaggcagcagugcauguaccccaugcccgaggugacugacuuggccacauccacguggcuuucucgaccacaguugcgggccaaaacucccacauccaugaggauauccacuagcaccaccaggugauaggggguccagcagacagcaaaggcugccaccaccacuaccacuagccucauagcucgaaaacgccucuggccucuggagaccagcagaacagcuaggauaugggcauagcaguaggccaugaccagaaggggcagcaggaaaccagccacuagcugcaguacacgcagagcagugcgacccaccugugggaaguuguacuggcaauggguggcauugaggcgcugaucguaguuggcugauagguagaugaaaucugggagggcaaagagcagacagagaccccauacaacuaugcaggugagggcuacacguacccgggggucccugcgguagaucuggguggcgugcacuaugcucagauaucugucgaagcuuauacaagccagcaggaaggccccugcauagaaguugauguugaacaaggcgccugccacuuugcagaggccagggccgaaaacccacuggacagcagcauccacugcccacaauggaagaguuaacaccagcagaacaucggcuacagccagguggagcaggaagguguccgugcugcucagggcagugcgcugacucaguagcacagcagccaccgccccauugccuagcagccccagcaagaagaggaggcuguagagggcuggcaggaagguucugucaaaguucaggcugaaauccugugggcagggcggggagucagagaagucgcucucguuuuccccauaaucguagggagaggugcuguuuuccagaagaaaggcaaaguccgaggcaucuagcacuugacguucacuaaccugcccgaggaagggggagagagggaagggaggccauucucuguaaagacccagcaacuggcuuugccccuuugugcccugucauuuauucuggugaguguuuguuucccuuagcaauagccagacccugagcugacucuuucucuccggggaccacaucuccuuaacuccaucuacucagacugggaaggugacccccccuuuucaaaggcugguaaccccccggcccccccccccccagacccuuucuggauuaucauccaggacagggauucucugccggaagaggaacuuccuuccagggucuggagccuuccauucuuucccuuccucuuuacgcuuggugauuugucagccuugcugcuauggccaccccugccuggaucaaccacuggccuccccaggugcuuccuuacucuaucuucuagucccuggcccuccuuuucccuccucagcccuuaucuggugacccugacuuccuggucucacauaaggauuuucuacaaaccacugugcaccccuacacacaccguacaugccucucuuccccuacccagaggcaguggguacccacugagcuucccacccaagcccuaauuggucuucccaagauggccaggcugauuucaaacucuugggcucagaugagcuuucugccucugccucccaaguagcucagacaaugggggcauaccacuuccacuucagcucuacaccuuaucccaaacuaucugagaacuagagaucaccgaaguugaguuucuacagcuugacauuuucagaugaggcauccaagccacagaggcaggagacaggccugugguuaguggccaggcuggguuucccaauccaccaaugcucuuauuaucagaaccucugcauucgaugcugcucacucagcccgcuggugccucuuggcugugggccagcccacgcuugucccugguauccgagcucggccacuuggccgcuguauuguagcugagcugggcagcagaacuuaccucaagguacauggcuuggcuggugcuccggcuguggcugcuggggucaggucucgugcugccugcuucucugccuuuggcacuugugguugggaacuugcagugaacagaggaagugaagauuucacggcucagcacagccucuuccaaaggguaaucuauaccagcccuccgcagagggcuuuucugucuuuucugccacgccuguggucaggugaauacac

SEQ ID NO: 9652 - RNA, 4037 nt, Mus musculus
cucauacuuguuuuuuuuuuuuuuuaaaguggauuuaaaugcacuuuauuuuuagacaacccacaugacaugguuuuuuuccuuaaaaaaacaaugccaccacuccaaauaaaucacggucaaaaaaaaaaagcucaagaugacaucagucccauuuguccuaaguccugguguuguauggaugguaagcagcagccaauuauggugacaggugauagauccaauuuguuaacauuucuccaucucuaagccauccuuaaagaaaaucaugaauggagucacaccaucuucacgguaguccaggagagcaaccauaccaucuggaugguuucauguuuucaccaauaaaaaacugguaguucuugaaauuagcaaggaugugcuuaaucugcucugcagcuccagucauaaaaggcuuuacucuuucuggguucugcucuucaaguuugccuuugagugauuucauguagucuuugauguacuuuuuguaggccucuuuugugaagcugguuucuuguaagugaugguucaugacaaugucaacaccggugacuacuguacuuucaauaccuucgcccuccggaccuucagcggaagcauuuccaccgaugagcgagucaucgauggcacccucuguucuacugaccaucuugcccuccaccuccaggcacagcccguccgcgaucucccggaucuuguagaugucggagaacagcucgucauggcugaugaggucccgguagacgaucauggugacaguuggggacugcggcgcuagccugacagugcggaagcguggcucauacuuguuauccagcacucagugaguagagacagaaggaucagaaguucaagggcauccucagcuacauuguauauuggaggccaguaagggaugcaucaagcagauccuauuuuuaaaagugugugugugugugugugcgcgugugcgagcgcauacaugcacucuacagggccugguguggugacacacaccuauaaucccagcacuugggaguggaggcagaaggaucgauucagggccagcuucaguuaccuagugaguuuguagccagccugggcuauuugauacauugacaugcuucugcaccgcauaagaaacaacaaaauaaacagccuacaaauagaggaaaaauauuuuccagauacuuaccuggaagacaauuuauaucauuauuauuaagacuaauaauuuuuuuaaagccaguucugauggcgcaagccuguaaucccagcuacauagggggcuaagcaggaaaauuggucaguauacacaugaaaaauguuuguaacccugccguuggggaaguucaaaucaaagcugcaggcagcauggcauggggauacagacaguugguagagcucuugucuggcacgcuugagucccuggguucaaaaucuaaaaccaaaacaaaaguacacugaacuggguuaauggcccacaccuguaaucuccagacauggaggcugagacagcaggagggguuuuuuuuuucuuauguacagaaggaaguggguaaaggacagaaaagucgaagggaaaaugcuagagcaggagaaaaggauagaaacaggaaaaggguggggaaggaagccaacaguaagugaagugaaugugauucgguugucaggcuuggagguggguuccuuuaacuugcugagcaauuuugcuggccuaaaaaaauaauaauagaaaaaaaucguggugacgcaugucuuaaucccagcacucaagggguggaggcaagagaaucauuugaaguacaaggccguuugaaguacguagcaaauagacccuuuuucaaaaccacaaaaagaaaaaaagacgugagcaggcauuaaguaggucgagaagucauagagaccaugcuuugaaguuaaaggaaagaugagucaaccauagaauauuuuccugaguggagagcugaggaugaaggagcucugaguguauucagcacugcagagaagaagauggugggaaaaguacccaagacaaaagaugaauggucucugaagcaagccuggagcaggaacuggggguaggagcuggggugacagucauugagaaagggaaaagaugacuccuuggccacagcaggaggcucaggagagaggcagauggcuucucugauaauaaaggugaccuauaggaggaaacuacuuuuucuccuacaaauuugcaaggcauggcagaagggggcucuccaggccuccuggagagcaugcagagaaaggcauguaggaaugccaggugacccagagcaccuugacaaagcuggccugggauacugacuuggcagagacgggguggagacaagauggucugggggaacaaggauggcuugaacugaaacagaggacagggugaauuugguggacugaagagaagugaaugaacuagcugggguuaagcucagaaaagaggguuuccacauacaaaaucuugaaauugaaacuaugguugaguagaggugguaccacccuggagucaauuaaagguguauggugaaagacagucaaaauggaaguuacugaaaaaguuaggaagcaguuagguuuccuaugauccccauugcauaccuuggaaacaagaugguguaaguagccaaaugucacaaagcuaggaacugcuggacuugaaauuugagcccagaucugugcauuaaauaucccguugacagugucacagaaggaacauggugcuguuaccagugguuaggguguaagacuagauguucccagguucuuguccucuuaucaaaaaaaaaaccgccuuaaaauaagguuucauacacauaugcaaaagaaucagauagcuuuauuauagagagauguucugucaagucugacugugggccacaugacugagaauauucaguggcaccaauuauuguuugcuauauccuuuuauggagcucaagagaaagaggugguuacuaaacggggguguuuugggugguucucuauuauaauugauagauuacaacauaauucauuuuucauguuguacauguccuugcccauuauaugucugauuuuaauaauauguaugccacuuguauauagacauaacauaguaaauaguauacucccuccaaaaugacacuugaaaaccauacuucuuaccaguucaggccagaucagcccuucuguuccuguaccuaacuacaacaggaauacaccugagcagaaacuaaaucugauuguuacuaggaguggagaaaucuguauuauuguucagagaccagauguguguaggaagaugcagguggugcgagaggaugcugcuguugcuaggugcccuguuuggagaggagugugugaagaagcucuuggguuugccugccucuguguuuugcuaucugugaggaaaguaacagggacaggguaaaaggacuacaagcagagaggacagugcccugaagggaauuaaacaugaaauuaguuuaaauuuacauuggcaaggauaugaguuaaguuccuaaauuagggacucaauuuuuaaauauuuguuuguuuaugguuuuuuuuucaagacaggguuucucuguguagccccagcuguccuggaacucacucuguagaccaggcuggccucgaacucagaaauccagcugccuuugccucugagugcuaggauuaaaggugaaauuuaccgcugccugacacgggacuuaauuuuuuuuaaugcaagaucuugcuauguagcccaggcuggccucaaaccuguuggccucuuauuucuguuucuagauuacucaaauucuuggcagauggcacccugucugucaggacuuaacauuuucaugucauuuuuaacuaaaaugguucuuuggggaauaguuguuguucagcaaggugauucacagagcacuuucacuucaugugucacagcuucccacagacucuggggagauggcagccauaagcuuuaagugauucaauaaguggaggcggaaggacccgaaagaaacuuacagggcgaugugccaauuucuauucuauccugguacaug

SEQ ID NO: 9653 - RNA, 882 nt, Mus musculus
aaugccuggagcccuugauguccugcagaugaagaaggaggauguccuuaaaugccuugugguaggaacgcauuuagauggcaccaaccuugacucucagaaggagcaguacaucuaaaaaggaaaagggacaauaucuacaucauaaaucugaaggggaccugggagaggaugcugcuuacagcuccagcucuuguugccacugagaacccugcugacgucagcgucaucuccuccaggaacacaggccagcgagcugugcugaacuuugcugcugccacaggagccacuccaaucgcuggccgcuucacacgugggaccuucacuaaccagauccaagcagccuucagggagccacggcuucuaggggugacugaucccagggcugaccaccaguaacucacaguggccucuuaugucaaucugcccaccauugcucuguguagcacagauucuccccugcgcuauguggacauugccaugccaugcaacaagggagcucacucagugggucugaugugguggaugcuggcccgggaaguacuccucaugccagguucuaucucccauugagcacccaugggaggucaugccugaucuuuucuuccacagagacccagaggagauugaggaggggcagccugcugagaaggcuaugaccaaggaggaauuuuagggcuaacggaccacaccagcuccugaguucacugcugcucagccugagguggccgacuggucugagggugugcagguucccucugugccuauccagcaguucccccgcggaagccuggagagcacagccagccacugaggacuggucagcagcucccacagaacaggccaccgaguggguuggagccaccacugagugguccugaa

SEQ ID NO: 9654 - RNA, 4375 nt, Mus musculus
ccgcggcggaggugacgguugccuucgcccaggcguagccagcagugcggugaacggcggcggcagcggcagcgguggcagcggcaggucucccucggacagacagacagcgccugcagggcuggaaccaugaguucuccugaugaggugucuuuucgggggaccaauugggggccggaaaguggggagcacacagagagacgccgguuugcccauggauucccgcggggacacggccccggccccggccccgaggagaaggugugccuucaggucuccaggccuccccaguacgacucgugguuagacagggaggagauggacggaaggucagucauuuggggcugcgaggggcggcccggcaccccaguggaugacagaggggacaaucuggacuuuguacagcagcuagccaucgaggguacaagcuucgggcagcacauagccaaccgggaggccugggggauccacggacaucaaucccccccaagcugugcugcugagcccauuagcauuuggggagacucagacgcaagcacgcucagaagaagcaugcggccucagaccucaacggaagggaagcaggucacagcuacccaacugcaccccagagguccggggcgaggcagggccuggaugaccccaagaagaagugccaugaguaggguaguaaccagugaugacauucaaugucccuccuccagcccugagucuucugaugaguucagugagacacagaugaugaggguaaccauuugucucaaagaaggaaaccagcccaaguccgcuggccucacugagcaggaagauccagcuagacacacgaauguccauggcagggaaaguuuuguccaugugccucccucuaugcuggccucuacuccaagaggacucgguucagccaucgaaaagcaggcuucgggagagcuggaaagcucuucagcuaagaaaaaacaaacuaugguuuggagcaaagaagggggcaggcccagccaccaaggagcuacugcagcagcagcagcagcugccacugccacugccucugccucugccucugccucugccacugccaaugccacugccucugccucugccucugccucugccucugccacugccacugccacugccucuacuguugccccugccccuguugcuguugcuucugcuggcuuauacaagauaaguccaagaaagaagccagcccaggaaaagccaucucagugggacaccucaagaggacccguggcgagaaucuucccaccauggggacagagacucaaaucagcuacuguagaaccagccacuuuccccccaaucucagggguugcucugcuagggaaggcaaguaaaugcucacugccuucagggcccaaagaguucaaguccgucugcacugggaagaaauccauagcaaagaagacaagggagccacaggcagggcccaaagaagauaacucaccgagagauccuggucugcaggcccaagugaguagaccaugcccucucuccugucacccugcccuuccccuucccggcacauacguuugugcugcucccccugccccugccccugccccugccccugccccugccccugccccugcccaugccuuggcuugggaaguugucaguggacacucauccugauuaggaugucuaguguggaguccuggugguaaauaaggguggauaucaagggagccucaguuagggguugcuuccuguucccuucccugugcauuuccucucucuaaccaggucuggggagggaaaugugucuggcugucaguuugggugguugcuguccagagagccccuacagugugggcugaacaacuugagcauauagccaguccugagggccuccuggcuccucccuggcuccuccccaaggaagccaggccaggaccugaggcuuuucagugucugugggcuccuuccuggcugagcucugccuccugagcugagggugacugaggacaggaggugcagaagggaugagccucccaagccuccauuuuguuacccccuuucccucagccccucaacaacauauacucagugauaaguauuuugugugugagguuccacuacacagggcagagcagccuuccgugugcaugcaucguggagaaaugagcaguggagacuccaacaccagagccccucaaguuccagcaaacccacaguucuucuugauccagagaugugccagacccagagcaccaccugcaccugcuggugagacuuuggggcuuggagaacagugggggaggcuggggagagggaagcaaccuggggcucuguucuuuugaggauugcagccuugcuucuuaggcuucucugaugagguagguagggaguccacaggagacuggguauggucagggcugaccucaggucacguugggaaaugagugagauugugggaugcaugacuuuaaagguagggcaauaugaguuccaucuugaacacgacagauuuugcugcugagcccuauacaugcacugagcuccuagcuucuagccauggugguaguccugcuagcauacacucagugccacugucuuaggggcucacagcaccuuuaugcugccucugggcugcaguaagggcaagaauagagcuagauagaggugaagacuuaccagguacaaggugcugccagcagagggcacugcggccucauuuuggaccccauuagucccuuccaacuuauauaauccuguuucucauccccacuccugugugugucuguguguguuuguauguuucaggugaccaggaauuaccucuacgucugccauucccaguuggcgauaggcagcaucaaauacaagccauagggggcugccaacagguaaaacuuuuaucagcucucugaaaugcuagccucagguagacccugagcugacugucaaaguuaaccugacaauuaaccuccugugccaacuccugucccaaauugcacgggggggggggggcaccugcuugcucuucaagguuuuugccagucuuaucccaggacuguggauagugggagguguaaugauaaagggcacguguggauggagcagagaagaagccaggacacugaauauuaaucucucuuuuucuuucaugccugcugggcuagugugagauguuacagaaggaaauagaugaacucaaggaacaacucgguauggccuaccccgggcaggaaagauauugggacaggggcagaggggggagcuuaguguuugggugcaggugguuacagugggugguggggcaggcccucauggggaaggugacaugaaucaggccaggcugggagcccugugugccuugacuucuggaacuugcaccaagaggcucucuguucucccaugugcuguacagaugaguccccccagccucuucucucuggacauucagauguuccuccuuagcuuucccuugaaguccuggcaccuggaauuuuugggugucuguugacacauguuuguuuguuuguuuguuuguuuguuucacaaguagggcuggcacugcugugacccagcguuugaggacugccuauccaugcuguucuccuguagaaaacguuugcacauagcgcucggugaugggugggggagugugucccaacucugucugcuuggaugggggcuggagggcagugaggcggcugucuggaaguuccuguggagcagagcaugggucucaggcggguggguuccuguccugugugucuaugucuggaauacccauuuuuaccucuguguuucagcaaucaugcaagucuucaaagaaaaguuccaggauccuugaagugaguguccuaucgacagcccuugccacacuccugacugcucaggaagcaagagcuggccugacucuguuuuugcuuggcagguuggacucaagaguuucuccccacagaagaggccaaacuaccaccuguggauccugcuuccuuccaguuuucuucgacagcagugguucccaccuuccuaaugcuauggccugcucaugggcuucauuuugugauguuaacccucuaccauaaagcuauuucauuguuacuucacagcuguacuuuugcaacuguuguuuaucaucguguacugucugaugugugagccugugggaguugcuacccacagauugagagcgucugcucuacagucagucagagcugagcugugccccuguuuuuaccccaagccugccccuggugacagcuguuucacauugaguacuuuggcuguccuggaacucacucuguagaccaggcuggccucgaccucagauaucugccuaccucugccucugccucugccucugccucugccucccgagugcugggauuaaaggcgugcgccauca

SEQ ID NO: 9655 - RNA, 4055 nt, Mus musculus
caaggacucuuaaggaaagggcggggccuggggaccuuuccugagugaggcgguuucgagacuucgaaggcucgccaaguucucggagaagcuugcccuagcugugacgaaaggccguggugaggagcggggagacucuuccuccguaucgcaugcugccgacaugagcucuuuggguaaggcggcaguccccacagccugugaugaugaggacacccuucuuaccggagaugcgaacucccagcaucaggugucugguucugaagcuggcuugagccaggagggcagggagcgguuaggggacccugugaucagcccaggaguugcagaggguccgagcccccuccaagggccucuggagaucagagagggugaggccagccucccgggccccgagagcagugacuuagggucugggucuaagauggaggcaacagaggacacaggcagcaugcuuagggauccggaaggcggggccacuucucccguagaccaagaagaagaaguugacauggauuucuugccccagcucaguauugaggccaugacugucaugcgagagcugaccaaccuacagcuccgaaaagucugcagguacccguccccacgaacuugugcggcugaacuggcugcccucuggggaaacguagaugaaggcuccaacagaggggcacugucuccgagcucugugagagggaaacagggccccgaaggugcacuguaccccagaggccuggggcgaggcagagccugggggaccccaagaagacacaccauagguaggauggugagcagugaagguguccacuaucccuccucaaacccugugucuucugaugaguucagugacacucaugugaugaaaggaaccgcuggccucaaagaagaccaggccagguccaguggccucacugagcuggauaacauagccagacacacaaauguccguggcagaggaaauuuuguccauauucccccuucuguacuguccagugcuaccuggggagucagcucaggcauggaaaggcaggcuucaggagaacaggaaagcucuuuggcuaagaaaaagccaaauauggucuggggcaaagaagggagcaggcccagccaccauggagugacugcagcugcugccaccgccucugcugcugccccugccucagcuucuacagcuucaggugcccugcccaagaccagucccaaaaagaagcaagcucaagagaagaccuccuccucagaugucucaagaggauaccaggggaaaaacuugccaacauggggacagagacucaaaucagcauuugaggggccaacgacucuacccccaaucucagggguugcucugcuagggaaggcaaguaaaugcucacugccuucagggcccaaagaguucaaguccaucugcacugggaagaaauccauagcaaagaagacaagggagccacaggcagggcccaaagaagauaacucaccgagagauccuggucugcaggcccaagugaguagaccauguccucucuccugucacccugcccuuccccuucccggcacauacauuugugcugcuccuccugccccugccccugcccaugccccugcccaugcccaugcccaugccuuggcuugggaaguugucaguggacacucauccugauuaggaugucuagcguggaguccuggugguaaauaaggguggauaucaagggagccucaguuagggguugcuuccuguucccuucccugugcauuuccucucucuaaccaggucuggggagggaaaugugucuggcugucaguuugggugguugcuguccagagagccccuacagugugggcugaacaacuugagcauguagccaguccugagggccuccuggcuccucccuggcuccuccccaaggaagccaggccaggaccugaggcuuuucagugucugugggcuccuuccuggcugagcucugccuccugagcugaggcugaggacaggaggugcagaagggaugagccucccaagccuccauuuuguuacccccuuucccucagccccucaacaacauauacucagugauaaguauuuugugugugagguuccaccacacagggcagagcagccuuccgugugcauguaucguggagaaaugagcaggggagacuucaacaucagagccccucaaguuccagcaaacccgcaguucuucuccuugagccagagaugugccagacccagagcaccaccugcaccugcuggugagacuuuggggcuuggagaacagugggggaggcugcaccugcuggugagacuuuggggcuuggagaacagugggggaggcuggggagagggaagcaaccuggggcucuguucuuuugaguauugcagccuugcuucuuaggcuucucugaugagguagguagggaguccacaggagacuggguguggucaggguuugccucaggucacauugggaaaugagugggauugugggaugcaugacuuugaaggguagggcaacaucaacuccauaacgcgucuuuuagcucacuagaguuuuugcuuggugugcccuccugcaaacugaccuccucucagaugcuggauuagguuguaccaagcaaggagcaacaggaaagcaaggcucaaagcuuccugagcugaugacccaacagauaccaguuucuaacagcagagggaugugugggcucguuuuagauuuccccagucccaucacaucuauaccccaagccuagauguuacauaauuuuuuuuuuuaggugaacagaaucaacuuauggaucccauauucccuaaugaagaaagucagcaaguaauacaugggacaccagguugugcacagguaaagagugucagcucucagaaaugccagccucagguagacccugagcugacugucaaaguuaaccugacaauuaaccuccugugccaaccccugucccaaauugcacggggggagggggugccugcuugcucuucaagguuuuugccagucuuaucccaggacuguggauagugggagguauaaugauaaagggcacguguggauggagcagagaagaagccaggacacugaauauuaaucucucuuuuucuuucaugccugcugggcuagugugagauguuacagaaggaaauagaugaacucaaggaacaacucgguauggccuaccccgggcaggaaagauauugggacaggggcagaggggggagcuuaguguuugggugcaggugguuacagugggugguggggcaggcccucauggggaaggugacaugaaucaggccaggcugggagcccugugugccuugacuucuggaacuugcaccaagaggcucucugcucucccaugugcuguacagaugaguccccccagccucuucucucuggacauucagauguuccuccuuagcuuucccuugaaguccuggcaccuggaauuuuugggugucuguugacacauguuuguuuguuuguuuguuuguuuguuucacaaguagggcuggcacugcugugacccagcguuugaggacugccuauccaugcuguucuccuguagaaaacguuugcacauagcgcucggugaugggugggggagugugucccaacucugucugcuugggugggggcuggggggcagugaggcggcugucuggaauuuccccugaaauaugggucucagguggguggguuccuaugugucuguuucuggaauacccauuuguacuuuuguguuucagcggucaugcaggcccucagugaaacguuccaggauccuugaagugaguguccuaucgacagcccuugccacacuccugacugcucaggaagcaagagcuggccugacucuguuuuugcuuggcagguuggacucaagaguuucuccccacagaagaggccaaacuaccaccuguggauccugcuuccuuccaguuuucuucgacagcagugguucccaccuuccuaaugcuauggccugcucaugggcuucauuuugugauguuaacccucuaccauaaagcuauuucauuguuacuucacagc

SEQ ID NO: 9656 - RNA, 4055 nt, Mus musculus
gcugugaaguaacaaugaaauagcuuuaugguagaggguuaacaucacaaaaugaagcccaugagcaggccauagcauuaggaaggugggaaccacugcugucgaagaaaacuggaaggaagcaggauccacaggugguaguuuggccucuucuguggggagaaacucuugaguccaaccugccaagcaaaaacagagucaggccagcucuugcuuccugagcagucaggaguguggcaagggcugucgauaggacacucacuucaaggauccuggaacguuucacugagggccugcaugaccgcugaaacacaaaaguacaaauggguauuccagaaacagacacauaggaacccacccaccugagacccauauuucaggggaaauuccagacagccgccucacugccccccagcccccacccaagcagacagaguugggacacacucccccacccaucaccgagcgcuaugugcaaacguuuucuacaggagaacagcauggauaggcaguccucaaacgcugggucacagcagugccagcccuacuugugaaacaaacaaacaaacaaacaaacaaacaugugucaacagacacccaaaaauuccaggugccaggacuucaagggaaagcuaaggaggaacaucugaauguccagagagaagaggcuggggggacucaucuguacagcacaugggagagcagagagccucuuggugcaaguuccagaagucaaggcacacagggcucccagccuggccugauucaugucaccuuccccaugagggccugccccaccacccacuguaaccaccugcacccaaacacuaagcuccccccucugccccugucccaauaucuuuccugcccgggguaggccauaccgaguuguuccuugaguucaucuauuuccuucuguaacaucucacacuagcccagcaggcaugaaagaaaaagagagauuaauauucaguguccuggcuucuucucugcuccauccacacgugcccuuuaucauuauaccucccacuauccacaguccugggauaagacuggcaaaaaccuugaagagcaagcaggcacccccuccccccgugcaauuugggacagggguuggcacaggagguuaauugucagguuaacuuugacagucagcucagggucuaccugaggcuggcauuucugagagcugacacucuuuaccugugcacaaccuggugucccauguauuacuugcugacuuucuucauuagggaauaugggauccauaaguugauucuguucaccuaaaaaaaaaaauuauguaacaucuaggcuugggguauagaugugaugggacuggggaaaucuaaaacgagcccacacaucccucugcuguuagaaacugguaucuguugggucaucagcucaggaagcuuugagccuugcuuuccuguugcuccuugcuugguacaaccuaauccagcaucugagaggaggucaguuugcaggagggcacaccaagcaaaaacucuagugagcuaaaagacgcguuauggaguugauguugcccuacccuucaaagucaugcaucccacaaucccacucauuucccaaugugaccugaggcaaacccugaccacacccagucuccuguggacucccuaccuaccucaucagagaagccuaagaagcaaggcugcaauacucaaaagaacagagccccagguugcuucccucuccccagccucccccacuguucuccaagccccaaagucucaccagcaggugcagccucccccacuguucuccaagccccaaagucucaccagcaggugcagguggugcucugggucuggcacaucucuggcucaaggagaagaacugcggguuugcuggaacuugaggggcucugauguugaagucuccccugcucauuucuccacgauacaugcacacggaaggcugcucugcccugugugguggaaccucacacacaaaauacuuaucacugaguauauguuguugaggggcugagggaaaggggguaacaaaauggaggcuugggaggcucaucccuucugcaccuccuguccucagccucagcucaggaggcagagcucagccaggaaggagcccacagacacugaaaagccucagguccuggccuggcuuccuuggggaggagccagggaggagccaggaggcccucaggacuggcuacaugcucaaguuguucagcccacacuguaggggcucucuggacagcaaccacccaaacugacagccagacacauuucccuccccagaccugguuagagagaggaaaugcacagggaagggaacaggaagcaaccccuaacugaggcucccuugauauccacccuuauuuaccaccaggacuccacgcuagacauccuaaucaggaugaguguccacugacaacuucccaagccaaggcaugggcaugggcaugggcaggggcaugggcaggggcaggggcaggaggagcagcacaaauguaugugccgggaaggggaagggcagggugacaggagagaggacauggucuacucacuugggccugcagaccaggaucucucggugaguuaucuucuuugggcccugccuguggcucccuugucuucuuugcuauggauuucuucccagugcagauggacuugaacucuuugggcccugaaggcagugagcauuuacuugccuucccuagcagagcaaccccugagauuggggguagagucguuggccccucaaaugcugauuugagucucuguccccauguuggcaaguuuuuccccugguauccucuugagacaucugaggaggaggucuucucuugagcuugcuucuuuuugggacuggucuugggcagggcaccugaagcuguagaagcugaggcaggggcagcagcagaggcgguggcagcagcugcagucacuccaugguggcugggccugcucccuucuuugccccagaccauauuuggcuuuuucuuagccaaagagcuuuccuguucuccugaagccugccuuuccaugccugagcugacuccccagguagcacuggacaguacagaagggggaauauggacaaaauuuccucugccacggacauuugugugucuggcuauguuauccagcucagugaggccacuggaccuggccuggucuucuuugaggccagcgguuccuuucaucacaugagugucacugaacucaucagaagacacaggguuugaggagggauaguggacaccuucacugcucaccauccuaccuauggugugucuucuuggggucccccaggcucugccucgccccaggccucugggguacagugcaccuucggggcccuguuucccucucacagagcucggagacagugccccucuguuggagccuucaucuacguuuccccagagggcagccaguucagccgcacaaguucguggggacggguaccugcagacuuuucggagcuguagguuggucagcucucgcaugacagucauggccucaauacugagcuggggcaagaaauccaugucaacuucuucuucuuggucuacgggagaaguggccccgccuuccggaucccuaagcaugcugccuguguccucuguugccuccaucuuagacccagacccuaagucacugcucucggggcccgggaggcuggccucacccucucugaucuccagaggcccuuggagggggcucggacccucugcaacuccugggcugaucacaggguccccuaaccgcucccugcccuccuggcucaagccagcuucagaaccagacaccugaugcugggaguucgcaucuccgguaagaaggguguccucaucaucacaggcuguggggacugccgccuuacccaaagagcucaugucggcagcaugcgauacggaggaagagucuccccgcuccucaccacggccuuucgucacagcuagggcaagcuucuccgagaacuuggcgagccuucgaagucucgaaaccgccucacucaggaaagguccccaggccccgcccuuuccuuaagaguccuug

SEQ ID NO: 9657 - RNA, 882 nt, Mus musculus
aaugccuggagcccuugauguccugcagaugaagaaggaggauguccuuaaaugccuugugguaggaacgcacuuagauggcaccaaccuugacucucagaaggagcaguacaucuaaaaaggaaaagggacaauaucuacaucauaaaucugaaggggaccugggagaggaugcugcuuacagcuccagcucuuguugccacugagaacccugcugacgucagcgucaucuccuccaggaacacaggccagcgagcugugcugaacuuugcugcugccacaggagccacuccaaucgcuggccgcuucacacgugggaccuucacuaaccagauccaagcagccuucagggagccacggcuucuaggggugacugaucccagggcugaccaccaguaacucacaguggccucuuaugucaaucugcccaccauugcucuguguagcacagauucuccccugcgcuauguggacauugccaugccaugcaacaagggagcucacucagugggucugaugugguggaugcuggcccgggaaguacuccucaugccagguucuaucucccauugagcacccaugggaggucaugccugaucuuuucuuccacagagacccagaggagauugaggaggggcagccugcugagaaggcuaugaccaaggaggaauuuuagggcuaacggaccacaccagcuccugaguucacugcugcucagccugagguggccgacuggucugagggugugcagguucccucugugccuauccagcaguucccccgcggaagccuggagagcacagccagccacugaggacuggucagcagcucccacagaacaggccaccgaguggguuggagccaccacugagugguccugaa

SEQ ID NO: 9658 - RNA, 4768 nt, Mus musculus
gugagugagagcgcagccgcgggagccagugggcucccucgguucccgaaggcccgccccugcggggggcgcgcguagcugagcuuaaaaggcgagagggaucgcugucugcaagauuuuuccucgacagauccugccgcagucccuucccuccuacucugccugccucuguuggcgucaccucugccagcgucucgucugucuccugcgccugccgccuccaggucccgagcugcugccugcucucucuccgaccccugccacgagguaacgcgucccggaccgagccccuguggguguggcccgggcucgcuugcgccgggucgcccugucgccgcacguuggucuccucccacgcccaccuccucauuucugccuccuccugcacuccccauaacucccuacccccaagugcccagcacucaaagccccaggaacuugucacaaugucugaagcggcgggaaaucucaauagccuccgcuuggcgaauguggcccugcgagaggaguuaaaugcccuucgaggagagaauguccagcugggccugcagcucggaagagccuuggccgagguuaauuccuugcggggcaaugucucgagcuacauccgcuggcccaugcccauaguaccgguccuugccgaggagaacuuugaguuccugcucaaugagacugaucccacuccugaggaggaggaagaggaggaggaggaggugccuuuccugugcuggccuccuccacgcacagaucccgaguacgucucagaugaucuuuugauuaaugugguccaggacuauaccaaccccgacggguccagugacccuccucugucacccagcccgucccagccggaacugcacucccccauguuaaaggagccaaccuuugaguuccuuuugccaccgcuggagcggccagacauagaacccuuuucaggcgacccaguguaccuggcugaauuucugaugcagcuagagacuuucauagcagaucacgaggaucacuucccugggggcgcggaacggguggcauuucucaucuccuuuuucacaggggaagcgagagacugggcuaucucagucacucaggaaggaagcuccuugcaugccaacuucccgcgcuuccuggaugaaauccguaaggaauucuguggccccauccccucacgcguggcuaaaaaggccauacgcaagcucaagcagggaaacuguacccugggcagcuaugcagaugcuuuucaguucuuggcccaguucuugucuugggaugacugucgccuccaaaaccaauuucucaaaggcuugucagaaauuuuucgaaaggaacucuuauggucaacugaaguggccgaccuggaugagcugauucuugagugugucaagauagaaaggaaagugcguguccccaagacagccucgcucacuggaguucaaaauagcugcugccccuuugcacuaauuccuaaugaggaugaaaaugaagguguggaguucuacagugaaaaugagggugagggugaagaggcaggcggguacaggcuuuaucugaaggaucagaggcagcacaugacagcuuucccacaagagaugagggaggaagaggaggagaugaggaaagaggaagacgagauggaggaugaggaggaugaggacgaggaugaggauuaugaauuugaggaggaggaugaagacgacgacgacgaggaggaagaggaggaggaagaggaggaggaagacaaggaggaggagaugaagaaugaggauagcgaugagaauaaguaugaagaagaagaugaaguuaucguuaggguccuggagccagagcaggagcaagagagggaggagauagagcacgagcauguguaugugcacgagcacauacacgcccaugugcacacacuugcugcccaccaccacggccuacauggagagcucauggugauggacgaaccuguccuuguugacacgucaacccagaccauuagcuccgccauaggcuaccaugcugaaaauuaccuggggguauccccuucuguaaugcauucuagcagacagaggagccagaaucgagucccacuucuggagggccuucccgggaccaauucauccuucuacagcccgccaccacugaugcgccaugcaggucgcuuggggcaacgccaaaugcgaagaugucccucagugcucuucugccucacuccuaggcaggggggccaccgagcuacucaaggucgaauucgagugugaacacugggggugaguuggccacggggaacacacccuuccccugcuucccuugccucugcuauugcugcuguacgugccccaucuacugaccaguccguacgaaagccccagacuggaggaagaccccaaagaagaccugcagaauuccagauuguuucgcaaccacaaccagaagagugaaaagugcccaaccagggccauccaggaaaggagaggucaggacucaacaguccucuugcuguguacucggcucaguccucgcacaaaguugcaaagcaagucucuuggccuguucuuguaaauggcacuggucaccuuugucuccaacucuaguuguccccaaucuucgccucuccugugcuucuuugcccuguguucuacaguguuauccugacuuuaccccaaugccugagugaucugccccaaccaaugaucuaaaggcauuagaucuaaacucuuaaugcucugaggccacuuacuagacaacgagcaggaugacaccaagaaauauguacucgccauauuuccagcagaagggccugaaaggggaaccuacaccuagagcagcgagaaccugcaaagccaugagugcaauggacaacuugacugagguuuacucucuuugggggcgggaggggggauggcgggcaaacagaccucacuuugagugcugggguuuaccuuccccucagacuccugccucaggaccucugcacagacuuuggcuaauucggccuucauguugccuacaggacuggcauuagggggaggaggaggcagagguggcuggagcaccauaguucaguuugacauccuaaggagugaaucuugcuuuaggaacagggcccucuucuggcuaggcuuuaagacugcagucccagccagaggccucugaggagacuguguccucuagguuguggggguagcccugcuggcccacucuuuaagccccucugacucuaaggaguccuuagaacugaaaggagaaaacagggcuggcucugcagagacuggacucauugcagcauugcuggccaacaccccuaugguucucacgugaggggcaaaccucuccuaggccuguuguugaacuucaguuaaccaguguggcuuaagaggcgacugccuccugcacacuccuggggcuucuugggcaccaacucaggugccccuagucaaagaccugcuguucacuuuuggguccaggaaaauacugcugcugcagugggaaguacacauguauuauguccauucuggccacaaaauggcagccugguucacugcuggcccaaguuguuccuggacauugaacuugcugcacggugccuagcagcugggcaaaguggagcccaaguuguccguggucagcaggaagaaagcagcaaauggugucucuuccucauuggagucugaagaugagaacccagcccuagaguuugaacuuaagaccagagaaggaacuugaggaagaggaguccuagacagaccuaguccucagacugguuaacggugagcucucuauucaucagcaagagguaaggggccuuuuuguuuagcacuuccauuucuugccugaagaucagucgaauuggguuccuauagccugcggcuaccuuuuaccaugguuuccuccaaagagagaaguuaacguauagucauuaugggaaauaugggaaguagugaaugccauaaggacaaaauagcuuccucccgaccauucagaaccucgccacacagaggcagcauuucuuucuuucuucaaggugaggucauccugcuggagggccagcagcaggccugaaaauggcugucaucugugugacgcagaaucauuucaccuuccugagucaguuguuagacauuucaguuguuugccuugcccauucccaccaaggcaggaggauagggaaccaugugaagacuuuguuuugugucucuuuuucagcuuauuuccucaagcgagaauuccagaagggaaaacucuauuccuugaagcuauggacccugucugcugaugccaacauacuggucacgcugccuguguccuuguggagaagcgcaagaagcaggugucuuguaccucagauuccagagaucccccuuggcacacacaggcuuugccugucuucacggugcuucuuagucugaaugcuuguggcccugaccagggagaccaagcacaugagcacuaaacuggccugugggccucugggggcagaggggccuugaacuuccuuuaaccuuuucccuucuuucccaguucuucaauauuuguugugaugugacagcuacaggagcuguccgaagcucugagugccuccuuggguugagggggguggggguggggguggggaugcaugcaggguacaagggugauccaaagacacccggaggcuccagagaaacaaauguguuacuguuuuuacuguuacuguuguauuauugugcugugaagauaaauuguucuguaugcuaaagcuuucucuccucaauaaaacaaauaaaggguguguaaagauugu

SEQ ID NO: 9659 - RNA, 2829 nt, Mus musculus
uccagagagaguucuguaggcgugcacuaauuacggcaugggguugauuggauggcuuuuguggugcaaacuaugacugugacucuuccaaaacuucaugccuuuuucaguuugauugucuaugcggagaucagggugaugaguuuuaauaaacuucuaggacccccccccauuagcuaaugaaccaagcucagccaagguaacucgcaugcacgccuugaggucucucgagugucugucaacauagguagccaggaucugugcccagcucaugcuguauacuccaagaacgcucauuucacuugcauguaacauucauuuuacaggaaguacuuagguaaaggaccggcaucauggaaggcuccaggaguggaaagaaugguaucuugucccgauaccauucgauucagauugugcuauuuugugguugcuucgauuuuguuuaaaggaagucugacucuuucgaaaguccagaaccuguauacuaaaaaaaagauccacucaaaaucaaaaaggcagccaugcuauggcccaggauacaagggcuacuuuuugccaucuagguacugcuauuuggccaacuuucaguuagcugugguggaagacagcagauguggaaagacuuccagaacaaccacaaugaccccuucuuuuccaaagucaucaggcacuggccauucuugucaacucaguuuuguaagcaaagcaagagcuccugauuuccauauaccugcuuucuggggggcuagggauaagaugggcaaaacacugagcagagaaaccgugcuugccuguguuggaaagcucucggucuucuggucccaagggggccaaaaggaaaugaacuuguaucgugcuuugcaaaagcaaacaaacaacaaaaaacgguucccugcacccuuccuccuguaccccugcccacggcacuucugcccuuccagauuccuugcucacucuccuggaggaugcagcaagaggccagaaacaaacagaucuccauuuugacaauccuuaucaaugagaagcaagcucuuagcucaacugcccacacuccagcaaggcaacauggcugaaacugaaauaaaacuccacugagugcugagaagacucgagccccuggcauggaagccuuaggcugaaauccuugguuggguuggucuaauucugaauucuagacaaaugaaaauaggucaagcucaccaacugucuucuagcacuucucucagacuuaaggggaaaauggucucuuaaauaauaagacaguucugagaaacuauaguuguuuuggaaguguuuaaaacauuugacaugaagaucuuaaccaaguuuccuaaguuuugacugaauugaaacaagagucaggcaggaaugugugaugcaguuuugaucccagcaccuggaagauggagccaggcagaucucugugagguugaggccagccugaucuacauagcuagcuccaggcugcugaggcuacauagugagaucuggacuucagucuuggccuuaguuuauauagaaguaucacagcugaccugaacucagaacuccaaaagacagaggcauuugccucuguagggaaaugaaggagcggaugcccaugcuugugucuaagagaagcaaaaggcucccuggcucugcccuucagaagcaucgugagugguugaacgugugagcauaugggacucuguauagggcuugcuacuuuugcugauuuuuuuucuuugcaagugucuuguuuguuccuucucauggguuuugccucuccccucaccuugcuaccucuggagguguucccccccccaaaagauuguaaaacugaacgcuuagaccgcuugaggugguuucaguugccugaacccuuguuuuccucugcaaaacucugugggcccgggauguuuagaacauuucugcaucacuaugacccucagaaacccauuagcacaaaaggauuuggggcagagacuucacagucagagaaaagacuuaggccugggaauguccauucaguguuugcaggaguggaccuaguccuaaagaaaccagacuauuggggaaaagauuuaccacucauugaucagcacaccaccaagcaucuuucuaauacuuaaccuucucuuauucaacucucuucccuggguacaauguaugcugccggugaggaugggggaaaguugaggagaaacucuuuucagggagguucucugggaaguugcuuccagagugaucucuauagguagaauagacaguaaguuggagggaacucaaauuggccccagguagucagccucugcuucaagcuauuuguauuccccuguuucccuccagcuucaaucuuuagugguagguggcucuguuagagugaauauagacaaagguuggcaagacgcccccccccauccccaccccaagaugcaauuaaugcuuuguacuugguggguauugauuugugguucaaaugugagugguggagagcaggcuagucuuaguacaaaggcugacuuugcuuguggcuccuccccuuugccuguacuccuggccugcaugggccuccaacuuguccuccaguccuaacacccgugaacugcacugguaccaacagcucagccacaaaggagucaaggccaugggcagccaauccauuccuguuagcuucaugaccccaagguuaagguucugccaacaagcauucugccugacaucuacuuuaucuagacaacccagauccaguugucuccguaccuugucacucugagcagaucuacccaugcaccuguccaccccccuccuccucaccuuugaaccagucaggaaaaaaaaaaaaaaaga

SEQ ID NO: 9660 - RNA, 8259 nt, Mus musculus
ugugacgcugcuuucaggcauugcggaggacauaccuguggggccugagggguccuuuugcuagcaccggaacaguugccggagaguucauccgccagcuuaagagaugccgccgaaggggaaaagugguucuggaaaaggagggaaagguagaccugccgagacagucauggagcgagcguagggguggauggggagaaggacaggaguagaccugcagcuguguggggugggggagggaggugaucauaagccggacagcagggccaccgggagcacccugagccgcugugguuuauguuugggcuucuugugguaaggaaagaucagugcgugaggagcugcugugguucaggguauccaugagguuucagugcagggacccucguggcgggcaauagaagcugcuggggaugguuccucgugaccugggguuuauucccacuaaaauugaaucugaugaaacgccagcaauaaaaggaagccuacacuagugaucaaucuaguccaucuaggccucuuaacaacuaacaggacguaccucccccccccuccccuccccuacacacacacaugaggagggacucgcuucuugaagaccguuguuggggacaacauugugcuuucaggcuagaaaacuaagacaacucuuauucaucgcuggacaauguggggaagauaguagccucuaaguacugugccgaauguaguugugagaguuauguuauagaagguggaaagaggguaaagaaacaaacuggagauacuuugggcaggcugagauaagcagcagcaauaggguaaagaguccucaacccggagaggccagccccaaaggcaguuuaguauagcaucgcugaaguaaaacuucaaaacaaauaagcaaguuggggaaauuaaaacagaagaaaacuaaaucaugaggugugcuguauaugguguuaauuaagguugguuaggggccaggagguccuuuaaagagaugauuucaagccgggcagcgguagcgcacaccuuuaauccuagcacuuggggaggcagaggcagguggauuucugaguucgaggccagccuggucuacagagugaguuccaggacagccagggcuacacagagaaacccugucuuaaaaacaaacaaacaaacagagaggggagaguagugagggagagagagagagagagagagagagaugauuucaguaguucugguaagagagagaguuggccugaacuaagauugugguuguaggaacccagagaagagacaaauaaauggaguguaguagagugauaccccagagguccaaggaaccaagauguuguaaagaaaggucugagaaaugggugaggcacugcagagacaugccacagcagugggaggcugaggaggaccugagugugaggucaccagggguacacuguccuuuagcugcucagcuccuguucauccaucaggugguaccuggcuagcugacauauguguucccuuccacaauuucucgcuugucggacucucagaauguggucucucuuccucacugggauacgagcuccuuggcugcggcuuugaauccuauucacuguguacccccaagaacuugaacuggggaauuauuuaggaaacaguuguuaaacuaaauacuuaauuuaaucuuagacaccuuggccucuaacacuuaauaugcugccuucgacacaaaacuuaaaagaaguaagaugugcuaccaaugcuugauagccugaauguagcagauuccaggaggauaucaguagcuguugugguagacugaaggggaaaagaaugcacacacacacacacacacaccaagcacucugaaauaaaaccaaaccccucaaaaugcauuguuggagauuuugcauguuagaauuucaggugucaaacacacugucacagaauauaauagaaauuguauuauuuuauauaauggcaguguuaaguuagaaggcaagauuuggaauggagucuaaagaaucuggcccaggcuucuggagugccugcauccaugcccacacucauuucuuuaucuguuuucugugaaguauuuuguucggcacauuuccuguuauuagagaugagucacagaguaaguuaacuugauugcaugacucaccauguagccuuuuggaacuuggggcuguaauggauggguuaccuuguguuaugaguuggaccuaucuauaaaugucaaaguacagucgaaaugaguuccuauccucucuuuucuaaaggaggugcagccucugggagugacagugcugacaagaagucucaggguccuaaaggugguggcaaugcaguaaaggugaguuaucuuaugugucuccucuuuuccauguaaaguauuaguaaguggguaugcauagaaaagacagugugaguaaccuguccuuaucuaugaggcuuaauacuaaguuaaauucaagaugauacaaaacuggaaaccaaaaaccagucucacuuuuaaaagguagaauuuucacacuucuagcacuguuccuuuaaauguguuaacuuagcgacugggguuucagccucggucauuaaagugcuugagaaaagaccuaagccuaguuggugaguuucaauccagugaaagacccuaucucaaaacgaaaaaggggguagauggcacccuagaaaggauuaucuucugaccuccagaugcacaugcacacacauuuguuacuuugaccaugggugggagauagucccugucuugguuaggguuuuacuguugugaacagauaccaugaccaaggcaagucuuauaaaggacaacauuuaauuggggcuggcuugcagauucagagguucagucuguuaucaaggagggagcaugguagcaauccaggcaggcaugaugcaggcagagcuaagaguucuacaucuucaucgaaggcuguuagcaaaauacuggcuuccaggcagcuagggugaggaucuuaagcccacacccacaguaucccaccugcuccaacagggccacaccuccuaauagugccacucccugggccaagcauauacaaaccaucacaguccccagauuauuacuggaagcgcuuaagcaaccaaucccaugggagugucugcaaacagaacuguacuacuauggcuaucuaacaaggaguuuccauguuugggucaggauacaggagguaaaagaaaauagauuucauugcuucugccuacaaauucaaccauacacaugcagcauaaaagggggagagaaagauggagagaaaaugugaacugagcuguucuacucaguagaccuaugccucagaaauauagcagaagaugaaguagucauuguuacagucuggagugggaggcaucuggcucuguugggcuuccugaaagcuggcauguuggucuucauaauggauaagguuauuugggcuaugugcacucuuuacugaguuguacugacgaucaaaccuuccaaccuaugagacuacuguagcacauauagcuucaaguagccaucugguccccucacaaagagccaaguccaguauggcacuaugguagauaaauggaaaagaauggcauguaauuaagguaggaggguagaucaggauuaaguuuuuauuaagcuuuuuguuuaaugccuuuauauuuuagccugauucccucaauaguaacaucuucuaaaacuauaguucaauggcauggucagaauacugacacugauucagaauauugagcuaccccucaagccuuccacccuauauaaagagccuccuguugcuccuuuauuuuuguaaagauuuauuuuuauuuauaugagcacacugucacuggcuucagacauaccagaagaggguaucagaucccauuacauaugguugugagccaccaugugguuguugggacuugaacucaggaccucuggaagagcaaucauugcucuuaaccgcugagccaucucuccagaccguguugccuguuuauaacuuuauaacuccuucugcuuuuaccccaacacauaccuuuuuuuuuguuuuuugguuuuuuuguuuguuuguuuuuugagacaggguuucucuguguugcccuggcuguccuggaacucacucuguagaccaggcuggccucgaacucagaaauccaccugccucugccucccaagugcugggauugaaggcauucgccaccacugcccagcauacuuuuucuuuuugagacagucuucuuuugcccaggguggccucaaguucauuauguagcaaaggauggcuuuggauuuaugacccaccuguuucuaccucucaaaugcuggaauuagaggcuucuaaccuaucccugucuuucuaucccauuuugagugaguuuuuuguuauuauuauuuuguguguggggugggguuguuguuuuaagacagagucucacuguguagcccuggcuauccugaaacuuacuauauagacucggcuggccucaaauucacaaaaaucaccugccucuuccuuccaaguguuagaacugaaggcgugugccacuaugcccagucuuuaauacuuucaagaauguaacauuggauggaaucauauaguuuaugaccuuuggcgagugucagugucauuuucuggugguuccauugcgguuguugugacaauaguuuguuccuguguguugcuaaguucuguuucaugauauagaagucccacauuuguuuuagccuuaccugcugaacgauauuagugguuuuguuguuuucaaauguucuggcaccacaagaacccuagaagcaaccacaccccuguacccacaugcuguucugugucacuaggagcugugagucacaccuacugaggcucccucuuucuguucccuaucuguugaacuagauuucagguucuaaaacccacucugcuccccagcaccgccuagcuuccauuauguucuguccuccauaucuucuuucacuagggagccuugacugcuuuuccucauacgcauucaccugcuagcccucaccuuggggucaguccaguaggccacuuucucugaacugaacccaaacuucuaggcccugcucgggagacccagucuuggugaugggaaccccaaaccugguuuguaacucuagcauggauggcccucagugucgcuccgcagcucuuucuuuuucacuucaagccacccagcacugagcuacagucagcagguaacuugagccagugguucucagccuggguguugagggcuuagcuugcuauauaccugcagagcuaaccuccagugcccacgggcaccucaggucugcugcauccgguucuuuggacuuggguccuggaccugaaugucuucagcucuggagguuuuucaagugugcugccagaguuaagcaaacaccagucuagucucaaggguugcuaacgugaggauuuaaugcgauccauucauggaaagcacuuagcacuuugaaguuggcuuuaauucaaggagagcuaaaagaacaaagagcuaauaguauaacugaacuaagcaucuuucuuugagaaaguuguuuucaaaaaucuugaacauaaaugaccugaaugaacagcaaaggaauugaaaaucccuuaaaugagccaggugugguggcacacgccuuuaaucccagcacucgggaggcagaggcaggcagauuucugaguucaaggccagccuggucuacaaagugaguucuaggacagccaggacuguacagugaaucccugucucgaaaaaccaaaaaaagaaaaaaagaaaaaagaaaaucccuuaaaugaaaauguacugauuucauguuuuaaaaaaguuaguauuuucauaauaauauuuauaaugcuuaauuauauagucauuaauuuaguuugauauuaauuucauuguuagcuauuaauaauuuacugugaugguucauauaugcugggcccagggaguggcauuauuaagaggugugaucuuguuggagugggugugucacuguggaugugugcuuaagaccuucaacucuagaagccuggaagucagucuuccacuagcagccuucagaugaagauguagaacucucagcuccuccugcaccaugccugccuagaugcugcuaugcucgcaccuugaugauaauggacugaaccucugaaccuguaagccagccccaauuaaauguuguccuuuauaagaguugucuuggucauggugucuguucauagcaguaaaaccuuagcuaagacauuuaccaagggguagaaggcuuuggucuucaacucuuaccaacaacauuuauuuuccuugguguccuggguuacaucccuagcaucuucucucuccucucccuccguuucuugcuuauuuaguuagaguucuuaguccagguuguccuugaacucauuauguaccuaggacugaccuagaacuuaugaucguccuuccucagccucuuaggugcuggguuuauggguauacacugccaugcucagugagagaaccagucuagaaguuguaguuaaaucagauugagaucugagcgauucuuguccccccaacaugcuguccuuugcuguccagcuugcauaccugucuccucuggauaggacuagacacauucuauacaagcugugcuugccagcaacuccuuuuuuuuuaaugauuuauuuauuuuauauaugugaguauacuguugcugucuuuagacacacuagaagaggguauugguccuauuacagaugguugugagccaccaugauguagcugggaauugaacucaggaccucuggaagagcagucagugcucuuaccugcugagccaugccagcaacuuuuauaaccugaauucaauccccaggauucaugugguaggaggaaaaacugacuccugcaaaugucuucugacuuccucaugaguauuaugguacacaugcauucuuaaacaaacauacauagucaauaagagggauacauuucuuucaaaugguguuuguugggcuagagagaugacuuugcagguaagaugacucugcucuuuuggagaaccugauuucauuuccucgaacccaugccagguggcucacagccgacugcaacucaaguucaagagaaucuuguaucuggccuccgcaggcagaggggaagucagaagacaauugcaggagucaguguuuccuuccacuauguggguccuggggauugaacucaggcagcaguuuguugauacugguugcauagcuuccuucacaaucacaugugaacagucuuggaggcguaaaaacaugcccaagaucauacaagagagcuggaauuggacuccaggacccaacacucaaccauuacauuucuucuuccaguuaccauugaaguacauggagaggauaggagauucucacaggcugcuguccacuuucaucuaaaucaagguucugagauacuguuugaugcagaaauggguuuguggcagucacuccugugggcaaacuuguacuauguucaaugacugugaguuagaugagauguuuuguagugagcagggauaauucagaugugacucuuguaccaagaagauucauauuuuucuccaaguacuaacaggauaugcuuuucccuuguaggucagacacauucugugugaaaaacaugggaaaaucauggaagccauggaaaaguuaaagucugggaugagauucagugaaguggccacacaauauagugaagauaaagccagacaagggguauguugcucuuuaucauuugaauguucugucacuaauuuuagcaauaucuuuguuucaagaaaaguagaaauguccagcuuaugggacuaaggauguagcuaaaugauuggcaugaagaaccuuucacagaugacuucugaaugcagcaggauuuugagcgugccugcuccauccagucuuagacggccuccugccauuuguccccugggagacaaugccuacauagccagaugaauaauacagcccagugagccauuguauucauauugggaaaacucuuggaagcugcaguagaacugcucucuuuucuaaggccacuucaccugguauuauuuaucuuuuggauuuuucagggugacuuggguuggaugaccagaggauccaugguggggccauuucaagaagcagcguuugccuugccuguaagugggauggauaagccuguguuuacagacccaccaguuaagacaaaauuuggauaucauauuauuaugguugaagggagaaaauaaaaucacaugaaagacugacuaag

SEQ ID NO: 9661 - RNA, 15377 nt, Mus musculus
caguuggcucuaccagucuagugcgugagcccagccuggguaaggcgggagcgagcgaaauucaagcgcgguuuuaacugggagucuccuuuccugggcucuccggauucccuggccauggaggcuucccaaggcuuagcggaaguggagacuuugagcccacaacuggccgagaguuaccugagguauguuugggucuccggacgggucgaacuugcagucccuggccugggguugagguggaguggcucccaccucccccuaggaucugcuguggcuuugaccagauuucuauuucggggagcucgcccugccaagucacucguaagucaaauaacucuugaguaugaacucuuuaagagccugaauuuuaauuaacugaugaaaucuuugagucuuucuaacucgccaaccgccagaccugggagaaaagaggaaaaauagucccuaaguuguuagcaauuggguagugaaaaugggaucugaaacagaaauacuuuaugguguuugauggaugcuguaaaauguuuuauuucccgaccagagugcugccauuaaaagaaaggggguccaguuacgaagggaagacauaugcccccaaaggaaccauuaagcccagugaaugaauacgcuuucaccagaugccuagguuggaauauuuaacuauuaaaaauuguagugcagggcuggagagaugacucagagguuaagagcacugacugcucuuccagaagacccagguucaauucccagcacccacauaguagcucacaaccauuauguaacuccaguccuacaggauccuauguucugguaccuaugugauguacaugcgcccccccacccccgccccgcgcgcgcauaugcaaaacacccgucuaugccuauauaauuuuuaaaagacuacauaaaauauuagcaaaggauuuguagacauuucucuuaaaaaacacauaauggcaaacaggcacaugaaaagguugcucaaaaccaccccuaaguagaggaaaaaagaucacaacuauaauggggugugugccauccccuccugagacugaagauacagaggguugugagccaccaugugggugcugggaacugaaccagaguccucugaaagagcaagcaccuaguccucuuaacuacagaguccucucuacaguauguagauuuauguuguuaacuuguaggguuuuuuuuccuuggagacaagguuucucuguguggaucaggcuggccuugaacucacagagacccacauaccacuaacuuuugcucagugcuuggauuaaaggcuagcgccaucacugccaggcauagguuuuguuuuuuuuuguuuuuuuuuuuuuugaggcaggcugcucuugaacucuauccuucucucugaguccacauagugauggaauuacagguacauagcaccauguuccagugaaucaacgaucagucaguggacagagccaccaguacucuaaguagaguuuucccucgagggaccuccucuuagauaaaaauggagaaaagaauuucaagacauaccagagggaagcaaaguuaaugagucucuaaauaaaccuggagucuuguaagacagcccaugggcguaugcuucacaagagaguugacucucgggggucuucacaguggccaccacuauaaaaaaaguaaguggcuuuccaaguuuaauaucacaaaggauguaauuuacuauaaggcuuaaagauuaaaucacucuuaaaauguaauuaaauuaaaaaauagacgagcuggcuuacuuguuuuucuccaaggaugcuccuuuacaacugaaauucuaaggugguuuucuuaggcucauuguuuggauuuaggaugagaagagugcucagucagugaaacucaagaaguucaugcaacuucuggccugaaauaaacaguuuguuugcuguuuuuuuggucugguuugguuugguuuuucgauacaggguuucccuguguagcccuggcuguccuggaacucacucuguagaccaggcuggccuugaacucagaaauccaccugccucugccucccgagugcugggauuaaaggcgugcaccaccacgccaggcucugaaggcauuuuuuuuuaaagauuuauuuaucauauguaaguacacuguagcugucuucagacacaucagaagaggucucaugacggaugguugugagccaucaugugauugcugggguuugaacucaggaccuuuagaagagcaguuggugcucuuaaccacugagccaucucuccagccccggcauuuuuuuuuaacaguuuuuuuuuuuuuuuuuaaucuauauuaguggucugugugcacggaugcggugucugacaaaauagaugacuagagagacaaccguggguacugggaaccaaacucuuauauuuuggggugugagccuagccuuuaaugccugagccaucucuccagcccuuuugagguucucuuauccuuucccuuuacaccauuuaacacaauaguuguaccauaugccuugcugcuaccaguuacuaccguccuucugguacugacuaccuuucagagacauggagagauccuguuguguuuuuuuguuuguuuguuuuuggcuuuuuuucaagacaguguuucucuuuguagcccuggcuguccuggaacucacucugucgagcaggauggccucgaacucacagagaucugauagccucugccuccagauugcuauguuuucaccaugacuugauuccaccaaaacucugguggagauuuaauugcccaaguaauaaucuugagaaguaaugggcuaggugucagacucucuguccucaucaagggguuagaugagaacaccucucagaagagcauguuugcuucuguguuagucacuuucuguugcuguagcggaauaugugggggaaacagcuuaagauuuauuuaggcucgugauuuuugagguugugguacauguuuggcuggcuccauugcuuuuaggcuuucuuugggcaaggcaaagcuucaugagggaguagcaaggcagaggaagcaggaagagagggguaaucugggacaauguauaccccuccuggccacaauggcagucacaugcuuccuccaccugggucucaucuucuaauucccacagccucccaauaccacuauuagauuauaacuucaagagauuauuggucaguccuuugguuaggucagagcucucuagauccaguuugaggcucaaaagccacaccuuugaacauuacagugggacuaauccuucgaugcaaguuuucuuccucuuuuaaugcauuaggguuuucuuuuucauuuauuugugugcauuugugcaucugcacacaugaauguggaagucagaggacaacuuaaugaguugauucucuccgucuacacauaaucugaguucuggaaauugaauucaagcuaucagacuuggugguaacugccuucacccucuuaagccaucuugcuggccugagguuuuauuugggggggggcgguaguugugaguguaauguaugugcauguauaugagcggaucuuugugcaaaugcauaaaggccaaagaaggacacuguuuaucccugcucugucauucuccauucuauuucuuugacauaagaucguucagaaauguauuuauuuuuuauuuucugugcauuggcguuuugccagcauguaugucugggugaggguuuccgaucuuagaguuacagacaguuguaagcuacugggugcugggauuugaacuugggucuucuagaagaauagucagugcuuuuaacugcugaguuaucucuccaguccccauagaucauuucugauacaagguggguggaggaaauucacauauaugcacauauacuuucaagcaauuucagcaguguuuugagacauauuuucccuuuauaauagcacuggcuggcuauucuggaacucauuuuguagaccaggcuggccucaaacucaaaagaaauccaucagucuuugccuccugagugcuaggauuaaagucaugcaccacuaccaccuggcuauggaaacauuccuuaaauuucccucuuucuaggcugggcaguggugaugcaugccuuuaaugccagaacuggggggugggaacagaggcagucagaucucugugagugccaaccugguuuacagaguuaguuccaggacagcuaggguuacacagagaaacccugucuuggaaaaagaaaaacaaacaaccuuuuucuacucagacugguggugugugccuuuaauccagcaauugggaggcagagguaggcagaucucugugaguuccagaccagccuuggcuacauaucgaguuuagggcuagcuagaguuacauacgaccuuaucucaaaagaaaaaaaucgggcuggagagauggcucagugguuaagagcaccgucugcucuuccgaagguucugaguucaaaucccagcaaccacaugguggcucacaacuauccguaaugagaucugaugcucucuucugguacaucuaaaaacaguuacaguguacuuagauauaauaauaaauaaaucuuaaaaaaaaagaaaagaaaaaaaaaucccuucucagguauguauaccugacacauaccuauguauagguuugugucaaguugccaaccaacacaggcuaaaaguccuagcuccuuggcauaaauacuucuaauagucugugaugauuugugugauaggugugaggaguauuagguauauaggugugugggugcauguauaagcgugcaugugcauauauguauauaaucauguguaggucagggauagccuuagcugccauucuucaaguucugucuaccuugcuuuuuguaaaagcaucccacaucugucauuaggcuaggcugacagcccagcaagacucagggauccuccugucuccaucccccagguuuggauuacaagugcaugccaccuuugucacucccacauagguacugaguagcaaacucugcucuuuauguuugugcaguaucuuaguuaggguuuuacugcugugaacagauaccaugaccaaggcaacucuuuuuuuuuuuuaagauuuauuuauuuuuauuauauguaaguacacuguagcugacuucagacacuccagaagagggcgucagaucucauuacagaugguugugagccaccaugugguugcugggauuugaacuuuggaccuuuggaagagcagucgggugcucauacccacugagccaucucaccagcccaccaaggcaacucuuauaaggacaacauuuaauugggguuggcuuacaggcucagagguucagucuguuaucaucaaggcaggaacauggcagcauccaggcacacuugguacaggaggagcugagaguucuacaucuucaucugaaggcugcuagcagaguacuggcuuucagggagcugggaugagggucuuaaagcccacacccacaguaacauacuuccuacaacaaggccacaccucuuaauagugccacucccugggccaaccauauucaaaccaucacaugcagcaagcauuguacuggcuaaacuguccuuucuuuguuugcaacauuuuauuuuauaugugugugcuuauguauauguaccauguacaugcaggagccuuaggagaucagaguccuaccuuauacaguuuugcuuuguuuuggagacagaaccuuucuauguagcccuugcuauucuggaaccucacuguguaaacuggaguuacagacagagcugagcccauguucucugcaagaguggucucuuguccacugaggccccuguaaugaguuuuuuuuuuuugguuuuucgagacaggguuucucuguauagucuuagcuguccuggaacucacuguguagaccaggcuggccucgaacucagaaauccgccugucucugccucccaagugcugggauuaaaggcgugcgccaccaugcccggcuuguaaugauuuuaauaugaguuaaauguacugugggcugcauaguuuucugucaacuugacacaagcuaaagugaucugagagaagggaaccucaauuaagaaagugcccuucuaggcuugccuaaagccuggucuuauaaaagcauuuuagacaaaaugauuccugggggagggcccagcccacugugggugguaccaucccugggcugguggucuggauaguaucaaaaagcaaucagagcaagccaauagggcuuccaucugucagaaaggcuaagaucaaaauacaacugacaauucaugcuggcaaagagagaauguagaacaaggagaacacuccucuuuugcugguuguaaugcaaucuucuacagccaucauggaaaacauggcaauuccacaggaaacuuggaacuaacauaucucaggacccugcucuaccauuccuggguauauauccaaaggacacucuaccauaccacaagcauacuuguuuaauuugcugaguauucucuguuuagagcugguaccccauuuuaauuggauuauuugcuuuguugaugucuaguuucuuaaguucuuuauauauuuuggauauuagcccuuugucagauagggaauuggugaaaauauuuucccauucucuagucugccauuuuauccuguugacagugucuuuugcuuccucccuuccuccauccaaccaggaagucccucuuacucgcccagugauuggcuccuuuauucauuaggggauugguucacaagaaguaagcugaguaugcccauuauccacagcuccuccuaggagaguggaauuaccaucaaaauacaaacaggccuauccacaaccuuucccccuuucuguuuuaauaaaaaaccaaaaccuuucucucaaauauaaauagagaacaacuauuaccauuuuguaauuuauaagauauaagauagaccuaacacccaguccaucauuugugucauuaggauagaacacuguccucuauccuaacuuaaaggacuuagaauuugcuauguaggccaagcuggcccgcuucugccuccuaaaugcuggaauuaaagguauuuacuaccaugcuuagcaauuuuugucuuaguaauaucugaguaucuuuauuguacaaauauccuguauauuccuguggccuccgggugaaagcauuaacgucagccaccuggcuacuuucauggaucuaugaauuuuugcaucucaauaaagagucagaaaaucugauguugauguuagaaaucugugucuuaacaagcccccauuccaagaaacucuagaaauagaaaauugagaaucauugcccuuaauuuuuuugugguacuagggauugaaucuagggcuuugugaaugguaagcaaguguucuacuauugaguuauaucaccagccugagaaucaauuuuuaagccuuuugagacaaagaucaugagagcaggcuggccuugagcucaugaucuuucugccuccacuggaauuacaggugugagacaucacaccuagcuugggaaaucuuuaaaggcugagugaggugaaguuagcuuaauaaaagaggagaguguucuagcaagaggacaguggugugaaccuguacuuagagguaacagagaagcauacuggaugcauggacuuagaauaauauuuguaagguagaagggucaagcgugaugguggaugccuuugaucccagcacucagguggcagaaucaggcagaucucugaggccaggccaaucugaucuagccuacacagugaauuucugaauagccagacauacccugucuucaaaacaaaaauguguaagguaggaugugacugguaagauuagaggggucauagauugcuggcuauguuagagaggacuuguaauaccagauuaagcagcuuaagcuuuguagacuauggguccaccagagacauuuuugaguuaacaccuuuauugaaugccuaugccgggcauuugccuauugauacuguacaguucagugacauucauuauauucacauauuugagaauaugguguguucaaauaauugugcacuuuucacuauagccaauuuuuggauauuuucauuaccuuucaaagacauuauuuuuuaaaaaaccuauaguuuauuuuuauuuuuuguacauuaguguuuugucugcauguaugucugugugagggugucagaagcccuggaacugggcuauaaaggguugugagcugccaugugggugccagaaauugaacucguguccucuuaaccucugagccaucuuuccagccccacaaagaaauucuuaacuguuuagccaucauuccauuugguuuugguuuccauuucccugauaacuaacauggagcaucuuuuuauguucuucucuuuuuaaaaauuauaaauuuuagugcagaguaaauaugcaaaugaaugggauucucagauuuugcauauauguuuauaguauauauugaucauguucaccguaccuuuauagagcaggcuggccuggaauuuagggauccaccugccucugccucuccuaugcugagauuaacagugugcaugacacuauacccggccucacccacuuuuaugccuuccucuguuccuuuccuuuccucuucucuuucuccuaucccaguccccaauagauaccucuucuuuaagcuucagguugguucagguugguuuguggcuuuuucuccucuugggggguugggaagggagaucuugcugcaaauaaguggauugggggggggggggcacuggugauaucccuauauucaacccuucagaacuauagagaaaaauauuucauuuuuuauggucagauaaugcucaauuguguguuuuauuauuauuauuuuauaauuccuauaaagguaaggaacuuuucuaugccugcccuagcucugaaauaauggcacagaccagguauauucuaagcuucuuugacuauagcugaguaggguacucaucuauucuaaccugacuaugcuggccuggccuauuucccagccaccuguccuguuacuugccugaguuacuugucugagucugguccugacuaggaucagaaguccugucuuucuccucccccacccaguuuuugggugaaucagcucuuuauuaaccaaucagaggugauagaaaacaauauauauauuguccuggaacucacucuguagaccaggcuagccuugcacucagaaauugacacaauuucugacauauuuuaacaucauugagacaggagauguuauaacaaucaugacagugccaacaucuggacugcgaccagaucucugggcacggaaaucagcaucugaaauauacacuguuguaaaaaaaacaucccucaacaaauuccuuuuuauuuuuuauaugcagugguguuuuguuugcauguaugucuaugugagggcauuagacccuuuggaacuggaguuacagacauuuguaagcugccaugugguugcugggaauugaaucaggguccucuggaagaguagucagugcucuuaaccucugagccaucucuccagcccuucaauuguauaguuguauuacauauauguauauggggagccuggcugauuccauaacauggguauuauguauagcgcugugaugaacauggguaugggucucuauacuaagguaagugauuuugguggguaaaugcucagaagugauauaauuggauuauauagugguuuuguucucauucuugagaaugucuuccauagagacuuacuaauguacguucccaacaguaauuguuuacuuauugcuacugugugcgaucugugugcaggugucagaugauggcuuugggauuugcuugacggcauuagaaacccaauuuaguuacagggcuggaugagccucagcugguaaagugguugccuagccaugcacaaagcccugaguucaaucucagcacuacauauaaaacugggcauagaagaugccuaaaauucccagcacucaugagguagaggccagaagauaguuuaaagucaaccuuggcuauauagugaguuuaagaagaauuucaagggauacuugagagugccuuaaaaaaaaaaagcccaacuacaguguggauuccaaaaugaacuguaaagcuuucauagguuaacuauucagucuguuuccucucuugagaauuggcuucagaggcuccuucaugccaagcaaauauucuaccacuugagcuuauuuccaagucccaugucacauuauuuuuuuuauuuuuucuuuuuuaaaauagauaugugcaagaagccaaagaagcagcuaagaauggagaucuggaagaaucauugaaacuuuucaauuuggcaaaggacauuuuucccaccaaaaaggugaugagcagaauccagaaacuccaggaagcuuuggagcaguuggcagaagaagaagaugaugaugaauuuauagaugugugcagcucuggcuugcugcuuuaccgagagcuguaugagaaacucuuugagcaccagaaagaaggcaucgcuuuucucuauagccuguauaaggauggaagaaaagggggcaucuuagcagaugauaugggacuggggaagacuguucagaucauugcuuuccugucagguauguuugaugcuucacuugugaaucaugugcuauugaucaugccaaccaaucucauuaauacaugggucaacgaauuugccaaguggacuccaggaaugagagugaaaaccuuucauggcuccagcaagagugaacgcacuagaagccugacacggauucaacaaaggaacggcguugugaucacuaccuaccaaauguuacucaauaauuggcagcaacuugcaagcuuuaauggacaagcauuuguaugggacuacgucauccuugaugaagcccauaagaucaaaagcgccucuaccaagucagcagugugugcacgugcuauuccugcaaguaaucgccuccuccucacagguacaccaguccagaauaaccugcaagaacucuggucccuguuugauuuugcuugccaaggcuccuuguuaggaacauuaaaaacuuuuaaaauggaguaugagcauccgauuauuagagcaagagagaaggaugccaccccuggggaaaaagccuugggacuuaagauaucugaaaauuuaauggaaaucauaaaacccuauuuucuaaggaggaccaaagaagaagugcagacgaaaaaggcagacaauccagaggccagacuuggugaaaagaauccagcuggugaagccauuugugacauguuuucccuugccaggaaaaaugauuuaauuguuuggauacgccuucugccuuuacaagaggaaauuuauaggaaguuugugucuuuagaucacaucaaggaguuguuaauggagacacgcucaccucuagcugagcugggugucuuaaagaagcucugugaccacccuaggcugcugucugcacgagcuugccguuugcugaaucuaggaacugccacauucucugcucaggaugaaaacgagcaagaagaugucucaaauaugaacagcauugaucacuuaccugacaaaacccugauacaagagucuggaaaaaugauauucuuaaugucccugcuagaaagacuucaagaugaaggacaucaaacucugguguuuucucagucgauaaaaauucucaacaucaucgagcgucucuuaaagaacaagcacuuuaagacauugcgaauugauggcacaguuacucaucuuugggaacgagaaaaaagaauucaguuauuccagcaaaauaaagaauacucaguuuuucuacuuaccacucaaguaggugguguuggccuaacauuaacugcagcgacuagaguugucauuuuugacccuagcuggaacccugcaacugaugcucaggcuguggauagaguuuaccgaauuggccaaaaagagaauguugugguuuaucgacuaaucacuuguggaacuguagaagaaaagauauauagaagacagguuuucaaggacuccuugaucagacaaacuacuggugagaagaagaacccauuccgcuauuucaccaaacaagaguuaaaagagcucuucacaguuggggaccugcagaagucugcgacccagaugcagcuucagugucuacaugcugcucagcggagaucugaugagaaacuagaugagcauauugccuaccuccacuugcugggcauagcaggaaucucagaccaugauuugauguucacccgugaucugucuguuaaagaagagcuugacaugcuagaagacucucaguacauucaucagagaguucaaaaagcucaauuccuuguugaaucugagucucaaaauacagugcaaagacaaacgacuggaauugaggagaccuggcucaaagcacaggaauuuccuucucaacagaagaagaaagguacugaauucaacaaaccucagccccagccuucacgccuucugacuaaaccuacccagguagaggcuaucaguucucaaauggccaguauaaccauuugcgaucagucugcagagagugagccccaagagcacucugagguacaugaugucacuucacugcaagguagucaccacuucaacaguacaucugaugcuggcacuauagcuucuuuaccccagggggcugaaaguauaggcgaaguuucuacugacucuuuauugagcccugcaaaagguuuugcagcugaaaaugaugcuaugcagaagaagggauuacaagcaucaccugggcaagaggccccaucagagaaccugggaaguuuucauuauuuaccuagagaauccagcaaggccagucuugggccaaauuuagaucuacaggauagugugguuuuauaucaccgcagucccacagcaaaugaaaaccaaaaccuagaaucagauguacccaugauugaaauaucugaugacuugucugaaccuccuagcgcacugcagggugcucaagcaaucgaggcccaguuggaguugaaagaggaugacccuuuaaaaucaccaccacaauaugcaugugauuucaaucuuuuccuggaagacucugcagacacuagacaaaaccucuccagcaaguuuuuggaacauguugagaaagaaaaaagcuugcaaagcccugcagcuaacuccagggcaaagucagcacuuacucucaguuuggauucuucuccuaagagugaugaagaaucagaagugauuagugugaaaaccaaaagcaaaacuagaaggauccucucagaugaugaagaugaagaugaagaagaugcuuuuaaagguagucauacaaauucaauuaacaucucucccuuuccauucucaucugugaaacaauuugaugcuucaacuccccaaaguggcagcaauccaucucgaagguucuuuucaccuaaaacaccaggugaagugaauacguccuuacauucuaggaggucccuggcuucuaggaggucucugaucaaugugguuuuagaugauguggaagauauggaggaaaggcuugauaacagcagcgaggaggagagugagccagggcuuucagaagagaacaaugaagaagaagccuuagccugcacagaagagcagccuucuggggcaacacuggcuucaggaaacaaguccagcaacuugaccaugucugagccuacuucuccagccccacaaagcucucccugugcuccugaaccuucgucaagugacccuaugccugauccuccccaggaucuggcaguggaggcugguaaugacuaugagagucuuguagcucgugggaaagaacugaaagagugcgggaagauacaggaggcucucaacugcuuaguuaaagcacuugauauaaaaagugcagauccugaggucaugcucaugacuuuaaguuuguauaagcagcugaacauuugagaacuuuauagccuauuucuuaugucuaaaaugcaauugaauauaaauguuuuguucagcaguucuucccuugaauauuucauuuuuuccccuuuaggcauacuuugcaaacuuucagaaguguuaccuaaaguuuugugaagcuguucuggcuauuuuuacugugaaaagggccauuuugucuguuagcucaguucugaaaauuaaagugccuuuucuccagaguguuuccauucauuuucuuucacaaggugguagacagaaacucuuuaguuccaauaagcucgucauuuagcauuccaaaucuaagauagccuuaauaaugugccguuugugcuuccagcuuagcugcauacaguaccuguacuagcauucuugggcacuuguagccugcccuggaguugcucuaccaacugguuagcuauucuucacuuacucuggacuaugcuuuucuucaacccaguuauguggugugugugugugugugggggggguguucuucaguuuuuugagacaaaguuuuacauagcucuggcuggccuggaacucagggagauagcuccaccugccucugccucccuggagcugggauuaaggauguauaacacuaugucccacuuauacugguguuuggaugcuaucacauccucucuuuugauuguugacuacauaagaauccgauucaccuucagaaacaccaagugcagcauaugcugucaccaaagauuuaguguuuacaaugugccuacuggauauugaguauaucacacaggccucuuguuuaauccuuaccauaaccuuugagguggagggugguguuuuuguguuugaacugaaacaucuaagacucacugugaccugcccaugaugaaugacauaguaaggcauaaaacugacuuaacuuuguacugaaugaaaagcaacuuuguaacacugaguucauuuuacuuucaucaccaugacacccaguguggugguggaaguccauaccagaacacuucucuggacaccaaccagugaccugcaauucaguuuggacacaacccagaguuagugggagacuacaaguuuuaggccucaguuccacaaagucugccuuuauaggguaguguuaaaagaauauucucccaguguguguggggagccgcccucacauucgccauugcaagauggcgcugacauccuauguucuaagugguaaacaaauaaucugcgcaugugccaaggguaguucuccaccccaugugcucugccuuccccgugacgacaacucggccgaugggcugcagccaaucagggagugacacguccuaggcggaggauaauucuccuuaaaagggacgggguuucaccauucucucucuugcucucuugugcucuggcuccuaaagauguaagcaauagagcucuugcucucuugcucucuggcuccugaagauguaagcaauaaagcuuuugccgca

SEQ ID NO: 9662 - RNA, 2069 nt, Mus musculus
ccaugucacauuauuuuuuuuauuuuuucuuuuuuaaaauagauaugugcaagaagccaaagaagcagcuaagaauggagaucuggaagaaucauugaaacuuuucaauuuggcaaaggacauuuuucccaccaaaaaggugaugagcagaauccagaaacuccaggaagcuuuggagcaguuggcagaagaagaagaugaugaugaauuuauagaugugugcagcucuggcuugcugcuuuaccgagagcuguaugagaaacucuuugagcaccagaaagaaggcaucgcuuuucucuauagccuguauaaggauggaagaaaagggggcaucuuagcagaugauaugggacuggggaagacuguucagaucauugcuuuccugucagguauguuugaugcuucacuugugaaucaugugcuauugaucaugccaaccaaucucauuaauacaugggucaacgaauuugccaaguggacuccaggaaugagagugaaaaccuuucauggcuccagcaagagugaacgcacuagaagccugacacggauucaacaaaggaacggcguugugaucacuaccuaccaaauguuacucaauaauuggcagcaacuugcaagcuuuaauggacaagcauuuguaugggacuacgucauccuugaugaagcccauaagaucaaaagcgccucuaccaagucagcagugugugcacgugcuauuccugcaaguaaucgccuccuccucacagguacaccaguccagaauaaccugcaagaacucuggucccuguuugauuuugcuugccaaggcuccuuguuaggaacauuaaaaacuuuuaaaauggaguaugagcauccgauuauuagagcaagagagaaggaugccaccccuggggaaaaagccuugggacuuaagauaucugaaaauuuaauggaaaucauaaaacccuauuuucuaaggaggaccaaagaagaagugcagacgaaaaaggcagacaauccagaggccagacuuggugaaaagaauccagcuggugaagccauuugugacauguuuucccuugccaggaaaaaugauuuaauuguuuggauacgccuucugccuuuacaagaggaaauuuauaggaaguuugugucuuuagaucacaucaaggaguuguuaauggagacacgcucaccucuagcugagcugggugucuuaaagaagcucugugaccacccuaggcugcugucugcacgagcuugccguuugcugaaucuaggaacugccacauucucugcucaggaugaaaacgagcaagaagaugucucaaauaugaacagcauugaucacuuaccugacaaaacccugauacaagagucuggaaaaaugauauucuuaaugucccugcuagaaagacuucaagaugaaggacaucaaacucugguguuuucucagucgauaaaaauucucaacaucaucgagcgucucuuaaagaacaagcacuuuaagacauugcgaauugauggcacaguuacucaucuuugggaacgagaaaaaagaauucaguuauuccagcaaaauaaagaauacucaguuuuucuacuuaccacucaaguaggugguguuggccuaacauuaacugcagcgacuagaguugucauuuuugacccuagcuggaacccugcaacugaugcucaggcuguggauagaguuuaccgaauuggccaaaaagagaauguugugguuuaucgacuaaucacuuguggaacuguagaagaaaagauauauagaagacagguuuucaaggacuccuugaucagacaaacuacuggugagaagaagaacccauuccgcuauuucaccaaacaagaguuaaaagagcucuucacaguuggggaccugcagaagucugcgacccagaugcagcuucagugucuacaugcugcucagcggagaucugaugagaaacuagaugagcauauugccuaccuccacuugcugggcauagcaggaaucucagaccaugauuugauguucacccgugaucugucuguuaaagaagagcuugacaugcuagaagacucucagu

SEQ ID NO: 9663 - RNA, 377 nt, Mus musculus
gugcucagaggcacucaggaugguccagcguuugacauaccgcuguaggcuuuccuacaacacagccucuaacaaaacuaggcugucucgaaccccuggcaacaggauuguuuaccucuacaccaagaagauugggaaagcaccuaaauccgcauguggcgugugccggggcagacugcgagggguucgugcugugagacccaaaguccuucugagauugucuaagacgaagaagcgcgucaugacgcagggccuaugguggguccaugugugccaagugugucugugacgggaucaagcgggcuuuccuauugaggagcagaaaaucauugugaaagugcagaaggcacaagcacagagucagaaagcaaaauaga

SEQ ID NO: 9664 - RNA, 377 nt, Mus musculus
ucuauuuugcuuucugacucugugcuugugccuucugcacuuucacaaugauuuucugcuccucaauaggaaagcccgcuugaucccgucacagacacacuuggcacacauggacccaccauaggcccugcgucaugacgcgcuucuucgucuuagacaaucucagaaggacuuugggucucacagcacgaaccccucgcagucugccccggcacacgccacaugcggauuuaggugcuuucccaaucuucuugguguagagguaaacaauccuguugccagggguucgagacagccuaguuuuguuagaggcuguguuguaggaaagccuacagcgguaugucaaacgcuggaccauccugagugccucugagcac

SEQ ID NO: 9665 - RNA, 130275 nt, Mus musculus
caagggaggcggcacccggggcgcugacccgcugcugucgccggccuucagucucagggccgccccggucuccuucagucaagcggaggaugccggugcgccacccggggaccacgggagacugaguggagacggggucuuugccggccgaagccuagaccgcgggaggcugagccgcggccugaaguggacucugaggccgccggaaccaggugacgcgcgggaaccauuggccacacgagcaagggagcguuuagaagguuuccguaggccuggcguccgagcuucccgugugugcagugggggauuagggacguggcaccaugaggagccgcaguaacucgggaguccgccuggacggcuaugcucggcuggugcaucagaccauccugugccaucagguaaguguagguaagggugaagugugagcuccggacacugacucugggugaacccugaacgcauuugucucuggagagaccuuaaaggaucccgaaggaaaguugcauguugaacuuggaguaaaaucaaaguguggcauggagaaucacaaucccccacccucgaccccucugcagugauuccagagugaugguuucugagcucagacagaaugccaccccuucccccaacuccccacccucccaacuauggcaggauuccagggacagaguuucaagaaauaacacuuuuuuauugcccucaccccagguuugggccaucuacuuccacuccacuuccccaaagauguaugagaacauagagcauccuaagagaccuuagacuacugugaaggucaaggcacuuuguacauacuuuuaaacaguuuugcacaguggcucaggcuggccuugaacuugggauuuuccugccauagccuucacaguuuggacaacagaccacaagccaguggguuuuuuuguuuguuuccuaagccguuguuguuuuauuucuuccuuuguugagaggauuuuaccuuguagcccaugcugaccucaaacuccccauccucgagcuucaucuccccauugcugggguaacagguaugcgccacugcaccugguuuauaugugcucuuuggaguuguugguuuuugaaaccaagucugucuuuguagcccacgauggccugaaacucacuauguagcuggccucgaaggagcgucagucuggagaauuauaggcuauaaggcacugcaccuggcuguauauauuucuagauuucuuuccuacuccuuuacuucagacuuuucguugcuaguugaauuuaacuuuuauauuuauuuuucuuuuaaaaugcacuuaguggcauccuuaguacuacauuugauaauaccccuaauaaugccuuuauuuuaauaauaccuguguuuuggacuuguaagcuuucagccagcucuuuccuuauucuuaagauagugcauggaaauagaagaaacuuucucaucucauauaaauauguucugcaaugcugauuagcagcaguagcagcacacugacuaguccauacuacuuuauuauauauauauauauaguugaaacuugcugagagaggagaucccuccuaucaaaaagugagguaauagauguauuaacuugauugucauuucacaguacauucauguauguaucaaaucgucauguuguauacaguaaauauguacagcuuuuauugucaguuauaacucaguaaagcugggggauaguaucuaccugcaacugguuaaaagagaagaaaggucgaaaauuugagaauggggaaguaggagaaagacuaaaguuucuaaguaaaauauucccuagauuuuguucccuuuaacauucugagguuaguugccuguccucucucucucuuaauugaucuugcagaauccagugacaggcuugcuuccagccagcuaugaucaaaaagaugccuggguccgagauaauguguacaguauccuggcugugugggguuugggccuggcauaucgcaaaaaugcugaccgugaugaggacaaggcaaaggccuaugaacuggagcagguaaucaaaacaaaacuauacagagauguggggcucuguguggguguaaugggggagcaggaauugaaggaaaaauagcccuugugccaccuugcucaaauugcauucuauaagguuuuccuacuauuguaucugcaguggguuugguuuggucugauguggucugcucugguuugguuauugugguggaaacuugaaaacuauaauucagggaagagggcucagacuauuuauuacuuuacuuuugaaaauccuacuuggauauauuucccaagauuaauaauucucuaaguguauuuucagguucuaccauuuuauuuucauugcaaggaauauuugggagcaaauguguauuauuuuauuucucucucucucucucucucucucucucucucucucucucucucucucucucucccucccucccucccucccuccccaaaguguacuauuuuaucuccccccucucucuuuugaaaauaauugugguaucuguaugaguggaccugacagaucaacagguuuucuucauuagacaaaaauaaugacuucguugaucuuuauaacuaugaccacaauuuuagagagccuguugccuggggucaaauugaggucagagucagcagaugacuuuaagccaacuuuuaaggcaccuuccccucaauaaauuaguauccuuucuagaacuucugaacagaaaggaacuacuucaucuuaaguguuuaaaaaggcaaucauuuggcaucauuugaauuacacaagaccuuuaaugauaaaguacuaugcuaguuguaaguauacguagaucuuuucccauuagugagaaggagccuuaccacagcagcuguuucuccuaucgucuuccuugaacuuaagaaaucugagcuccacuucugauuuacaaaucagguuauugggaucugguuauuuuuaaaagcagcaacauauucagaaguuguucuugggagugggacaagucucacuguauuaucuucagcaucaguagccauuuggaauuccuucaagccauuacugagagauacaaaagaguuuuugcucuagugaagcaaguacagacuuuuauagaaauaaugccauaauagaaauuuggaagacauagaguguauuuuuuuuuaagaaaaccucucuaguccgauauccuauccugaauguuuugcuguuuugaucucaguuguuuguuccuuguuuugauuugcuauacauuaauaucagaauaacuucaguuaugugccugauauaauuugaucaaaaauuuucaguauuauaagaauaaaucuguuguuccaucauucauuggaauuacuuggaaagcuuuucaucgauauccuaacuggauagaccucacuuuaaaacaguuuaaguaagaauuuaaaaauuauauccaugagcacuggucuuuuucaaauuaccuaggugauucugauaaugugcugagauaauaaccgauguaaaacuaguaagugaacauagauuaaguccaauacauccacagauuaaauuucuaccugcugccaacuugccauuacuguguggauuucccccaaagcauuguuagucauuuauauacccuuucuuccaacucucguuuuugcuucucuuucauaaaaucagaaaaccaauaagaauagcagauggaaauaagaaauggguuuaacuaacuuccuuaaucuauauuguaaauagaauuauacacaaauauauauuuacagauucccuccuuucuugaucacauagauaaaaaacaagucucagggcuggagagauggcucagugguuaagagcacugacugcucuuccagagguccugaguucaaaucccagcaaccacaugguagcucacaaccauccguaaugagaucugauguccucuucugguucaucugaagacagcuacaguguacuuauuuauaauaauaaauaaaagaauauuuaggccagagcaagcagggccaacuggagcaaguggggucgaccggagugagugggguugacuggaacgagcagagguccuaaaaaaauucaauucccagcaaucacaugaaggcucauagccaucuguucagcuacaguguacacauauacauaaaauaaauaaaucuuuaaaaaaugucuuauagcuauaaaaauaaacacucaggcagaucaccaucucuuuggcugcccccacuucugguucuuaguuucuucucuuuguauugucucucaucuguuucucauggguuuuccauuaccuuuuuaggaaugauuuccagcucucuuccuuuagcucugaccucaguugagauccaaaugccaguuuuuaugucucuucuuacuaguuuucccuguguguccugugguucuuuaaacucugugugccugagagcccaccuuuccaaguaaaacacaauacaacacuguacgaaacaguaguaacuugccacuguguuucucuuaacaguguucuuaauuuacagucgcccucacaguauuacuuggaaaauuuucucauaguauggucuguggaacacaaagaugacuuaagaucuucuagacuguaaaacagaaagauuuguagagaauuggggaagcuguuccaugcugugauguucuaaaacauacucccuacucaugccaggugugcaugagauguacacauauacauauaaucaaaacacucauacagauggaaugaaaaaaugagucuuuaaaaauaaaaugagauuuuaacuaagaagaugccaucaaggcuagagggcauauacuggcggagccuuagagcccggggagugagcuaacuugcgccuuuucucuagguggauucucaacuauuagaugguuggcucauuuuuagguaaaagugccuuagaguuuuuauauuaguacuuaaauucaagggaucauaaagcauggcuuuugauuuaacuuuuagcugcagucuguuuugugugccuauaaaguaaaugccaugcaaguagagcccaggauaggguuacuaguucucaaaggucauguacugaccgaagcugcugaauaaguguucuuguaucucgguauguuuauaaccgucugguuuccauuuauuuuugcagaguguagugaaguuaaugaggggacugcugcacugcaugaucagacagguauggcacugguaacaacuucugauaaaacauaacaucuuaaugaugcuuauaaccuuuuauucagauucacaaauuguagucucuaauuuuagaagguucagaacucugggaugggcaugguacacagacccuguuacaacuagaauuauuuccuuucagucuuuuuccuccccuuaugaaugauuuuucucaaaaagaaucauuauccuauuugcaguuaugcgcacuagauaaagcaugauacagguuuuuuuuuuuuaaucuuaucugaaacuuuuaggcccacaucccuucuaaaacuaauacauuuucagauuuuuaaaaagauaagcacacugcacguuauauaauuucucaugucuucaguagauagagaaaauacucuaaggagcugaagugguuugcaacuccauaagaagaacaacaauaccaaccaaccagacccccuccccagaucuccaagggacuaaaccaccaaccaaauagggagccuuggcuccagcugcauauguaguagaggauggccuugacaugcaucaaugggaggagaggcccuugguccuguggaggcucaaugcacuaguguagggggaugccagggcagugaggugggaguuggugggugguugggggagcaccuucauagaagcaaggggggaugaaauaggggguuucuggaggggaaacugggaacauuugaaauguaaauaaauaaaauauccaauuaaaaaauaaauaaauaaagcuguguaccaccacacaaaaaaagaaaauacucugaaauuaaaaaaaaaaaaaacucucucuaggaaaacauuccuuacacacuaaaugggauaaggccuauaaagaaccagauguugauuugaauuuaguguuuacaccuaauuuaguguuugaaguuugaauuuugaguuuugauacaaaauuuacguggaaaaaaucauucaaaguauucucaauuuuaagauuggggcaaaggaaucuugaacuucaaauaauuggucuucccuggccuuguguguagcuaaacauccuuuuauaugugaauugaaaauuugcaguuccuuacuggugaauuaccugcuagagcuuugccucuuuguagguugucuguuucuugcuuauugacuucuuguguauuauggauguuaaucauuuguacauugcaaauauguuuauagucuaccauuuacauuuugaguuuauggcauuuuuccacacaaaaguauuuuacuaagaaaccuauauucugagaucuuaaaacauauugaaccugaguuaauuagagcaaaguagaaaggaacagaucucaacuucuaaacuucaugauuuuuaaaugaauaugaaguuauuuauuguauguaucucuuuacuagucucacauauaucacuuugugucuuuauacuuuauuuauauuuuagauaguuaugcuuuguccuguuaaauagauauagucacaaauuucaugaaccauauuuaagauuaucauacaucagagacauaaauaaucauaucuacauaucaggaacuagguuagaaacuaguugccuguuaucuaaggucuggauuucugcucuguguguguguguguguguguguguguguguguguguguguguguguuagggauuggacccagggccuuaugcauccucagauuacaguaccgcugagguauauccccagcucccaaugagccucuucuaauuaguuuucuauaauaccaguuuugugacucuauauggcucucauuaacucuuuuuauggcaucuucaaaauuuauccucuugggguuagagagauggcuuaaugguuaagagcacauauugcucuugcagaagaccugaguuugguuccuaauacucacuuuuguuggguggcuuacaacucuuauaacuucagcuccaaagagucgaaugcccucuucuggccucuggggguacccacacccacaaacaacuaugcacagguacauuaauaaaaauacccucaucugucaauuuaucugcacauuccuacuuuaaauucaagaacaaauguauagcacugcauuuucucacuaaacuguucuuauacauuugagcguccaguuucucuacaauaugacaaaguaaccauuugaaaagcauagaaaagaggaaaugaacaagaaauagguggguuuuuaaaaacuauuucuuauuuuuuauuaaaaaugcuagauuuccccaguguagaaaaaaagcagguaauaguauauuucccauauucacaauuuccugaaggcagaguauggugauguguaugucagagcccuacagauagaugcauagcauauagguugauuuaucugacuggccauuuuauacuguuuccuugucagguggauaaaguagaguccuucaaguacagucagaguacuaaagauagccuccaugccaaguacaacaccaaaacuugugccacuguggugggugaugaccaguggggacaccugcaguuggaugcuacuucuguguaccugcucuuccuagcacaaaugacugccucaggucaguacaagaagagaauaacugcaugcuuguaaguuuggaucaucucugguucaucuacuuucucuguagggauugacuagaaaauaaaguaucuguuuaggguacucaaugaagcaaauugcaaauaacaauaguuuguaaguuugcuauagcuagauaacuuuuuuugagguauaggcaauaucuuauuuuauugagaagcaaauuugcaguucuaauuaauacucuuuugaaaugggaacccagaaaagugggcuagaucuuuagcuagguuuuuuauuauuauuuauuaauucucagaugccaggagaugggaaggaagggcaaagguuuguuuuuuuuuuaauuuucauauucuacaccaguaugccuuuggucacuguggcuacagaaccacccaguuuauauauucuuuauuaguaugaucugaaucuaaauguguauguuucauuauuaagcaguauucuauuuaaguaguuuugugauaauaguuagaugccugauauguaaaagaaaauuaaaaaaaauauaguagcucacaucucucuguauccuagcacuugggaggcagauauaggccagcccuaguuuacauacuaacuucuaggucauucaaaacuacauaaagugaugcuuuauagauguaaaauuggaggugaaaacaauucuauuauauggaguuccuaaacuuaauaagaacauuuccagaucauucagaguaaguuaauguauuuacaauacuauguuuucugugguguugggguuucaaagaagggaaucaugcaugccaaacaagcacucuaccacuaagcuaaaaucuuuuuuuuaauuucuuucuuuuuuuuuuccuuuuuuuaaaauuagguauuuuccucauuuacauuucccaaugcuauccccaaagucccccauacccacccccccacuccucuacccacgaagcuaaaaucuuaacccuuuacauuuuuuuugagagaggaucucacuaaauuguccaggccagagaguuccuugauauuaaaggaaacaaaucucucucucucucucucucucucucucucucucucucucucucucugccucucugcaaauaaauguuugguaauaaacuccuuaacuuuuuucuuuuuacacccuagaguuugaauaagcuuucuuugaaauuaugaguugaucauccaauuaaucuccuuuuggaggagaaauuucuuccacaacaaauuuaauuuuguuuuauuucuuuaaguagaaugguaguuauaauuucacuuugaauaauauuuuuauuucaacucugaaagcuguuuaccauuuuuaauuuuuaaauuuaaaaaaauuggggugggugguauuuugagacaggguuucucuguguagcucugguugccuuggaacucacucuguagaccaggcuggcuucaaacucggagaucucccugccucugccucccgaguacuggggauuagaggcauguggcaccacugccuggcucccuuggguauucgauggcuaguguuuuuaagcucccaaguauucugaccugauagaguuguaaaguaaguaugacguugccaccuucaccuagcuuuuuauuuucucucuuuaaagcaggcacugacuaaauaucccugaugguuuuuaaauaugauuccccaaaauggaagcaaagauagauuaaaacauuucaugaggacuucuauagcaugcuaaauauuuuagaauuauauucugcaaccaguagagauguuugauguggauaaucaagggaugguucauucuaguagcaggaagauagguugcaugagauagauuagauaaagaacaaaauuaagguagaagacuaguaaagaagucagugaaauacuuuagcaauaaauaauacaaauuuuguauaaugcauuuggauugaaguuaaaaagcaacauuguggugaaaagaauauaauaaaagaucuucauagagaacuagcaauagcuugaauguucuugaauacuuaguuauugcccgagcuuuuguuccaccggcaagaacacgcucagaacaaccggaaucuucugcggcaaaagcuuuauugcuuacuucuucaggaggaagagagaaaauggcaaaaccccgucccuuuuaaggagacuuauccuccgccuaggacgugucgcucccugauuggcugcagcccauuggccgaguugucgucacagggaaggcagagcacauggagugaaaaacuaccccuggcacaugcgcagauuauuuguuuacuacuuagaacacaggaugucagcgccaucuuguaauggcgaaugugagggcagcuccccacacuuagugaagauagauuuaggcagaaauugaaugaaauuuauagaauaguagcaugaagagcuccagcaaaacagccaaagaugcuggaaauuuaagaacaaaccaauacuuugaaauuguccauuggauauuguucaaaaggauuugcaguaaguagagaagcacucaaaaaaccccuaauuauuaagaacaucaagggacugagguaucuggccucagcuuaaccuccuaucccaacucaggauaauagaagcacuauuccaggcuguauagacagaacacaggcuuccucucuccuaagcucuaguuuagugguucucaaccuuccuuuaacuucuuuuuuuuuaagauucauucauucauucauucauuauauauaaguacacuguagcugucuucagacacaccagaagagggcaucagaucuuguuacagauguuugugagccaccaugugguugcugggauuugaacucaggaccuuuggaagagcagucagugcucauaaccacugagccaucucuccagcccugguucucaaccuuccuaaugcuugagauccuuuaauacaguuccuuaugugggagugacucacaaccauaaacuaguuuuuauggcuacuucauuuugcgacuguuauuaaucauaauguaaacaucuguguuuuuaaauggccuuugggagucaugauccccauguugagaaucaccauguugaguuuaagguuccugaaugucccucagaaaacaagcuggcaucauuuauuacccuuccaagcucuguauugcaagcccuaguccaggcaaguacagcuuuaggaucccccauauccccagacacuuaggaaauaggaucucccuuagauagagcagagugagaccacuaugucaucuacuucuugacugaggcaaacauccuacacuggaauaugcaagcugggaagaucagaagcuaccacucuguccagagcuuagugucuaaaacaggaaugccauuccaaaagaaauggucugcagcacuggcaugaauauucucauggaagguagcaacacacuguaaaaacaaagcuccuuaacucuucugaagaaaauugccuuuacaaaugaagugugagaaaauuagauaauuacuuaguaauuaugauguagggcuggagagguggcuacucuucuagaggaucugggcuugauucucaacaucuacgugauggcucacaaccguuuguaacucuaguuccagggggauuccaugucccuucuggccucugcaggcauugcacguacaugguacacagauaucauacaggaaaaacacccacacacaucaaagguggucuuaguaaaaacacaucuaaauaauuaagaugaaguuaauuguucaguaacagcaagaaacuaagaaaaagauuagcuagaaauuuuuaaaaauccaaagaaagcuaaggaguccuuuuaaguguaagaacaaguaucaaagacuugacucaaagauuguaccagaaaggaccugagucuaauuguuuaaaacgauagagaaauuuauuuuugaggauucgacaaaaucauuaaacaaucaguugaaaccagggguugggccuuagcuucauaccagcagagacagccaucuacuagaucuuggaaagaauuuuuuguuuguuugcuuuuuaggugaaggauguccuuuuuucuuuuucuuuuuauugaauauuuuauuuauuuacauuucaaaugcuauccccuuuccugauuccccuccccugaggaacccccuaucccauccacccuccaccuguuucuaugagugugcucccccacucacauccuugccaacauguguugucacuugaucuuagccauuuuuuugauagaacaugauuuuaauauuuucaacuguuaauauucaacaaacagaauaauuguuuuaagauauaguuuguuguuaugucucccuuuucauuucugauuuuauuaauuuggauacugucuuugugcccucugguuagucugaaaaggguuuaucuaucuugauuuucucaaagaaccagcuccuccugguuuuguugauucuuuguguaguucuuuuuguuuccacuugguugauuucagcccuaaguuugauuauuuccugccgccuacuacucuugggugaauuugcuuccuuuuguuuuagagcuuuuaggugugcugucagauugcuaguguaugcucucuccaguuucuuuuuggaggcacucagagcuaugaguuuuccucuuaccacugcuuucauugugucccaugaguuuuguuaugauguaucuucauuuucauuaaauucuaaaaagucuuuaauuucuuuauuucuuccuugaccaaguuaucauugaguagaacauuguucagcuuucacauguaugugugcuuuccauuguuuuuguugguauuuaagaccagccguagucugagcugaucugauagggugcaugggauuauuucaguuuucuuguaucuguugaggccuguuuugugaccaguuauauggugaacuuuggagaagguacugugaggggcugagaagaagguauauucuuuugcuuuaggaugaaauguucuauaaauaucuguuagauacauuuggcuuauaacuucuguuaguuucacugugucucuguuuaguuucuguucccaugaucuguccauuggugaguaggauguugaagucucccacucuuauugaguggggugcaaugugugcuuugagcuuuaguaaaguuucuuuuaugaaugugggugcccuugcauuuggaacauagauauucagaauugagaguuccucuuggaggauuuuaccuuugaugaguaugaagugccccuccuugucuuuuuugagaacuuuagguugagaguugauuuuauucgauauuagaauggcuacuccagcuuguuucuugggaccauuugcuuggaaaauuguuuuccagccuuucacucuaaaguagugucugucuuugccccugagguggguuuccuauaugcaccaaaauguuagguucuguuuacguaaccagucaguuagucucugccuuuuuauuggguaauugaguccauugauuaagagauauuaaggaaaaguaauuguuucuuccuguuauuuuuguuguuagaguuggaauucuguucauguggcuaucuucuuuagguuuguugaaagauuacuuucuugcuuuuucucgaguuuauuuucccucuuuguguugguguuuuccaucuacuauccuuuguagggauggauuuguggaaagauaauguguagauuugguuuugucauggaauaucuugguuucuccauuuaugguaauugagauuuugcucgguauaguagccugggcuggcauuguuguucucuuagggucugugugacaucuguccaggaucuucuagcuuucauagacuguggugagaagucugguguaauucugauaggccugccuuuauauguuacuugacuuuugcccucacugccuuuaauauucuuuauuuacugcauuugguguuuugauuauuaugugaugagaggaauuucuuuucugguccagucuauuuggaguucuguaggcuucuuuuauguucaugggcaucuguuucuuuagguuagggaaguuuucuucuauaauuuuguugaagauauuagcuggcccuuuaaguugggaaucuucacucuuuucuauaccuauuauccuuagguuuggucuucucauuguguccuggauuuccuggauguuuuugguuagaaguuuuugcauuuugcauucugcauuuuuugucuguugugucaauguuuucuaugguauccucugcaccuuagauucucucuuccaucucuuguauucuguuggugauguuugcaucuaugacuccugaucucuuuccuagguuuucuaucuccaggguugucucccuuugugauuuccuuauuguguuuguuuugaguuuuagauccuggaugauuuuguucauuuccuucaccuguuugauuguguuuuccuguaauucuuuaagggacuuuuguguuuccucuuuaagggcuuuuagcuguuuaccuguguucuccuguauuucuuuaagggaguuauuuaugaccuccuuaaaguccucuaucaccaucaugggaguaguuuuagauccgaaucuuguuuuuccaguguggugguguauccaggacuugcuguggugggagaauuagguucugaugauaucagguaauccuggucucugcugcuuguguucguacacuugccuccugccaucugauuaucucuagugcuaccugcccuccguauaucugacaggagccuguucuuccugugauccugguugugucagagcuccucagaguucagcugucucugugauccuguuauuaugggauucugugauccugagauccugggugugucagagcuccugggacucaagcugccucugagaccuugggauccuggugugagcaagcuccugggauccuguuauccuguggucuugggugcguuagagcgcuugggaauggaucuuccucuggguguugugggaauggcucucauccuaugauccuguguagggcugugggugugucggaagaggggaguuggagagagugccugcaucccgcccgaguucugguguucugggcaggcagaugagcacaugcuuucuaugcagccccgggugggcaucuggcuguuugaagccacugaccccacaaggcagggguuggacaaggggcagcccccgguaccagauucucagccuccagcaucccaagcuggauacugccgagaagcugagaacagaauaggggcccugggguggcacuuggccccagagauacggggagagagggcagggggaaagaggggugcugggugguuuccacgcaggugagaguccuucagagacagucuauaguuuuagagcuuuauuauagaaaggcagggagaaagagaaaagguagaaggagagagggagaggccagccauggccacgaggagagaagggggaagagagagagagagagagagagagagagagagagagagagagagagaaggcuagagaguaagagagguaaaagcuuagagaguaagaaagcuuagagagugaggaggggccaagcagccccucuuauagugggcuuuguuaucuugcuguugcuagguagcuguggaggagucuagccagaaggccauugggacauugucuaccugacuaauagccacaugccucuccugugggggcuauaggggcgguaacuucgacaggagccagggguccaggagacaugagggaacgccuaccaucccauguagguggaaauuaccacacauaggguaccgcugggguucaauggagaccaggcugucuguccuauaauccugggauuguuagagugucuggauguagaucuuccucuggguguugugggacuggcucugauccuggguguguuagagugccugggguggaucuuccucuggguguugugggauuugugguggaguuugcacccaaugucugacaggaaggagcacaugcuacugaaugggcagaauuccuaguugccuggguccugcuggucucaguuauuuccaguguuggggcagaugugucuuucucaccucugauccuaugauccugggaguguuagagcgccugggaguagagcuuccuccaguguugugggacuggcuguggaguuugcacccaaggucugcucagggcaguggcccagacagaaaagaggaaagaaauuguuaacgagcuccaauaacaucaucuuagagugacaguucauguuccuaagacugugucuucugauggcuaccagaggcugcauguuaugggggaauagauuguacugaauuaguucaguuaaaccucuaaauaaauagaaacagucuccagagaauagucucggaucuugcauucucacaacauacuaacauauaauacuacccaguuuucaaccuaaaaauuuagaugcaaaggaacaagaaaauagaaauauauagugguacacaccuauauccuagcacucaggaggcagagaaaggaggauuaugaguuugaugcuaccugggauauauaucauggcccugucaaagaaaguggggagaggaaaagagagaaaagguugaaaagaguggaagagggaggguagaagggaggacaggcgugggggcacacaccuguaaucccagugcuugagagguagacacaagaggauugggaauccaaagccgggguugguuacauagugaguuuaaagccaucuuuggauacacgagacucuucucauaaaacagaaacaauauaaauaaauaacagcaaagggaagcaggagugaauguucucuuggauaugaugccaaauguauaaacagcuaaagaagaaaaucguaauugcaauuuaccaaaauuaacaucaaggacccaucuaagaaaguaaaaaagaaucuguguauaguaugaugucugcuuguaauccgagcacuugggaggugagggugggauccagaguugaaguucaucuucagcuaauagcaaauuugaugcuaaccuaugagacccuauuuauuuauuuauuuauuuauuuauuuauuuauuuauuuauggaagcaaugguaauucaaucucugggugcaacaacuaaaacccaauuguguaagccuuuaaucugacuccuccaguggcgaauccugauggauucaccaugauaccaggaaacucuagcagcuacaucuugcccuuaugcuauuccuguuccaaaaagcugagaacccauuaaaaaaaaacacccagccuuucucaguguguguguguguauguaugauauauguauguauguauguauguguauuguguguaguguguauguauguaaaaucaaccuauauagaaggaaauauuugcaaucauauauaagcuauuuauauugaguagaaagaauucucacaacucauuguuuagaaaauaucagaauaacuaagucagauauguuggggugguauaugcuuuuaaaccuaauagaaggcaaaggugugaggaucucaaauuuaaggucauccuaugaugacacugucucagagagagagagagagagagagagagagagagagagagagagagagagagagagagagggagggagggagagagagagagggagagagagagagagaaauagccuccuuuaaaauggcuagagugggcuagagagaugggcugcucuucuagaggacguggguucaauucauggcacccacaugacaggucagaacuaucuguaacuccaguuccaggcaauaugaugucuucuucuggacuaaacagacagagcaugcaugaagcacacagacauauauguaggcaaaaacacucauacaccaaaaagcucaauuuauuuuauaaaaaguggcuagaggauaugaacuggauuuuccucuauggaguuuguagaaauaaccauuaaguacauuacaaaaugcugugcaucaucagucacuagaggaauacugaccugaauaacuguaaugaccacuucagccacaacagaauggcaggaaucaagaugacagauuaaaagguguugcugaagauauugagaaguuggaaccuuuguucacuacucugggaaauguaaaauaagagcaaaggauaugucucagcagguauaaguacuugcuacuaagucugacaaccugaaugcaauaccuggauccauaugguggagggagagaaccaacuacccuuaguuguccugacuuccuuguguaccauggcaugcacacacauaaauaaauagauaaauaacuaaguaaagaaauuuaaguuuuaauguaaaauaauacaaucacuuugaagagcagucuagcaaugccucagaggcuuaaauauagaguuaccauaugauccagcaguuucucuccuaagcguguguguaugcauauauguguauguaugaauauguauauauauguauguaugaaaaauauguccacauacacaaaaaguauauaugaauauuuauagcagcauuauuuacgauagcuacaaaguagaaacaacaacaaggucuaucaccugaugauuggauaauuuaaauauggugcguucacacaauuaauauuuuuuggcaauaaaagaaguacuaaugcaucccacaacacaaagggagcuucaaaauauuguguucaguaaacaaacacugauaacauaauauacuucucaguuuauaugaacgcccaaugaguaaagaauuccuucuugugaugaugaauaugucccagaauugauguaauagauauauacuguaauacaauaacaaccauuauauuauaugaauuacacgauaaguuauaugaaaggucuaucucaguuuauaaaaauacaugugcuggucaggucaguaaaggcaauugaagugaaguugauugaagcagaguucacugagucauuuccauuuuggggcaggaggcugaagugauaaccaacuaacugucuuuuucccucaggacuccauaucauccacagccuagacgaagucaauuuuauacagaaccucguguuuuacauugaagcugcauauaaaacugcuguaaguacuuacuuuagaaugaacuuaaacauagaauguuuuuguuuccaaaacaccaaacaacucacuucuccuuauaaugaacgaaucaaaaaggcucaugacaaaaccauuuucaguuucuuuacuaagaccuucauuccccuguuugcccugucgucaauguguuacagagauaaaugcugugguuucaguuccuucaaaucuuauucuucauaguaugugcuuggcaauggaacuaauuuguagucauuuuauuauauuacuauuuucauuuaauauauuuuauuagagcaucucuaggcuaggcucauccugaacucaauacaugaaggugaucuuaagcuucugauucuuccgucucuaccucccgaguguguuggaguuauaggcauaagcuaccaugaucaguuuuauguggugauaggauuugagcccuagcaagcacucaaccaacugagaucuguccccagccucuacuagucuuauuuuaacugaaaccuuuaaaagaagcaugauaacugaguaauguuaugggccauuuggcuguacacaaauaaaauuuauucauguuuuuguuguugaucuaguguacaaaaaguuuuuccccuuaugaacuaccauaugaaguagguucauauuaaaugucaucaauaauauuuucucuguauaaaauguugcauuggacacuacagaaaugcauuuuuccuuuagucuaauaugaaggguuuuguugcuguuguucauugacacuuuccuuauaaucucccaaucuucaaaucauccaaaugcccaggaacaaauacaagggauaaacaaauugcaguguucaugaaaggucauuuuguucaacaagaaaaaaaaugaacugugagccaugcaaaaacgugaauaaaucuaaaaugcauaaugguuaguagaagaaauuucauagaaaauguacacaagcccgggcauggugguguguaagccuuuaaucucagcauuugggagaggcagagacagguggaucucugugaauuugaggcuagccuagucugaauagcaaggcccaagccagccagaacuacauaguaagagccucucuuuaaauguguguguguacaugugugcauacaugcuuguauguguauuauauauauauauguguauguauuauacacauacauacaagauaauuacacuaacaaaauucuagacaucuguaaugacaguaagcagauuugugauugcuuuauaacaggggcagaggaagaaauggauuuuggaagccaggaagagacuuuggaaguuuuugaaccuaucuuuuauugugacaauagauucacauauauaaauauaauuaauuaaucacagugguaccagcuaguuuguucagugguuaaagguguucucugccaagacugauguucugagcaagaucucucucuuccucucucugucucucugucugucucugucucugucucuguuucucucucucacacacaacuguacuaaacauuuuaaaagaggaaucauauaguuuaacuauauuccgguuuaacuacaccauuauacaucaauaaagauauaaaacuacuguuguggaauggaugaauacaaucacucuaagauuggacaaauacuacacuugucucugauugugcuuuuaguauguguccauuguuacugacuaacccccuuguauuuaacauaccucuuuucuuuuauuuuuuguggugcuaggauuaaacaaaaguccuuacacaugauuggcagauacucugaaaccgaacucuaucuccacucagaauucuuuuucacuuucaagugucauauuauuuuaaaagauacuacuuuaaaaugcauuuaucacuuuugauaauguucauuucuccaugcauauguauauguaacuuuacccauuucuuuuuugauggacauacagucugcuucuguaacuuaacuuuuguaaauagugcuauaguaaauguggguauguacguaauaugugugugguaugcuggcugauuagauuccauuggcucuauuucuggaagugguauagcuggaucagauggcagaucuauuuuuaguuuuuaaaggcacucccauacugauuuucauagugcuggacuaauuuacaugcccaacagcaguguguaacauuuucuuacauuuguuguuaguuauuuuucugaugauagauauucugaauggggugagaugaaaucucaauguagguuagguuugguuugguuuggcuugguuugguuugguuuuuugagacaggguuucucuggauagcccuggcuguccuagaauuugcucugcagaccaggaugaccuagaacuuaaagauccaucugccucugacucccaaguacugggguuauaggcauacugcaccacugccugcauguggauucagaggucugcuuacuucuuucccgugagugcugggauuaaaagugugugccauuacacccgccuaaauccauagucaagguugagauugaagcaucuuguaguacuaaacacuccagaaguauucagggaggaacagggaaugucaaaaguacacuagaaaaugucagaaccaagaggcacaggagccuaccaguggcuagaccuggaacaauuaacaauguaggcagcaaaauaaugauagcauuccauaauaaaccagcaaacauacacacaccaauaaauaaacaacugaaaaagaaaaaaaacaaggaauaauggacugccuuccuuggagaaggauuauaauuaaugaccauagagguagcaaggaaaauagauuaaaauuaucaucaaaacuauacuuauuguaagcaauuaaggcagaaugcugaauugguggaugguuguuuaaggagaagcaaacuauuuacaugaucaucuuguuuuucugagauagagucucaucucagguuugcaacaaggagcaaccccaccuagugauauauuuauauaauauugaacaaucucucaaaguauuuacuaauuaaaaagagaaaaguaaaauggaaaaugccaaugcgaaccaaacuguuuagcuuucaguaguuuuuacuuaggaucaaggucacaaaggauaagauuugagaaagcacuauugauuggaagucacuaaggagacauggcagggaugaaauugaaucuuggaauauauaaaaagcaccagucaggcaugguuguguacacuuacaauuccagcucuuggaaaguaugggcaugaaguccauaguuaacucaguugcuuaguugaguugaguccuuagcuuuagcaguuguccugugguuauggucaauguuaacauuaggcaaaacuaagucauagguguuagggauucauuguacuauuuuugcaauuuuguguaauucugaaguuuuuuuuaaaaaaauaaaaaguauuaaaauuaauuuuaaauauuuuauauugccuagggaauguuuauagcuauggcuaggaguagguuuuggugugaaauuccuuagaauguacucuggauucugucacuuaccaaguauacaaccguggguuaguuacuuacugucauucuuguaauuuaguuucaucaucuguaaaauguaaagauuaaggguagagagauggcuugguuaagagcacuuccagagaacccagguucaauucccagcacccacacagcagcucacaacucuuuguaacuccuguuccaggcauucugacaccuuuuucagauauacaugcaggcauagcaucaauauacauagaauaaaaauaaaaagcauauuuuuaaaaaguaagcauuaagguagauaaugcauguauuguaaauuuuaagaaccaagagauuaagauaagaauguaaguuucacauaaaaauaccaacuguugcuuagccucuauguguuagacuucaugggaaucuccuuuagggaaaacuugagaaguguuucuagaugaucugauuaaguguugaagagacucacaacuuuuuagaggccccaauuuaacuuaggucaucaucugcuccuuaauagccuauacagaggcuauuaagugagugaguauaugagaguguauguaaaaauuugcugcuauuaauauuuuuauuaaaggauuauacaucuaaugaauguuuagugguuauaauuugauuguaaugaguuauaucuugauuauuuuuugcuaggacuuugggauaugggaacguggcgauaagacaaaccaaggcaucucggaauugaaugcgaguucaguuggaauggccaagguacauuuucuuucuuauuuuuaccaagucuugucaauggaguuuaguuuaucuuugugauagauaaaaucuuaauguacauguugacccaucaaauuguucuuuaaaccacaaacaaaauuuagauuccuccaugaaacuaugaauauauaauuugaaacuuuuuauaaguuucaaauuugaaucauauggcuuuuaaggcaugucucugcuuauauuuccuauuagaauaacaaauuuuaaacuguacucaccauuuuugccauugcauaaacuaagggaagcucuuucccuuccaacaguccagucacccaagcucaguaucagauagccaccucacgguccuccauccucuguacucuccucaaucucccauaucaccagcaccuuuccacuuggccauauuucuagaaagaguaagaauguauaaaauaggauagcaggagaaaguucaaacauuauuauguuaaauguacauggaucagccacuuguacuaaacaggaaaaugcagauuuuuuuaaaagaaguauacuucuuauaucauaaugauacugaaaguuuaaaaccaaguuaggagaaguaaaauauagagacuaaaaagaaaugaaauaacgauucaaggcaaaaaauauuacauggaauaaaguggacaagaggguuaugauagaauuuugacauaaccuauaaugagacaauauggucuggaauguaguuccaauuaauacagaacacaauauauuugaaauacaagacagauguaguugcauaaagaaauaacuugcuggacagugguggcacacgccuuuaaucccagcacuugggaggcagaggcaggcagauuucugaguucaaggccagccuggucuauagagugaguuccaggacagccagggcuaaacccugucucgaaaaaaaaaaagaaagaaagaaagaaaagaaagaaaaggaagaaaaggaagaaaaggaagaaaaggaagaaaggaagaaaggaagaaagaaagaaagaaagaaagaaagaaagaaagaaagaaagaaaaaauaauuuaacagcaagacugugauacauguagaaaaccccaaacaaaucauagaaaaguucuauacaaguuuuccacugcugaguucuaucuauugcuccuuccuuuuuuauuuugaaauaauuuuaaacuaaagaaaacaauuuaagaauguuagggggaaaauuccauacaucauucaugcaagguuuauugauauuugcuuuaucuuuccgucuacuguguuagacauucauacacaugcaugcuugugcacaaacacacacuuuuuccugaacuaguugaaaauacacaaacuauggacaugaugaaguacuacuacaacucaacauuucauugugcacuuccucaaagacuguuguaaccaugguaugauuaucaaaaccaggaacuaagugauuacacauaccacaggaccuauucaguuuuuuaaaauuaucccaauaauguuaauauaggcuuuuguaauagaaucugaugauuuuuuuuugcauuuccucagauucuguuguuaugucucccuuuucauuucugauuuuuuaaauuaggaugcugucccuauacccucuagugagucuggcuaaggguuuaucuaucuuguugauuuucucaaagaaccagcuccucguuugguuaauucuuugaauauuucuuguuuccacuugguugauuucaccccugaguuugauuauuuccugcugucuacuccucuuggaugaauuugcuuccuuuuguucuagagcuuuuagguguguugucaagcugcuaaugugugcucucucuaguuucuuuuuggaggcacucagagcuaugaguuuuccucuuagaaaugcuuucauugugucccauaaguuuggguacguuguggcuucauuuucauuaaacucuaaaaaucuuuaauuucuuucuuuauuuuuuccuugaccaagguauaauugaguauaguguuguucagauuccauguguauuugggcuuucuauuauuuauguuguuauugaaaaucagccuuagucuguggugaucugauaggaugcaugagauaauuucaauauuuuuguaucuguagaggccuguuuuuuuaauauucacuuucucuuauugugguacugguaacugaauucaggaucuugugcgugcuagacagguacuuuaccacagaguuauacccucagcccaacacaccuaccauuuuaaaacaacaggaugcuaugaaguacacaauaacaucgcuauuuuuuuuaagauuuauuuuuuauuagauguuuucuucauuuacauuucaaaugcuauccccuuuccuaguuugaccaauuauacggucaauuuuggagaagguaccaugaggugcuaagaagaagcacuucuuguuuuggauaaaauguucuauagagaucuguacaaucuauuuaggucauaacuucuguuaguuucacugugucucuguuuaguuucuguuuccaggaucuguccauugcugaaaguggggugguaaagucucucacuauuguugugugaggugcaaugugugcuuugaguuuuagcaaaguuucucuaaugaaugcggaugcccuugcauuuggagcauagaugaauugagaguucaucuugguagauuuuaccuuugaugccacacuuugguuuuccuucuugaguuucaugugguuuguguuucaugugguuugugaauuguaucuuggguauuccgagcuucuaggcuaauauccacuuaucagugaguguauaucuuucuaaaucuuggaagguaagaguucaccugaauagcggccucuuuuugucaguugaguccacaaauacacugaaaucucacauggcugguuggcuuuaucucuugccacuacuaugccccguucuucuucccugagucacggggauucucuuccauuccucuuuucauucuagccugcacaacucuaaguguccaccccauguccagccauuggcuguuagcaucuuuauugauggaucacaaaccaauuugggacaagaaccuucaguguuuggcuggacacgcagauuccagauugaaucaaagccuuagaaccagucuccaacagguaucccucauuggauugaagaaauuucuuucuauuguugauuuuuaaaauuuguaaacauguauugaauuuuauccaggguugacagcaagcuguaaaauccuugcuuuuuuucuugugacgguuaucuagucuuggagcauaccuguuccauguguguccucauggugaaucuuccugguccuucucugcuuccuccuuucugcuucucuccuuuuguuugggaccaagauaccuuauauuaagaagaauauugucauauacugagagugaugcauuauauugauauaauaugcauaaaaagcaaucuagcauuguaucucaauaaucguucacauacuuuaagccacagauuaucuacuuuaagaaaguaaugcuugggagaacuggccauuucucucgccagccacaacacucaggagagggggccugcaccuugccugagcagcagaguagaacuggcccugguugcuggggcugccugugaucuggccugagggcaugagagcagcuugacuggauagugauacaaacuccauuuuaauuuucccugggcacugugggaggcaaagugcaaaucccaagcuccuaggaauaaggaauguuauuuuauuuucuauuucauuaaauauauucaaaagcaacaucauguaacauuuauaagauacuaagaagaaaauauguauaauauaucucauucuugauuuucuuucuuuuuuuuuucaguucugggauuugaacccugggccuugcauauacuaagcauguguucugccacugaaguccucucuuccauugcuucuuacaggcagcccuggaagcacuagaugaauuagacuuguuuggugugaaaggugggccacaaucaguuauccauguccuggcugaugaaguccaacacugccagguaaagaaagaauggaccauaucauagcaagucuuauucuugcucagagucagacuuagcaugagauuuagcuuaaagagagcaacccaucuugugacuauuaccaugugaucagaaaugucuuuaucaagcauucuauagugagauaaaccugauauagcaugagcuauaauauagauuauggauaucuuaguuaggguuuuacugcugugaacagacaccacgaccaaggcaacucugauaaaggacaacauuuaauuggggcuggcuuacaguucagagguuuaguccauuaucaugguggaaagcaugguaguguccaggcaggcaucgugcuugagagguaggugagaguucuauaucugguaaaacuucauucuuaguuuuguuuauaauugcucccuauauugaaaguuucuuuucucugguauaugaaguuucucccuuucuucaaacccugauuauguccuaugauaucccagugaauauaaauuaaacuucuaauuuugaaaauaguuuuuguggauaaaguaugucauggaagaagcagggagagcuuuuguggcuaggaaggaggcuagugggacugcugcgggggcagggagaauucuagagaggaaauaugugcaaagugcaaugagacguggcugcaaauagaaagaagccuaguauuccccauacuugaugaaaauuaauuugaaaacaucucagaagcauagcgauccuucucuagucugcccaacugcuguauuuugucuuaguuuuauuauuuuaaaauuuuuauaauuuuuguguauggaauuuuucccugaauguauaccugcaccauauucauucauggugcucaugaggccauaaagagauguuggcauuauggaugguuguuagcuacccaauccucuagaagaauagacagugcucuuaaccacugauuauguuucuagcaucucucucccucucucucucucuuuuuuuuaaccuagaugcuagcaaccaacagaacugugugcaucccacagauguuagagucuuuaucuaugaacagcagcucugcaaucaggauggggaaacacugaaacaggauuaagaaaagagaugcuauaccaagcaaacuacuuguuuaagagucuggcuauuuaauagaguuuggcuuauucuuuccgauaucuuuuguuuccacaucaaucauuuggaaccaaaguuucacuuuaaaaccaagguauuuaguaacaaacccuauuuugcuacuuuucucuuagucuauccugaauucacuacugcccagggcuucaacauccaaagaaguugaugccagucugcucucaguggucucuuucccagccuuugcuguagaggacagccauuugguggagcucaccaaacaggagaucaucaccaagcuucagguauggccaugugugacuuucuucucuuuagggcugugacuugaaagggagauucuaggggccaugaguguaaacuuaugccaggaaccuccccucuuccuagguuacacucucauaaguauuuuuuuuguuuguuuguuuguuuuuacaaauugucaaaagcuucugcagucguuacaauuguaagugguauauccacuuaggaaaacaguugguauauucuuaggaauuuaaacauauauguaacaugugauccaacaaacauccuaucuauguacugagguuauccagaucuugauuuuuaaauaauagucuugauaaaugguugauuugaggaucaaacuagggaugauacaaaggauccugaagcaucugaaaauuuuagaagguaaaaacuucaaaaggauuuggguguggcuaggcuuggugggacaagccuuuaaucccagcaucugagaggcagcaucuguuaauucaacagcagccugcagagugaguuccuggacagccaggacaacacagagagucagaccaaccccaaaagaagacacuuaaugucaaauuucuucuugcuguagaagucaauuaacacagagacucauaacuggacaauguguagagagugagagccuuuguauugcucagcccuaaauaggaugguuuugucaaagcccuaagcacaugacccaggaaccuauguggaagaggacauagaaagaguuuaggagccagagaugaugagugacucaaagaaaacagugacaucuagacaugauaggacugauagacacaugagcucacagaaacugugacagcacacacaagaccugcacagguucaaaccagacaaaauccuagcauggagaagggaaacuagacacaaaauucacauccuucauaguuacaguuucuauugcugugacaaauaccaugcacaaaaagcaaguuggggagaaaaauguuuauuuggcuuacacuuccaaagcuguguucuucauugaaguaagccaggacaugaauucaagcagggcaggaauccggaggcaggagcugaugcagaggacauagaggaguacugcuugcuggacugauuugcauggcuuucucagcuugcuuucuuauagaacccaggaccacuagcucagugauggccccacccacaugggcuggucccucucuuauagaucacuaauugagaaaaugccuuacagcuggaucucauggaggcauuuccucaauggcuccuuccuuucuuaugacucuagcuugugucaaguugacacacaaaaccagccagcacacuguuguuaaacaagaagcuauuugcagcugguaucugcuaggaaaggaacaaucaauuuucuccaauggcgugacaggggauaucuucaucacacuccaaggcaggucccauacccaguguugggguuugggaauugacacuuaaacuaaauaaacauugaucucaguuaaguaagaauaguuuauugaacacacaccauaaaacuggacuuucaggaccucagaaggacucaggggccuaauuguaguauuagucugcucuucaggguagacuuuuuauaggaaaaacuagguuaaaaguucaaaaggcaaggaggggagcaguuggcuucuuagacaaaauaucaucagcuaaccuuuaaucugauugcuccugaguaagggaaggguggugguggauggguggugaacaagggaaucagagcauuaguauuguaaucauaacuuuuuggcuuaugaguaacauucuucagugucagccagaaaaaaaaccccacagugauacauagguguaggaagugcugccgguggccagcucugacuuaagauaguuuagauaucgaguucauauugaccuucaauuugauagguccuauguaaaacuuuguggaauuucuuaagauuagcaaaccacauacagaacauacagaauagacaggguaugugcucagcauguccuugagccaagucacuucuguguuacuaaccuguaggcauguuaaagcaacaagaugaaauagcuagcagguauggagcaaauggcuacagauauucuggggggagggaggucagaccauaacaccaggacaacacaaaauggaguuuuggggggguuuaguacuuauuauuuuauugcuuuuuaaaauuuuauuuugauguucuuuuuuguuuauuuuucuuucuuagagagacaacauaaaguuggguggguaaugaggagguagagaggaucugggaggaguugguggacagcaaagaaaaugaucaaaauauacuauauugaaaaaaaugcaccugaaaaacugcaagagccagaggaacagggaguuagcucuaagauucuguuuucuaggaauaucagaagcugcacuuauaaauucuuaccaacaugucugcuuaaacaugacccaaacccggggaaagccuacaaggccucuaagucacacaaagaacuacaagaaacuaaggaaugggaaaaacagaagaugucuucccuaaggaagagcaaaccaguaccaagugcucagcccugaaaacacucauauacaccauagagacugagcagguugaauuuauagauuuaagaauacauguuugugugugcuuguguauaauauguauguaaguaacaaugauuaaugaaaaaagagaccaugaauuugaaagagaucaaggaggaguguauggaagaguuuggaacaggaagggguauauuuauauuacuaucuaaagaaaagaaauuauuuuaaaaauaaaguaccaaaagauauuuguaaacauuaauuaucaaaguauuaaaacacauuauuaaaucaaauaaagagcagucuuuacccaauuugggggaaugauaaaaugaaaugaaaagauguguaacuuuacuuuuuucaaaccuuacuuuuaaugaugguuccuaaaugcuuuaaccucccuuguagcccaccauacaccagagggaaugggaaaaaaaggauacaggggaaguggaagggaccuaucaugcccccugaaagacccagcaagcagcugaaagagucagaugcagauaucugcacccaaccaauggacagaagcagcugaccccuguuguugaauuagggaaggcugaaagaaacugaggagaagggcaauccuguaggaggaccagcagucucaauuaaucuggacccccgagaucucucaaacacuagaucaccaaacagacagcauacaccagcugauaugaggcccccaaaacacauacaguagaggacuucugggucucuguucauucagagaugaugcaccuaacccucaagagacuggaggccccaggaaguuuagauggcaggugggguggagaguggggacauccacauagagacaggggguggggaggagguaugggguguggaacagucagaggguagauggguggcaauaaaaugugaaguguaaaagauaaauuaauuuaaaaaaaauaagaaauuaaaaaaaaagaaagguucuuugaagcaacuccagucuguguugucuggaaaucagcaguucauuucacagguuagcgggcaacuugaucugcuuguaaacacuucauggcuacaccagcaguccaguucacuagaguuggguuaacaaacaggaaucagcagugguagcauaaccuagcagagauagccaggccucagccucagcacaagucagcaggagggaccgggagggacagcaggagaaguucuccuugugccucucucagaagagagaucagugaagacucgaaacccagaagcauuguacagaaacacugcucuauaagcaagccaagcucagccucuauuacucuguagagacccauuuauacccuccaaauagcacgugccuucaaucagugaguccacagaaguggcaagaaacugccccacaccaacagauguuuuuuggugcauuucucucuauggaguucugacagaugcagcucaacuaugcagcagauggcagaccaauacaugcaugucuuuaacaaagaauucuucaucacauguccuuucauauacuugccuuagcagaacauccucucuccugugucugcuucagggaaauguccuucaggagucuggcuuagccuuucacaacuguguccucuuuagcaaaguguuccuucccguguuugcccauccaaccaacuuuccaaagaacccuucuguuuccacuucauagauuaauuacugauaaguaugagaagaaaagaaaguaaguagaagacagaaagaagucauucuggaauagaguggcccuucugacuuacacugugacuuauacauaacuuagaauugcugcaaaaaugagacaaacuuuuaggaaagagaaaggaauuuccaaacagcuuuaguagcuuugccacaacaauccucugccaaaucacagcccaaacaagaaauucuauuuccuuuuggugcucucuccuuuaccagcaaauauugcauuguuuaugugaaaacaagcaggcacacccauucgaucaguuauaaacagucaaauguagaauaaaauucuuuguuuuuaucauuaaauacuaaacagaaaaaagggauaguuaaagucgaggagccacagaaaccaacuggaaaggaacccugaugcacagagugaagacaauuaaaaaaaaccacuuauaacucaagucuuguaacucaaagaagaaaugaaguuaccucugagucuauacagagaacaauaaauauaguuacaagagugaaaguuauagugaagaaaucuaggaucugccacauuaaacaaaugauuagguuuaauaucaccauuaauaggacaagugcccugucaaacaucaacuagauucagcuagacuugccaggaacccccaggaauccucccauuccugucucuccagcauuggaaugauaagaacugccaccacaccuggcuuuccaccugggugcuggagaucugaacuuagguucuuacauuugcacagcaaacacauuacccacugggacaucucuugaguccuguaguguggggcuuuaaauuggauccuagaacagaauaauaaaggacaguggugggaaacccagugaaagcuaaauaggcuuuauaauuuaauuaauauuaguauauuguaacuauacuuuuggcuacuuuauuggguucuuauuccuauuccucuuuccaucccaaucccuuccaaaccccaacacuagguaggugagaaagaagguuagagggaaaggggcuguagaucucuuuagacuacuuccugccgguuaggaguuccuaggggcaagucaaauuuccuuugucaggauauccaacuagcaauccagcaaaacagcaaaagaggcagaggcagauggagcagcaggagcagcagccucugagggcucugccauuuuuaauacucucuuaggagcugcauuacuauggaguagacugugcaguaauuagcuuguugcagguuuggccugagguggacagccauggaaaagauacugcuggcaaugcugcuuugaagaagaaccuauaacaacacauuucuugcuugaaaggguauugcuggugcugcugagcugucuuugaauacuaugcauuugugagauguugauacauaaagauguucgagaauauuucuucuuaauuauagagucacacagauguacaagauucagggccuuuuucucuguccccagggucguuaugguugcugucguuuucugcgagauggauauaaaacuccuaaagagguauguuucuuuucaccacagggaaauaggguggaauuguucuuacucuuuguagcuuuauucagagauaacaguuacgucauugauggaauuuuugcagaucauuaaaaaauaauaagugauguuugcuguauuuguugggcuuugcugccaaguucuaacauugaugguaaauaaacuaacaguaaaaugucaaaaaaauaaauauaaaaaggaaaggcauucuuuucuuucagcugguuaguguaaacacaaguuuuaaacacaaacaguguuuacauaaucuccaacccccacuccaauauuuaaucaauacaaauggaaaggcaucuuuucaucaguacaucuuuuuaacuaccugucauaguccauuuucuguuaucagugacaaaguaccaaaaacugaguauagcucagugcuuugagggucgcaauucuauuggcacaaaaugaagggguccacaucugaugauugccuucuuacugacagagucccaagugugguucaaguaccuuauggcaaaagauaggaaucacuagugcgccucuucuggucucucuccugacaaaaccagggauuuagucuccacucuaauggccucauugaauccugaaugcugcuuuggggaagaaccuauaacacacuucuugcuugagugaauauugcugcuacugcugagcuguuuuugaguacuaugucuguguuggugagagauugauagauguggaugucugaggauuugguucugcuuaauuacagauuaguuuaucaauggaccucauuauccccaaacuaguaguuagaaguugcuucauagagcacuugccaggggaggggaguaugaguauguacuuacugccuuuccugaugcugucuuugaaacaaauaggcugcuguaaaacuccuauuauaauaccucuaaacuaaggauauacgucuaaucucugagugacaggacagccuuugucuauuauauuuuuauucaggaucccaaucgccuauacuaugaaccagcugagcugaagcuauuugaaaacauugagugcgaauggccauuguucuggacauacuuuauccuugaugggaucuucaguggcaacguagaacagguaaugaucugggagaagagcucuuagcaagcugcucuuguauugucuuuugacuaauggcuguauguuuuuacugacuaagugggagucuuccuaugagggaagagauggaguugucuccuagauacuuauagcugauaguagugaauuaagaguugggagacucagauuguucuuuucuucaauccugaccauugaguaauccaaguauagucauuaaguucuucaguuucagugucucuguaggugaggaaacauuuuauuuuucauuaaagauuaucaaguaaggauguuaaaauagguacaccaauguaacuauaagcugaugucgucuggaaacuuaacucuuucuuacuguuuuguacuaauaagugcugguuucuuauuuuguaaugcuuacuauuugugcuuuaauaagcacuggcuucuuacuauuuguguuuuaauaagugccgguuucuuacucuguaacuuacuauuugugcuuucauaaguguugguuucuuacucuaccucuguugcuuaaggaccucucucuggccaggcaagaggcuucgauucauuuaacucuucaugaaccaggaagaaaagaaagaaaaucuuuuacauaggcaauaugcacagauacacaugcacucauacacacacaaauuuuggucgggcccaaccacaugucccaucagcuucauaaguauucauacauacacacauaccuacacauauauguaaauaaauauauauaggcaaacagauauauguacauuugaauggauggggcagagcccaccaagcuaccaccuuauuucuucucucuggccuauuuauaucuuuuuagacaaaaguucuuuagaaaauuaccucauagauaaaauguuacaaaaaagaggaguuacagaaggacauugaaagucaguacaaaggaguguuuucaaucucuaucguuuguuuguuuguuuguuuuuugguuuuuugagacaggguuucucuguauagcccuggcuguccuggaacucacucuguagaccaggcuggccucgaacucaaagauccaccugccucugccucccaagugcugggauuaaaggcaugcaccaccaccgccaggcuuuuuuuauuuuauuuauuuuuuauuuuuuuaaaucucuaucauuauaaguuccaagcaacaguuucacauggucucacuuuaucauaguauacaccuguggcuucaucuuucaaucugaccuagaaugaauguuuuucuuugguuacaaauuugucccaagcccauuucucucuuuaguguacuugugaaagcucauuguauucuuuauuauguauccuuuacuuacuauuuuaugaggaguggguauuuuuuauucuuaauucuaacuuuauuauaucuuuuuggcaaagcaauuaaaauaaucucuuaaaccuuucuuccuaaaauuauuuuaaucaaauuagaaauucuauaaaagcauuaauucgucuagaaagcauuaauucaugaaacuuuauuuuuauguugauaugcaggaaaucugcucaauagguggaauucuaggaauccuuaggcuauguaauaaugacaggagaggcauaucaguagcaagaagcaauccuggaaugaagucuccaacgacccugcucacucauucuuaaagcucacccaucauaggccauacagaaaugugagccaccuucaggaaacucaccugcuagccuuaaccuauccucaauggauccggacaggagaaaaagaagguuggagaagaaagagaacauauaucucuuuagacuacuuccugcugauuagggauauuaacuucauuaggacaagucaaaucuuuguagucaggauaucuccaacuuguuccggucucucugcuguuuuuaauuagguauuuucuucauuuacauuuccaaugcuaucccaaaaguccccccauaccuucccccccccacuacccuucccccuacucccacuucuugacccuggcguuccccuguacugaggcauauaaaguuugcaagaccaaugggccucucuuuccaaugauggacgacuaggccaucuucugauacauaugcagcuagagauacaagcucugggggaguacuguuugguucauauuguuguuccaccuauaagguugcagaccccuuuagcuccuugggugcuuucucuagcuccuccauugggggaccuguguuccauccaauagcugacugugagcauccaauucuguauuugccaggcacuggcauagccucacaagaggcagcuauaucuggguccuuucagcaaaaucuugcuaguguauacaauggugucagcguuuggaggcugauuaugggguggaucccuggauauggcagucuuuacgugguccauccuuucaucucagcuccaaacuuugucuuuguaacuccuuccauggguguuuuguucucaauucuaagaaggggcaaaguguccacaauuuggucuucguucuucuugaguuucauguguuuugcagauuguaucuuguaucuugaguauuccaaguuuaugggcuaauauccacuuaucagugaguacauaucaugugaguucuuuuauaauuggguuaccucacucaggaugaugcccuccaggucggguccaacagagugguuguaaaagcuugcaaucccaccaacaauggaggaguguuccucuuucuccacauccuugccagcaucugcugucaccauuugccuaggaauuucauaaauucauucauuuuaauagcugaguaguacuccauuguguaaauguaccacauuucuguauccauuccucuguugaggggcaucuggguucuuuccagcuucuggcuauuaaauaaggcugcuaugaacauaguggagcauguggccuucuuacaaguuggaacaucuucuggauauaugcccaggggagguauugcuggauccucuaguaguacuauguccaauuuucugagaaacugccagacugauuuccagagugguuguaaaagcuugcaaucccaccaacaauggaggaguguuccucuuucuccacauccuugccagcaucugcugucaccugaauuuuuuaucuuagccauucugacuggugagagguggaaucucgggguugcuuugauuugcauuucccugaugauuaaggauguugaacauuuuuucagguacuucucagccauucgguauuccucaggugagaauucuuuguuuagcucugagcuccauuuuuaaugggguuauuugauuuacugggguccagcuucuugagugcuuuguauauauuggauauuaguccccuauuugauuuaggauagguaaagauccuuuaccaaucuguugguggccuuuuugucuuauugauagugucuuuugccuuacagaagcuuugcaauuuuaugaggucccauuugucgauucucgaucuuacauacagcacaagccauugcuguucuauucaggaauuuuuccccuaagcccauaucuucgaggcuuuuccccacuuucuccucuauaaguuucacugucucugguuuuauguggaguuccuugauccacuuagauuugaacuuaguacaaggagauaggaauggaucaauucgcauacuucuacaugauaacugccaguuuggcuggguauaguagccugggcuggcauuuguguugucuuagugucuguauaacaucuguccaggaucuucuggcuuucauagucucuggugaaaauucugguguaauucugauagcccuaccuuuauauguuacuugacccuuuucccuuacugcuuuuaauauucaaucuuuauuuaguguauuuguuguucugauuauuauguguugggaggaauuucuuuucugguccagucuauuuggaguucuguaggcuucuuguaaguucaugggcaucucuuucuuuaguuuucuucuauaauuuuguugaagauauuuauuagcccuuuguugaaauuuuucauucucaucuacuccuauuauccauagguuuggucuucucauuguauccuggauuuccuggauguuuugaguuaggaucuuuuugcauuuugcauuuucuaugauuguugugcugauguucucuauggaaucuucugcaccugagauucucucuuuugucucuuguauucuuuugcugaugcucacaucuaugguuccagaucuuuccuaguuuuucucucuccaguguugccucacuuuggguuuucuuuauugugucuucuucccuuuuuaggucuaguauuguuuuguucauuuccaucaccugguuggauguguuuuccuguuuuucuuuacggacuucuaccuguuugguuguguuuuccuauuuuucuuuaaggauuuguaacucuuuagcaguguucuccuguauuucuuuaagugaguuauuaaaguucuucuugauguccucuaucaucaucaugagauaugcuuuuaaauccgggucuagcuuuucggguguguuggggugcccaggucuggcugaggugggagugcugcguucugaugauggugaguagucuugguuucuguuaguaagauucuuacguuugccuuucgccaucugguauucgcuggaguuaguuguuauaguugucucugguuagauagagauuguuccucucaugauucuguuagccucuaucagcagaccugggagacuagcucuauccucugaguuucaguggucagaggacucucugcaggcaagcucuccucuuacagggaaggugcacagauaucuggcauucggaccucccuccuggcagaagaugaaggccagaaacgggaccugucccagaagcuguguugcuuuggccugucacagaagcuguuagcuucuguaguccacacucucaccugcacagacuagucucagagggauccgggaaucaagauggcucccccaggugcucuggcaaagcccuccuaggcagggcggacaccucuccucuggcagggaaggugccuggaugucuagagccugaaacggggucugucucagaagcuguccucuagggaccuugguguuguccgccgacucagugcccaaggugaccaggugcuggcaccuaccagaagggacuugugacccuggucagguuggguuuccugcuuuccuaaugcugucucaggucccacgcgauuggauuggaacagaaguuguguuccacucacuggugguccuaagaucauguggagaguccucuagggaaccuuggggguguccaccuacuccgcgcccaaggugacccggugcuggcgccuaccagaagggacuugugacccuggucaagccggguuuccugcuuuccuaaugcugucucaggucccaggcgauuggauuggaacagaaguuguguuccauucaccggugguccuaagauugccuggagaguccucuaggggaccuugggugucugccgacucugcgcccaaggugacccagugcuggugucaacuggaaggacuugugacccugccugaucucucuguuuacaaaacuuugacaaacugcaacaacagcagucaggagcagcagcugccucagagugucccaggccaucucagaacucuggcauuuauauccucugaagaguccccagaauuccaaauguaaacuaucugcagcuggcaaaaccaugucacugcuaaugcaugaggcaaaucauaaucacucgugaagcagccacuucucccacaccugggauuaaaacaaaaacauauucauggaacauaaauaaccagguuuuugaagaaaccaaaacucccacuuacauuucccccauuuaguccaaaauggcuuuuuucuaacaucaauaaacuauaugcaauaagaacaauuaugagaacuaucaaguaagaauuuuguuuacaauguccagucuauauguauuuggcagucuugaagaaagcacugcacuaucuauccuauccuauugagucuaaaguuuugaaucuaaauuacuuucauaaauuucuucuaucaaacuauaaacaucuuuuuaaaccuuaaagcauuuccuuagauucuaaacaacuuaagcuuuucuguguuuaaucuuuaauaaggaagauuguaagacuguuaacuauauagucuucaacccugucagcgaccugaguaagcaggaaguuccaagcaagcagcuuccaaaacuguagagguucuucaugcccaacauuuucuuugaagaagauuggggggugcuuccaggagcagauguguugcucugugaaaaaaacccuuuuauuauuaaaaaaucuuuuuauuauuaaaccaacuuaaaugccauauucucuagaucucugaaguguuugcagaccaccuauuuaucccaguauaucuuaauagccaaacauuauuugcuucuagcuauuuacucucuguuuaacuuugaaaacauauacaagacuaaauaaagcuuauuucuguaauuaacugaacuaguaccuaacaagacaacaaaguaagauuauuuauaggugacuaacuacuuacuaacuuacauuucuaauuauccuaaacaguuugcaauaguagcuguuauaagacuagaacuuuacauuacauuuuuaagugaguuguauauguacaauacauuaagcaagauuugaacaaaauaagcuuaaauuucuaacaacaauacaauaauucauaucaauguaaaauacuugagaguaguagauuuaguaauguaccuuuuauccugucauacuguacuucuugcugcugagccuugagcuggggccacaaagcaaaauauuaauagcaaaauauuauauaguauaucccuccuggcuguaacaaaaggauggaccaucuagagacugccauauccggggauccaucucauaaucagcuuccaaacacugacaccauugcauacacuagcaagauuuugcugaaaggacccagauagagcugucucuugugagacuaugcuggugccuagcaaacacagaaguggaugcucagagucagcuauuggauggaucacagggcccccaauggaggagcuaaagggaucugcaacccuauagguggaacaacaauaugaacuaaccaguaccccgaagcucuugacucuagcuacauauguaucaaaagauggccuagucggccaucacuggaaagagaggcccauuggacauacaaacuuuaucugccucaguacaggggaacgacagggccaagaagugggaguggggggggggcgugugggggacuuuugggauagcauuggaaauguaaauaaaauaaauacccaauuaaaaaaaaaguauaucccuccugucccugcacucacuuguucagugggaagcaucuacaaacucugggaagccucagcuuucuuacugaggacacauugcucccagaaagggcucauuagugucuguggacaaaguacucuguuucucagaguuaauacacaggcuauuuugaucucugagacuuuuagcggcuugguuacaguuucuuuucaaaugaccaaauuuaccacaguugaagcacugggaaggguagugguaguaaucucauaaccccagacugccgcucuggugcaguugguuagaaagauaagcacuggagaagccaggaaaaguuaaacacacagcuggagucuccuaagggagaagauauuuggcuguucucccagaagugcuggggaaaaauguaguuuacagccugguaauccuuugguaccuguugagccagucuccucccauaucacccaggauauuaugcuuguuuaucccagacuccuaaauccuugagcauuacuucuuggccauaaaacuuaccauugugagagaugucauuuguaauuuauaacaagcucaguaacuuuuguguuguauuauguucauuuccauuacucuccuuagacccuuauccugagcauuguuucugaagucaagaagaagucaucuuacagauaaagcccuauguaugcccuuuguaaagaacuucagugugaacacgucuuaagcuuuuaaacccuguauucacagggcugaguuaauuguuauuugauuuuuuccaaaauagagcuguauuuaaauauggcuaaaguaaaaugaacugggucagacucgagaaguccugggccaggacugguuaccaaaauugggcugauccuaguuucauucuuacuuuacccugaucauuuuucacugcuugccuuaaagccucuaggaaccccuccacaauacucaaaccaugccccaaucuauuaaacacauuuggacaaauuugugacuuugucaauauccuauuuauaccaugaagcagcuuggaugaagcuauuguguuaaagaacuauguaauauguuuucugccauaaauuauagguguguguuguguguguucauuuuuguuuuacuucuuuugagcccaaggccuuguguauguauauacuaggcccacugagcuguauccugacccuucccuuuuauauaguuuaauguauuauuauguuucagcaaaugcuaaguaaauaacauaauccuaacauaauaaauaacauaacagcagccaaaucuagagaggagagaugacagggguaaugggaagguauuuauaaucaaaguauagugacauauacauaugaaaugucauaacaaauuccauuauuuuauauacuaauuaacaaaaguaauucauaaaaauguagguuuaaaauccuagucaauggucuggagagauuucucagugguuauaaacauuugcugcucuugcagaugaccaaaguucagaucccagcacccacaucagaaagcucagaaccaguuccaggggauacuaggccuucuucugaccucagcaggugugugcacaugcacaugugcauauacaugcaaacacaaacacacacucagauggauauacaugcauaaauaaaaauaaaacuuaaaaagaaaugaaguaugagccaaguuaaggacuugugagauagcuccaugauuaagaagagcacauaaugguuuuccagaagacccaagucuaauucucagcaaacuuugucauaagguucacaacacuuguaggugguacagucacgccuccaaggguacauguucauauacucacacaaaaacacauaugcauacauauuauuuuuaaaaaaauaauuuuuaccauggauaguggcacauauccuuaauccuaauacauggaaggcagaagcagacagaucucugagucuaaggccagccuggucuacagcaugaauuccagaacaggcagagcuacauaguaugacccuguuuucaaaacaaaacaaaagcaaacaaaaagcaucauuuacaaguauuuuuaauugaaauagaauuguaccacauuccccacguccuuuccuucuucauaccccucccagcuucugucuuucaagccucacccaacuucucucaaguugauaccuucuuuaaaacaauacauguuuacagacaaaagucagggggcuggagagauggcugcucuuccagaggaccuguguucaauuuccagcacccacauggcagcucacaacuaucuguaacuccaguuccaggagaucugacaugcccuacacagacauacaugcaagcaagacaccaaugcacauaaaaaauaaaauguaucauuaaaauuuuuaauucaaaaauucuuaguaaauuaagugcuuauuaguaaacuacagguuuggaaccucuuuaaacauaauccuuauguugauggacuucaauugcaaauaccuacuacaaugaaaugcauauuaaaugcauuaaaauaugcacaauuuccaugauacauuuaaugaguaccuaccuuaguuaggaugcuacugcugugaaaaaaccccaugccuaaugcagcuuggggaggaaaggguuuauuuccauauccugaauuacagugcauggagggaagccaaggcaggaacucaaacccauuaggaaccuggaggcaggcgcugaugcagaggccauagaggaguacugcuuacuggcuugcuccucaugccuugcucagccuguuuucucauagaaccagaguaagggaucuuggaaucaggacagaacacacccagacaccaaauuuuucgcacaaaggaacaguuugugcaggagugguuuauaaagagagaaaaggggaagccaguguucggaugaguuggugugcccugauuggacauguuagccaguauagccaaauaauagaauuugauuguuggaccuugucauuuugacucuugaaccuuggugaucagucucaggaaugagucagugacuaaauaagggaauguacauugggagcuagcuuucggaaaguaaucuaacaguuuagcaagagagaggguaaggggaaggcgaggccugccagugucaugguugcaaugcuugagccuguuaaaaagcuauuuacccaggaccacuagcccagggauggcaccacuugcaaugggcugggcuuucccccaucaaucgcugacuaagaaagugcuuuacaggcuugccugcagccuaaucuuauggaggcauuuuuauuuuccacugagggccccuccucucagaugauucuaguguguaucaaguugacacaguaccauucucccuuuccuuuccuuuuuacuugguuaaauaagcucuguuguaauugugcuuuuuuuuucuuuauccuucugcucugauucccauauaaagucucuaaaauuuugguuuucuacuuuucuuuucuuuuucugcagguucaagaauauagagaggcucuugaugcaguccucaucaagggcaaaaauggagucccucuucuuccagagcuguacagugucccuccugacagggugaguuggauagugcuggaccauugacgggaaaggaaccauguuucuaugauacugacucaucugagucacgguguuugugacuuuguaucuugggacuuuaauauucuaagguuuugguuuucacaguaggacaacagaaacaauuuccuucagaaauaaauuguuaaaacagucucaauuauggugcuguuguacaaugagauguaaaugaaagcagauauaaauucugagaaugauguacagaucaguauguggaaccagagugguguuccgugucagcuuguuaucuucugaagccaguaaucuuaagauggcugguguaaaucagacuuagaaaaaucagacuucgccauugugaaggagaauuagacaugguagcaauacagccuuacauucugguggggauuuggagaacauuugcuaacagcauccagugucaccugagaauuuauuacaaaaacuuucauccacaccuaccguaccuauucagucugcauuuucauaagauuuuugggugaucuguucauauaucacaucuugaacacuguccuacuuagcuuuucaauccauugccuauaaacuauaaaucaaacuagacgccagucuuuuaucgucuagugucuuaagcuuuccaguauugccucucauuugaccucuuuaucucgucauuuagguugaugaagaguaucaaaauccccacacuguggaucgagucccuaugggaaaauugccucacauguggggucagucucuauacauuuuaggaagcuugauggcagagguaagggaagauuucaaagcuaucccaccuuuuauugguuuguuuaccauagucacuauaauaaucagauuugcaaugagcugaagucaaaggauuucuucauccuuuuauacuuugacuuaauuacagccuuuccucuagcuugucugcaugggcuauggccauugcuugacaaaaaguucuugcucccugucuguuaugcugcccauagcucccuacuugggcauuguacuuggugcuguucaggaaucaaguugugcaucuuucccuuucaaaacuccccuaggugacuugccuggugacuaagcaauuacuggugauagauuaaaugccaaccuuccuaagcaucauaagauuuuauucccuaauugaauuaagugaucauucggggcacuuugacuugcuugguaauaacaauguggucuuucuguuuuguuaguuaauggguuuuuguuguucuuauuguguuuuuguuuguuuguuuuuguuuuuuacuuuuuggaauggaacuuccaaugucaaacucuguuaagacagcucuuaaugaagcacaauuuuguauccaguuucuggggguugcauuuugagccuacacagaaggcuauuucuucuaaaaaaguuuucuaguccuuucugaaaacucuauuuucaacacuguagguuauguuuaagagccaaggucuuacuauguagcaguaguagcuggucuugaacuugccacauagaccaggcuggccuugaacuugcagugauucuucuguguuuguuuccugaguucugggauuacaaguguguucuaucaugccuagcauggcuguuuugaugugagagacccaaguucuuagagaaucuaguuuggaacuuagcuggcauuucugaguaagauauuuuccuguuuauauggccauuuauuuucuacagcuguguuuuuguuuuguuuuguuuuguuuuuucccuguggccauggcuguuugauaaucuugaauugacaugacuuuggauuuagcaauaaugggcauaaugcuucaaaguaauccguguccaguaacuuucuugucugacaauaaaugaaaugggacaaaaaggaaggauucaguauuaucaaggaaaaagaugagugagcucauuuuauuuaacaacauauggaaacuaaguaaaaagauuuccacuaaucaaaauguacagcgggcacauggacaaacaagcaaacagugcuuacuaucaauuuuuaaaaauauuuuuuauuauuacguauuuuccucaauuacauuuagaaugcuaucccaaaagucccccauacccucccccccacuccccuacccacccauucccauuuuuuggcccugguguuucccuguacuggggcauauaaaguuugcauguccaaugggccucucuuuccagugauggccaacuaggccaucuuuugauacauaugcagcuagagucaagagcuccggguuacugguuaguucauaauguuguugcaccuacaggguugcagaucucuuuagcuccuuggauacuuucucuagcuccuccauugggggcccugugauccauccaauagcugacugugagcauccacuucuguguuugcuaggcccuggccuagucucacaagagacagcuauaucaggguccuuucagcaaaaucuugcuaguguaugcaauggugucagcguuuggaaacugauuaugggauggaucucuggauauggcagucucuagaugguccauucuuuugucucagcuccaaacuuugucucuguaaccccuuccgugggugauuguuucuaauucuaagaaggggcaaaguguccacacuuuggucuucauucuucuucaguuacauguguuuugcaaauuguaucuuauaucucggguauacuaaguuucugggcuaauauccacuuaucagugaguacauaucauuugaauucuuuugugauuguguuaccucacucaggaugaugcccuccagguccauucauuugcuuaggaauuucauaaauucauucuuuuuaauaguugagugguacuccauuguguaaauguaccacauuuuuuuguauccauuccucuguugaggggcaucuggguucuuuccagcuucuggcuauuauaaauaaggcugcuaugaacauaguggagcaugcguccuucuuaccgguugggacaucuucuggauauaugcccaggauuuaacauauuuugagaauuccauguaugugugcugcuuuuauauuauuuucacuucuugcuccuuuucacauacagagacugccaaguccauuuagugguacuuauauguguauuuaggauugaccacuugggacuggauacccugucagggggcucauuccuggagaagacugguucucccugucucagcagccauuaauugccuauagaucuuugucuagagucccugagauuuuucuccauucauguugccaugucuauugguggugucauuguggaggccuuacuuaggugaccgugguuuuuaaacuuucaugcauguaugcagcuucccugucauauauaggaaguacaauauauugcagcagaaguccugguccccuagcucucaaaauccuuccacuugcucuuccauuauguucccugagccuuagguauagggguaaugugcauuuugucuauagggguuggguaccccaaagucauuuguucucugcauuuuaaccacuugugguuuucuguaauggucucugucugcugcaaagaaaagcuucuuugaugaguggugagagcuacauguaccugugcggauaaggauggguacuuagaauccaguuaggaauuaauacugguucaggaaaguggcaguaguagguucuccucuaaguucgugaccccaacagccaaggguaauuggcuagguuuccaguauuagacauggguuccuuccuauugaguaguccaauucgacaaccauugguugccucuaugagauaaguacaaauauuggacccuuggggcuaucuuaccauacuggucguaauugugguucauagguuucaaaacuggccaggacuauugauuguuuuccucccuuggcaguuuguuuagcacuuuuggucguuagaaggcuaauuaugagguaggaagcuuucuggucaguuccagcuuaauuccuuccaguccugugucuaaggauauggugucuucagcuauuagaucucaccuuaaaguucugugaggcaaccaaggaaaauagcaguagccuacauuuauacuguggagccucuaucucucucucugucugucucugucuguaucugucucugucugucugucugucugucugucugucucucucucucucucauucucucucucucugcuuaaagaaauauaaaauguuucccuuuggcucuuccaaacauguuuaguauuauuuaucccuuugccauccuucucccuuuccaguuaaaucuccacccccuauuuuucccauuucccucuuuuuaaaaaacauuacauuagguuguuuuucccucauuuaucuguuaugccauauaaacauauccagaaaagauaguggaauaaccagaaacuuccuauuuauuuauaauuuauaaccugcuuuucuucuaaaaaauaaggauuuguggcacccacuaaauauaaaccagacaaaauuaauuuggagaugaauucuggguuuucaagcauuuuuauacagagcaacuguuugucuuuugucauuucccccuaaaauacuaacuuuacuuuuuuuuuaacuauuuuuaaauuuuauuuuauuauuauuuuuauuugcuuacucuauguguggaugcuuuuuauacuauguaccauauguguauagugccuguggagggagaagaggcaucagcuuaccuaaaacugguauuagacaguugugagcuuccaggugggugcugggaauggaacucaggucuucuggaaugccagucuacauacagggugcuaucugaggggauccaggaggcucuggcccagccacagcagccagaggguuacagcucucugacaggaagccagaguguggugggcugcugggccucuucuguggccacagcuucccuggaguuggugacagacaguggaauacagcagacaucuaggggccaaggucagggccaccaagcuuguggaaguggcuguggucagguucacacaccugucugguugggcuaugucgagguccagcuuugggagggaaagcuuuucccuggaguguuauagcuugauaaaagaggcacucucagaugaucuuuauucccuguagauaggaacuuauaaaccuuuggggguagguugggaucuagaggcagaugcuuucuaguggcuugguuugagauauuaggaaugccucaucugcuuguggaaggacuucagguauugucccuuaugugacugauugugaugguccucucaauggggugucaugguuauguaugccaggacaggaacccggucaggaauauauuuaaaugccuacuaaacauguacuguucucaaugaugagaauugcagggguuucugaauaugcucugccuuacuuacauaguccacugccccacacuggaagagcagccaguguucuuaacugcagggccaucucuccagugccccagcuuuauuuuugaggcuuauuaauuuuguuuuuauggauuuccuucagggauuuuuagcuccuggagaaauugauccccugaaucguagguuuucuacugugccaaagccagauguggugguucaagguauguauuacucuuagcaacagaaauauuguacuaaaggucugauuaggcaaagagauuugggggcuuuguguugggcuucaagucuguaacaaauuugguuuaguuugguuucaaaauugcuguuaauaauaaaucaaugaaagaugaucucagaggauuguaaaauucuuuuugacauaccucauuucugggaauuauuuucucuaaaauuccaugacauuuuauuccacugguuacuguuacauucuuuuaaaucacauuuucugagcuuuugcugcuaguauaccuuucuuuucauaaccuccuaugcauuaacauccugccugcauuaggcuguuaaggccuguuucccucauaguacauuuguuucuaaucauuacuuacuaggaaguauaucuaaaaguuuucuguuaagaauuaacuuaaaugugagaguaucuacaguaugcaaacacugaacugaguucucuaaauauuaagaauccaaguagggcuggagagauggcccagcuguuaaaggcuaggcucaucaccaaaaauauaagaauccaagccuuuggcuggguguaguaguacauguguuuaaucccagcagugggaagccagaggcaggcagaucacugaauucaauuuuagcuucuuuuauaucaggaguucaaggcuaggguuucuauugcuuucaagagacaccaugcuaucuacuauuuuuauccuuaauauuuuuaaauauccacgacgcuaguacccucuaauuagggcuggcuuacacuucagagguuuaguccauuauuguuaugaugggaagcauggcagcaugcaggcagacaggaugcuagagagguagcugagaauucuacauccagaucagcagacaacaggaagacagagagacugggucugacuuaagcuucugaaaccuccaagccuaccuccagugauacauuucuuccaacaaggccacacauccaaauccuaucaaauaaugccaugcuuuacaaaccuaugggagccauuuucacuuaaacuaucacagagauccugucugaaaaaauuccuagucagaauuucaaugaaugaacucuguguuaaacacaaaaaacacaaagcuggucucuuuccuaucuauccuucuuacuucccccaaaguuguugauauuuuuaccuuccuuguuucuuucaauauuuccauuauccugguuuuugguuuuagacaucuugaugugaauuuucauucaacaucacucuucaauauggugucaaguucuacuauaaaaauucuuuaagauauuccuagucauuuggauuuuugauucuguauggaaaaucagccuauuuucuaaagcugcuuauacuugauucucugugugauaauauagguggucuuugcuucuuguugcuacuagcaaugagaaacuauuguucuucaucccccauaagaaggcauguuuuccucugagguuuaaacguucuugcuaugcugaucuucuauuuguucuaauucauauauuuaugacuuugaagcucaacucacagucuucuuucuccucccaaaauucugucauaaaacuagauuucagcauugguguaggugauagcuacuauuuuuacccuuaauauuuuuaaauauucaugacacuaguacccuuuuucuguaucucuagguuacauaccaugucuugguuacuuuucuauugcugugacaaaacaccaugauaauuuggggcuugcaguuccagagguuagagaccauggccaagaugacagggagcauggcaacaggcaagcaugaugcugaagcaguagcugagggcuuacauccuuaucugcaguuaggagacagacagagagacagagagaggggagagagagagacagagacagagagggggagaggagagagagaauaugaacuaacugggaacaauguggacuuuugcuaccuccacugacacgcuuccucugaggaggccacaucucuuaauccuucccuccagcugaggacuaagcacuuaaauaaaggcuauaggggcccuugucauucaaaacuccacacaaaccaugggucaaacuuuuggaccuuauaggugugucauucuuguguucugcuaacaauggaucauggcuuuucccuccuuccuauuuguuucugauuccuccuagucuauucuuuucuaccucauguuugaucaucugaauaucccauucaccauugcaucauauuguuucucuaucuaccagaacuauuauaguucaagcuuaauuguauaggcuccacuuucugauccuaaaccuacuaaaaagcaugauggggaaaaauacaugagaagcagagugguggcaguggguguccauagucuccaacucagcuucccaguagauuuuguucuuauuauuagacagcauuuucauauuuuucagcuaugcccuuuguuuucagccuauuauucagacugcuauuucaugccagaucauuuucauauucugaugucuuuuaguuuaccaacucucccaccccaauaaucuuacccauacauacuugcuuccuuuucuuucuccuauucaagacgaauuccccuauugguacuugauccuauaaucuucuuuacaaauaaucuguuuugaaauauucagauuuccccauuucaguuucuuuaucuauuguuauauuaaucuccaucuggauuucagagguggcuuguuuucacauucauguuucugccucuuuauaauccauuaauucuccaguucguuauagugugguuuaauacucaaauacucuugcuuaguuuucagaggccuuggcauugucagucuuagauauuuuauaaucaguauauuagcagauuuuuuagaucaacuugucauauaucuuucuagaaacuuaauuucuacaauguucaugaugauauauguauuuguagaucuucuucaaucuauuugaaguacuuuucuaccuuauucuuggcuuucucuuuuauuucccuugagcuguugguauuccugagaguucuguccauagccuaucauuugucuuguucugaauaaugggucacguucccgaaucucauuucaaacccuuucucuuuucccucacccccacaugaugaccccauguucucugccauagaaaaaaauaagacaugauacaagaacuucccccuugucccaggcuuauccuuaucaaucuauuccugaguuuucucaaagugauauuccacauccucuuuucuugacuuuauauucucuucccaucucaucuguuucuaaugacuucugacuugaaugugucuaugcacuguagacucaacuaaaacagaucagcuggauccuccuaauauaccagcuaauccugcuaucccuucugugucuguaucauuaaauacucccagcacagggaaaugaacacccaaagaacaccuuucaauuccuauuuauuccucucugauuuccuguguuuauauaacaaguucuggcuccuuuacuucccaagucacucuaaaauccauccuguuuugacagugucaguagcgugauuguaauguaagcuaucaacacgcacacccccccuuacuucacugcuuuccuuuugaacugauauuucugucuccagucuaggcccaauacagucagggaguuucuuauuuuguuuuuuaaaaaucacuguugccuacacaaagaaacguccauucauucuuuaauuauuaacuugaguguacucuuuuuaagaugcaacauggguauauuauuccucugcaggaacuuccuauuucaguucuuuugacauggcuuacaaagacucuuuguaguuuacucuauuucucuuuacugcuccuucacagucauuauuccuacuacaaagaacuugguuuacaggcugaggguguagcuuagugguacaagugacuggcuguuugugaaggccuggcuccauuccccagcacaacaggaagcaaagcagugaaagccaacuuuguaacuuuguucaugcugugucucuuaucugaaacagauucucuuuuacucuuaccaucaccucuaucagauuaacuucuuucugcccuccaucaggacucauuuuguccauuauguaccccuugcaucugacaucaaacucucaguauuuuauaaauauaaacaaaaauuuaguugcuuggguugaauguacucccggaaacucaaagggcuguuuaccuugauucuccuuuaguccauuuuacuccuguaaccaacuuauugcucccuguagaacccuuaaguuuuauagaaugcagcuugggaaacaaugcccaacaauaauauacaaaaccuuaaaguaacaccuauccuuccaugaugagcuaauaacccugucuaccuuuucacuuucauuuauuuuacugcuuaguaaaaucaugccauaacauugaagcuuauauaguuugcugcugccuccccaaccuuuagacuagaauaacuauccucuugugauuuaauuuuuuuaaaaaagcauaucaguaaggcccauuggacacgcaaacuuuauaugccccaguacaggggaacgccagggccaaaaagggggaguggguggguaggggaguggggguggguggguaugggggacuuuugguauagcauuggaaauguaaaugagguaaauaccuaauaaaaauggaaaaaaaaaguaaaaaaaaaaaagcauaucagcauuuugcuugcaugugucuuuguguggcaagugagugucuggugccuauggaggccagaagaaggcauuggauccucucuucauuacgguuuacauuaugaccaaggcaacucauaaacaacaacauuuaacuggggcugacuaacagauucagagguucaguccauuaucaucaaagugggagcauggcagugcccaggcagacgugggacugauggagcugagaguucuauaucuucaucgaaagauagacaggagaagacuagcuuccaggcagcuaggaggagugucucgaagcccacccacacaaugacacacuucuuccaacaaggccacaccucuuaauacucucugggccaagcauauuucaacuaccacauuuccucuggaacuggauuuaaagaauuuugugagccaccauguagguacuggaaacugaaccuggguccucuggaugagaagcuccucuuaacugauagugaguugucucuccagcacuccauucaccuuuccaauuuacucaugauuucaagugcaguuagcuaccagcucuuucaggcuacuuuauuuuacuugauuuuuuaaaauuuaauaauauaguuguuuuauuugaauauacaucugagcaccaacauguguuucuggugcccucaaauggcauuggauccccuggaaauggaguuauagauggaguuauaagccauauguacagaaagauauugguaacugaaucuggguccucuagaaaagcagccagugcucuuaacuacugagccaucucuucugcccccaagucuaccuuucuugaagccaaccuuccuaacuccagacuagguaaaugccacuucuauguggucucaugauauucuauacauaucuccauuuaccuaggaggucauuuucuauugaauucauaugccccucuaccauaacacuaagagauucuuacaggagaaacuacuuuauucaucucuauaucucuaguaccuuaaccaccaucccugcaaacccacaacugucaggccuguauacagcugacucagaccuuccuccucaguuuacucuccuucuuccauugucuagcuauaggacaacucugguguuucagauguucuauacuacccucauacuccuagcacugacauuaaguguacguauauugaagagccuggacagucagcuuucaccagcacuaucagaaaaagacucaugauuaaaauuucccauuucaacauggaaucugauaaauacccaaagagccauccaguaggcacauauagauaccuaaccaaaaagcucagucucauauucuaaucauguuuuuuccuuccuaguuauguaauuuuuaaaaucuagaauaaucccugauucauuagaauuccucaauaauacuuuccucuuucccucuccaaagaaauuaugcacuuuaaaauauuucuaggggucuggagagauggcucagcaauuaagagcacuuguucuugcagaagacucagguucacuucucagaacccacaugguggcuuauaacuguauauaaauccaauuuuaggggaucugaugcacucuucagaccuccaugggcaccagacguuuaugugguccauagacaugcuugugaucaaaacacucauacacaucaaauaaauaaaucuaaaagauauuuuuaaaguuucuauugaacuaaaaaucuucuguugaccucaucuucuuucuuuccuauagucuccauucuggcugaaacagaagaaaucaaggccauuuugaaggacaaaggaauugauguggagaccauugcugaaguguaccccauaagaguacagccagcucguauucucagccauauuuauucuagucuagguaaggagauugacuaguguuaugugaugcuggcugauugcuuuccauuccccauccugacucccacuucuuuagcuuguaaugcuuuauuacauuggaauccaaguuucugaacuaauguuuuaugagcaggcuuaauaauuuuagguguguguuuuuuuuagauuuauuuauuauuauauguaaguacacuguagcugucuucagauacaccagaagagggaguuagaucuuguuacggaugguugugagccaccaugugguugcugggauuugaacucuggaccuucggaagagcagucgggugcucuuacccacugagccaucucaccagcccccauuuagguguguuuuauacauacuuugguaugcaggacaaguuugauuccagacaauauuauauccuucuucuaaauguauagucaacuagcauguuuuccacuuucucggaaacuauauuucuguuaugaauacaugcuaauuuuauauagaguaguaaucaaggaacuuauuuuaugcuuuguuguguaaugaacuaauuauuaaaaaauuaauacccuuuucuaaauaguuauauuuauucuuuuuauuaaauuuaaugauggaauuuuauauuaaacaaauuacugcacuguuaacuaacaaaaaaauaugggugcugguagucuguagcucagugacagaccccuuguauauacuguguauacugacccugaguuccaaccuuauuaccaaaaaauaaagggauaugcaaauuucugaacuaccuuuuuuuuucuuuuuuuuuuuuuaauuuuuuauuagguauuuagcucauuuacauuuccaaugcuauaccaaaaguccgccauacccacccacccccacuccccuacccacccacucccccuuuuuggcccuggcguuccccuguacuggggcauauaaaguuugcguguccaaugggccucucuuuccagugauggccgacucggccaucuuuugauacauaugcagcuagagucaagagcucugggguacugguuaguucauaauguuguuccaccuauaggguugcagaucccuuuagcuccuuggcuacuuucucuagcuccuccauugggagcccugugauccauccauuagcugacugugagcauccacuucuguguuugcuaggccccggcauagucucacaagagacagcuacaucuggguccuuucagcaaaaucuugcuaguguauacaauggugucagcguuuggaugcugauuaugggguggaucccuggauauggcagucucuacaugguccauccuuucaucucagcuccaaacuuugucucuguaacuccuuccaaggguguuuuguucccacuucuaaggaggggcauaguguccacacuucagucuucauuuuucuugaguuucauguguuuaggaaauuguaucuuauaucuuggguauccuagguuuugggcuaauauccacuuaucagugaguacauauuguuugaguuccuuugugaauguguuaccucacucaggaugaugcccuccagguccauccauuuggcuaggaauuucauaaauucauucuuuuuaauagcugaguaguacuccauuguguagauguaccacauuuucuguauccguuccccuguugaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugaggaaccgccagacugauuuccagagugguuguacaagccugcaaucccaccaacaauggaggaguguucuucuuucuccacauccacgccagcaucugcugucaccugaauuuuugaucuuagacauucugacuggggugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauacuuucccaaucuguugguggucuuuuugucuuauugacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaagugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcucuguaguaaagcuuuaggucaggcauggugauuccaccagagguucuuuuauccuugagaagaguuuuugcuauccuagguuuuuuguuauuccagaugaauuugcaaauugcuccuucuaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagauuugaaguucuuaucauacagaucuuucacuuccuuaguuagagucacgccgagauauuuuauauuauuugugacuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucugguggaauuuuuggggucacuuauauauacgaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccagaacuuuuaucaugaauggguguuggaucuugucaaaugcuuuuucugcaucuaacgagaugugaacuaccuuugcaagagacugaauaaccauccuucccucaaaauauccggguucugaucuuuaguaccuaugaacauuacauuauauggcagaaauaacuuugcaaaugugguuaaauuaaggaacuugagauaagaacgauugagguggaccucaaauacaaucauagggacaggacaggcuacagaagcagcugugauauauuugggguuuauuagaaugacuuacagauugugguccagugacuccaacaaugacuaccuauaaaaguaagguccaugcauccagguaguguuuuaguucacaaggcuggaugucucagcuggucuucaguguacacugaaaucccaaaaaaaguaggcucuaaugacagugaaaaaagagaaagcaggcaaagagagcaaguuuccuucuuccauguggauaucuauccauuguacaacugcaaacacaucauaaauuuagaauaaguggcaacgucacuugagggccguccucuuaguaucucaaacguaaguaugcuaacaauugauauucucuuaauugauguuacauggccugauaaauugaggaaagaccuggguggugaugguccaugccuuuaaucccagcacuuggaaggcaaaggcagccuggacuacagagugaguuccaggauagccagugcuacacagagaaauacugucaaaaacaaacaaccaaaaacacaaaauaaagaagaaauugaagaaagaaaacacaaaugcauucuuaacaaaauaugacagaaauacucaugucaauuauaauccucauuuuugcaacuggucacauggccuuagcugguauuuaaauuaucuucuacuaugcauucuguauauccuccacucucagcaagucccugaggucuugacucuuuuucuggacgagugaccaauucccucauucuugaagggucuguguucuuugucaucuugccagaauuacgugcuuauaguuucccauuggcaacauagaagaugguaggaccuagagacacccugaaggaucuccuacauuccagacauaaucuuucuuagcucuauuuuggagaagcgauccaauuucccccugguaaucuggaucaaucacccauccuaagacuggcauuacuuucuuggccuguuggcuuaaggucaccaaaaacccaaaguugccaguacagggucuaaguuuacaguucaguugaauauuuguuaugguuccuggcaggaaugcucccucaggcuggaaccaaaacuucuaggccagaagaauuagaggucacaggaacaggaagcaaaaauuuuccuacugggucacuaggggguuaaaguaaguggaacuaaucccuuuucuaucccuugauuccuggacccauggauccuugcuaugguuguaccauauacuagaugcuaauucaaagcauauaccaccuuuuggagaauccugucccagcccuugaggcugcugccacuucauuggcauguaacuuuguguucaaaagacuauuccaccuuucuuccuuuuucaaaauuuuuauuagauauuuucuuuauuuacauuucaaauguuaucccuuuccuaguuuacucucugaaaauccccuauccccuccccuugcuucccaacccacucacucccauuccuggucuuggcauuccccuagacuggggcauagaaccuucacaggaccaagggccucuccucccauugaugacugacuagaccauccucugcuacauauacagcuagagcuacaaguuccaucauguguuuucuuugauaggugguauaguuccaaggacuucuggggguacugguuaguucauauugauguuccuccuauggggcuucagaccccuucagcucccuggguauuucuauagcuccuucauuggggaucuuuugcuucaucuaauggauggcugugagcauccacuucuguauuugccaggcacuggcagagccucagaggagacagcuauaucaggcuccugucagcaggcucuuguuggcaucugcuuagugucuggguuuggugguuguuuaugagauggauccccaaguggggcagucucuggauggucguucauucaggcucugcuccaaacuuuaucucuguaacuccuuccauggguguuuuguucccccuucuaagaaggauucugagcuucugggcuaucagugagugcauguuuugugaguucuuuugugguugaguuaccucacucaagaugauauccuccaaaauaucaugaauuucaugaauucauuguuuuuaauagcuaaguaguacuccauuguauaaauguaccacauuuucuguauccauuccucuguauagggacaucuggguucuuucuagcuucugacuauuauaaauaaggcugcuaugaacauaguggagcauguggccuuauuacauguuggagcaucugcuggguauaugcccaggagugguauugcuggaucuucugguaguacuauguccaguuuucugagaaacuaccaaacugauuuccagagugauuguaccaccuugcagucccaccagcaauggaggagugcuccgcuuucuccacauccuugccagcaucugcugucaccugaguuuuugaucuuagccauucugacuggugugagguggaaucucaggguuguuuugauuugcauuucccugaugauuaaggauauugaacauuuuuaggugcuucucagccauucaauauuccucaguugaggauucuuuguuuagcucuguaccccauuuuuaauaggguuguuuaguuaucuagaguccaacuccuugaguucuuuauauauauauuggauauuaaccccuuauuggauuuaggauugguaaagaucuuuucccaaucuguugguugucuuuuggucuuauugacaguguccuuugccuuacagaagcuuugcaauuuuaugaggucccauuuguugauucucaaucuuacagcacaagccauugcuguucuguucaggaauuuuuccccugugcccauaucuucaaggcuuuuccccacuuucuccucuauaaguuucacugucucugguuuuauguggaguucuuugauccaguuagacuugagcuuuguacaaggagauaagaauggaucaauucuuauucuucuacaugauaaccgccaguuuagccagcaccauuuguugaagaugcugucuuuuuuccaauggaugguuuuagcucccuugucaaagaucaagugaccauagguguguggguucauuucuggcucuucacuucuguuccacugaucugccugucugucacuguaccaguaccaugcaguuuuuaucacaauugcucuguaguacagcuugaguucagggauugugauucuaccagagguucuuuuauuguugagaagaguuuuugcuauccuaggauuuuuguuacuucagaugcauuugcaaauugcccuuucuaacuuggugaagaauugaguuggaauuuugauggagauuucauugaaucuguagauugcuuucggcaagauagccauuuugacuauauuaauccugccaaucuaugagcaugggagaucuuuccaucuucugagaucuucuuugauuucuuucuucagacacuugacguucuuaucauacagaucuuucacuuccuuagagucacaccaagguauuuuauauuauuugugacuauuuugaaugguguuauuuuucuaauuucuuucucagccuguuuauucuuuguguagagaaaggccacugacuuguuugaguuaauuuuauauccagcuacuucaccgaagcuguuuaucagguuuaggaguucucuggugaaauuuuuggggucacuaauauauacuaucaucugcaaauagugauauuuugacuucuuccuuuccaauuuguauuccuuugaucuccuuuuguugucuaauugcucuggcuuggacuucaaguacuauauugaauagguagggagagagugggcagccuugucuaguccccgauuuuagugggauugcuucaaguuucuuuccauuuaguuugauguugacuacugguuugcuguauuuugcuuuuguuauguuuagguaugagccuuaaauuccugaucuuuccaagacuuuuaucaugaauggguguuggacuuugucgaaugcuuucucagcaucuaaugagaugauuaugugguuuuugucuuugaguuuguuuuuauaguggauuacuuugauggauuucaguauauugaaccauccuugaaucccuggaaugaaaccuacuuggucaggauggaugauuguuuugauguguucuuguauuccguuugcaagaauuuuauugaguauuuuugcaucaauauucauaagggaaaucuaccugaaguucucuuucuuuguuggaucuuugugugguuuagguaucagaguaauuguggcaucauagaaugaauuggguagaguaccuucucuuucuauuuuguggaauaguuugaggagaguuggaauuaggucuucuuugaaggucugauagaacucugcacuaaacccaucugguccugggcuauuuuugguugggagacucuuaaugacugcuucuauuucuuuagggggcuuuuuagaucauuaaucugauccugauuuaacuuugguaccugguaucugucuaggaaguuguccauuucauccagguuuuccaguuuuguugaguauagccuuuuguaguaggaucugaugacgcuuuggauuuccucagguucuguuguuaugucucccuuuucauuucugauuuuguuaauugggauacuguuccugugcccucuaguuagucuggcuaaggguuuaucuaucuuauugauuuucucaaaacaaacaacaacaacaacaacaacaacaacaacaaaaaaaacagcuccugguuugguugauucuuuuuuucuuuuucuuuucguuuuucgauacaguguuucucuguguagcccuggcuguccuggaacucacuauguagaccaggcuggccuccaacucagaaauccaccugccucugccucccaagagcugggaucaaaagcuacaggcaacuaauggcugggaaaugagugagaaccaggauucucuggggacaaccccuugauagguuuucugaucccauauugucagccuugaacacauacauauagacaacauuaaauggacucaauaagaugugcuuuuaugggccggugagauggcucagccguuaagagcauugacugcuuuuccgaugguccugaguucaaaucccagcaaccacauggugccucacaaccaccuguaaugagauccgacacccucuucuguugugucugaugacagagacaguguacuuaugaauaauaauaaauaaaucuuuuaaaaagauugcuuuauauaugcauaugcauguauauacacauaugugugcauguauaaaaauaauaauaaagaggcuaugaguuugaaugugaggaacagaggaguucaaaggagugaaaaauaugcaaauacaguauuugugugaaauucuaaaaaaaaaaaaaaaaaccaaaguuaaaaaaaaaaacagaucaguagggauacuggacucacaauacaugcauauacauagaacaaaaagaagucuuuuuuucaaguuaaacauagaacugguauauauuucaggaauucuaaguauaugcacaaaagggaauggaaugagaacgaugaauagauauuuucuacauuauucgccaauauuguuuauaauagccagaaaaugugaacaucugcaauguucaucaacaauugaauagaaaagcaaagguugcuggcaagaugacucagcaguuaagagcacugacugcucuucugaaaguccugaguucagaaaucccagcaaccacauggugguucacaagcacccguaaugagaucugacgcccucuucuggcgugucugaagacaguguacuuauguguaauaauaaauaaaucuuuaaaaaaaagaaaagaaaagaaaagaaaagaaaagguggcauauacaggggguggaauaugugaccugggagggaaacuuuaauaugugcuauuauaaguaugaacuuugaagauacugugcugauugaaauaaaccaauuaguuauaaaagaaaaggauucuagucaauaucagauauuuugaguagucaaauucauagaugcaaaguagaaauuuguugucagagacugggaggagaaggaaccuuaguguuuaauggguguggaguuucaguuuggagacaugaaauagucuggagaggugaauagcgguggcauuuacacaaugauauauucaaaggaaguuacuaaacuguacacuuaaaauauuaaaaugauaaauuuuauguuacacauaaaauaauacuaucaaaggcccucaugaugguaaaagcacuugucacuuaagccugauaacuugaguuugauccuagaaacucuaagugaguucagucucagacccaaaggauugagcaccaacucacaaagguugcccuguggccuccaugugugucaugucaugagugugcaugcacacauacacaacauauacaauaaauaaucauuaagaucuuacuaacaagaauucgugaauaaaacugguuuugcuauuaauccuagagcaaauaugagaguuauucaguggaacuuggaauauggccaaggcauugagcauucucuggucuguuccuuuacaaguugaagcaacucugaaaauguaauguuugugugugggggugugugguuaauagguaaaacucuucccuuauaaucaugaggacuuggcgucuuugauucccugaauauauaugaaauugucaggaaugguaugcaugcuuacgaucccaacagugaggugcagcucacucacuguuaagcaagucuagccuaauugguggauucuccgucagugagagacccaagcuggaaaggagaugaauuacauugaugaggaugacaccugaaggguuccacuugccugcauauacuuacacauguucgugagaagguucauguccgugcaguuaacaaaucaaguacuuauaaaaauauaguguagccaaaaucauguaguagggguucucucaguagugacaagaaagaauagucaacauaucuuggagguaaacaguuuuagaacaauaugugaaguauuuuuccccucugaugaaggaaaaauuuaugucagugaaugaacaauucccuuauuguaccuuaaacaauauuuaauguaguuuucuauuuauauauaauauauaguuauauauguauauaguuuauuuaacacagauauggauugcgagguagauucugauuuuagaaagcuaaacuguaaaaggaagacaucucaaacugaaggaaaugaggugguugugagucuaugcauauauguacauuguauuaucuguauuaauaaauacugcuuuaauuuguacacuaagaauuuccugaucguuucucaauucugugucaggaugcaacaguagaaugaaacucaguggacgacccuacaggcucaugggugugcuuggaacaucaaaacuuuaugacauucgcaaaacuaucuuuacuuucacuccacaggugagugggauaagcuguaaaauucauagagaugaauggaaaugagagagagagggagggggaggggagagggagagggagagagaaugagaacacagaucacagaagcaaagcauuugcuagaauuggauuagucagagucccacagggccuugcauaucuuaaauggcucaauaaguguuuguugaauugaaccaaauugaacuugcagcauagaaaauugccaagugacuguuauuaccaacaguagucccgggugguaaauuguguuugggauuuucuaaauguucagguccuuacacaguuuuucuuauuuuuuggaaguuaaaugaagacuguauuuauccuuuauaagugaaacacagucguuuuauuuaagugcuaaauuaaguuuuuccuguggggaaggagcccuuucauuugcauagaaaacuucagugcccuuuaaagaaaaagaucaggacuguuaagcuguaauuauacauauuggcggccugacauuuguuagcuacauaauaauagaucuaaguucaauugcacguggguaugguaguagaaaugauuuucuggugccacaugcuuguaaucccagcacuuaggagggugaggcaagagacuuguguucagagccuccaaccugagcaacaugguuagcaaggucauuaugaacuccacaggaguauucugucucacccaagagcugaagcucgagcucagggcugaguauucccuaaguaugugcuaggaccaggguuuagcucuagcaccacagugaauauuuucugaaaggaaaauuuaaguaccuugucauaucuaaaacagugcagcugagacaaacauaaaaaaugaugaagugacucuagacucauauuucugauuuuuccauuugcuaaugagaugugugugcuaguucauauacugucucugagucuuuuucuucauauuaaaagaaaaacagcaaguugggaauaguggugaaugccuguaacccaggacucaggaauucucaagcaggggguuaugaguucaaaccagcuuaggcugcaaaaugagaaacuagggagaaaaagaaaagggaaggaggagcugccuacacuaggugguuauaggauuaaaugaaauuacauauuugaacagauuucuaggcacucacacacuucaaaauuaucagaaacuauugugccuacuauuggccaacauguacuuuagaaauuauuagccacuaaauuugagaguacuggguuuuuuuuuucugugauauguaugccuuauaaauaaaugaacauugaaaaauauuauuugauauuugugagagcaaaacuuccugaacgaugguuuuuuucuuuucucaguuuauagaccagcaacaguucuaccuggcucuggacaaccagaugauaguagaaaugcucagaacagaccuuuccuaccucuguagccgcuggaggaugacaggccagcccacgaucacuuucccuaucucgcacaccaugcuugguaagggcugaauaaagcaggaaaguaagucacauguguaguuaguucuucagugucccacuguagagcuacuucuuacaguaguacucaccaguuuucuaaacucugcacagagugggugauaggcagguaugguuucugcucuauuuaagcuuauguuucaggaagugaagacaguaaguaugaaacaaauggauaccuaagaauauauagcuuugagagaauaaauagcuuuccagaaugauuuuugaggcacuuuuccaaaaaaacuguauucuacaauucuucuuaaagacaguacuaguacaccuacaucuauuuuaucccaguggaucaucaagauuucuagggaaguucccaaguucucucgggaagcuugucuuagggaaacaggaaggucuagcauggggaaagugcaaaggcuuucgguuuguacuaggggcaaggagaggugcuuccucacaaggaaagacucuaguguucugagcuccugcaggauuaaaagacagaggcuguuucuuucuuucugugucucugcuguugcuuccaaaggacugcauguacugccaaagugcauaaaauucuguuucauuaaaaagaaccauuuaucaugaaucauuuaaaauccagacagacugggaagaauuuuggucgcaucugaaaagggcuuaaaaauuagaagagaaaaagagcugagaaaguaggguagucuuuguucuuuuugucuuuuucccuuacuugagaugauuaacaagugucuguuuaauaaugaauauauucucacaauugucuucaaauaguacacagucuaauuuagaaggcaaaguuaauggaugaugaugaugaugaugaugaugaugaugaugauaauaauaauaauaauaauaauaauagaagacaaauucaagacaguagauuaggaaguacugaagcacugaagguuaccacagugccaaagaaaaaauucagcugaugugagacuuaaguuuuuggaauugcuuuuauuuuuuucuuuuuaacaagauuuuaauauaugugaggguacauauauguccacagagaucaaaagagggcauugauaauaagccaacugaagccaaauuaaaguauaaaggcagguuuauugggggcagcugaucucacagggggaggucagggaaguuugccccacagacaggaaaacagaaaaggggauggggugcagagagagaaagugcacuagcacuacaaaggaaaaaugcagauagaggccaaagugucugaaguauauaaugaagaccugagccucuggcuuggaaacuucaggguagaaggcaaaguaugucagccaggccuugaacagggauucugggagaacaugaaggccaggucugcuuuaguauguuaaauaugcaccuccgcgccccuucuccugagucugaaacccagcagguaucagauccccugguuuuguuaagcaccugauguggugguggguggugguggugguuucgagacaggguuucucuguguaacccuggcuguccuggaacucacucuguagaccaggcuggccucgaacucggaaauucgccugccucugccucccaagugcugggaucaaaggcgugcgccaccaccacuauuaaauuguuaaucuucacauaggaggaggaaagaagaaugagaucucaacuggguuuggggcugccuugagugaggccuggagagaggaaugagccugugugugaggcuggugacaaggccaacuugaacauauuagaguacuaugaugaacaaaacuggcaaaguaagguaggcucagguuaugaagacauacuucgaaaaucagcagagagauuuaaaacaaguuauauuagaaguuacauaagagguugaagcuuuccaaaguuuuugaguaaggagugauguggggagacccugccaacuuguucagaugcuccucugagcucugcauaaaaauggaggauuuccuuuaccagcuggccuugcccugucuggggaaccugacccuccccccacugucucccugcagaacguuggguguagccuuguugagauuacauguuuaagcuuccuuucucccaauaagaaccuguccaacaacuaccugaaauucuuggaaugccucuccaggcaaacaaggcauucuucaguaugcaaacucuagcuaaugaaacuuacucacccugaaaacccugcccccuucaaaagaaccaaaaaaccugauauaccacuugauuuaguccaaauaaaguuaggcuuucucuuugaagauaauuguccucauggcugguggccaacaaccucuggggagaagggaggaccacagaaugacaugaaacaaguuguauuuaguagauuuuaguuguugacaauaguucuguugucacaguacacuaacaucaagaaaacaagugaccaugugaggugaggagauaauauucugcauuggugguauugaaaauugaagaaagaugauacaaagccauuuugcuuuguucuguuugauguuuccuuucuuuucuuuugcucuuuaauucuuuugacgcagaauucuacucuauggcccuggcuggcuacaaucucacuaagaugauuugaacucauagcagucuuccugcuguagccucccaaaugcuaagaucacagccauuugccacuauaucaagcuauuuuauuccauguguuuauucuuguuuugcuugauuuacauauggauguuuguaaauauuuauauauuuauuuauuuguuguaugugcacauacacaggcauguaguggcucuuguguggaagucagagaacaguuugcagaaauugggccucucccucuaucauguggguuccuuggaucaaacucagguuaucaguguuggcagcaagugcuuuuacccguuaugccaucucacuuucucaguuugauuucugagacuaggucuuauauaguauaagcugucaucaaacaugauauauagcaaagguuggcuuugaacuccugaucuuccuauaucuaccucucaaguacugaaauuacagaugugcaccacuaugccuggcuuuuauugguuuuuguuauuuuguuuuguguuuugaagcaaagucucacaauauacucaggcuauuguggagcucauuauauaaaucagccuggccuugaacucaugguccuccugccucugcauccugagugcugucagaaagaacaaauuggaaaaggcaaaucacaagauuaucaucaguuucauaaaaaggagguaauuaguacccuucuaaaggauuuuaaguguauauauacacauucacacauacauuugcacacaccaaggcucauugugagugauaccaucuaugagauacuuaucauaaugauaaucccaaugaugcaaggcgaacagacacugacccauaucaucauggucagauuaaugaaagcaagcaauuaauuaaagcaagcucuuuuuauucaugugaauaggcugccucccccuaaagugugguuuaagaggucagccuuggacaugggcaagguauggcuuuuaucagggauaggagguuuccaaauggggguuuugacagacuaauaggcgggguuacaggaacagcauaacaaaguagucauaacagccuuuugaaacaaagguaagguugcacgauggucauaacaacuuuuugaaacaaaaacaugauugcaauguccuggaacaggcaguacaaacccauuuguaguuaagguuauaggugggugggcauaguccaguccuugagaaacaaagauuugauuauaaacaggaaguaaccuaguuuaccuuuaauauaagauaacuuucaagccuaagauggaggugggcugguucaucaauaguaugugucauaaacauuugguaaauagugcuggguacuugugauaaacaagauaauuccuuugaagaacguaaucuuuaccacuuguccauucuacagcgauguugauucucacauuaauaguugaagcacagaguaccuguacgauguuaguuugaaauaauugaaauauuuccccuuaguucuaagauaaaaugacaaauaauuguuuuuuuuuuaaaucuuuccuuuuaaagaugaagauggaaccagcuugaauucaaguaucuuggcagcacuccgaaaaaugcaggauggcuauuuugguggggccagguaauugacauauauauauacccugaaccaggagagauggagcacaagaaacugucaguaaugcuuagcccuacuuauaauaugagaaaguuaaauuuagauccaaauagaugcugaaacaacacauacaaauauaagaauucacugcagucuuucccaagacaucauuccugaaagcacuugagguggguuagucauuaugaacgauaugcucucaguuuuagugcuguucaccaagugucuucagauccuuuuggugggucaaaaauggggucuuacaucuggcccagggcuugggccacuggaugagguggauucagggaguuugacugcggcacccccacaaaacugcaggucaggugucgggcuaugugaagccacaggaccccuuuccagauauggggaaggcacagucugagguccccguggaccugccggaguggaguagggaguugggcucagacucucagguaacacagaugcugcuggguaccacaaaagagccgguucgggggucccugggcugcaagaaggccagggacuucagguucugggucuuugacaccacagacacugcuggaugucucagaagagcugagaacagagcgggggagggggcacaggcagacucuggcccagagccugaagggaaaaggggcagggaggagagcuuuggcuggguuccuuagggaggaaaguccuuggcuugcucauugguggcuuggguugugacuggagugcagggaggccucccagugggagguuagauacauggcuuguuaggggaagaccugcuccauugcuccugcaugguggaucccaaugaaaagaggcaguccauaguuuuaaggcauuuauuguagaaaaucagagagggggagagaguagagaagcagaggugagccauggccacauggagagaggggcaaagggaaggcagagacagggagagcaagggagcaagaguaagagcaagagaauaagaggauaagagagggaggagggggcaaacagcuccuuuuauagugggccuggccuaccuggcuguugccagguaacuguggggaggagcauaccuggcuguugccagguaacuguggggguggaguccagacagaauaccaggagcuuggggcauugccuacaugacugauggccacacaugccucucugccuggugggggcaggagggucuuugggaggcuguagccggaacaggagccagggucccaggagguguggcugaacaccugcagucccuuagcaucaccaggguucaaggucuguguuugaccaggaccaggcugucugugcacagcucacugcccuauaccuuuucucaaaagucuuugagcaaauggugcuggcuuccauugauucuugcaugcaagacuuauuacuaagucuugcgcgcgcccaacuggccaggaagaacgacgcugcaacaggauccuucugcacacguuuauucaguccuguuucuucuuguuuauaucucccuuguuuauaucucccuuguuuauaccucccccgaacccugggccucucacucuuuuauacucucaguucccauccacgcacagcaggccacgccacuucaccaggcacgcagcuucagcuaaucagggcagcaggggcauaucuccaucaaaauggauucgccgguauccugguacaccugcgcagcucucaagauguuuguggcuuauaugaggaagucaggugcaagucauacgacuuagcugcagucccuagcgccuuugggacugccgccacacccguuccccacaucuccguuauaaaauagucuucuagaaauuugucugcauauauacauauauauaaaccaagguucauuugacaguguuucuaucacuuuguguacaucuagaauuagaauucuuauauaaaaaaacuuauuuuguggcuuaugauuaauauauauucuuuggauucuuauuuuauucaacaugucauggcccauucuuuuuuuuuuuuuuuuauauuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccguugggagcccuaugauccauccauuagcugacugugagcauccacuucuguguuugcugggccccggaauagucucacaagagacagcuacaucugcguccuuucaauaaaaucuugcuaguguaugcaauggugucagcguuuggaugcugauuaugggguggaucccuggcuauggcagucucuccaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacuuaucagugaauacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcucccuugucgaagaucaagugaccauagguguguggguucauuucuggaucuucaauucuauuccauuggucuacuugucugucucuauaccaguaccaugcaguuuuuaucacaauuguucuguaguaaagcuuuaggucuggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagauuugaaguuuuuaucauacagaucuuucaccuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuugugcagaauuggaauuagaucuucuuugaaggucugauagaacucugcacuaaacccaucugguccugggcuuuuuuugguugggagacuauuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguugauucuuugaauaguucuucuuguuuccacuugguugauuucaccccugaguuugauuauuuccugccgucuacuccucuugggugaauuugcuuccuuuuuuucuagggcuuuuagauguguugucgagcugcuaguaugugcugucucccguuucuucuuggaggcacucagcgcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauguggcugcccuugcauuuggugcguagauauucagaauugagaguuccucuuggaggauuuuaccuuugaugaguaugaagugucccuccuugucuuuuuugauaaauuuggguuggaagucgauuuuauccgauauuaaaauggcuacuccagcucguuucuucaguccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugagcccauugauauuaagagauauuaaggaaaaguaauuguugcucccuuuuauuuuuguuguuagaguuggcauucuguucuuguggcugucuucuuuuugguuuguugaaugauuacuuucuugguuguucuagggcgugauuuccguccuuguauugcuucuuuucuguuauuauccuuugaagggcuggauucguggaaagauauugugugaacuugguuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaugcuucuuguaugaucaugggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcugaugcucgcaucuaugguuccagaucucuuuccuaggguuucuaucuccagcguugccucgcuuuggguuuucuuuauugugucuacuuccccuuuuaguucuaguaugguuuuguucauuuccaucaccuguuuggcuguguuuuccugcuuuucuuuaagagccuguaacucuuuagcagugcucuccuguaaaucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugauuucuguuaguaggauucuuacguuugccuuucgccaucugguaaucucugaagcuagcuguuuuaguugucacuguuaagagcuuguucuucaggugacucuguuagccucuaugagcagaccuggaggguagcacucuccuuaguuucagugggcagaguauucucugcaggcaagcucucuucuugcaaggcagguacccagauaucugguguucgaaccagacuccuggcagaaguuguguuccacucacuagaggucuuaggaucacguguggaauccugugugggcccuugcgggugucaggcgacucagcuggcaagguagccggggcucgaguggaguggaagggguuugugccccagaucaagcccggguagccugcuucccuauguaccgcagucucaaguuccacgcgauuggauuggggcaggcacugugauccacucaccagaggucuuagggucccguggggaguccuguguggacccuugcggguguugggcaagacucugcuggcaagguagcccggggcucgagucccgagucgagcggaagggacuugugccccagaucaggcccggguagccugcuucccuauguaccgcagucucaaguuccgcgcaauuggauuggggcaggcacugugauccacucaccagaggucuuagggucccguggggagucccguguggacccuugcggguguugggcaagacucugcuggcaagguagcccggggcucgagucccgagucgagcggaagggacuugugccccagaucaggcccggguagccugcuucccuauguaccgcagucucgaguuccgcgcgauuggauuggggcaggcacugugauccacucaccagaggucuuagggucccguggggaguccuguguggacccuugcggguguugggcaagacucugcuggcaagguagcccggggcucgagucccgagucgagcggaagggacuugucauggcccauucuugucauuauuucuuuuauuuuucaaauuauccaaggucuggccauugguagccccuuuaagcuggcuuccuuagaaaauuaauaccacuaggcagaucucugaguucaaagccagucuggucuaucaaguaaguuccaggagagccagggcuacacagagaaacccugucucaaaaacagacaaaaaagaaaauuaguaguacuaacuucauuuggaguuuuggaauuggcuuauuaaguagaaacugauauggcucaacuuaauuuauuacaauguauauaauuuucagauacugucuuuuauguccaaaaugguccuuugauaguauuuuaaaaacuuuuugagauuucuuuuuauuuuucuucuauguguaugggaguuuugccugcaaguaugucugugcauugugugugugugccugguaccuacagaggccagcaaacgguaucagaucccuucaaauuggaguuagagacaguucuaagccauuauaugguuacugggaauuaaacccagguccuuuggaagagcagucagugcucuuaaccacuuagcagucucuccagcccgauaguauuuuuaaaaugauguuauagauuugugugauuuauccucauuccccaucuaugucucuaauagcuaauacagguuuuuagcagacauucaacauaguguacagcaauggaagaacauagaaauaaucuguuggaggacuguaaacuuuaauuuguggccuuucuuuuaaaaucuccccaacaugcuuaaaauaugcuuagcauuccuuuauuuacaaguguggcuuauuuguuccucuguuuaauuuuuggaguugagcaaaggguuuuguucaugcuaggcauguacuuuaccaauugagcuauacugcuaaaauuguguuacuuuaaaaaagauauucucuaaguuucuuuuuuucucuguacccuguaauuguaaggauccaaacagguaaauugucagaguuuuugacaacaucuugcugcacacacuuaagcuucauggacccuggaccugaggguaagcuguacagugaagauuaugaugaagacuaugaagaugauuuggacucuggcaacuggauggacagcuaugauucaacaaguaaugguaaggaggcuuuaaacagcgcugcauggccagacaguaauacaaaugacuguuuagcuucauuguuaaaauucaggcuuccagccaucucaugugaaucauccucacuccucuuuaauacaucuagauuucuacuguuguuuggcuucauuuuucuucccucuacuucucuuugguuucuggucuaauaacucuguggugacugauuauggagugugggguuagaauaugccuuacuaagauugggggggggguucuuucuuuguaguagcugaugauuugauaugaaagaaacaauggugaguaaaguuuauuaaaucaguugugcaguugaaaauaucauacauacacguauacaaacauacaugcauuuguauauauuacuuuugguauuaagaauaaguaaauauggccgggugugguggcacaugccuuuaaucccagcacucgggaggcagaggcaggaggauuucugaguuugaggccagccuggucuacagagugaguuccaggacagccagggccgcacagagaaacucugucuugaaaaaauaaaaaauaaaaaaauaaaauaaagaauaaguaaauaugaaauuugauuagaguuauuuuaaaguuucucauaauucaagguauuauauuuuauguaucauuagaggcauauauugguaguugugaggucuguauaguuugaaaaaaucuagucagaaugccuguugcuuuaugugacacacuagacaaauaauguguauuuaauaagugcuaaagauaugaacauagugccaugagaaagcacucugauagcauguauuuaaaaugacugagaaacacugacuggggugucaaaguacugaccuaugcaagucaagaauuacauuguuugaauccccauaagagaauggucaauaagagaaugauucuucuaacuaucuaaauuuugguggaccuguuuuuguugucuggguauuugacuguuagcaucuaucuuaagauacuaacaaacauaaucucauauauaauaaaagccaacacauuagaaguacuaaguacuacuuuuuuuuauuugcacucaacauuuacuauauaucccucuuuguuugcuuaguguuucuuuuuuuuuuuaauaaaccauuuuuuaacuuaaauggaacugauaucucuuuacucaaguauuuggauuauauugaagauuaagauaccugucacugggaugccauugaauaugaguucuaguugugcagcucugcuaguuuccacuagucacauuggaucacugagggacuucuggagaggucacuggagauugcccagaaccugaugaugcaugacuuugguacugaucccagcaccauguuucucuaacuauaacauuacagaugcuuauaagcuaugacauuuccauuaucugaauucagagaugauucuagguggguccagccuuuggacaggguggcaugaugucauuaucuacaaaguucaugcucaagaauuauaccauagaguuacagaaaaaaacccucauauuuugaguaaguucauaauuuuauaucaggccuuauucauagcuuuccuuggcuucaugaagccauggggcuggagauccuuguaagauggauaccuguaagagagugaguccaagagaauacagaggauauauacuuucuauaacaauucucagugccuuggacacugccuguucuauaguaacaacacauauuuggugaauaaauaaguaaauaaauauugacuaaaaggcaguuuguggucgauaguccuauuucaccaauagcauauaaagacgcuuuuuggcuagugauuagaacuauuguuuguacauucuguuuacaacuaacucaguauuugguggaagauuuuugcccuuuccuggccuucaccaaaaugucuucuacuugugggacuugaaggggccuguccugcuccuucuccacuguugucccccuucugccaccacuguugucacacagaaauaaugaaauacuugcucugcuuguucugaaacaaacucauacugcuuuuagcuuucaguaacuuuuccugugucccagaacaguggaagagcaggugguucccggaaaauggccauaaccucuaacucucaaucugugagguuguauaaugaucggaagcucguuuuccuccaugagcuaagaacagagugcuucugacaguguuuuagguacaagagccagucguucugacugcugggcuagauuuugaaauaacuaaaauguuccuuuuuugucucuuccccuuucccaacuaaccuugcagcucgcuguggugaugaaguugcccguuauuuagaccgccuuuuggcacacacuguuccccauccuaaacuagcuccuaccucacggaagggagggcuagaucgguuccgagcugcugugcaaacaacuugcgacuuaauguccuugguggccaaggccaaggagcugcauauacagagugaguaaugccauuagucccuagugucagacacaagguggcaugaagcccaaguugggggcaggacauugauuacaucauaagcaggaaguugggauuauucacugcuuuguuccuggccucuugggcagcaccuagaauuuuguaggcacucaaaugcuuaugaagucaaggaauuagauagagucaugauauggauauugucacauaaucugguguaaccaggaaaacagcacgacacagaacaaaagaguauauucaauuuuaauauaggaguaagauguggaagaaucuggaauaauuacuucuuuggcaguaauuuuauuuaaagagaaagcaucauuagacuacuacaaaacaggagggacagacacagagacuuucuuuaagcuauaacugguucuccuuuuaugcccacuauaauugugcacccaguuguucuaggcaugcugucucagauagaaaacucauucuucucaguauugccacaguccucuccauaaccaguacccuccuuuaguaguguuuucagaggaggacaccuucugaauauuugaauaguagccaugguuccuaaacuuguucaguauuucuaugguugcuacauguggagggagagaagggcuccuuggccacaccuacaugacuuuaauguuacauuauauaaggaugagaaugauugagaugcauguucuugcuaccuaaaucuucauugaccguuacuaaccagauacuaaaagugagcacaaggguauuguuuaacauugagaauagggaaaagcuuaguguacccauugguuauguuccguauagaaaggguuuaugcaaggacaugaacuuuaaguucauuaaguugcauuuaucauuugugaauuagaaaaccagaauuuaauuuccagaaguguuauuuacuuguuuggcuaguuauagcucugaguagucucuguauaaaauggugaaaaugacaugcagcucucuccuuggagguuaugguaaguauuuuaacuauguaaguaaaacaucuuuggaacaucucaaaguucaucagccacuacuuguuuuugauucccuagauagauuucauccagucccaaccucuacaagucaaauauuagccuaggaaagcccagaaaaaguaaaauguaacagaguucuuugucuauguguuuuauuauaugaaaauaucauugauagcaucuuuuugauagugaucauauuacuaaacauaacaucccaugucuaguugaugguacaauuaaagaaaauccuuucaaaaucauagaaauagucacugauuauuuuaaaaauuauuuaauaucuuacauuucuuuuuuugaagucagugaaggaaguucgcaucauuucucuucuguaaagaaauagcccguguguuaccuucuugcugcugucagcgauggauggguuuuaggacuuuccuacagaucuuaacuuuucccguaaaugucaacuucuugcagauguucacauguaucuuccuacaaaguuauuucagccuucucguccuucacucaacuuacuugacuccccugagucuccacaagauagccagguaacugugcacauauuucuguaagcuuuuuguaaaacucugucauuuuuauuggacauaauacaacuagccaguaugauuucugguguuaaacaaaacaguaucaaaugaaaugcaugccuuuuaaagguuacucuuuaaguaggcaagguuuucuucuuggacuuugagaaaacuacuuagcucuaucauagggcuuguugguuuuguugguuuggccuugcuuuucaucaacaguuuuggggagaaaaauugaggcagagucauagguaacccagacuggccuuaaaaguuacuauguagaugaggauguccuggaauuccugauccuauugccuuggucucccaaaugcuaggguuacaguuguguacuagcacaucuggggagcauuuagaaaauucuuauagaaaagguuuccagguggaaagauaacucauucuagggcaucaucuacuuaagcacuguuaaccuaguuucuuuucaucauugcuuauuccaaagguuccuuccguucauguagaagugcaucuuccuagggaccagucuggggaaguggacuuccagucauugguuucacaguugaaggagaccucaagcuuacaggagcaagcugauauacucuacaugcuguauucaaugaaguaagugauggauauuauugauauacuuuaagguacauauugugaggacauauaacauguuaguaagcuuucuauacuauaacaaauaccugggauaaucaguuuaacaaaagaaaauguuuauuuaaagcucaauugcuuauuuuaguacuuauauuuuuaaaauauuuuauuauguauauacguguuuugcuugcauguaugucuacgcacuccaaggccagaagcgagugccaaaucuccuggaacugaaguuauagauggcugugagccaccauguuggugcugggaucugaacccugguccccuggaagagcagccaaaugcuuguaacugcugaacaaacucuacccuaacuugucuucauuuuauuguuuuuuuuucuguuucaaacucaaguuuuaacauaguucagaaaaauauuuuguugauuguaaggaggguacaacaaagaauuuaacaguuuguauuuucuucuacagaaugaucauguuucuacucauguuuaauauaguuuuguacuaugguagauacauagcucuccugaauuauuuauuauucaaggguuaaggguuuaaaaauccucuaaauaauaaccugaauuuuauuguugauuauuuuagcuauauaaaauugcucuuuuuuucauaugaaaaaaaaaaaaaagaaacagguuuuauuuugguaguuucauuccaugauuaguugucccuauugcuuuggggucuguaaugacauaccagauuauggcagcagcagaggcuaaaccauucaucuaauaacugguuugcaagagggaaaaaguaauagaacaguguccuaguaucugcugccuagugggucaagaguuuaggcacugagugagggucagcagggucagaggccgcaucgggaauggaaacugagugacccuuucccucucuagggugauacaggaaaaagccucauggggagccacccucuuucagcagugauaggacacuccugcauaucaagggcaagcugaauggggaagcuacaguucaucuccagaaagcaauaguaaggcagcaucccuuucccuaguaguacauuaucagaaaaggccugcugggaugggguuaguaaguucuacauuauucuaacauacuauacagaguccaggguaccagggaaaauugauugucaccaagaaccaggaauuccucaucuugaaugugcaaaaggaauugauagaggcagcagagauaaggcagaugcuaggauuaaacaagaaagcuuguagagggacuauuaaaaugcuucaacaaauaauuauaaauaccccagaaacaaaugaaaaacaaaauacagugaagucucaguaaagaaguagaaagcacaaaggaauccuaaauggaaauuuuaaaaauuaaaaauacaaaucuacacacuggucuuuuuaaugugcucauuuuaacaaguucauugccuguugaaaauucuccuauuuguuucucuuaaucaaaagcaaaaaagcuuaagaguuaguauagcauacagaagccucuaugauaaaguuccugccugcuucuggaccccucuuccaccauccuguuguucugcaauuggggguguagcaauaccaugccauuucucacaucucugcucucccuucuuucccuucucucccuucuccuccuccucccccuucuccucuccccugucccuccauagaugugauccccauuuacucgcaaauauucauuccggcucuauuuucuaaaaccuguaaaccuuuugcauaagcagaguagaaugauuaaaauuuauucuaucuguggggaccuucuugucuuccuucuucaggcugauugacagguucugacauagccuuaaagaagcuagcuugaaaccuguccucuucugaaccgcugguuccuuaggcagccaucuaccauaguacacgugacuguugcuguauuguuuugcuauuuucaugcauuuaucucaccccucaacaugaaacaccuugaguucagggacauucuuuuauuuauuuaagcugcagugccugcuacguguaaguauuuuggacaaaugaaugaacacccuuauucaguccucauacuuuuuaaugagggggguuacuuaguaguaaguacaaagcccuggguuuagcuccuagcacagaaaaaaaaacaaaaaacaaaaaaagagggacuuauuaaaaugagaaauucaguaccuacauuuauuauaaauguagaaaucaguuuggaaagguggaucaauuuagucaaggucacacagcuagggaaauagaucagaugagaagcauuuuuuuuaccuaacauuauuuaaugagaaaguaaaaacacaaagauauuccuauuaucugaaacuucacaugcuguuuuuacagugcucaggaucaaacugaggacuuguucaugcaaggcaaaucaucuauguggagcugcccccugaggccuuggcucuuacauuuucccauugcuaagcuucaacaacuguuaagcaaaucugacuguuauaaagacugacuuugacaagucaagauaugauuuaaaagccaugcauccuaaagucaugaaguuguacuuaagacaguaauagucccauauuaagcuaguugcaaaucaaaagaauuacuaaccagguacuuuggcauuuaccucuaaucgcagcacuuaggagguugaggcaggaauauuucaaguuaaaagccagccugagcaauauagccagaccccaugucaaauaaacaguaaaaaauaaaauaaaauaaaaauaacccccaaaagucauauuuucagucauguugggcuguccuggucuuuauacacccccccaccuuacuuguuagcaauaacuaaggugugagccaugaauuuuuucucucagaaauagccagucagaucuccuccaaggcugcugagggauaucauccuauguccccaacucccugcucccuuugagaguucccuugccuuaugcucuucugggggacagaacuugagccaaaauucuuugcauacccagucacuacuugcuagaauucucuccaccauuaaaaccuacuucaucagucacucccauggugccaugucugguuucuaauaauaagcagauaauagauuaugagauaucaccaaaccuuuuucacaucuuaaacuuauuuugacaauuucagaguuagaggaaaguuguaaauauagauagaacaagauauuuggauauccuuuauucggaucccgcaaauguuuccacccagcuugucucuguaucucuguccaucucugguucuucuuccuccucucucuucucuucacuugucacucugcucuauucucucucucuuccucuccccauccuucucucccuucuccuccucuccccugccccuucauagaugugauccccauuaacuccuaaauauucauucaggcucuauuuucuaaaaccuguaauccucaaaucagaaaauuuaagcaaugcuaucaucaauuuguaugaauuguaaaaacaaaaucuuaaauugcguguuuuauuuaguucucauguguccugugucuucacugaucuggaacaguuccaaaauuaagauaacuaggaccauuuguuucuaaaugacccuaccuuuuggguuugggacauuccucccuaaguagaaucgagugaugcauuuuuauuuucugcaggccugcuacuuaaguuccuuucugugaaagcacugccaguggcacugcugaugcuguugcuuuucaucacuugacuugauccuuuauuaaggaaguaccuuccaguuuacuuccuuugcaauuaagaacauucucugaagauagauacacuuuugagccuauauaaguagccuuuacuuuuuaaaacuugcaauugcucauuuuguacccauuugacuuuuuaggcacuucuuauuucauguuuuuuaaaguugauauuugaauagauaauaauucuuacaggucaacuuuuuuggauuuacguuauuuuaugugaaugauuauaugaguuuuugccugaaugcaugcauguaugcaugugcauaccuggugcuugcagaagucagaagaaggcaucaugucuccuggaacuggaauucuggaugguuguaagccauuaugugggugugaaaaacugaaccccuauucucugugagggcaauacaugcucuuaacuacugagccuugucuccagagccuaauuuucaaaauauauagugaaaaggucaaauauuuucccuaccuguuucugaauacccaaauuuuucaugggcaacguuauuuuuguuuguguauucuccuagguacgcucuauacauguauauguaaauauagacauauauguggauauuuguagcccuaugugcccaaaguuagcauaauaauagauuguucuauacucuuuaucacuaauacuguauaucuuaaagaucacugcauauauauuccaguuaccuauugauucauuuuuaaaaaauucaccuuaacacccaguggcuugagcaggaggauagcaugauaagaauguacaacuuuaacaguucuuggauugaguggucuugacgaggcaguucuugcccaaggucucucauuugguuuuugucagacacugauucaugaaugaagauagccaagguuugcucacucacguacucaagaguagauacaggcuguuaacuccagucccauuaccuacaucucuaauaccuucaaauccucacagcaugaugacaaggggcucuuagagugucacaagagaagacaaggugaaaacuguauuuaaaacuaacuuagcagcagaaauuacuuagucccucuuuuacccuagucacaagcauacauggugucugcuguuuuuguuugguugguuugguguuuguguuaggcccaguuuuccagaaacacaggagaccuccagagaucaggacacugaggcaaacacucaaaagucuuuauuccaaguccgaacuugggacacaaccuucccugcucugcagguuaggaaugcaacacccaggucuaggggcucaggguuuauauauaggagaugcauacgcuggggcuuucaagccuuggcguuacaugauugugugagggguaaagcaaugauacccuugaaaaucaaucacaucucuucagacaaggagggaccguacaucugcaaaaggaccuuuuugaccugggaugaaaugacucauuuuguuaucagugaccagugcauuuuuacaagccggccacagcugucugggacuguuugguugucucuuucccauagcuuaagagugggaccuuaucacuucaagggcauuaauuuucugccuccuucaaaggcaggagacaugugcacaggguggggauggggaguccuggcuguuuaacuagcacuaggacuaacacagaagggagugcuaaacucggugccaagggcuaacacagagaugagggcaggcugcaagaacaggcugucuuuugucucuuuauuugugucaacuuaaccugagcuagaguuaccugagaagggaaaggaaccucagcugagaaaacacuuucaucagauuugccuguaggcacgucuguaggauauuuuauugauuuauaauugguguggaaggacccagcucagugugagcagugucacuccugggcacauagucccuagcuauauaagaaaguaagcagagcaagcuaugaagagcaagccaguaaauggcacuccuccaugaucucugcuucaguuccugucuugacuucccucaaugaugaauuguuaccuauacaucuaaaaugaacuaaacccuuucccccacaagcugcuuuuggucaugguuuuuaucacagcaacagaaagcuaauuaaggcaacuggauuuaaagggagggcugagggaagaaguguaagaauuacauuguaagaagagcauauugaaugaaaaauuguugauggacauuucagaaauaugaucugauaguacauaaaucuaccuuacauuucuccuuuucucuuugaauuuuuauuaguguauguuaauuauauacuguagauuuuauaugucguuuucacacaugcauauaauguauuuugacuauacacaccccaaccucuuaccuuccuuugccccuugccugcuaauccuauccuuuuucccaacuaguccccuuacucuuccauguuuuauguuuuuguuuuuuuuuuuuugagacagggucucaguauguagcccuggcuagucaggagcuuucuauguagauuagucuggucuugaacucagagauaucucccuacuucugcuucuugaaugcugggguuaaagggggaggugugcacugugcucagcucuuccaugucuuuuuguugaugacccaguaaauuauauuaggacugcuuguaggagcaucgguaccugccuugccuuaccucgccucgcccgccucuccuuuucuuccuuccuuccuuccuuccuuccuuccuuccuuccuuccuuucucuaucucuaucucucucucucucucucucuuuucuuuuuuucuuucuuccuuccuuccuuucuuucuuucuuuuuugggguuguuuguuuucaagaccuuucuuagcccuggcucucuuagaacuaguucuguagaccaggcuggccuugaacucacagagaucugucugccucugccucccagugcugggauuaaaaacauguguuacagcuuguacaaccacucuggaaaguagucuggcgguuccuuagaaaauuggacauaguacuaccggaggauccagcaauaccucuccugggcauauauccagaagaugucccaaccgguaagaaggacacaugcuccacuauguucauagcagccuuauuuauaauagccagaagcuggaaagagcccagaugccccucaacagaggaauggauacagaaaaugugguacauuuacacaauggaauacuacucagcuauuaaaaagaaugaauuuaugaaauuccuagccaaauggauggaccuggagggcaucauccugagugagguaacacaaucacaaaagaacucacauaauauguacucacugcuaaguggauauuagcccaaaacuuaggauacccaagauauaagauacaauuugcuaaacgcaugaaacucaagaagaaugaagaccaaaguguggacacugugccccuucuuagaauugagaacaaaacacccauggaaggaguuacaaaguuuggagcugugacgaaaggauggaccaucuagagacugccauauccagggauccaccccauaaucaguuuccaaacgcugacaccauugcauacacuagcaagauuuugcugaaaggacccagauauagcugucucuugugagacuaugccagggccuagcaaacacagaaguggaugcucacagucagcuauuggauggaucacagggcucccaauggaggagcuagagaaaguacccaaggagcuaaagggaucugcaacccuauagguggaacaacauuaugaacuaaccaguacccccggagcucuggacucuagcugcauauguaucaaaagauggccuagucggccaucgcuggaaagagaggcccauuggacucgcaaacuuuauaugccccaguacaggggaaugccagggccaaaaagugggaauggguggguaggggaguggggggaggguaugggggacuuuugggauagcauuggaaauguaauggaggaaaauacguaauaaaaaaaaagaucaggaguucaagaaagaaaaacaaaacaaaacaaaaaaaaccccauguguuaccaugcccagccuuuuauuuucuuaauagauauguuaaaauguauuauuuaaguauaucauaauuuauuuggccauuuuccuaaugauggacauuugggcauuuuguagucacuauaacaaacuguuuauaguaaauaaccucuuaaccaacauucuuucacacacauggaaggaauucaucuuacaguuaaaccacaacuugaauugauuggcagagcaaaauauauagguauuuuacacaggcuuagugguacaugucuguaauuuuggcacuugagaguuggaaggcaggagaguccuucggaggucauccuugacuaguauuugcaagguuugucuccaugcuguagcauaugucaaaacuucaguucguugcugucagauacuacuuguauggccggagcacaguuccuuuauucaucaccugaugggcacuugggugguuuuuacuuuucagcuuuugugacuaauagugguguaaauaucuguguacaaguuaacacaaccguguuuucauuuuuucuuggauacauaaccaagaguagaacuacugaacugaaugguuaacugggaacugguaggaacugcugguugauuccuacauccgugugugcugauguuuauucugcucaauuuucuuuugucuuuaucuguuagaguucuuuaucuuuuuagcagaauugauggaggaauuuaaaauauuuauuauuuuauaauuuguccuacacuuugcuuaguucuuuucaguaauaccucuuuauuguuuuauuuaaguaaauguauuacacuacucuuuauggcuucuggugacguuucaugcuuagaaaauccccuuccuuccuuccuuccaacauuaugagcuaauuuucccauguguuuuuuuagcacuuuaauauuuauaugucauuacaguuagacugucaggcauaggcauauuuuuuucugauagcuacuugaugcuuuuaacaucauuuaauaaauuaucuacauuugucauauaauaaauuccagauuucagauaaguuucuucaucucuagguugauuuguguaacaguaauucauaacagucaugcaucuggauccuuucaacacaaauucuaauaccauuuaguucuuaaaauacaguaugcuuucacaauuuggaguaguuaaaccuguuuauaauuucaaccguguugaagcuugggauauagguaaaagaacacauuguuuaaaagcuaaauuacaaaauuugugucuggacauuuagauuucaagauugucuuuuuuuuuuuuuuuuuuuuuugguuuuucgagacaggguuucuguguuaguccuagugcuuucuuucuuucucccccccccccccgagacaggguuucucuguauagcccuggcuguccugggacucacuuuguagaccaggcuggccucgaacucagaaaucugccugccucugccuccugagugcugggauuaaaggcaugcaccaccacgcccggcucaagauugacucuuaauuacagcuuuuaagaguuuuuacuaaauaguuuucuacuaaaggagguuacaacaagcauauccauuauaauacuaagauaaaauauuuuucucauaauuaauauacuuccaucuuuaaaaucccagaggaccugacuggaacacugaauuguaugaagaagggggggcuacugucagagagcuucuuagugaacuguaugucaaaguuggugaaauucggcacuggggucugauccgauauaucucugggaucuuacggaagaaaguggaggcacuugaugagguacuaauaaguucuuggauguauacauaaucuaaauggggggugcacuuuuaaaguuacuacgugcugggaguauagcucagugguaggguacugucuagcauuccugggauccuggguucaauucuuugcacuacaugaggagaaaagcuugauuuuccuauguuguuguuguuuaaagcaaucacaacuucuaggguuuuuuuuuuuuagcacaucuauaaaguuucugguauucaguuagccuuuuauucgugaguggcaauuauauguuacugaaccacaagaacugcagacuauaaagguguuguaagccagaagaguuugagaucuuagugaguuuacacugagcugaaagucucugccuucuagaagguggaagugccuccugauuucuuccuggaaaucugucuucugaucauguuucaugagaaggagagcuugguguacggcuguaaauuaagggggauuaaguuuuguuggcugacaggaaaaauguuuagaaauaugaagguuucuuuuugaaaaggguaagcuuugcuaccucugccuaggccugcacagaccuucuguccuaccagaaacaccugacaguaggacuuccuccagaaccucgagagaagaccaucucugcgugagugggucaugugguuggguuugauagaguuucucugcaccuuuaagaaauugugugggcuuggcacaguuuucucacccuacuuuguagaauaucuuauaugcaaggcugcagcacaggagaaugacaggguacagguaaguuaaagagaguguuuauaggaaguaauaaucaaaguuuucuuacugacuuuuccucaauccccccuauuauucauuuaauguaugugaguacacuguagcucucuucagacacaccagaagagggcaucggaucccauuacagaugguugugagccaccaugugguuacugggaauugaacucaggaccucuggaauagcagucagugcuuuuaaccgcugagccaucucuccagucucaaauuccuuaauucuacuuuuuuaaacacacacacacauaucccacaccacaccacaccaggagaucaggaauuagcaacauaaaagacaaccuuagucuaaaagagaaauagaagaaaguauguaguuagagcauuggguugcuauugauauagcuccaugcugcugaagaacaaaucaaaggugugcguuuuauguuugguggaggugugggggaagggggugccucugcaggcccaugcugaggcaugccuucccuguaagggaccagccacaugaugguauagcauagaauagaguuuauucagugcauggguagggaaguugaaggaguagaggaagagaaaggcagagaggggagagagggagagagaauagaggagugaaggccugccaugagcauguggagagagaagagggaggggaaugggaaggggaaggaacaaaaggacugaacaagagcaagaagacaagagagugaggagggggcaagcagccccuuuuauagugagucagacauaccuggcuuguugccagguaacuguggggcggagccuagacuaaaggugugaaggucaaagcugaaagggaaaaugagcagcagccugagguggcaugucugcaagaacacugucaucagauugccacuggcccaguuuacuguagcuucugaauagcaguaguccccugggauagacugagacaagagggugaggaguggaaguuuaaucccuacccauaguagucacuuaccacuagccacaccaguaaaguuuaucugcacuaagucuaucuaaguucaugcgaugauagugccgauauuuaaaucuacaagcagaugguauuuaaaagaaauauuuuuagaauuauucuaacuucauaagugaucaaaaguaaaucugguuuucuaugaaagaauuaccuaaaaaaaaaaaaaaacagcaugucuccccaacugccaguucuacuacaauaaccaguguaguaaaaauguuuuuuuaauugacuuauuuuuuugagacaguauuaccauauguuccagucuugucuguaacaugcaauccuuuuacaccucaguccccuuauuauacgauuauagguaugcaccaccaugccuagcuagugagcuuaaccagggauugacaagagagaacacuuagcagggaugcuucggugguaucugcagacuacccuguuuccaguucauauauauaagauuucagcugccuguaagguccaguacuggauggaggcuuagagagacauuugccacagauucuauauguaacgucuuaguuauacuuuaggaaaauaguuuggcuaacuuucuucuacugccaugacaaauaucauagacuggauguuuaaaugacagcaauugauucuggcaguuuuacagugucaacaggauugguuucuucugaaggcugucaaggacuucauucuaggcaucuucuuggcuuguauauggcuguuuuccccuaugucuccugauauuuucccauccuauacaugucucuguguccaaaaugucccauuuuuauaaggacacuagucauauuagaucaggaacuaucuuaauaacuucacuuuaaucacuucuuaagagcccacuuuucauuaaaauccauuaaaaucugagguacuaaagauguugacugaauuucaacaucugagugaugaaggacacaguuuaaccuguaaggccuugcuuuuaguaaacacaaccuuguaucacaaauaagaucacuuuugugucacuagaagcauuucaaaagaauaugcccugacacaugcuugcuaagcacaccaugucaagacuggagagauggcucaacagauaagauugaauucugcuccuacaggaccuguuuguuuccuagcacccaagucagacagcucacaacccauuguaacuucagcuccagagguuggggaaugauguaacaccuuugaccucugagggcaccugcuacacauccccccccccacauacacacacacaaacuuaauuaaaauaaaaucuuaugucaugucaaugggagagagucauaggguuugaccaguuguggugauauguggcucuaauuccaaugcucagaggccugaggcaagcagauaaaaaauguaaugccagccugagcuacauaauaaaauccuauuuaaaaaaaaaacaaaugacucuccccacaaaaauacacaauaaaaaggcuacucccacaaaaguuugagagucacaaauaugaauguguauauauaccuguguguauguguguuugcaacuauagcugaacugauggaacuauuuaaaauaucaauauaccggggcuggagugaugccucagugauuaagagcacugacuguucuuccagagguccugaguucaaaucccagcaaccacauggugguucacaaccaucuguaauggaaucugaugcccucuccuggugugucugaagacagcuacaguguaugcacuuuaaauaaauaaauaaaucuuuaaaaaaauaaauaaaauaucaauauaacccuauaagaugugacuauaaaguaauaaaaugguuuccaaaggacacagcugaaaguaaauuucuuuguagcuauuaugcuuacuuguuccauguugaagacaaauuauaaaacacuagucuggaaagacauugaagggugagguuuaauggagucagagugggccacagauguagugaaugagcuuuuuguucugaugaugaugggcuaaggcaguggcuuggacuuguggugaguuuuuacucucuaaagucuauuuagguuacguuauuguagaaguugaucuuuagucacuguuuucuucucuaggccucuaccguacgaggcacucacuaagcugauagaugaagccagugaaggcgacaugagcaucucaacccuuacacaggugggcagugauuaaagccuagccuggcaguugauaagucacuauuuguaacugaccugacgauuuacaaaggcaacaaacacacugugaaaccugugcuaacacuuguuuaucuccauucuuuacacaggaaauaauggucuaucuugccauguauaugagaacucagccuggccucuuugcagaaauguucagacuucgaaucgguuugaucauacaaguuauggcaacagaacuagcacacucucuucgauguucagguauuucuuuaauucacaguaacuaguuuuagguggaauucacuucucgugcagauccuuggaguuuggaagagacauggaaaggaagauacagagcugugugaggcuuuuuuuuuucugaauuuauuggucacuaacaaagggagcaaaaaaaaaugguauauuguguacuggcucagcagcuucaaagaucccucggagacucugcauuucacagucuucuuaacuaaguccuuucaacuaacuucuuccuaacaccuuaagggcuuuggagauugacauacuguguuggauucugacucaaagaaggaagcuccuggacaccaagugugagucacucacuaaagugcaucauagugguaguggucucucaauaucaugaucaaacaaggaaggaaggauuuuaucaacguuuuucuaacaagacucuaaaguauuuauagguuuauuugucagcauaacaauuucaguugagaaaauaauuuuggcccgaggaagcuauacagcagaauugucucacagguuuaucuaccuuuugauggugcuuucuaaccuugccaccuaugacuuucacacuugagaaccauguacuugaauuuaaaaaaaaagccaggccaccuaugacuuucacacuugagaaccauguacuugaauuuaaaaaaaaagccaggcacugguggugcacaccuuuaaucccagcauucaggaggcagaggcagacagagcucugaguuuaaggccagucugauccacacagggcuauaugcugagcccaugucuccaaaaauauuucaaaaauguuuaaauagguuuacaaauuuguaucaggacacauuuauagcuauaugugacuauguguggucugcacaaggcugugccuaaaguguaaaguauaaaagagcuagagauggcauagaaaauauaaucacuguggcaaaacucaaacuaaaacucauuucauguauauuuccuaaaauggcauuuuaacaauuauuuaauuuuaauuauguguauauuugcaugucuguuuaugugugcguaugugaguacuuguuccuauauaguuccaaggauaucagauccccuagagcuggaguuacagaugguuguguuauaagccaccugacauggaugcuaggaaugaacucgcuuauaaccacuuagccaucucuccacuuccccacauggcuuucaacuuucuucuuagaggggcuggagagauggcuuagcaauuaagagcacuagcuucuguuccagaacacauggguuugaauccuagcacccacauagcaauuaacagcucucugaauuccagucccaggggauucauugcccucuucuagcuucuuuaaacacugcauacacacgauacauagacauacaugcagggaaaacaccaguacucauaaaauagguagauaugcucuacauuuuuugagauguuccaaguagcccaggugagccuauaaauugugauccuucugccuucaccucuagaguaccuggauuauagguagucaucauaaugucuggugcacaaaggcuuuuaauugauauagaucauucaaaauauauauucacauauaucuucaaggauauauauauccuucaagaagagaaacaauaauuauuuuaugacuauuauuuaucagauacuguuauuugguuuuauauuuuuauguauuaucuuauuuaaucuuuauaaccacccacuagagaauacaauguaauucuguuucugcaaauaaagaaacugaaaauuuaaaaaaaugaaagaaagaaagaaagaaagaaagaaagaaagaaagaaagaaagaaagaaaaguauuggguaggacacagaggcagauggagggaaaccuugucucaaacuuuucccccaauaaaaauauuaaauaaccugcccaauguaacaucaccaguauauaguauauaguagaauuugaugccaugucuguuugauuucaaaugauuuccaaucaguacauuuuuagaaauaaauguuuugcauaggauuuugcaagugugguaucaaggaauguauuuuuuagaggguuuguguccuaguuaggucucuaucguggcaauaauguaccauggccaaaagcaacuucuggggaggaaaagggugauuucagcuuacaacuugaacaugaugacaugaagguaugggggaggcagggcaggaacugaagcaggaaccuggaggcauguacuaaagcagagucuauagaggagcgcugcuuacuggcuugcuccccaugccuugcucaguuugcuuucuuacagaauucagaaacaccugcccagggaugacaccacccacagugaccuaggcccucccauuaucaaucauuaaucaaaaagugcccccacaggacuugccagagccacucccuccauugagggucccuuuucccagaugcuucuagcucuuacuggguugaccaaaaaacuaagcaacacaauauaauuauucaguaauaaaccucagcaaugauaaaacucucagucauucuuuacuguuccuugccuguaauagucuuccuguuggcaucaucaaaaucguuugcaggaggugcuucugaguagcuacuaacucaguagugccgccugcaaacuaguuuaucaaucucuacucuugaagacugauguccccucugauuuccaaacagucacugauuauauugcucacuuaagcagugcuauacaccauauuuuguuguuuuuauuuuuuaauuuuauuuuauuucuccuguuuacauguucuaucucucuaaaauuaaugguaaaccuuucaaugucaggugcugugugucauacuugcuuguacuaauauggcuuaaaaugaugaccuauaugcaguucccuucaaaaaaugacuacuguugaugaacacauucaaguucuccuuaguauucuuaauaaauucacagacucaucucugugaauaccauauacacugaaagcuuuugaguuuaacugugagcauguacauucauugcuauuuucugaaugccuuccauuucucuuguuaacuuucauucuuuucaccuucaaauaaagacuguagggaguuaugcaacaguguggaaacagaaugaagaagaaaguaacgagacagcuaaucuacaaucuagguagucuguuguagccguccagcagccauggacgaaauggguaccugaaaggggagcuggaaauaaaaaggacaggaugcgagagaaggaugaagccgagacaaagguucugaucaaggcuccaaguuuaauauucaucacuguguuuauauagggagaucucacagacccauucuuuguuucagcugguuuauguugcgaagcaaggucauugggcagucuauucuucuaaguuccuauaggaguugcaugugcaaucacguagaucauuaagcccauuguggcaagcacucaaggucuguucagccugcuucccugccaaggcuggggaaggccacagucuguucuuaaauaguaaaaaccuaguguuguaugaacaggcaauuaucuaguguuagaaauuuguuauguaacccacaucuucuaaagugacuuagaaaucugaugaaaggaaguagaggguacaacuuccaucauagaggaaaggagagggcacaucggcaugagcagaccaaguguggucaccaaguuccugcaauugugucacuuaacaggcugaggcaggaggaugauagguuuaaggcuagccuagacuguguagugagagcuuguuucaaggagaaaauggaaaacgaggaugugggaagcaaaguugauuuccuucugccucaauuucuguccauuagcugaggaagccacagagggccugaugaaucucaguccuucagccaugaagaaccuccugcaucacauucucaguggcaaagaguuuggaguggaacgaagcgguaagacccacgcacuggacuuguacuuccgggaacugaauuuuaguccucaguuuuaaaauguugcucuuuaucauaggagcucuuaguccccaaauaaauagaacuccaauaaauaaaacauguaaaagcaaaacuaucuuuggaacaauacuugaaaucuaaaagaaaaauucaauuuaacagaagguuuuggacuagggagagggcugaugguuuaaguguuugcugcccauacuugaugagcugagucagcaucucuaguacccacauaaaugcugagcucaguaccuuaugucugcaaucccaccucagccauggccuaguuugcuuuucuugcugugauaaauaccaugaccaaaagcaacaugggacugaauggguuuauuuggcuuauaaguccuggucacgggccaucacugagggaagcuaaugcaggaacgcaagcaggccaggaacugcuguggaggccaugaaggaaugcugcuuacuaguuugcuccucggggcuuccuuguggcucccucaguuucuucuuucuacaaccuagaaucacugguucccauuggcuggaccuucccacauccaccauuaaccaugaaaaggcccugacagacuugccuacaggccagucuguuggaggcauugacucaguugagcuuuccucuucucacaugacuccaguuuguguuaaauugacaaacaaacaaacaaaaaaaaaccaauaaaaacaaacaaaaaacuaaucgacacacucccauauugagaugagaggcagagacagggggcucucaggaagccugugggccagcuagucaauauaugcagcauugugcuagaaagacccugucucaaacaagggagaagucaaggaccuacacggaagguuguucucucaccuccacaugcauaccauggcagacauguuugcucauucgcacacgcacucugccuaccucccucugucucucugcccccccccacacacacacauagcacacguuuuuuaaaagauuuggaaacauacacauucaguuccuauggaggccagccagcgacuugcaagacuggguucucuccuuccaacauaugugucucaggaacugaacucaggucauuagacuagguagcaagggcuuauaccugcugggccaucuugcuggcccucauguuuccuuuuuaacuauauaguaaauuaccuuucauuuuccuaauucaggaggacaacuaaaaacccacaguaugaaucucuauuguauucaaauugucaguaauucagcagaccugauaauguuauggguguguguauauugguaguugcaacauaucuacuaugucccuucaaccuuaaauuauaccucuaaaguaucacaaccuaaucuucauguacacuuuuagauuuuaauuaacagguguuaauuuuauauaucacugaaauuacaaguauuauuuuauuuuaauacauguguacagcaugugucgaucaaaaccaucaugcacucugaguuuuuacaguauuauuuaugcuguauaccuaaagaaguagaacaaaaaccuaaagaagugagaaaaaaggauuaucucauauguucaauuauuaacuuuaaguuauacuuuuucagguggagggauggccagacuuuagcauauuugguuuuauuuuuguuuuguauuauuuaagucuugcuguguccuuccauggccuccugggagagagcugacucagguagugaggaaaagaagaaaagacaagcauguacagacagacagacacacagaaaaucugaagucuguggauugggcucugaugaagaaacugcagcauccccaaaguuuaucauguuuucuuuuguuuguuuguuuuuguggauauuuuauuuauuuauauuucaaauguuauccucauucccuaacccccccccaggagcccccuaucccauuccccccuccuccugcuuauaugaggguauucccccacccacucacccauuccugccuccccgcccucgcauuccccuacacuggggcauuaaaccuucacaggaccaagggccucuccucucauugaugccuaacaaggccauccucugcuauauaugcagcuggagccauggauccuaccauguauacuccuugguuggugguuuagucccagggagcucuggggguacugguugguucauauuguuguuccuccuauggggcugcaaaccccuucagcuccuuggguacuuucucuaguuccuccaauggggacccugugcucaguccaaugguuugcuguuagcaucugccucuguauuugucaggcucugguagagccucccagaagacagcuauaucaggcuccugucagcaagcacuuuuuggcauccacgauaaugucugcauuuggugacuguauaugugaugguccccagguggggcagucucuggauggccuuuccuuuagucucugcuccacacuuugucucuauaaccccuuccauggguauuuugaucccccaucuaaggaggacuguggucuuccuucuucuugagcuucaugugguuugugaauuguauauuagguauucugagcuuuuggacuaauauucacucgucagugaguacauaccauguguguuguuuugugucuggguuaccucacucaggaugauauuuucuaguuccauccauuugccuaagaauuucaugaagucauucuuuuuaauagcugaguaguacuccauuguguaaauguaccacauuuucugucuccauuccucaauugagagacaucuggguucuuuucagcuucuggcuauuauaaauaaggcugcuaugaacauaguggagcauguguucuuguuauauauuagaacaucuuuuggguauaugcccaggaguguuauagcuguguccucagauaauacuaaguccaguuuucugaggaacugugauuuccagauugguuguaccagcuugcaauccuaccaacaauggaggaguguuccucuuucuucacuuccucuccagcaucugcugucaccugaauuuuugaucuuagccauucugacuggugugagguggaaucucagguugauuuucauuucccugaugacuaaggauguugaacauuucucuuuuucuuuuuauuggauauuuucuuuauuuacauuucaaauguuaaacccuuuccuaguuuccccccuccuggaacuccccuaucccauccuccuucccccugcuucuaugaggguguuccuccacccacccacccacucccaccucccugcccucaauuuccuacacuggggcaucuauggagccuucauaggaccaaggaccucuccuuccauugaugcaugacaaggccauccucugcuacauaugcagcuagagccauguguugauggcuuagucccagggagcucugcggagucugguugauauuguuguucuuccuaugggguugcaaaccccuucagauguugaacauuucuuuaggugcuuuucaaaccauucgaguuuccucaguugagaauucuuuguuuagcucuguaccccauuuuuaauaagguuauuugauugcuggagucuauuuucuuaaguucuuuguauauauuggauauuagcccucuaucauauguaggauugguaaagaucuuuucccaaucuguugguugccguuuuguccuauugacaguguuuaucauauacaguugaacaggaggugaggcuauugcauaugucugaacaagggggcuggguuagcgagucuccauaggagcaaccuuaaggcuguaaacauuggggaaaggcaacuaagguagauauuuucugcacacacuaucaauauucauacucagauucccaaggaaggcuuugcuagccccugaaccucaccuggggaagguucugcuacauggggcagaggcauuggaguccuuggcauggccaugccagugucaacagcacauacucacucaggacuucauucccuuagcaccccuccacucccugcacaaguuagaaaacaggagcuggagagacugcauggcaguuaaaaguacuuacuguucuuccagaggcuccaaguucaguuccuaucaccuauguagaucagcucacagcugccuggaacuccagcuccauggaacacagcuccuucuucugcacauguggcauacauuuguuccugcacauguguacaugcacauacauacacacaacaaacaaauaaaaaucauaaaaguagccaggugauggggguacagaccuuuacucucagcacucaggaggcagaggcaggcagaucucugaguuggaguccagccugucuggagagggaaaacaaguuucgggauacacagugaaauccugucucaaaaacaucaucaucaucaccaucaccaucaccaucaucaucaucgucuauuuuaaaguuagaaaauaguacucaggcuggagguauuucuaaagugaagauucugaaguagucugagauucugcuaucaguaucuucugugguacugaugcugcugguccaagaaccacacuuaaaacagcaagguuauacuagguuuuucuuauguuaaaaacaaaagaaggaugcacauuuaagucuuuuuaaaaugauugagaaaaugagacugauuuuucuuuuuucuuugauucuauacaguucgucccacugauucaaaugugaguccugcuauuuccauccaugagauuggugcuguuggagcaacaaaaacugaacgaacuggaaucaugcaguuaaaaagugagauaaagcagguaagauauaaccugaaaaaguauggauguggucauaauuaauaacauucuuagcuggacaugauggugcaugccuauaaccccacacacaggggauacaaguuggaggaucaagaggugaaagccagucucggcaacagaggaagauggaagcuggucaggaauacuggagacacucacuguccaaaaacaaaaucaaaaccaaaacaucauuuuaaaugagacuuugcugugcucauuuccuuaguuucuuauccugaguauaacuugaaccauuuguuuuccagguggaauuucguaggcugucugucucgauggagagucaggugaaccaagacaucuuucaauguugacuggcuuuccuaacccuuuucgaagcagacuuuguugugcucacauccuuuguuucccauccugaguauaacuugaaccauuuuuucagguggaauuucauagguugucugucucaacugagagucaggugaaacaaggaagacuuuuuaaacagacuuuaacuagccauagcaugcauuaccucacaaacuuuccacaagcaaugacacaccauggaaucucucccauagcaaccauuuguagacagcacucccuuuuguagaucaaaugacuuaauuuuaggaagaaaguaccuggcaacagguagcaagaaagugauguccugaguuuccuuauuacaguuaaugugcaauuuauaauggauuuucuuuauaaaaguagacacacuuauugcuuuuaagaauagcuagcuggagagguagcucagcaauuaagagcaguggcugcucuugcaaacaaagaaccuaguuuuguuuuccagcaucaacaugguggcucacaacagugugacuccuuuuccuggagauuugaugcuuucuuuuggccuccauggguacugcaugcacaugguacacagaaguacauucaggcaaaauauucauacacauacaugaaaaauaaauacaucuaaaaaagcaaaacaaacaaacaaacaaaacaaaccauggggcccagagagauguuuuaguaguuaagagcauucccugccuuuauggaggaacaagguuuaguucucagcacauacaugacagcucacaaguguccuuaacuguaguuccaaaggaucagauaucuucuucuggcuccacaggcaccaaccacacacaugguguacauacauacaugcaggcaaaaaauguauacacguaaaauuucaaauuauauucuucaaaaauuagaaaaaaaaagaauagguacaagaguguaggugaagguuuuauuuuuaaaucuuuuuggagauuuuaacauguacaagcaccauaaacauaaaggacaaugauguuuuauuagauuuuauuccaaaauucgacuuuaucaaugcugagagagguacaugagugcuacuguguaggugaagaagagccaugucuaaacagacuaggaaucaacaauauauuagagccuccuuucacugcugcuaacaaugacuggcguguugcauuauacaacggaauguauacucucuuuuaaagcugugggaaacuguuugauuuuaggauaucuccauugagaaggugcuaauguaaguccuucuaguaccacuucguuuuuguuugagaaucccacauaugcauauaauacacuuggaugaaaucuaauccucagucauugcccuccaccgucuccauauccacccccuuccacuuuccucacacaacuucauggaguccacuuaaugcuacuagugugugcuaauuccaugaagaaugauaguauuaagcucucaccuagggucuaugaccuaaagacuauacuuguagagaucacuuauauaguuauuaauagcacuucauaagaaaggcuuauagaauuauaauagcuuagagcauuaaagccucauggagagaagaagcaaaugaagauuuuguuucuuuaaaggggagcucugaaaccauuuaggagaguucuugaagauuaauuuugaaggaaguuuggguaccuuccuuaaauauccuuuaguguuuguauuuuaugcaaggggaagacugauauaagaagaugggcuggagagauggcucggugguuaagagcacuggcugcucauccagagguccugaguucagucccuagcacccacaugauggcucauagcaucuguuacuccagacucagggaaucuggcacccuuucuggccuccacaaacacuacaugcaugugguccacagauauacauauaagcaacacacacauauacacaugacauacaaauaaaauaccaaauauauuuuaaaagaaaaaaaaaucgcaugcuacaguucuugcuagguaacuuuuuuuuuaucugaacauuuuccuauuugaaaguggaaaggacaacuucagugcuaaauaauuguucauuggugugauuggguaauaauccuuguuuugguugagggugauaggcuaagugcauuauaguuuugggauuuguuuuguuuuguugcaacaaggucucuauagguaaccugacuauccuggaacucaauauguagcucaggcaagccuuuaaacucacagaaaccugccugccucugccuguagacuucugggauuaaauguguguaccaucacacccagcucacauuauagguuuguuugguuuuuuuuuauagacaucugguauuacuuacgauuuuuuuuucauuuuuuuauuagguauuuagcucauuuacauuuccaaugcuauaccaaaagucccccauagccaccuacccccacuccccuacccacccagucuccuuuuuuggcccuggcguuccccuguacuggggcauauaaaguuugcauguccaaugggccucucuuuccagugauggccgccuaggccaucuuuugauacauaugcagcuagagucaagagcuccgggguacugguuagcucauaauguuguuccaccuauaggguugcagaucccuuuagcuucuuggguacuuucucuagcuccuucauugggggccaugugauccauccaauagccgacugugagcauccacuucuauguuugcuaggcccaggcauacucugacaagagacagcuauaucaggguccuuucagcauaaucuugcuaguguaugcaauggugucagcauuuggaagcugauuaugggauggauccccggauauggcagucucuacaugguccaucuuuuuaucucagcuccaaacuuugucucuguaccuccuuccaaggguguuuuguucccacuucuaaggaggggcauaguguccacacuucagucuucauuuuucuugaguuucauguguuuaggaaauuguaucuuauaucuuggauauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguuccuuccagcuucuggcuauuauaaauaaggcugcuaugaacauaguggagcauguguccuucuuaccaguuggggcaucuucuggauauaugcccaggagagguauugcuggauccuccgguaguacuauguccaguuuucugaggaaccgccagacugauuuccagagugguuguacaagccugcaaucccaccaacaauggaggaguguuccucuuucuccacauccacgccagcaucugcugucaccugaauuuuugaucuuagccacgauuuuuuuauauuauuggaacucaaaguccuuguugccaucuagauuaaaguccaccuuuccagcuacucaagguuuuucuccuacacauucaguaccuacaggucuucaauggagcccaaaugcuuaagacuauaauuuagaggauagggaagacuccguuaucauuacuuuuuuauuuauagcaucgcuuuccauccuuacaugccuaugugguauuuugcauucuuuucugcuauuuaccagaacuuuaauuucuagacgaaguuauuucaggguaguuuuucauuuauuuuacccuuuaccauggcauuuagaggaaacuuauuucuugggcuuuuaaugauaacauguaguauacuacuacuaauagcuuuuuuagacacaaauaaugcuugccuuaucucaccucuuuaaaaaaaauuacuuucucaauuucuuuuauagacuagugguggucaucccucggguguagauuugaugucgccauccuuucugguaacuccuuuuauguuaucucauguuucauucacaaguguuuugauauaaugguauguagaucauaacauaguauuugacuauuauaaaaccaaauugggggcuagagagauggcucagugguuaagaacauuuguugcucuugcagaagaccugcauuccauucccaccauccauguucacagccaucuguaacuuucaaguacuccugugguagcuauuuauacacacaaaauaaaucuaaagcuaaaaaccuaaauaaauaaauggauccagaaguaacaugacuaugaaagaaguuccuacaaaagggagaggucuguuucuuuccugguaaguuaggaaaggggguucaaucacuuucuuuuaggaagaaaauaaaacaauguaauaaguaguuguucuguguauauucauucuuugagcuguugcaagugugcaucccugugcaucuaacaguggacuagacaacaugaacauuaguuuggaauuuauuugaaaauccgaauuuuggucuguauccuagugaugcuaaggcccagcagucuguucuaaugcgcucuuuaggaaauucugaggcacuuaaauuucaaagguacucuguuguagcugguccccugagauguaauccaguuagugaaugaacuaaaugccaacuuuaugucauguaugggagauaugguguugaacaaaaugaaaaugauacaaugaugcucacaauugaggaagauucuuuucuaauuaaauuccuuucaucuuuguuuuauccacuucaucagaacauacuaagcuaugaaguaaugaguuugguuaugacauuuucuuauacauaagauauacuuuaaucauauauauuuugguuuaaaucauagcaaguuaugauuucauuucucacaaauugaagaagagagcuauuagaaauaauauuuuggcuaacuuuaaguguuagauuaagaagaauuggccagcuuugugauuuccauguuaauaguaagaucauuagugauuuaggaaauuaaaaugacagaaauuguuuuccuagaaaauauuucuuucacccuucauuuuuucuuuauuucugaaucuaaucugucaaauaaucauuuuaaccaaugaauuuucuccuuuauuuagcuuaauuuuucagaguuuuuauaucaucacacacauugcuauuugauuccuuuuuauugcacauucucucuaucuguugauaaugucgauauaaaccuuuauguauagauuucuacauagauaugugucuguaauuacacagauaugugcuguaauuaaaacaccaaaagcaacuuuaagaggauuauuuuaucuuacaucacaguccaauugcaguccauccuugagggaagucagggcaagauuucaaaaucaaacgaggcaggaaucuggagacagaagcugauguagagaccagggaagaguucugcuuacuggcuuugcucaaccugguuuuuauauaguccaggaccaccuccccagggauggcaccacacacaaaggucuaugccuuucucuagcaaucacuaauuaagaaaaugcacuacagacuuugcuacagcccaauguuauggaaacaguuuuguguuugagaguuccucuuccaaaaugacauguguauuucucauuucucucacaucuauuucuauggggcuguauuaguuacuuuucugugugcuaugacaaaaauaccuaaaaaguaacuuauaaaaaguuaaaagguguauuuuggcucacaguuugagggcauaguccaccaugugaggggaaacauggcaacaggaucaugaagcauccggucacauugaacccacaguuaggagacaggcgaaugcugguucucagcuccuuugcuccuuuuuaaaaccuagaauuuuacaauuuucuuuuuuuuuauaacugcauacauauaaccaauguaucuugauuauggcuauccccaacacucccuuccacucuucccagccacugccaacacaugcgccucuccacuucacauccucuccauuuuugcccuaaccaauggaaugcuuuucuuuacuacuacuacuacuacuacuacuacuacuacuauuauuauuauauuuucuuuauuucaaauguuauccccuuuccucauuuccccuccgaaaacccccuaucccguccccccucccccugcucaccaacccauccacucuugcuuccugccccuggcauuccccuacacuguggcauugagccuucacaggaccaagggccucuccucccacuuaugacuaacuaggccauccucugcuacauaugcagcuggagccaugggucacuccaucuguacucuuugguuggugauuuacucccugggagcucuggggguacugguuaguucauauuguuguuccuccuagggggcuggaaacuccuucaguuccuuggguccuuucucuagcuccuccaguggggacccuguucucaguccaaugguuggcuaugagcauccacuucuguauuugucaggcacuggcagagccucucaggagacagcuauaugaggcuccugucagcaagcacuuuuuggcauccaccauagugucuggauuugggaacgguauaugggauggaucuccaggugggacaguuacuggauggcuuuuccuucaguuucugcuccaaacauugucucuguaucuccucccauggguauuuugacccccuaucuaagaaggaccgaaguauccacacuuuagucuuccuucuucuugaacuucauguggucugugaauuguaacuuggguauucugaacuuuuaggcuaauauccacuuaucagugagugcauagcaugcauguccuuuugggucugaguuaccucacucaggaugauauuuuccaguucuauccauuugccuaagaauuucaugaagucauuguuuuuaauagcugaguaguacuccauuguguaaauauaccacauuuccuguauccauucuucuguugagggacaucuggguucuuuccagcuucuggcuauuauaaauaaggcugcuauggacauaguggagcauguguccuuauuacauguuggagcauccuuuggguauauucccaagagugguauaucuggguccucagauagaucuauuuccaauuuucugaggaaccuccagacugauuuccagagugguuguaccaucuugcaaucccaccaucaauggaggaguguuucucuuucuccacauccucuccagcauccgcugucaccugaguuuuugaucuuagccauucugacuggcaugagguagaaucuaaggaucguuuugauuuucauuucccuggugacuaaagauguugaacauuucuuuaggugcuucucagccauuccaguuuccucaguugagaauucucuguucuccauucuuuuaaagauucauuuauuuauuguauacauaugaguaccccaccauuguucucuucagacacaccagaagaaggcaccagaccccauuacagaugguugugagccaccaugugguugcugggaauugaacugaggaccuauggaagagcagucggugcucuuaaccacugagccaucucuccagcccuguucuccauuuuuaaauaggguuauuugguucuuuguagucuaacuucuugaguucuuuguauauauuggauauuagcccucuaucguauguaggguuacuaaagaucuuuucccagucuguagguugcugguuuguucuguugacagugcccuuugccuuacagaagcuuuguaauuuuaugaaaucccaaucagucuuaaccaaugcagaggguuaggauaauuguuuagcauuuuuaggaacuauuagacuucugcagagcugaacuucuucacaucccauuguguaagcauuuuaauuuccucacccccuccccagugcuuauucuugucuuucuuuuguuguuggccauccuaguggggucuuguuuuaucauagcucugugcacaaugauauugauauggccauuugcuuauguuugaagaaauauuuuauuucuaucaucugcccauuauuuuaauuagcauacaaagauuauguuucauugugacauuuuucaaacauccuuugcuuuuguuccucguucucuucgccucccuugcccaucucccuuccccuuuguacccuucuaucuccuguagucucuuuuccacuuucaugucaccuguugucucccuuccucuccucccucagcacccccuuuuccucucauugucuccuuuauaguuucaugaccaagacccacauuuacacuuacauguauacagccaauuaacugauaagguagaauuucagaguagcuuuaauuugcauuucccugauucuuuacccauuuuuaauuguguguuuuauauuugggaguuacaaggauucuuuauauauucuaaauauaacauccuuacagaauauuuuuauucuuacugauguucuuugaagaggucuguuuuaucagaggucaguuuuucuauuuuuucuuuuauuguuccuaucaaagaaggcuuuaccuaaaucaacacuacaaaaauuuagugcuauuuuuuucuucuaagggcuuuguuaaaauuguuuuagcucguacauuugagacuaugauuauauugggaggugaaauucccuaaaacuauccacagcuucagcaauuuaguaggagucacaggauuaaucacacauuaaaagacuuaacaacaaaaucagcaaaagaaaaggguguacugggugaaacccauagaaaagcacacaagauucuaggaguacuccccagcagagccaucuauaggauguacuaaaauuccuccuguaaaugacuaguuacagcaggugaagugcugauaaccgaaauagcuaauuaaagacccagcacaguaccuagggucuuuggagcuagucauaaagagagccucugucuggcauuccccaaacucuagacucccaggaggaaagaagguguucuaaauaaacuagugucgauacaagcaauuuaugaguggugauuaguuugaggaauggugauauccaucugaacgcccacauuuccagacuccagaugaaguaccaagccuguaacaaaugacuuuucaaaaacagcacacuugucuucuggucuggucugcugugcugacuguuuuuuaacacucuccagggcaggccccaugcaaauacaaaaucaacuccaugggcuuuuuggaggauuuuuuuuauuuuauuugggaggagggcuguuuucuucaguuugaguaugagcuuuuuguuuuauuuuguuuugguuuuaucuuauuggucuuuugcuuguuuguuuugauuucccuuuuuguguuuuuuauuugguuugaggcucuuugucuucccuuucuuucuuuuugccaaaauuccaaugggauucccacuuuuuugcauaguguuaaauagugugcuacuucauucucugccauguggauauccaguuguucagcgccauuuguuuaaaagauuauuuuugcucccauuuaauucuucugaaacuuuuauugaagauuaauuaaacaaaaugugauugauuuauuucugaauuuugugcuauugaucugcaauugauuugugcaauugaucugugggucgauccuaugucaguaauuacuacagcuuuguacagugcauuaugaaauugaacucuaugagucuucauacuuuuuucuuccuuuuuaaagauuguauuggauagcauagguuccuuaaauuuucacaggaauuuuagaauucacuuguucauuucugccaagaauucaacugggacuuugauaaaggcuguguucaaucuguggaucaaaauuacucucuuacuaacguccucugauccauggguuuccuuccauuuguuuaaguaguuuauuucaguauauuuuagaguucucagacaugcuuuguuauauuuauucauacaguuuggccucauguuucuuuaaaaaaaaaauaaaggcaggaucucuguauguagcccugccuguccugaaagucacuauguagaccaaguuggccucaaacucacaaagauccaccugucucugccucccaaguacugugauuaaaggugugcaccagcaagccuggaccuauuuuuuucaauacuguuuuaaaaaggaauugaucauuuucuuaguauuuuuuuuucaucagacuguugucuucuacuguuuaaacagaucucaucuuuuaaaaauauguguaaccugcucuaucauuaaugauaguccugaggguguauuuauaagcccaauuaaaugguuucuuuuagaaguugguguagucaugguguuuuaucucagcaguagaaaaguaacauacagaggcuuguguuaauagucauaaaagugacaaacaaaaccagagagcagcuagacguuaaacagauaaagccagauaagcagacaguugggaauguguugcuggcauuuuuaugguuguuauucugaaucaccagagugcuguauauaaugauuuccccagggaacaucacaccaguuaguuacccaauaccaaauggucagccuugaguacacucauagaaguaucauuguacagacugagcaaauuauucuuguguauauguaugggauaagaauuaauggaaaaaggccaugaauuugaaaaagagcaaggaaggauauaugggaggguuuggggggaggaagggggaaaugaaagaauuauguuauaaucucaaaaauaaaagaaauaaauuauuuauuuuuucauuaacuuacuuauuuauucacuuuacauuccaaugauuaucuccugguucccuccucacacagccccucccccagccccucuuuccuuuucugagaggguggagguccccuugguuaccgcccccccccaggcacuucagagacuauacagaguuacagcacugcaagcuguacagagguugacuagcuuuacagucaugucaucccauuggcucugucauuuagugugugcuucguccuucuauggaguauuuacaauucacuggguuacacacuguuuacaacguuuagguuuugaaauuaaaauauagcaguauuauccucaaucacaggguaagaggucacuuuugauuuacauuuguucuucucccaaguccccugcagccuguauugcugcaaguaguggauccuuuccuacggugugugaucaucagacaucuaaagauagucgucaaggccaguggcaacgcaggagaaggcuagauggagcacuaaauagaguaccaauuggauuuuaucaaaaaguauggaaaauuuugcagaaagugaguauaacacaguguuauucuuuauuccccucuugaacgucugaaucugucuagcuaacgugacauaaucauagcaugguuguaauuauauagagaugaaaugcucagauaaaguauagacaaaaacacaaagcaauugauuuauugugacauuaauaauuuuagucuaauuuccuuauuguuacaauguguuguuucaaauaagauuuuaaaaaucauaaccucucugcuuugugcuauaguugaacauuguaggauauugcaacacauuugcugccagucaauaaugugcugcuaaguagcucgcuuucuuuguugguauuaugaaaguggagauguuauuuguaucucucagcuauucaucuuuauaugucacuacaagaaaacaaaugaccuauguggggaguuuguacaggcagcucuuacuucuaugcuuucuuagaugaauaccacugaacaaauggaaagccacaaugaugcucuuguuguugaugaagauggcuuguuguuugauuuuguuuuugcuuuuuguuuuuauggguauaugugcuuauuuuauauguauaugugccuguguauacauauguucaugaaguuccagcagaagucagaaguuggcaucaacucucuuggaauuggaguuacaggcaguuaguugugaaccaucaugugggcggggucuucugcaagacuagugucuuaguuaggguuuuacuacugucaacagacgugauggccuaagaaacucuuaaaagaacaauauauaguuggggcugaccuacaguuuagaaauucaauccauuaucaucaaggcaggaacauggcagcauccaggauagcauggugcagauggagcugagaauuguacaucuucaucugaaggcugcuagcagaauacuggaugccaggcagcuaagaugaggguuuuauagcccacagugacacaccuacuccaaaaaggccacaccuacuccaacagggucacaccuucuaauagugcuacucccuggccugagcuuauagaaaccaucacaacuaguaacugcuuuuaaccuuugagccaucucuccagcucugaauaauuuguuuugagacaggguuuguuauuguccaggcuggccuccaauucaagauccucccaccucaguuucuuggagugcuaagauugcugagauguaccaccacaccaggccuagauaaaacucuugguguagcuacuauuucuucuuauuauuuucuaauagacauguaagggcauaucacaccauuauggugaugcuaauuuuuacagggccaggaagaccauagugcucauugacuggucucauuuauacaaauacaaucuuuuuucuugaaauauuucaccaauggcaucauaaucuugagguagguuuugacccugccaggacagugaucuuccagggacauauuagaaacagcaaaaguugauuccucagaggcuuugcucuagggaccuucauuuuaucaauuacuuggagucugcucuguuacagcuauuauaacaugauagagaccacauagagauaguauauauuuucucucuccaguuauucauggauuaccacaauucaacauaguaauagacauguauuaggugcucuguccacauaagaacauguauucuuuaucaucaaggaguugaauagucuuccuucaaagcaacuguucuacaaggccauacacagccgaaaugauuuguaauaaagaucccuaaccacaaggcaggcaaaacgauucuugccacccaccaugacuaaccaucugaguuccauccagggacccacaugauggaaaacaagaacuaacuccugcaaguaccccucugacuuccacacauuuguuuacuugugccugcccugaccaccaccacacacaaauacauguuugaaaaggauguuguaggaauaacaaaggacuggguaagucugccaaggaagaauggguauuuuuuggcagagucaaaaccuagacuuggugucuuaaagaaguuaaacccaugcuuuuccagacaugaaaguaacaauaauuuuuacauguuucaaagcuggcaauugaauguacggagauuacuuagaauccggaauauaacacguaaugguccaacagagucgguaaaccuguuggucaugugugguuguuuucuauaguguuuugacuucuauaaaaucuaaaauaacugauuaauuuccacugcuuuuuaauaguugaguucauaugcuagagaaaggcagagaguugcuuguguuaucuauugauccagguauggugcuucacaccuguacuugaaagcacugagaaggugaaggcagaacuuccaguguccaagagcagccucagccacauagugaauuuuacauaagauuacguuacauguaaccaugugucaaauaaugacaaugauaauauuuauugaguaucugcuaugcaccagagugucuucuggucauucccauuacaaaagacaaaauagccaacaauucuguccuuguggagcuuauauuacucacaauaaguaauaaacagcaaauaauauaucuaaaauguuaaaaaaaaaaggugggaaaauaggacaggauaagcauauugauagguguggcauacguuuuuccucuucuucccuaugguguugaggugccauugcacagcagagggggaggaugggacagaacccuguucugcaguccacagcuuuucuugguaacguucaaaacgggugggucccaggacuccccacacagugucagagaaggagaagcccugcugguaaagggaguccuccaguuuugccaagcucagaaggcuaucagaacaauuagacuuugaccuuaaucagcagugcccaacaaugagggacucaacuagaacgaguaggaaugggucauuguacauaaauguauaaugugagucauuuuuacagccuaagucuccugaagauccauuuaauuucuuaaaauaaauuuuguguguguguauguguguguguauacguauacaugaugguguggagcucaugccauagcauacauguagagguuagagaacaacuuuguggauuguguucuccuuuccuccuuuacuugggauuaugggaguaaagucaugucauuggacuugcaugggggugugagccaucuugccagccuuugaaguacacuuagaaauaugaggucucuccuccuggccucccaguuguuagcucaucucugguaauaacugguuuuucuauuucgcagugucaugggcuuucuguggaagguuuuguucuucccucuucaaccacuagggagguaagguucugucuuuucuauuuacaugagagaaagcuugccaucugaaauuuuucaguuauuaguuauugaauuaacacugauuuauaaaucagcugagugcacugcauggaggagguaaagcuggaauggggacaguagacaguaauaauacggugcuggcgagccagcucacuuggcaaacugcugugccaugcaagcaugagccuuuuuuccucuggauuauuuucuuugagcagagucccagaaauaauauuuuagguuauaggacaguuauacuuuuaugacucuuauuaugcauuaccaaauugccuuccaaauugauuaagccaauuuauaccauuucauuaaaggggcugaagccauauuguacuuacagggcuuuuuacggcuuuucaaaggaaaggauucauguucuugggugaugggaucuuagaaagugauuuguuucuuuuucugucacagaugaccccaggugagauuaaauucucuguccauguggagucuguccugaaucgugucccucagccagaauaccgccaacuucugguugaagccauccuuguucucaccaugcuggcagauauugaaauucauagcauugggagcaucauugcuguggagaaaauaguucauauugccaacgacuuguuccuucaagaacagguagguuguccaauguggaauacaccugcaaucacugcaucuaggaguuuggaggccagaggauugggagaccaaagccaggcucagcuauuuaguaaguucaagaccggcuuuagcuacaggagacccaaaaccuauaacagguauuuccuucucuuaaccacugugagagaagacagaaguauccaaacaaaauaugaaagacccaaggugggggaucccaauauagucucacuaggguucucuccaagugcuaauaacagaggauguuauuagcaaaugugacucacuuaaucaaauuuuaauugauauuuuauuuugaaaaugcuuuauaauagaaaauucuaaauaguaauuaaaauaauuucgggagucuagugacaagugcuauguauagaaguucauauccauccugcacaacccuucauguccccuucugguuaaacagccagagaaauggugcuggggaggaagcucagaggcacacuaauuagaguuugacucaguaggaucaguaauuuucccuuucacucuguuuucccacccuuuuaaaccaaauagaaaacccucggcgcagaugauaccauguuggcaaaggauccugcaucuggcaucuguacucuccuguaugacagugcacccaguggcagauuuggcaccaugaccuaccucuccaaggcagcugccaccuacgugcaggaguuucugccacacagccucugugccaugcagugagggcuguggguucugccuguuagaacacuucaguagcuagcccgucugguugauugugcauggaacugacauguuaacaccugaucacucccccaggcccuuuuccugccccaucccuccuaggaagagagaacuuugcugacgaucucacuacuuuugaagaaaagaagcccuaucuggagacuugacuccagagcgaagcccuaucuggagacuugacuccagagcgaagguucaacugcgccugcagucacuaucccuacuuuugugguucauagaagucugcaugugcguugauucuguagagcuguuaguggcuuaguuuuuaaacuccuauuggggaguagguauuaauaacuuauuccuguaaguugguuuucuuauuuguugguuuuuacguguguauaugagugguggguauugauuaggccaucauuucaagagaguagaugcuaaguuggauuucgugcugcuguaaauuggaacugucgacucuaagugccuuuacuuaggaaaagccaguaccacaucauggcuuccuucuucacucaaaggcugcuuugcucugaguggggaaagaguggguguuuuguagaagcauugccuuucauuguucuuucuauaucuguccacaaugccuacugucucuguggugaaauauuaaaauauguaagcucacauggaaguuuaagaauuucuguguuaauacuuggaauaacccagagaaaagaagccagaagccuaauuccagagaggaagggaaagaaguucuguagguagugcuuuacacauagggggccgagagaacaucagaggcagguagguugcuuguggacagccuuagacaccaaauccuugccucuggaguguagccacacacaacacagagaguaacugaagccuaucuuaagcaaagagaaaccacccguccacucuggggcugcccuacugaaugccccuuuccaggaccuugguauuccuucucauucaguccccagcacauccggcuaccccuagcucucuccacauucauuccucaagucucucauuuacaugguuugacuuuuuaauucuaguacuuacaaccuuuaaucuugguaacuguggccaaauaucuauuguuauacauaucucugaaugugcuuguaagugguuaaauaauuuguaagcauuuuugaucugucugucugucucuacauggauggacugaauaagaauguaaauaauauuuauugcaaagcaagccuggucauacuugcugcuugagaagcugaggcaggaggaucaugaauucaaagccagccugggauacauagcaaguuucagggcaguguggguaugagguugugucucaaaaacauuugaaagcauguugugcaugugugagagaguggcguggcuggucucaggcugacacucgaaggguaguagaaauaucccuucuggccuauugucugcuucgcuguguagguagccugacuugacagagguuucuccugguuuuccuuguuucuacccagagaauuuccuacuccccuuucccuccaaauguuaaggguuuucucccagaacaguaauggggcuaaaggggcagugagcuccaaacagucacagagugaggagucuucugagcucccuggcuaagugcagcgugcuagcagacaggcaggggaugcaaacggcugccgggccaccucuccccucucacaaaccauauaaacacagggaggggcuuucucaccacuucugaggagacuguacagcccguuuugugccuguguguguguucauggccuguaaguguaccccaagcacugugggcgggagcuaccacuucuuugagaaccucugcuuuacgguugacacugaugcuuaucuuucucuggaguuacggauuugccuguggauuuaaugcucacaccaugcuauuuaauuuuuaaaguaacuuuucagaaaauauuacuggcguuuuguucauuuuaagacuguuaacaugaagaaaagugugcuagaacuuuuuaaaaacacauaaugucuugaaguuagaauaaacacuaagaaaugacuau

SEQ ID NO: 9666 - RNA, 694 nt, Mus musculus
aucacuggacaagauuccuugaaagcaggggccugcgcugccauagaucuugaucacugcgcauggcccccaugucuaggguuccaguggucucagccucgggccguucggcguccucuccuaaaggagaaacagacagacagguggaucuuuagaaggccucauggaacugagaagaggguucguguucuguguguguguguggggggcccaagggggacagucuggcuuacugugaguggugagagaggcaggggcuggcuuggggcccucaccugaagaacuuggacacgcgugccagagcucucuggaagcggcuccuccaggaccuugugggaggagcaggcucccuggugucucuugggccccuggaugugagcauggugugagcaguggccacaccuuccguagccacaccuuccguuccagucugaaaaagagaguuaaggccucacucagucccaacauggaugcugcccacaaccccauucggcuacugugaugugcaucugcacagcuggucaaggugccaaggaggaucgacaagaggggcuaccugcccuguucacaccccaauccccccuggaaggucuuccaggucacauaguaagagacuuaccagcugaggaugcccaaccaagugcaugacgaucaugcuccccggagugucucuuccggcuggagugacuccuag

SEQ ID NO: 9667 - RNA, 42611 nt, Mus musculus
ugucaaacugagguggcagcgggaggaagugcaucuuuccucaaaacucaacuucuugauucucagccgcuggacacugagguaacuauauuagaauaauauuggcaucaagaauaagaucugcccauucccuguccugauucccgccucuuguaccacacgccaccccuaucucugggcacccaauuccuucauccuucauccuccucaagcagguuuacaggggcacggccagagaugcagguuagccugcgaccaccuagccuacccuaccccuucacuggggcucgggcuucaaggcuugggaaauagguagcuugaaaauacuggcaccacaaaaacgguggcaacucacguaaaggccacuagagagcacaaucuugguuuuguucuggcaggagucacugugugaauccagggaagaacaggggucacuggggggucaguaugggucacagaggagccacaagguugcuauggauguuguaugaggggacaaagcucauuggucuagaaacaggugcaggggagagaaaaggaaucccuggcagcuccuuggcagcaaacugagguggcagcgggaggaaguacaucuucccucacaacucaacuuccugauucucagccgcuggacacugagguaacuauauuagaauaauauuggcaucaaaauaugaucugcacauucccuguccugauuccugccucaccuuaccacaccccaucccccaucuaugggaacccaauuccuucauccuucagccuccucaagcagguccagaggggcgaggccaaagaugcagcuuagcccgggaccaacaaggguucugagcuucacgaacaugagggaagcuacugcuguuuuuggcucagauggggcauaaagggaugacuggguuucaugaggagaaccugugcuuuuugaacugccacaguacgauggacacaaggagggacuaccaagaaaguggagaaaccauuagugaagugugcggaaccaucuaaaagguuagccagaggcuguggcaccuguuuucaugcacccagacagaauacauuuuuaaguuuauuuuuauuguuauuuuacaugcauuguuguuuucccugccuauaugugugauggcuucagaaacuuuggaacuucagauaaauacaguugugagccaacauagaguuguugggaacugaacccagguguucuggaagagcagccaaugcucuuaacaguugagccaccucuccagaccagagagagagagagagagagagagagagagagaagagagagacagagacauagacauagacagagacugagagauagagagagagagacagagagacagagacagagacagagacagagagacagaaacagaaacagaaacagaggggagacuuuaggccugagaaaaagaacuuaaagggcuugcggaggaaaagcuaucuccuagcuaucuccuggcuagaaaaaggagggcauagcaauugcccugagaacaacagccugcugaggaggagcuaucuccuagcuaucuccucaugacuugaacagggcauagcauuuguccugagacaaacagcccccagaggaggcucuaucuccuagcuauggccccccuggcucaaacagggcauaacauuaacccggggacaaaaauccuuuuucaguuggagaaguuggugaaaugaggaaaauguaggaugcaggaagauaccuaaauguaagugguccaagauucuagaguaguguagucuuauuauaauaauaauuauuauuauuauuauuauuauuauuauuauuauugucuuugaugugguuauuaugggugacaggcugugccagagcuaugagcuguuguccaccucaccacuguccugccuuagccucccaggcacugguauuucuggcauggauuggccaagcuucuuggggagaugacagcauggucugaggaggagcaaguggucagcgcuuuccaaggggaucaacggaauuauuaagauuaaggcugggcuugaguauaaaacuaaugcagcuagaauggggauuuaugguuuccccugaagcuagcaacuaaguucacucacuucuacgggggcagucacugaauacaggacuuuagggagacagguagaaguucacagaaaaagcaggacuagccuuuggcguuggcagagcacaggaugaugcaagauagcugagaguggugauugcugagggagauaaagggacaucuguuggcuccucaccugggacuugaugugagcaagugagugagugagugaaagagcaggugauggugagcagggacagucgggaucaggcggaauuguugugggucuuaggagagcagcuccuuaggagaaggcuguguuccagagaagugauucugucagugugcuggaaggaccacaggagacuuguaggcacuagagauauagaugccugacgguaggguaaguacauugggggaaggaauuccagcggccauuuuggucacugccccuaacucuacaaccauggaauuugaaaccuaaagacagauaugaucuguuucuccuggaauugugacuccacugaauagaggguaugggaccagaugagcaaagacaggugugggguugugcgcaaacuuggucucagggaaccuguacuuugcucugaaagugccacaccgaugggagaaucagaaacaacuggggugaagcacauuccugccaagaucuuccagaccuacaagagccacuuucucauaugugugacuaacaugaguccuucaaucuccucuguuagagaaucugguagagccuugugcacugaaaguuuugggaagaagagcaguggacaccuagaaagcggcaucaggcuugaggcccaagaagaauggcugacgccuucaguacuccuaugagugcccagcaguguccccucaguucagcugucaugcgugagugucucuggccagguagggguuguaucaauacuggugugguaagcccaaggguuucuggcaccauuaggaccacagaauugccacuagaacuuaggcaaaccuuccucccccuuaaccuguccaagguauaagaggucucucuauguucuauuacagaucagcaccuguauccucuugaccagccugaaguccugcuucacacagguccccaacagguaaggaaaauuaguugcuacauggagaggcaccaagccagcagucauuuccuggauaguuuuaauugucuucaacacugagauucaacaacaauccugucugguacuugcauuguaggcuuuggaaagucuucacuucuauuugggccucaguaacaccaaaugcagaaaaagaaccaaaaaaauaauaauacccccccccaaaaaaaacaaacagcagcaacaaacaaacaaggcggcgagauuuuguucaccaaguuuuagagagcucuguggugguucauggcuuucauguccuuaaaacauacacaucuuucuaucuccauugucagauaugauguuuaacagagaugucuguccuuucagggaaucuuccaagggccucugauguugagcuugcccacaccagucaucaauauauccuguauuccggugacucugaaccuucaaaugacccauucuuucucauggaaucccaggcagcccaugacuauucccugccugugaguauauacauauaccuauaugaaagaccaugagccagcuguggcuuauggcccuggcccuaugugucaacacuuguuccugguacuguagaacucugggcagcagcaagaaaaaggaagaauaguauaaagggacagagagauaaagcagggggagggagaaagaaugauggaagaaaugaguaauggaaggaaaaaaggaaggaaggagaagagaagagaggagaggagaggaggagagggagaggagagggagaggaggagagggagagaaagagagggagaggaggaggaggaggaggagagaggaggagauggagaggagagggagaggaggagagagaggaggagagggagaggagaaggagagggagaggagaaauggagaggagagggagaggaggaggagagagaggagaagauggagaggagagggagaguaggagagggagaggagaggagaggagaggagagggagagggagagggagaggcagagagagagggagagggagaggcagagagagagggagagggagaggcagagagagagggagagggagagggagagggagagggagagggagagggagagggagagggcgagggagagggagagggagagggagagggagagggagagggagagggagaggggaggggaggggaggggaggagaggagaggagaggagaggaaaggaaaggaaaggaaaggaaaggaaaggaaaggaaaggaaaggaaaggaaaggaaaggaaaggaaaggaaaggaaaaucaugguggaacaacagaguagccuugcacccuaccuugcaaggacauaggccucagacauuuacuauuuccugugugacacacuuggagauaucguucugugguguucacucacugugugaauguguggaaaguagucugcccaggggcuuuaaagaggacaagcacagugcauagaccacacaguuggcuuucaaacauuuugaacuauugauccacucugaggggaauggcgauggggaaagguucugcugagaucuggaaggaucaaccagaagggucacagaggcccaggaacuguuccaggccuuuggagaauaugucuacugccacaugagcuuagcauauccuucaugacuggugggcaguggcaauguggaggcaagugucagacucugaagaggacugcuucauuucucuccuggugcauugcacauuccaacagcccuugcccaucuuccuuguaccgggggaauagaguucacucucuagaguagugucucaagaagagauauggaaggagguuggaaggaagauggggaucgaaccaggggaggauccauuccaaacgcaaaaggccagugccaucuguccuacugucugcaaauauucacaugccccgagccuggucuugcagggaccccggaucuucaugaguacuugcaguuguggccaucuauaauguuuaacacccuggcuucuccucuccucuuucucagguucccuaaugugaucaugcagcccaguaccaacacugcugccccugucaugcuggcacagguccugguaaaugagcggggacuaggucucuggaagggaagggauggaaagagaagaaccucuuagagauggguguuuguugggaagaaaugggggcugaagggucuguuaucuugggggagggcaguguguuuuguuagaauucagucucucacucuauuacuuuucaggacuccaacaucucuucccagaacccugccacugcuaaccagguuccugucaucugggcccagaguaacaacacguucaaccaggucccugaagucuacacccagggcccaguuaccuccacccagggcagcucaucugcugaggaacacaggcagaaggucauggaugcugccgaggcucuccugauucugcauaacucccgggaggcacugcaagagacuagcaccaccccagguacauaccuggauccuuggaugaggaaaaaggggcaagggggugauggagauugugggcaaacaggagggcuugugcugccagaggagugacugcuguuggugguuuucucuucucugaggccagagccuccagcucuucugugugguugaguagcagcaaccagggacugcucagucuaucuucaguuuucaaggcuuuugcccaacagcagugggccauuaaguacccugaagucaggagacugugaggcccuccaguuggcaaaguauugugggagggugggcagcauaugaaguggaaggaaaauggagagauccagguaaaaugacucccagcccauaggugugcagcagcccucagcauagugagaaggccucagaggagaagcacagggcaaaagggucugggauggagagagaucuccaugccagcucaaggcauucuccaugugaauguggaauggugaagccuucccaggcugaaucuuauaagcagaucucaggucuccaucaaggaagggcuuugugaguugauggggagauucucaaagcuagggaggcuugacagaaggcugcugagucaaaacagccaaggaguagcacugugugagugacaagccacucugguuggauaugcugguucaaaggauacugaguggagccaggaaucuugcuucucucaggggucuaucuggguggggaauguaugcuaugccagaacguguggugccugccauugugaaacaauaacagacuccaggcaaagaguccuuuaucauacucagggacccugggcugaaaaaaugguacuuaaggcugggacuguuggagaagccaguauuagagagaaagaauucagguaggaucagguguggucguuggucacaaugaagaucuuaguuggcuugguacacaauguuaccccugcagagccauguaaggacauaucugugaucugacauggccuuuucauuacggucugcagguccugauggagagugaagacugagacuauccugccuguccuugucaccucaggccacaagcucagcuucacugacugacaacuggucaucagguucgcaccucagucugucacuaagagagguaaaaagguggccucauggaggacugccuguguuguuucuguuucuuaacuuguaauguaguuccuggccaaaaucagaagcuccuccuucaugcuuuugcauuguagggucuucaacaccuuagcgcgagguuaggaaaauuuucuaacuguggcuguaugcucucaaccuugcauuaauuuuuuuuuuccuuuggaggacuugggucuuucugggugucauuaauggugcaccauguagcauauauuugucuguucacaauguucugagguuauuccuaaggcagcauuucuuuucuucucuauuuuucauuuucuuuugucucaucaugguuugcacacguggcuaaucuuguguguacccaugccuuuaccuacaucaggaugcucacccgugccucggauacuggacaugagagccugaauaaaguaucccugugguaaagcauuuagaaguauuggcugcuucuuugaaaauguaggccagauauuggggagagagcuuuucuuucucuggcccuaagcuggcuaauaauauauucaguguguuaguuauuaaggcaccaaaagcagcagacuuuggguagaaggcuuuguggacgugcauggcccccuuccuugcuuacugacucgauccugugagaccuccaaaaaagggauuuuccuugugccaugcuauuucuguguugacuacaugcgugagcagagucagucgagacuugggcagaaagcauaucauuccugccugggugucuaguaacacauccucagagcuguugguacugugucugaggguguguugcaaaacuugcaaccacaccuugcuuuugcucuuaggauguagccuucugcaacucuaaucauaugguggcaagaaucacauuccacuaaugcacagcuauguaugucacuggguuuucaaugugcacacugauuaucauucuagacuucccugcuauacaccaccaaaugcaaaccuuuuucaacuuuagggugacaacagcaaaccuuuugaccacacacagcuuagaaguuguuuggcacuguguuuuugaagccauuuguuuacacccaacacagccaaguguauuuuaaccucaauuuuagaaggaaccgugugucucaugaacaaguacaguccuaucaaagaaaucaauccuucuacaaaguuccuggaaacugcuagccuuuacacauacauaucuuccaauacaauuuuaugucuaaguuggcuuaaaggaggaggguauggaaaagaagcuugauucccccugacacccagaaccugcuucauccucuuugaaaugacuaaggaaaggacagcaacaauaacaaaacaacaaacaaagaagcaaaaagccacagaaacccaagaaacaaaaauuguuaagucaugauacgguaaugcgcgucagaaaugacugcaagagcuguuugaccacaagcagaaaggacucgguuugcaggaugguguauuaaccaguaaaaucgccagucuuugcaggaauugggaggggaauuaucucugggaacagcauuuuaacuuauaagaaggcagauguuucgggauucugcaucucgaauagcuuccugcacauguguccuggcuucuugagaaaaauuaaguaauguagggagcuuuuuacucgaaacaucuugcauaaagcaagaugacucucauccaggugagaggugagaacguguauggccuccucugaagcuaagaaagaggagaaaccuaaaauacagaaccccaaggagccaggccugaccaggaaaguauccagaggacaggugggaaaccuguccagcaggauucacauaaucagaggaagaccagacccugaggugacucaaaaccuuccugaaccuaagguuuucagagaaaaaaaccaaacaaacccagaaaccaaaccaaaccaaacuaaccaaaaagcaaacccccaaaucuagcuaaagaggaagucagcaacagaacucaccacgaaaaucccaucacaagguacugucugcuggucaacaucacccaauacauggcaaacaacaugauuuucaucuuuuacagaaaccaaggaauacugucuucaguuguggucacacggccuaccacaacauguagcaguaauaccuuguuuggggaacugugcuggacaguucugguccaaauaagcuugugguaucagaagucagagguaccaaugcaaaaucccuggaguaugguugcugugggcagugccucacaguccuucuguguggucauaagugcaccaaccacugagaugccucucuaagaaccugcucuagcccugccaagacugcuccagugaaccuggggaggagacagugucuccccccccccaucagaugguuuuguccuaaaccuucaguccucuacugaugcucugaagaaacgcagagccagugcugcccaccauaaagaaagcaaggucaccaagagucuccaggccugagguucuuucccaugcuauugccucccccuuguggccugccucuuguuuguggcauggggguggcuuccauuccugguuguuugguuguuuguuguuuguuucugaagcucugugccuccuguauuauugcucagugagaggagaaagaaauaggcaaacuuaucagaguggguugcugggaagugagccuuugugccuucuaucugugucccuuuguaauugcauuuuaaacuguggcaaaaguggcaccagcccccauccagagguugccgaccaugcuuugucuuauagacuccuggacauaagcccaaauaaaugucuuuaauucacaaauuacccaguuuuagguaucagaaaacauaugaggauagaaauguacaggugaaauuguugcugcaacagucuuugacuguacggugguggguuuggaugccaaugaugguuagaggccugcauaguuuucauuugaaccugagaauccuguacuauugugaguaagagaauaaucaaccaggagccaugacaaggucuacacuagagggagacauuuccugacaauguauucuguaauagaucauauuauauauguacauguaacugagcccacaucacaacaccaccagcaccagcaccagcaccaauagcagcagcagcagcaccagcagcagcagcagcaagaacaagaacaacaccaaacuacuuaacuugaaaauagacaaaugcccugaauacauguuugaaaacaaacgaaugaguuaugugcacaaaugugcuuauaguccuaggcugaaugugcucaaucuaucugaucagagggggucuggucacuacuugaaugggagacugccugggaauacuggaugcuguugacuuuaaaaauuaaaaaaaaaaaauuaaaaagaaacaaaaaaaaguucuguuuuucagagaaggauuuaggaaguugugaaggacaugggucccaaaagucuguauguguucagugcugaugcaaugucccacuaaaugucgugaaugugugcauauuugaaguuacagacgaaccacugcacauucugagggacuguuuguacuuucacucaguggaaggagauuuauguucacuguauagccuauagaaaaauucacuaaaaauaaauuaacagcccaaacauagaguccccccaacaaaacaauacaaaaucaggcaaaggggaguagagauuggcuguuuugcaguuagaagcucgugccaccaggcccuguuuaccuguggcauauaggugguuaaacuuacauccuccuacuugcuuuucaagugguuuagcuauggaaccccacccccagaccaguugggacucagugaauuugaggagacaucuccaagugaauauauguguacucaaugggaaaaaaugcauuuuagguacuugacaugguacugcuuccaaccccaggaaaugaggaaagguuguaccagacauaaaugccuguacuuauuagaggaauugccaggugcggaauugucaaggauccaguacuguuuuagacaaaguauccuguggguaagcuuuuaaggaaaaauguuuuccuuuggcuccaacuuagaugacagggauuuuacuaaaaagggacuugggcacuuuagaaggagacggggagcacucccaucuuccugacgucuacaccagaaaguugauuugcagagcaugaaacaagcaucacucuguaauaagugccaguacugacacacuuccuagaaugccugacugccccuucugaacuguagagaauggcuagacugagcauguaagcagaaguccuauuugauacccaggcuuugauuuucucaccaguaaagugggacauaaugauaguaauagcucacuccagaauuaaacuaauaugguaguaucuagcgucugcaggaugucaggcacaaggagcgaguauauggagacucauccccaacaguaacuugucucuauacucuggggucuacgagggcaucuggccaauuuugcugcccccacuuguuuccuagcagacaccaugucugucuugcuuuggagugacaaaaauaaagauuaaaaaaauagaaaauaauaaaucaauaaauaaggaaagaaaaaaaaaaaaaaccccggaauguagagcugugagagaugugagggacuuuuuauucuugagauagaaaagucagagccagucuccaacaagauggaacacaguguucccagucauuggcaaguguucugugggguuuaagauggcugcugagugagacaacaggaugugaggauggagggugguccaugccgaacuggaucgcuuguuucugaaaggacacauuagagccuagcaaguagauguaagugagagugugugcaccgugcaccccgcaccccacaccaugucgccuccaaauggaggccgguugcggaaccaccacgggaggauccaaagcucagucugucccucagugcaggcaggaccauuucggugagcaccaguagacaggaaaggccucccuccaggagccaggacacagcguaggcggaagugggucucagagcagccaccagggacgcccuucugagggccgagugcaggaagcucagggccucugaggcaaagcaggaaguggagucgaaggccaaggcacaaggagcccagagcaccagaaccgcuggccugcccgccugccugcugcuucuuuugaggcucagcuugggcgcugacucugaagggcuggaguccuggguaacugaccccugguggcgcgaggaaggugaccuccaucuucuccugagccuuucuccuuccuucuguccugcuccagugcccguuuccuucauuucuaggccuccucaagggaagcccgcuggugauaggaaacgggacagaggagggcgcgucgagcccgccugggacuuuggccuccuccacaggcuccguccaguccccgcgggcccugccccagccccuucagggagcaaccgucuccccgcugccugcgggucugggccugggccucgccagagagcagaugaggcagguagagggugagaaggaccagggagccauuccugucccagugccaacagucacaagguugcgaugacucuggaagauggguggacaacuggggaguagauguggggguuggaugaaaaugggccaugugaggcaacagaaagcugagcccacaggauagucugccuuugggcuaggucaggggccgccauuccacaugggugucaacaaacaucugucagguguagaaagcugggaagggaggaaauggaagaagaagaagaaugaaaaucugaaaaauuaaaaaaagaugacugagagaaauccggauggaucucaugagcaaacugcuuguuggaagcccaccuugucacuaguuagccccgguuggccucagucguggucucccuaccccagguucuuggguggaagguuuuuagguaugauucuaguguccacugccuucagaagaucaauaugauuucguggguggaggaguggaggcuagcagguggggaacacaaaggaaaucgguggaaaggcggagcaagggaauaauuaagucuguggugugaggaaaacuugaauggggguaggggugguggugaaagaaacaacugagcaccggucgucccugagacuacugagugcuuggugcauaugauuuuucccauguggggagagaaggaaugugaggcacgaggaagaagguugucuuccaguguccaggcugucucgugauuguccaggcaggcccgaggcugcugguguauuccuccuggaaaugggauguguggagugagucugagcagaucgauuggguaauggagccagugccaagaggcgguuggugggagguacugggugauugagacaacacgaggaaccugagauuaugugaguacaaaugggagaugaaggcagaagaaaaccaggagaggauaaaccugaugcugguggugaccauguuggagaaaauucucauucccagagcuaguuuucuuugcuuguuugcuugcuuguuuuguuuggugucugggaagggguuguuuuugcuuuguauguuucauuggguuuuguuuuguuuuuuguugcuuuuuguuuuuguuuauuauuuuauuauuguuuguuugauuucuguuuuauugucuuguuucuguuuguuuggguuuuuguuuguuuguucuuuguuuuuguucauuccuuugguucugcucaggaaagaagaguuacuuuagggccauggggauacaguguuguuucugcucucagccuaagaaccaugggaccaaaagacaaagcagcuguuuccugccggcccuccaccucggaauguaacauggggaacaagacuggagcagcagcaccuguaauggaaccuauccucagaggacgugcaaaucacccuggcagaggccacaguuguggcacccggacccaagucagguuggaaacccauucuucccacucucucggucugcuggugucccaguugggcugcauccuuuugaguaugguguccuggagggugagggggucagguucccuuugcacaugacuagcaggaguccuucaaaccccuauugaagggaccacggcgaggcccugcuggcuguggguucugagcaaaagggguauagugcacgaggaaagagacgccagauucgacuaccaagaacgacucucccccgcaaacccuucgaucaggccaagaagaccccuaccaaaggaagaggucgccgugagugucacuggcuggggagggagccugaguuugguuggagagaagcaaggcaugaguaacccugugaccagcucugccacagaauugcagugggaccaugggcaaggguagccuggaccucagugggcccagguagggguuaaaaauaaaacccaaaacauccuaucaaugguagacagcacuuguuugcaggaggcagagaucugggaaggggugcauucaaaaagguuuaaggugggaaguccucaaaaugguguugagugucuucagaugaggcuguugggcagccgagugggaaagaauucuuggucuuuuacagcugcaaaggagaacccugugucccagccugaagaccugccucaagcaagcccccaggagguaaggagaaucuguugcuagagugggaggcucccaccaguuacuguuaagaccccuuuuaacugugucuucaagucagggcucucaccucugacaggucagcacauugucuugugcggacauuggcaaauggcacuuccucuugagccuaagucuucucagcagcaguugagcacgagacuggaggggagggggucuggagagguccucagagcccugacauucuagauuccugccaucagacuaucauuugcccaucccuccucucuuccugggccggccuggaagccaauccccuaccuucgcucucugucuccucaggagagcccccacgggucucaaguguauugcuggcccccagcacuuucaccucugccuuacaugucagugcccccagagcagcaguugguggcuccuccuuccacggagauucacggggcuuuugcugaguccaacccgugaguagaaagggaccuugcaguugacugugucuugugucucugugagucaggacaugggcuuacugccacaggagcaggaggagggggauguucggagggaggaggacaaguggaggugggaggagaaggcugcaggucagacugaggggcaaggacagagggccucuccagcuuuggccguucccacuccagagacuugguacaagugacuuuauuuuuuucaaguauccauuuucuagaggucauuuuggcaagagcacucuauaccugccacguuguuaaaagcaccagcacgaaggccugcugcuacauagugggccuucaacacgugggcacuguuucucuacacacagcagaugagugcaaugggaggguccugaugaaaccuagggucaugguggacagggccagggaggcccagggcaaaguccagaggucaacaaagaaagccuccuagaagugcuccgggcuugucccucaugauccgugguggccuggcaaagugcuggcaagaaccagucccuggaaauggaaggucacuguaucucuuuagggacuuugcaguauauuaaaaugcagauacccguuguuucccgauacauucuucacugcauaucugggagagaauuaaaaaggaaaacaaacacuuguauggauuaauuucucaggaaaaaaguuguguugccggggagggaguuguuuaaaggaaaacagacugugcgggacaacgggcauguccaagccacagggccuaaggucuccacaguccuuugaaugcccaccuucugguauugcaaaacccugucagucucccucugcaggugcuaccuacccacccaaguguuuaauucccuuacuaccucuuguuuccagaugcucaaguaugguccuccugccacguaccuccaccgaucaccaccauccacuggagucacagguccccacagagaagcaggaggguucuggaaacgugggugggaggagcuaaguugauguguagggcagaccgucgggucauugagagugggcccuggaggccgcuggguacugagcgggcauuugugcuucugagaagagguguuggaugcacagcuccuggucuccucacaccuguuucuuugcagggcuccggugccucugaccaggccucgguuccugccuccuuagagugucaggaaauacuggaggcugcugaggcccugaugacucugaagaacucuucuuggaccuggcaccagacccacagcuaaacagguagcugacuucuugaaaaggagcaagggauggagguaguugggagaugggaagcucugugguaaguuggucauggcuggguacauggggcuaguuugugcuuggaaugacuucgggacuggguacaccagucuucugaggcugacuucagagagggcacuuggaggcuuauucagagaaugcuaagcaucucaaguuuuagccuagcaguaauuggcuagucgccaugacaucaaaagagaaggagucugaggcccccggggaguugcagggacuugcucuagggcaggccgcauaucaagugcaagaaauagaaccgggcacccugauuccccacccagccccguguucccagucuauugcucacuguuguuguggaguuucuacccugccuuugaccauuuaguucccagacaaaagacacacacaaccuuuauauuuacaagaagccuuaaacagcauaagaauuggacagauaucuacccccuagccuauuagagagucuacuuuccuguccuguugauaaccccgaguuauuacuacguuuuaucugggcugcucuuagcucuaauugaccagcccucauggccacgauuucaugacacucacucuuaacacaugacggcuucuccuuccuccuucaccuucuucuccuccucaugguucuccuccaacucccaaguccaggaauccuaaaccccaccuaugucucuucugcccagcuauuggcuguuggcauggcaacuucauuugccaaucagaaauaacuugggggcaaggucacgcagugucacuugguucgacuugcagauucucuccucucugggacaaccaggucuuggaggcccuguacgagcauuagaauacaagcagcauccagccaacccacuacacacugugauggucuggggaagacagagagauuuagaaugagguuuagagcccgaucuuagggcgauuucaauucagauguucagccuggauucucucaugagguguauuuugcaaccagaucucaaaugacccagggcaaguguuuaugagcugaggagggaauuaaacuucuagugugucugggcagcaaugcuggaccuuguugugcacagagacagauagggccuaggguauauaggaggaagccacccuggaaagaacugcuggaacacaacaggcagaaugaagcuugggagguggcugaucacaggggucuggcaagggcgggagaugaaucccaggccagggcuucuuaauguacagauaauaaacuguaaagaaacuuacuuuaauacaagucuuugguauacauguaacuuuaccauuuauuaaagaaaaaacugugcaugacaaggaacagcauguguuuguuuguuuuuacugcaagaguuagaucuugacuaaagguuuggcacugaggagcaugaagcaucuuccuugcuucucaggguugaucuguccuucuguuuauacuuccaguuccaagggugcugcuccaaauaaauacauaguacaagauggcagaaguacgcucagggucauuuccgaaauuguuagaaugacuguacaaaucccaaaccaaaauucaucugacaauuuuucacaagccucaacucagcagcucaaacaauaguuuuuaaagucaaacauuuuacaacauguuuaggagcgacagacagaaaauauuaaaagguuuugauauccacaguuaaaccaucauguuucuuuuagagcucucaaaaagggcccaaaacaacacucaaacaauaagggaaagacugacaccugagguugucuucugacuuucacauaccugcacauacucacaaacacugguguauaagcacacaugacagugcacgggcacuccccccccccucccccagugugggacuaggccaggaggagcagguaguggaagaucaaggaacuuuccugaaaucgggaaggauauauugagagaucaugagcuucaucaccacaguagguuuguguggaugauagaggaaugagggaaggugaggcuggaggcaaggaauuccgacaggaauaggucuguccacuggucucagugacagauguucacuugugggagacaaagacaugggggagaguugggaaagggacucguggucauuaguugguccucauaccauccuuucugccuucaggucuugcuugaaguuggagcagugaagccuccccgcccauccgugugauucagauccacuggccagcuccacuucacuuccuguugagugcaccuucuucuuggacuuaagggcccagagguggggggugcggacuucuucaagcacugaguugauguuaugugugguuccugucugaaaugcuuaaaugugcuuuguaagccuucgggcauuuaauaagcuuucagacucuucucauaauguagaucuguuccuuagcuugcauaguauguucuuguacccccaucccuuauuccuuuggaagcugaugcuauucaauguaucuucuguggauagcacugugcaauuuaaugugaccagucugucgguggggcucugaguggguuaguauaccauuguuugcauuuguucugugauugcauaugugcccaggcaccccuguacuuguauguggagaaguuucaacuugugucuaggcuuguauauuugaacaaauaauaaagcauugguaggagacacugcccaggucuucacuguaacuggcuacaccuuccccaguggucucucuucugggacucugaaccugccacauguuccaaaccuuaaccacgcuaccucacuccuucauguauucaaaaccuguaccacaauggagacucuuacaccuuaccaagcuggacugucagcaugaaauuuagccuuggcauccucuggaccacagcuucggugagcugguccugaggaaauaaucccagaagauuucaccucugugaggcugcuccccuuggucacaggugcuuuuucagccccaucugaccagcaucaauuauucuuguaaagcaaaaguuucacuuuagugguacuuuugucuuguaaaguacaguucauuaaucaauuccaaacgacuauauaaagcccauauugucaacucaacauuuugccuaugcagccccaauugaggguuucugaagaaucauguugguuuagaggaccuuguuuucuugguguguacaguaccucugucucuuacacucuuuuugccuccuuuuaagcacagugcccugagcucuaaaaggaggaaauagauaaagacagcccauuuacaucugagugucccagggucucucaugcuguggauaaugucuagaugugggucucuguacuuguucccauuugcugcaggaggaagcuucucugaugauggacaaggaacucacugaccuaugaguauagcuaaauguaacuaggaguccauacacacacacacacacacacacacacacacacacauauggcaauaguauuuggauucccccuaggucccuaggcuauauaaucucaggcucuuuucgcccaagcaguauccaguauggguuccaucucgaggagucagccuuaagucaaaucagauauugguugguuacuuccacaagaucugugccaccauuguccuagcauaucuugcaggcaggacacucuuacagaucaaagggucuguggcuggguuaguguuuacguuucuccuuuggugucauggagaguaccuuccuguaccaaagacacuagaaaguauggguaaaggcucuauguguuuugauucucugauuucuuucuccauccacuuucagguguaagaucucacccguguacuuagauuuuguuuuuuaauauagguacuuaaugucaugaacuugccucuuagaaccguucucagugugucccauuagguuggguauguugguuauacauucuuauucaguucuagaaagucuuuguuuucuuucuucauuucugccuugacccauuuuucagucaguagagaguuguuccauuuccacaaguuuguaagcuuuauguuguuucuguugauaccaguggugaucagauaggaugcaggguguuauuuccauuuucuuguaucuguugagucuuuguugguguuccaguauagggucaguuuuggagaaaguuccaugaggugcugaggagaagguguauuauuuuguguuuggauauaaugaucugaggauauccuuuuuauaucauagguccuuuugauuuauaacaucagauagauccaacuuuucucucuuuaguuucugucuguaugaucuguauguuguucagaaugguuuauucaagucucccaaacucagggugugacuccuggagggaggccuuuccugucuacuggugcucaccgaaaugguccugccugcacugagggacagacugagcuuuggauccucccguggugguuccgcaaccggccuccauuuggaggcgacauggugugggguguggggugcacggugcacacacucucaccuacaucuacuugcuaggaucuaauguguccuuucagaaacaagcgacccaguucggcauggaccacccuccauccucacaucguguugucucauucagcagccaucuuaaaccccacagaacacuugccaauuucugggaacacuguguuccaucuuuuggagacuggcucugacuuuucuuuucuaucucagggauaaaaagucucucacuuucucucacagaucuacauuccguuauuuuauuuuucuuuccuuauuuauugauuuauuauuuucuuuuuuuaucuuuauuuuugucacuccaaagcaagacggacaugguuucugcuaggcaacaucugugaaucuuguuucucagacccacauguaagucgccugucccuugucuuuuguccuuccauguauaugugagaaucugcaugccaguuccucaguaaacucgguuuaaaaccaguuuggauuggguuaucauugauucgggacauugccuaucagaaaaccagcuauccacgggauaccaggccuuccuagugcucagcucggcaugucucucucccuuuacauggagcugacaguuugguuguuucugcauuugcuucugguuucaugguuugugaagaggcaguccaucguuuuauagcauuuacuguuauggcgaagaggugugaugagugaaacaguacccccuuuuuuucagggcaggccugauguuagggaaggagagcuaagaggguaguacaggcagagaaaggcagagagcuggagcgaguagauaagaagaggcaggccaugaccacguggagagaggggggaagggaauucagaaagaggggaagcaagaggacaagagagagaagcaagaguaagagaaggaggaggggucaagcagccccuuuuauaguugaccaggccuaccuggguguugccagguaacuguggggguugaauucagacagaauaccaggagcuuggggccuugcccugugggacugauggccacagaauuauggagcugaggcuuugugucaggagccuagugacuggggacauggcaaacuccuuccaucucuugcacgaacaccugcugugucucuggaguuuaaacauagcucaaccagaaaacaggcugccuuucauggucccacaguguagguaucaaauauauauguauuuuaucccaucugugucucuuucuccaaacucuaccaacacuuacuuuagucauguaagagaacuaugauuuuguggcacguggacaggaaaaagcaaaagagauacuaagauaaacaugaaauuagccaguuaccagaaaaagccuagaacuacgcccaaccagggcuauaaguaaggaaacagagcauauaccuggauagaaggaugcagguuauacaaauguggggaauggcuggugauuuguaaaucacauauaacgaugccuaauaccugggacuugacgcuguugaguauuagaacugucacaucuuuauagaccacuuccuuucucaggaaugcauaucucuuuauuaauaaaccuuauuuauuucacuauccaugugucucuggucuaguucuuuguuuuagcacacaagagccugaaagucucucuuauccauuacuguaauaggaagugagcccucagccaggagguagugaagacuggagacagaaacugaccaugcaguucagaaauagggauucugaaaguucaaagucucagccuuguccuuaggcagaaguaggaaucauucuugguucuccagccagaaaaaaggucugguuguuuuguuuguuugguugcuuggauuccaucucuuuuccuauauaaccgaccacucucuggacauggagagauggcagaaacucuagucaaucuaggcaucaguccugauuuaaaauuggcuuucuaaacacucauggugaaaauugguuauaucuaguccccaaguuaaguuaaucuucuagaugauuuuagggacuuuugaaaggauaauauuacaguggucuuggagaacauugaggauagacauugggacuuuguugaagccuauuagagaaaagcuauuuacuccuggucaaaggaauugaaacuaccucugaucccuuguagaaacaugacuuucugacuugccccaaagauuauaacacugcauaacacuguguccuccauuaaaaguuacuuuaacaauggucucugucucaugaaaaagaagguucuuuguucacaggagagaaguuacacguaucugugcauagauuuaaggauacauauuuagaauguguuuguaaacacaacuaguuuuaaaauguggcaauuauacagguucuccucuaaggucuaugaacuucaccagucaagccuaaguugucuaaauuuacaugauuaggcaugaauucccuucuauugagcaugccuuacaugcuaaacuagauaaaaaugcagaaaacaauugacugugggauuccaguccucaauuuauacaucuacaacacaacauaacagagcauaugauguaaaaauuguaauaaccagaggaccagacaucugugcugaaagauaggguuucuuuuucuagaaauguaggaaguaaaauagagagguauguuguagcuagacuuggcuacuuuguguguucugucuuccacccuucuccauacuuuuucuuccacaauugaaaccccuaauaguagauaacagagaagaaaggguagagagaaaaagaaagagaucccugaaaaaugucagaaauuagaaagagggcaacguuauucuuagacuacuuccuguugauugagagggucaaguuucuuggggcaaguuugaucuucaccugcagaaaaucuacuuucuucuuguuauuuuuuucuuuguguaugacuacuuaacaaaccaugaccaacaacaaccaacaaccaacaaauauccaugaacaagccaccaccuuucucagggcccuagcauuuauauacucucucacaauucccagaauuccaagcaucagacagucacagaaacuaucugcagcuggcaaaaucauaccccuaggcaggaugcauaucauagucaguugcuguggauaaucuaaaccaccugcauaucccauacaugggauuaaaacaaaaaacauauucuuauaauauuucuguaauuuuaaagaaucccauaauccucacuacauuuuuguuuuaagcaauuaauugugcuguguauaacagguaauuaauuguaagugggacaucuucaaugaaauaagaacuuugggggucaguagcaaggguuuucaggagaccucuuuugcaugauucuaaucuuuaucaguuugaucauauucacagcuuuucauuucuuguggaaauauaaacaaauauauauugccccaaacaaaacuuuugcaggauucuauuuggcuguuaacacauccugacaguauauagacugauuuaauuaguuguuuuucuaugauccagucucucaguugcuguuguuccuuuuucauuaacauucagaaaauguaaaguuaacagacaacuaaucuuacccuggaggucuuuauucuuucuuuuguuugaaaagcauuuuuucagguaugauuagauauugcuucaauugcuaguacuuguaggauuguaugguauacuuguaauuacuuuauacuauaauaugcaauaauauauuauauauuauaguauacaaagaacuguuuaauuuugcuggagaacuguaugagggcagucuaagucuuaauaugaacaaguauaccuauaauagccuuccaguaaauauguaauuacaaaagcagccauuucaaaaaucaaagcaguugcccaaugaagcccugaacaagaaucaaugauauugugugcaaacuuuaguuuuccaaauccuacaaaugaaacaugugcacguaccaauuucauuucuuuugguacccccagguuuacugccaguggguaagggaaauggugaagcccuguuaauaucugacaaaacacacugcaaaagcaaaacaaagucaaacauauaggcagggaaacugcauaaucaucaaagaaaagaaaauccaccaagagaacauuguaauucuuaacaucuuaacuaucuccugaauuucaguggucagagcccucccugguggccacgucuccuuuggcggggaaggagcuuagaugucuggagcucagaucugcuuccuggcugaagaugaaggccugaaacgaggccugucccagaagcuauguugcuucugcagucugcaggcuuuccuguucagacuggucucugagggacccgggauacaagauggcucucuguccaccccccccaaaaaaaacauuuuauagccauaaucuuacauugguugaaaucuuuguauuuugaaguggaauugagguucuauuuuguuauauugggacagaauuuuguauauugauacagaaauaagguuacuuuuauauauugguguagguuauuguauauagacacaaauuuaaguuuauuuuaaauaaauguaauguacauauauauuuagcauuuguuugagguauuguacuuauauaauucuuaaagaugcaacauaaaguuauagaaaaaguccuuuugaaagaugcuauuguaaguuguuaggggugcuaaaaauucaaguuaugaauuauuugggaugguuaguaaauaaaaauuaacagugagauagccaaacucauauucauauuuaaauacuaguuuaguuaauuacaauaaaacauuuuaaagguuauucaggagguaaauagauaagaauagagaauguuugacaauuuagauauuagauagauaacaauucagauauuauauagauaaauagauagcauucaagaaccucagagauccacagaauaaggcauuucaaauuauuucauuauuaaaauauauuuggacuaugagacacauuugcuccugacaguacccacauuguacuucaaagaagauagugagcaucaaaagccuccauaugaaguugcuucaacuguggcaagcuaaccaccuaaauucaucuguagacaaaaugguguucauaaaagacaaacagagacagugaguuugacugccaagcugugccaagacaguguaagcaaauccuucauaauccugcuucacuuaaggucugucagaaguucugggcuaagaaguuguuuuuagaaugguaguacaaguuacuauagaaaaugauuuagauacagaacucuaaacucgccaagaugggauuaauguaagaauacauuaaguugccaaauauaaauggacuggacauuauaaauguaaaucuucugcaaaauuuucauaauuaucuccauugcuuuuuauuguauucaguuaauauuugagaaaagagcccuuuauugggcuuaaaaaugaauuguagagagaauaucuuagucuuauggauagggcacccaucaauaauaaaucugauagucuauggcuuaggcagaauauagaagacagaacauccagaaggcagacagaauucugggauagagccauucaggagauccacacagggaaaugugagaagacagaugcaugguaccugagcauggguaaccggacacaugacagaauguagaucaaaauaaauggauuauuuuaaguuaugauucuagucagagaagagcuuagcuauaugggcaagguauuuguaaauauauuuugagucugagccuuauuuuugggaacauaggacugggacaaagaaucagauguaauuucaacaucuaagaaguuuuauaauuguugcuguauaccauguggucauauuaagauggugaagucacauggcagguugcaagccauguagcugacaugcuugauauauaaauauauauauauauauauauauauauauauauauauauauauauauauauauauuccuccacuggcuuaacauuuuauacacacacacacacacacacacacacacacaccacaaugagaguugcauccaaaucauaugcaaauauacacauauggaguuaaacccaacuuacauacacacagaguugaauuugauuacauauauacacauauauguucuuaacaagagcagaaaaaagacaaauauuguuccagauuguacaaguuuuaacuuguauauuagcacauagaguucaaacauuucauuuuagaaaaauauuuuuauuugaaaaauauuuuaaugagaauuuuauacauaaauauuuuuccuacaucauuguuacauacuuuccuguaccauuugaauuccuacuaaaacgcuuaaauuuaauacauauucauauauguauuuauuauauguguauauacauauauauauuuucacacauauauagguauauauauguuuguacgcacacacacauauauauacauauauauguacuacugagauaauuuuuuguugcucauaaauaaauguguuuagagcuuaaaucauuuacauauuauucaaugacuuuauauuuaguauuguguuucagcauuuaaagauuguuuuaauuuuucuuaguguacauugucacauauaugcaucauauuuggaaagauggggacagugaggcucauguaaacuguaccugguguuuuacagauuggaaagagagcacuaugcacaagcaugagaccaggccccccaaaaccccacgggagauaagaagacccuguugcuuaugggaguugcuuugagaagcuacuucccaggcccccuguaccguguccuaaugacaugaguuccauccccaaaucuaccaugacuacccauaagaccuugggauuaacaucuucuuaccuuucaguuugaacugaaaauuaaagguaagccucacuggucuucagggucuucaaguucugacauccuggguuccccugcuccuccuacaacacucccaucucuccuugagucaugcuugaccugacacccaaauuccuacuguugucucuacuccugcagggaaguucccaaggcacucugaugcgcagcaagccacaagaaccuuccguucugccuuaugcuccagugacccagcagcagcaaucugugauuucuuauucagcaaagaaccucggucccauugccaggcccaaaaggugaguugaguaaggauuaagagccagaugggucucauaguacucuaugcugaaacuaugguaugguugaugccacgggagguggaugaaggagaaagaaggaggaaaaggaagaagaaauguagaggugaaagaggcagcaccucagaaggagaagggaagggaggaccacuccugugcuugagguguccuaauauugagaguuuggauaaguauuucauuuucccaagaauaugguuuccaguacucauucugggaaaccaguuacauuuacaacacugacaacaggacuagaagaaggccuaccacacaguaagcccucaucacgcuuggccucuuauucgaugugacuauagauggacaugggagaagauccuguugggaugugaagucgugaugggaaugggccacagagacccagaggaagggugaaggccagcagagaaaacuuccuagagaagauccuggcuuguccuucauaaccagugaggacugggcaaaauggaagcaagagucagucccugagaagggaggguacucuuaucucuccagaugcuuugcagacuagaguacagucaccuuggauucuucaucaucuucaagguagcccugggaggaaagaauuucaagaaaaauauagaaguuugacaaggaagcaggcuaagagggcgccuagauaaaaaaaaaagaccaacauuuucaagcuauucagauuuccccagccugauuuccaaagcucugguccuccaaguguucugguaggaguuguccaccagaggguuuaauccccuggccacuccucuccuuguuuccagauacucaaguguuaucaugcaaaaguguacagucccucagccucuucuacugcagccacagguccugacaaaguaguggguccagguccccuggagggaaugaguuuaguggaugggaagaacagaaagcuggggggaggguggguguugcuuggaggagcugggcacuugaagggccucugugcaggugggaggagguguugcuuccaaggugucauucucuaaugucauuuccuuugcaggucccuaaugccaccaagcacgauucuguugcugcugccguagaguggcagaggaagcuggaggcugcugaggcucuguuggcucugagaaacucuccucugccuucuccuguuucugccucuccaaaaaggcauggcaaaaugaccaauagcuaucuauggaacacaagguagggagaguuggggaguuggaggaguuguaauuuaguuauaccugggaacuuugaaacugagcugucuaggcucagacacuuaacuuccucacucugacuuaagagaugguauuccaggggcugcuaggggaaucuucagucagcaacaguugcucaacagcaaauggacagugucugaccccaaaacaaaacagaacaaaacuacuacaauugccacaacaacaacaacaacaauaacaacaacccaguagacugaggccuccaacguggccaguuuuuaccugagugcaagagcauaucacauagaaggaauggaauuggucaugacucccaucacaggucaacauccccaguucacugucaacugaggaggccugggagcucaugcauaggaaggaugguuugaaagggauggagggcuugauguugacgucagcaacuuugucuguauagauuggagcuuggguaccuacuagucaugagcucagaggagaauuccacagcuggagauacuggagaggaaggcugggcccugaugacaaaauaccacaaaaucaaauaaaaccaaacaaaaguaaaacaaaacaacaacaaaguacaaccucaugaaguguguuacugggaagccacuuggugguagacauacuggaauaaagagcaaugaaugaaaguggagacuuugcuugucacagaggucuggaagaauuggggauguaggccggacugaaaucuaggggaagaguaugaggaggugcacaacuuccuugacuacacuauugcauaugccagcaagauuuugcugacaggacccuuauauaguugucucuugugaggcuaugcaagugccuggcaaauacagaaguggaugcucacagucaucuauuggauggaacacagggccccuagugaaugagcuagagcaaguacccaaagagcugaaggugucugcaacccuaaggaugaacaacuauauaaagaucauggcauaagaagaagaagaaagacaagagggaaauacaacagacauuggaggaaggaagagacuaaggccccugggcccuauuuucaugaggccaggugccuuuguaucaggggucuucagaccugacauucuccauuucaagugucucauaauucaugagucucugacugguauauuuuaguucuccuuguauaucugaaaauguccacuguuaagcuuuuugauaugucucccauuuucaaguagagucacaguucacaguuugaaacccucaccucuguacuauuuuuacucucauauguuacauggccucaaugauuacucugaacauauccuucauuucagagcauuguuacaguggguucauuugaaaaggaaguguuaagguaaaaaaucuaacccauguuugcuacuauaggaucuacacaugcaguaugugugagcuuuugucucuggugaggaugacauuguugggccugcucucuuguucuuuucuucacucacucuuucaguaauccuucaggugauacuguggaaucuuucuaugaugcagagaaggccuccaagaugcuuaugucugauucauauuaaugccuuuaaugaauuuccaccaaagccugaaauacccacaauacccacugucuagaaauccuguucuuucggugauguaagucuucauagucuuuccaacucugcaccgagaagaugaugcuuucguguguauguguguguguguguguguguguguguguguguguguguguguguugcaugcauuguaugaggaguauauuugccucuuuauguguuguaugcauguguacggauggucuugccuggcuauguguuuauguguguggauguaggccagggaaguauguugaguguuuacuuauaucacacacuaccuuaaaauauuguauuuuauguguauaaguguuuggcuugcaagugugugugaauauauauaccaugugugugucuggugcccuuggaagucagaaguagcauuaggaugcucuggaacuggaguuuuggaugugaccaacuacaacuugugugcuaggaagagaaccuggguccucugcaagagcagccagugcuguuauccacugagccaugucuucagccccuccauguuauuuuuuaaagggacucucacuaaaccuagaccuugccaucuaugcaucaccucacccucacugucagugcaaauauaagcugaugcagccacugugggggaucagugugcagguuucccaaagaguucaaacuauaaguuugcauaugacaaacagcagcugugucacuucuagguguguagccaccaucuccuaucucuaagagaacuggaugucuaugcuaacuguuacucaauucuacaguaaugaggaaauguaaccaguguggauggccaucaacagguuaauguguagugaauauauaguaauacauaaaaucagauuuuguucagcuauaagggaaauuuaccagaaaauggaaagaauuggaagauacuauacuuugaggaaaucuacgugagauauacaguacuucagguuaaucucauaauuggauccuuuuaacacacacacaaacacacacacacacacacacacacacacacacaugcacacaugaguuuaggcagagauaagaaaauuaaaaagagcccaugagagggggaaaaagaauauucaaggcgaggauaaagaagauaauagaauaucugugacaugaaaguggaagggggguuuugagaucaauauguguacacguggggagagggacaaggagcugggauagagaagccggugugugcaaacaguccaagagagcuagauaugcaucaaacagacauagggaaacacauuuaccuacaucagaauauaaaaauauaucaauaaucauuuuucugguagaacuagcuuguuuucuugaaagauuuuuauucugaugauaugugaauuuucuuuuuuaaaaaaggacucgacacguugugauguggccuaaaagggccagaauauaguuauccugcugagugaaccuugagaacagcuguguuuccaggcagaaguuacuaugaauauuugcuugagugugugugugugugugugugugugugugugugugugugugugcauaugcaugugcacaggagcaccucaugcaugccuggucccugcaaagguuaguaaaaggaaucauuggugucacagaucauuggaaacugcaaugugugugcugcaaacuguacugggcccucuccaugagcaacaaguguucuuaaaugcugaacgaucucucuagucccugucuucuucuagucuucugucuucuaguuuucuguguuguuuauggauuaucgucuggacacuucuuccugugccacugacuguagugcaaagaguauagcuaaaaaggaucgaggagacuggauauucccuuuuucucagccucgcuacacuuguuugagaucuuggaggccgaggaaggcuaugguagcuggagcuucuuacauuuaaguaaggcaaacaaacaguguucguagacaugcccagggaccucugcucugaggucugcugugugcuccugguacuaagcuacaaguaauuuaaaaacagguuuucuaauuugaguaucauggcgaggagcccauagugaagcaaacugguucauuaugguagguaggaagggagagggugcaaagucaaggcaccugcugaggacauccuuucauagccuacuucccucaagucguccuuaacccuuucuacuauguuccuauagaccaucgaaguauugccuugguuucuuuuccuguugcugugcugcaauauccugaucaaagaaacucaggggagaaaggauuuauuucacguccaagcucaaggauacagaagucaaagcagcagcaggagccugggacaguugaccacaccacauccauuauuagggagcauagacagguggcucuugcuuauuuacuuuucucucuuuauauaguccagggugcuagccaggggaaggugcugcccacaguuggcagaacauuuccucucuauuaacacaaucaagauaaucccucaguggcaugcccagaagccauuucucaaggaauuuuagauucugcccaguugauaacauuagccaacuguguaggaaucuacaauaauucauucacaaugucagagaccucccgagucauucaccugccaaagguuucacugcugauggcagcugccuugaggaccaagccauucaagucauaagauuuuggcagaccuuuaaaaguuccaaucuauaacauuucuuuauuacauguuugaauugguauguuaauguuugugucacaugggcaaguaauaguuuuacugaacagaauuuagcucauguugauagagguucacuuucaguacuagacauaaauuaaacuaucuaaagcccuggaccagugguucccaacuuuccuaauacuguggccccuuaaugcaguuccucaacuuauggugcccccagccacugguacgugauacugaaagccuggaggauuccuaaagguggaauuaacuggguucuaaugucagugaaugaugauaacauaaguggucacaccagcagugucagcacuagaaacgugccaggaacacaaaggcaagccaacugaaagccaaaccuuucccuucuuucuaucugggcagcuuguagauggagcuguccacauucaaguugggcuuuccuauuaaaaauaugcuucucaagaaacucccucacaggcuuauaucacgggugauuauagaucuuguaggguugauaauacacacauauaaaagcacaauauguuacacacauacacaccauacacacacaccacacuuacacaauauaaaacuauauauagcaccacucucuauucccauagucuuuuguuaauaucaacaauuuguuuucguggugcuccaauuaauuguuucauagagauuggaaauacuauggccuguuuuauuucauguguauuuauguuuuucuuucauguauguccacaggaggcagucgaagcuaucagaucuaaaagaacuuaaguuugagacauugguuagaugcacguaagugcuaguaauugaccugaguucucuaggaaagcaguuaauaccuccuuaaugccuagggaucuucucucucucccuccucucucccucucccucccccucccccucuauacaccucucucucucucucucucucucucucucucucucucuaucucucccucuugcucucucaccuucuauugucuccugagaguucauuuucauaguuuuuaggaaaguucugcccaugauacuuuuccucauuuuuuccuuuauuuagcaaccacuuuaacaagcagagcuaugaggacguggauguuccuguggcugggaaugcuuccacucgugaagagcuacauuggggaauuaugucuguguuccugaaacccaugccauugaagcauucaaguguuuccuggauucuuuacaucuaaugcuucacuacaauugccuuuuuucuaugcugcuucagcaaaagggauuguuguguuuucagaugauucaaaauauuucacagaugagugauuguguucagcuguauuuacuaaagcuaaugcuaccuggauucgagggguguggccugccaguauauccaagggcaauggcacuauacccucucaaccuagaugggccccccuuccuuuuuuaggaguguuccugauucccuuccaacuugggcagugccccuaauauguaugguuguuauguggggugaaugguaguugcacugaucccuagccucagggcugaugggagcccugggauguaugcuuauaauaguguguguguuguguguuugguguaugugucaggugcagcaugugcaggcccucacuucugccaugguggcacaggccuuugccacaguggaggcgggacaaucucuucagauuuggcuugcugcucuaaagaaauaaugcugcguuaagccguggguugcaaggcuaagcagugcaccagaggauagcuagcuguuggcauccuguggaaggcacgucugauugcaugaagcuucaguguccuaguucccuucccccaggaaaaaaacgacacaggagcuggccaagaccucucugggugaugaacccaagggaugguuuuguguagggccccuaugcuugcacacgggggaucagaccucuaccuucacccaugaggcuugcuugcagcaaucaaaauugggccauagauuaauccaacauccugaccuucuggugcaccugccgcaugcagacaggacaaucuccucaaguguggauuggcaugauagagaaguagucaaugacggauaagauucccuggacgugucaccaaccuaagacagggaucaaaccaaugcuguuugucuccuaaggacagguaaggggcaaugccgcagggggcaaucuaagacauacauucucucugccaaaaaagaaaaaagggggagauaugaggaacagguguggcagcagucccaagauggagcccgggacugcagcuaagucuuaugacuugcaacugacuuccucauacaccugaaaauaagccaagaccauugugagagcugcgcaggugcaccaugaugcuggcaguguaaacaaguccauauuugguggagacaugccccugccgcccugauuggcugaagcugugugccugguaaguuggcauggccugccgugaguggaugggggcugagaguauauaagcagaccucccuggguucccgggguccccauaguagcaucgaggcauuccugcaauaaaggcuguugagaagaauccaaccauguugugucuucuuugccggccgaggugggugcaacaaagccuggucuccucaucugagacuacaaauauggagcucaacacuguguaauaaagaacacugggagcuugccauggggcuccucucuauaaucccagcacacagaaggcugaggcaugaagacagcugagauuaaacuacagccugggcaucacccgugcauuggagaccauccagaguugcauaguaagaccauguuucaauacaauguuuauggucuagagagauggcuaggcagcuaagagcacaggcugcuguucccgaggaucugggcuugguucccaacacccacauggcagcuacuaaccaucuacaauaaauugaaucccggggguccaaaagcccuuuggguuccugagggaauugcacaccuguggugcacagacacauaugcauuuaaaccaccuagacacaacaaaucaaucagucaaucuugaaauaaauuugaaaacaugacaaaagaaugggaaaaauuagaaaccuaaaaaccuaugugugagucugagguuaggcaauauuccaguaucacugcucuacagaaaugaaacaucagguucuguauagggucugcguaacaacuauucauacuugcaugauaucaagccaaacagagcaaagugguguguguguguguguguguguguguguguguguguguguguguguauccacacuccccugucugcacauuucugauggagccagagauggacuuugagucugucgcuguauccgucuccaccaacccacccacccacucaccuuuuuuuuguuguuguuuuuuuuuuguuuuguuuugguuuuugguuuuugcagacaggguuucucuguguagcacuggcuauccuggaacucacucuguagacuaggcugacucgauuucagaaauccgcaugccucugccuucaaaagugcugggauuaaaaugaugagcgagcaaugcccagccuucuccagguuucuugagguaccccauuucccugaaccuggaucucacugauuugcuuaaaugggcaagcaagccacagggacacucaugucucugacuccccaguguuuggauuacaagacccugccuauaaccggaaguuuuauacguguuccgggguucugacucugguccucgcaguuauuauguacagccuggauuauugcugacauuuuuuccagacaggguuucucugugcagcccuggcuguccaggaacucucucuguagaauaugcuagcugcaucaaaaucggggcuucaacugcuucugucuauccagugcugggaugagagacaagugauaguaaggcacuggccuuagcccugaccugcugcacuuuggagaggucaagcagggcuuggcaaguagguagccggaaacccuggcaccacaaaaaugguggaaauccacguaaaggccacuagagagcacaaucuugguuuugcucucacaggagucacugggugauuacagggaagaacaggggucacuggggugucaguaugggucacagaggagccacaagguugcuauggaaguuguaugaggggagcaagcucauuggucuagaaacaggugcaggggagagaaaaggaagcccuggcagcuccuuggcgucgaacugagguggcagcagaaggaagugcaucuucccucacaacucaacuucuugauucucagccgauggacacugagguaacuauauuagaauaauauuggcaucaagaguaagaucggcacauucccuguccugauucccgccucaccuuaccacaccccaccgcccaucucugggcacccaauuucuucauccuucagccuacucaagcagguccagaggggcgaggccagagaugcaccuuagcccagaacugccuagccuacccuguccccucacuggugcucuggcuccaaggguucccagcugugccacaugagggaagcuacugcuauuuugggcucugguggggcagaaagggaugacuggguuuccugaggagaaccugugcucuuuugaacugccacaggacuacagacacaaggagggacuaccaagaaagaggagaagucaugugcucaggugccauuagugaaguguggggaaccaaguaaaaguuuggccagaggcuguggcaccuguuuucaugacacaagacagacuacuuuuaaaaguuuauuuuuauuguuacuuugcaugcauuggcguugugccugcauguaugugugauggcuucagaaacuuuggaacuucagauaaauacaguugugagccaacauagaguuguugggaacugaacccagguguucuggaagagcagccagagcucuuaacaguugagccaccucuccagaccagagagagacagacagacagagagagagacagagagagagacagagagagacagagagagacagagagagacagagagacagagacauagagagauagagagagaaagagagacagugucagagacaaagacagauagagcgagacagagagacagagagacauagacaaaaacagaggggagucuuuagacgugagaaaaagaguuuaaagggcuugcugagaaagagcuaucuccuagcuaucuccuggcuagaacaaggagggcacagcacuugccuugagaacaacagccugcugaggaggagcuaucuccuugugacuugaacagggcauagcauuuguccugagacaaacagcccccagaggaggcucuaucuccuagcuaucgcccccuggaucaaacagggcauagcguuucacccggagccaaaaaaccuuuuucaguuggaguaguuggugaaaugaggaaaauguaggaugcaggaagauacauaaauguaagugguccaagauucuagaguaguguagucuuuuaugauuauuauuguuauuguuaauauuauugucuuugaugugguuauuaugggugacaggcugugccagagcuaugagcuguuguccaccucaccacuuuccugccucagccucccaggcacugguauuucuggcauggauuggccaagcuucuuggggagaugacagcauggugugaggaggagcaaguggucagcacuuuccaaggggaucaacggaauuauuaacauaauuauucaguaaaaaagcuaaugcagcuagaauggggauuuaugguuuccccugaagcuagugacuaaguucacucacuucuacgggggcagucacugaauacaggacuuuagggagacagguagaaguucacacaaaaagcaggacuagccuuuggcguuggcagagcacaggaugaugcaagagagcugagaguggugauugcugagggagauacagggacaccugucugcuccucaccggggacuugaugugagcaagugagugagugagugaaagagcaggugauggugagcagggacagucgggaucaggcgguauuguuguggggcuuaggagagcagcuccuuaggagaaggcuguguuccagagaagugauucugucagugugcuggaaggaccacaggagacuuguaggcacuagagauagaggugccugacgguaggguaaguacacugggggaaggaauuccaguguccauuuuggucacugccccuaacucuacaaacauggaauuugaaaccuaaagacagauaugaacuggaauucugacuccaccugaauagagguuaugggaccagaugagcaaagacaggugugggguugggggcaaacuuggucucagggaaccuguacuuugcucugaaagugccacccugaugggagaaucagaaacaacuggggugaagcacauugcugccaagaucuuccagacguacaagagccaccuucucauaugugugacuaacaugaauucuucaaucuccucuguaagagaaucugguagagccuagugcacugaaaguuuugggaagaagagcaguggacaccuagaaagaggcaucaagcuugaggcccaagaagaauggccgacgccuccagcacuccuaugagugcccagcaguguccccccaguucagcugucaugggugagugucucuggccagguagggguuguaucaauucuggugugguaagcccaaggguuucuggcacgguuaggaccacagaauagccacuugaacuuaggcaaaccuuccucccccuaaaccuguccaagguauaagaggucccuucagcgagaagugucuccuguuuacagaaaacagaaauguugugugugagguauugaaaagagauugacaggaacaugaggccucaaauggcagcagugcucuuugcagaguggugggaagggaguuucagccaagcucucuauguucuauuacagaucagcaccuguauccucuugaccagccugaaguccugcuucacacagauccccaacagguaaggaaaauuaguugcuacauuagaggcaccaagccagcagucauuuccuggagaguuuuaauuguccucaacucugagauucaacaacaauccugucugguacuugcauugcaggcgugggaaaggcuucauugcuuuuugggccucaguaacaccaaauggagaaauagaaccaaaaaaaauauauaacccccccaaaagaaaaacaaaaagcagcaacaaacaaaccaccaaagcggugagauuguggucaccaaguuuuagagagcuauguggugguucauggcuuuaauguccuaaaaacauucccaucuuucuuucucgguuaucaaaucugauguuuagcagggaugucuguccuuguagggaaucuaccaagugccugugauguugagcuugcccacaacagucaucaauauguccuguauuccggagauucuacaccuucaaaugaccccuucuuucucauggagucccagccagcccaaaacuauucccugccugugaguaaaaauaaauaaauaaauaaauaaauaaauaaauaaauaaauaaagaccauggagccagcuguggcuuuggcccuggcccugugugucaacacuuguucccgguccuauagaacucuggguagcggcaagaaaagagaagaauaguugaaggggacagagagguauaguagggggagggaaagaaauaaugauggaagaaaugggugaaugaaagaaaaaaggaaggaaggagaagagaggagaagagaggagaggagaggagaggagaggagaggagaggagaggagaggagaggagaggggaggggaggggaggggaggggaggggaggggaggggaggggaggggaggggaggggaggggaggggaggggagggcagaggaagggaggggaggagaggagagaaaaggaaaaggacaaaaggaaaaaggacaaaaggaaaaaggaaaaaggaaaaggaaaaaaggaaaagggaagggaagggaagggaagggaaaagaagggaagggaagggaagggaagggaagggaagggaagggaagggaagggaagggaagggaagggaagggaagggaagggaagggaagggaagggaagggaagggaagggaagggaagggaagggaagggaaggaaaggaaaggaaaggaaaggaaaggaaaggaaaggaaaggaaaggaaaggaaaggaagggaaaggaagggaaaggaagggaaaggaaaggaaaaucaugguggaacaacagaguagccuugcacccuaucuugcaagguaauaggccucagacauuuacuauuuccugugugacacacuuggagauauuguucugugguauucacucccugugugaauguguggaaaauagucugcccaggggcuuuaaagaggacaagcacagugcauagaccacacaguuggcuuucaaacauuuugaacuauugauccacucugaggggaauggccauggggaaagguucuguuaagaucuggaggcacauccauccgucagggucacacaacccagggaacugucccaggccuuuggagaauguguguacugccacaugagcuuagcauauccuucaugacuggugggcaguggcaauguggaggcaagagucagacucugaagacgacugcuucauuucccuccuggugcauugcacauuccagcagcccuuggccaucuuccuuguacccggggaaaagaguucacucucgagaguagugucucgagaagggauacggaaggagguuggaaggaagauggggaucgaaccaggggaggauccauuccaaacauaaaaugccagugccaucugucuuacugucugcagauauucacaugccccaagccuagucuugcagggaccccggcucuucaugaguacuugcaguuguggccaucuauaauguuuaacacccuggcuucuccucuccucuuucucagguucccuaaugugaucaugaagcccagcaccagcacugccgccccuguugugcuggcacagguccugguaaaugagcggggacaaggucucuggaagggaagggauggaaagagaagaaccucuuagagauggguguuuguugggaagaaaugggggcugaagggucuguuaucuugggggagggcaguguguuuuguuagaauucagucucucacucuauuacuuuucaggacuccaacaucucuucccagaacccugccacugcuaaccagguuccugucaucugggcccagaguaacaacacguucaaccaggucccugaagucuacacccagggcccaguuaccuccacccagggcagcucaucugcugaggaacacaggcagaaggucauggaugcugcugaggcucuccugauucugcauaacucccgggaggcacugcaagagacuagcaccaccccaggua

SEQ ID NO: 9668 - RNA, 6988 nt, Mus musculus
cagagcagccaccagggacgcccuucugagggccgagugcaggaagcucagggccucugaggcaaagcaggaaguggagucgaaggccaaggcacaaggagcccagagcaccagaaccgcuggccugcccgccugccugcugcuucuuuugaggcucagcuugggcgcugacucugaagggcuggaguccuggguaacugaccccugguggcgcgaggaaggugaccuccaucuucuccugagccuuucuccuuccuucuguccugcuccagugcccguuuccuucauuucuaggccuccucaagggaagcccgcuggugauaggaaacgggacagaggagggcgcgucgagcccgccugggacuuuggccuccuccacaggcuccguccaguccccgcgggcccugccccagccccuucagggagcaaccgucuccccgcugccugcgggucugggccugggccucgccagagagcagaugaggcagguagagggugagaaggaccagggagccauuccugucccagugccaacagucacaagguugcgaugacucuggaagauggguggacaacuggggaguagauguggggguuggaugaaaaugggccaugugaggcaacagaaagcugagcccacaggauagucugccuuugggcuaggucaggggccgccauuccacaugggugucaacaaacaucugucagguguagaaagcugggaagggaggaaauggaagaagaagaagaaugaaaaucugaaaaauuaaaaaaagaugacugagagaaauccggauggaucucaugagcaaacugcuuguuggaagcccaccuugucacuaguuagccccgguuggccucagucguggucucccuaccccagguucuuggguggaagguuuuuagguaugauucuaguguccacugccuucagaagaucaauaugauuucguggguggaggaguggaggcuagcagguggggaacacaaaggaaaucgguggaaaggcggagcaagggaauaauuaagucuguggugugaggaaaacuugaauggggguaggggugguggugaaagaaacaacugagcaccggucgucccugagacuacugagugcuuggugcauaugauuuuucccauguggggagagaaggaaugugaggcacgaggaagaagguugucuuccaguguccaggcugucucgugauuguccaggcaggcccgaggcugcugguguauuccuccuggaaaugggauguguggagugagucugagcagaucgauuggguaauggagccagugccaagaggcgguuggugggagguacugggugauugagacaacacgaggaaccugagauuaugugaguacaaaugggagaugaaggcagaagaaaaccaggagaggauaaaccugaugcugguggugaccauguuggagaaaauucucauucccagagcuaguuuucuuugcuuguuugcuugcuuguuuuguuuggugucugggaagggguuguuuuugcuuuguauguuucauuggguuuuguuuuguuuuuuguugcuuuuuguuuuuguuuauuauuuuauuauuguuuguuugauuucuguuuuauugucuuguuucuguuuguuuggguuuuuguuuguuuguucuuuguuuuuguucauuccuuugguucugcucaggaaagaagaguuacuuuagggccauggggauacaguguuguuucugcucucagccuaagaaccaugggaccaaaagacaaagcagcuguuuccugccggcccuccaccucggaauguaacauggggaacaagacuggagcagcagcaccuguaauggaaccuauccucagaggacgugcaaaucacccuggcagaggccacaguuguggcacccggacccaagucagguuggaaacccauucuucccacucucucggucugcuggugucccaguugggcugcauccuuuugaguaugguguccuggagggugagggggucagguucccuuugcacaugacuagcaggaguccuucaaaccccuauugaagggaccacggcgaggcccugcuggcuguggguucugagcaaaagggguauagugcacgaggaaagagacgccagauucgacuaccaagaacgacucucccccgcaaacccuucgaucaggccaagaagaccccuaccaaaggaagaggucgccgugagugucacuggcuggggagggagccugaguuugguuggagagaagcaaggcaugaguaacccugugaccagcucugccacagaauugcagugggaccaugggcaaggguagccuggaccucagugggcccagguagggguuaaaaauaaaacccaaaacauccuaucaaugguagacagcacuuguuugcaggaggcagagaucugggaaggggugcauucaaaaagguuuaaggugggaaguccucaaaaugguguugagugucuucagaugaggcuguugggcagccgagugggaaagaauucuuggucuuuuacagcugcaaaggagaacccugugucccagccugaagaccugccucaagcaagcccccaggagguaaggagaaucuguugcuagagugggaggcucccaccaguuacuguuaagaccccuuuuaacugugucuucaagucagggcucucaccucugacaggucagcacauugucuugugcggacauuggcaaauggcacuuccucuugagccuaagucuucucagcagcaguugagcacgagacuggaggggagggggucuggagagguccucagagcccugacauucuagauuccugccaucagacuaucauuugcccaucccuccucucuuccugggccggccuggaagccaauccccuaccuucgcucucugucuccucaggagagcccccacgggucucaaguguauugcuggcccccagcacuuucaccucugccuuacaugucagugcccccagagcagcaguugguggcuccuccuuccacggagauucacggggcuuuugcugaguccaacccgugaguagaaagggaccuugcaguugacugugucuugugucucugugagucaggacaugggcuuacugccacaggagcaggaggagggggauguucggagggaggaggacaaguggaggugggaggagaaggcugcaggucagacugaggggcaaggacagagggccucuccagcuuuggccguucccacuccagagacuugguacaagugacuuuauuuuuuucaaguauccauuuucuagaggucauuuuggcaagagcacucuauaccugccacguuguuaaaagcaccagcacgaaggccugcugcuacauagugggccuucaacacgugggcacuguuucucuacacacagcagaugagugcaaugggaggguccugaugaaaccuagggucaugguggacagggccagggaggcccagggcaaaguccagaggucaacaaagaaagccuccuagaagugcuccgggcuugucccucaugauccgugguggccuggcaaagugcuggcaagaaccagucccuggaaauggaaggucacuguaucucuuuagggacuuugcaguauauuaaaaugcagauacccguuguuucccgauacauucuucacugcauaucugggagagaauuaaaaaggaaaacaaacacuuguauggauuaauuucucaggaaaaaaguuguguugccggggagggaguuguuuaaaggaaaacagacugugcgggacaacgggcauguccaagccacagggccuaaggucuccacaguccuuugaaugcccaccuucugguauugcaaaacccugucagucucccucugcaggugcuaccuacccacccaaguguuuaauucccuuacuaccucuuguuuccagaugcucaaguaugguccuccugccacguaccuccaccgaucaccaccauccacuggagucacagguccccacagagaagcaggaggguucuggaaacgugggugggaggagcuaaguugauguguagggcagaccgucgggucauugagagugggcccuggaggccgcuggguacugagcgggcauuugugcuucugagaagagguguuggaugcacagcuccuggucuccucacaccuguuucuuugcagggcuccggugccucugaccaggccucgguuccugccuccuuagagugucaggaaauacuggaggcugcugaggcccugaugacucugaagaacucuucuuggaccuggcaccagacccacagcuaaacagguagcugacuucuugaaaaggagcaagggauggagguaguugggagaugggaagcucugugguaaguuggucauggcuggguacauggggcuaguuugugcuuggaaugacuucgggacuggguacaccagucuucugaggcugacuucagagagggcacuuggaggcuuauucagagaaugcuaagcaucucaaguuuuagccuagcaguaauuggcuagucgccaugacaucaaaagagaaggagucugaggcccccggggaguugcagggacuugcucuagggcaggccgcauaucaagugcaagaaauagaaccgggcacccugauuccccacccagccccguguucccagucuauugcucacuguuguuguggaguuucuacccugccuuugaccauuuaguucccagacaaaagacacacacaaccuuuauauuuacaagaagccuuaaacagcauaagaauuggacagauaucuacccccuagccuauuagagagucuacuuuccuguccuguugauaaccccgaguuauuacuacguuuuaucugggcugcucuuagcucuaauugaccagcccucauggccacgauuucaugacacucacucuuaacacaugacggcuucuccuuccuccuucaccuucuucuccuccucaugguucuccuccaacucccaaguccaggaauccuaaaccccaccuaugucucuucugcccagcuauuggcuguuggcauggcaacuucauuugccaaucagaaauaacuugggggcaaggucacgcagugucacuugguucgacuugcagauucucuccucucugggacaaccaggucuuggaggcccuguacgagcauuagaauacaagcagcauccagccaacccacuacacacugugauggucuggggaagacagagagauuuagaaugagguuuagagcccgaucuuagggcgauuucaauucagauguucagccuggauucucucaugagguguauuuugcaaccagaucucaaaugacccagggcaaguguuuaugagcugaggagggaauuaaacuucuagugugucugggcagcaaugcuggaccuuguugugcacagagacagauagggccuaggguauauaggaggaagccacccuggaaagaacugcuggaacacaacaggcagaaugaagcuugggagguggcugaucacaggggucuggcaagggcgggagaugaaucccaggccagggcuucuuaauguacagauaauaaacuguaaagaaacuuacuuuaauacaagucuuugguauacauguaacuuuaccauuuauuaaagaaaaaacugugcaugacaaggaacagcauguguuuguuuguuuuuacugcaagaguuagaucuugacuaaagguuuggcacugaggagcaugaagcaucuuccuugcuucucaggguugaucuguccuucuguuuauacuuccaguuccaagggugcugcuccaaauaaauacauaguacaagauggcagaaguacgcucagggucauuuccgaaauuguuagaaugacuguacaaaucccaaaccaaaauucaucugacaauuuuucacaagccucaacucagcagcucaaacaauaguuuuuaaagucaaacauuuuacaacauguuuaggagcgacagacagaaaauauuaaaagguuuugauauccacaguuaaaccaucauguuucuuuuagagcucucaaaaagggcccaaaacaacacucaaacaauaagggaaagacugacaccugagguugucuucugacuuucacauaccugcacauacucacaaacacugguguauaagcacacaugacagugcacgggcacuccccccccucccccagugugggacuaggccaggaggagcagguaguggaagaucaaggaacuuuccugaaaucgggaaggauauauugagagaucaugagcuucaucaccacaguagguuuguguggaugauagaggaaugagggaaggugaggcuggaggcaaggaauuccgacaggaauaggucuguccacuggucucagugacagauguucacuugugggagacaaagacaugggggagaguugggaaagggacucguggucauuaguugguccucauaccauccuuucugccuucaggucuugcuugaaguuggagcagugaagccuccccgcccauccgugugauucagauccacuggccagcuccacuucacuuccuguugagugcaccuucuucuuggacuuaagggcccagagguggggggugcggacuucuucaagcacugaguugauguuaugugugguuccugucugaaaugcuuaaaugugcuuuguaagccuucgggcauuuaauaagcuuucagacucuucucauaauguagaucuguuccuuagcuugcauaguauguucuuguacccccaucccuuauuccuuuggaagcugaugcuauucaauguaucuucuguggauagcacugugcaauuuaaugugaccagucugucgguggggcucugaguggguuaguauaccauuguuugcauuuguucugugauugcauaugugcccaggcaccccuguacuuguauguggagaaguuucaacuugugucuaggcuuguauauuugaacaaauaauaaagcauugguaggagacacugc

SEQ ID NO: 9669 - RNA, 10073 nt, Mus musculus
aauggauauagcaccuucauggaggcugcagagaaaggacuugggcagucuccagcugguguccaagucacuguacuggucucauuacugugaccaguuaccaggacagauuuguagacauaggacauguuccccugcaccuaugucuccagccaugccgcugauguccauggagucagugggcauaucuacuaaggcagaguggacucuuguugagcccugacccuggagacacccuccaguugguuuccccgaucauuugucugcuguuccugccauagaaacuccucuuuuguagucacaugacauuucuccuaucuuccagccccacacagaugucaugucuuccuccuugcccuccaccuuggauagacaccugacauggugaggcacaguucaccuguccccucuaucugcaggcaucccauccuagaccacuaggggaugacaguuaggccccaagcccuacuagcuccuugcccccugccucugcuggcacaagcucuuccuagguccagagagcuggguuuuugcagaugcugagguuccuaucuguguaccagcuacucagggagagauggaaagucaugccuccucaaggcacacaagggucaugcucuugauuucauguuguccuauccugagcagcuucucauuagagaagucagugucacuuauauaaacaggauggacucgggugccgugacagguacacgugcuggcuugugaaauuccauggaccccauagucuggucacacagagcugaugagacacuguguucaaacggccaauaaacacuugggacagugcacaaccucucagcuaugaggaaaucacauacaaaacucgcugcaguucguccaacccaagucagacuugucacugugaaggaagcagagcccaacacaucuccaggaggucacagggagagugggacucuucuggguuuagugugaacuggcccagccaugaugggagugaguagagugauucuucaccggcuagaaacagaaccagccuauggcccaguuuugccaccauuggucacaaggggcuauaagcccagagaacaaaaacccaguugugcauccauggguuggcugugcugugaacaauagccaggaaagugaaagagcccaggugagccucuggagauggggacuugaagaaaacagggugcacacccagaugggauuuuaaagaguguagggauuaacuggaggggauauguugaguagaacugggcaugguagacagcagcggucaugaugaaagaacaaacuagaaugacaccuguuaugaaaaagucaagaugaaacacacacuuacucuuuuccaugaaauuucacuggaaaaaaagaaaaaaaaccaagacaacaacaacaacaacaacaacaacaaacuacacaacucagucuucugggggcagggcaauuuguuaaguaaacaggcagccugggcuauuauaguggagucagucaagaagucuugagguaaggcaccacaauuuggguauuuuuauuugguuucuucauaaauccugugcaccaagucccuggguaaaggucagacccuauuccugcaauggccgugcagacagagggaaaguuuggucugacuccuuuggagcuaguucagucugacaguuuucuuuauguucugccacagauuugucugugucugucugugugugugugggggggggggggcuuggggggcugccacacuuguacgcacgcugauguucaaaucacuuucugcuacuuugaccauauggccccuguccucacagaugcggaauugugacauggccauugcuauagagcccuagcucucuuccaaccugugguccuggggauuuugucuacaccacugggugcuugggcauuuucucuucagcacagcugcccuugauuccuagcagaaugcucagcaucugguccuccuuucugaaggacaagggacaagagucuguuuuugcucuauacucuggaggauaucagcucgacuguccccugacauucaguucuguuugcccugcccccugguugcucucuccacaccagcacugaguagguauaugcugucuccugaccacacugggguuuuacaccccuucccacagagccagaagcacuagcuugugacuggggacccugcauuucaucccaaagugcgauuucagcuccuguucucauuugcuuucugggcagggaugugcacuucuugguccaggucaggaaccucagaaccucaagggcauccagccaagaguuaacaagcaccuggcucuggaccuggccuuucugagcccuugcccaacccacccagcccagguuuggcugucuuuaacuuaccauugggggcugcccuggaggcugggggcucuugauuuucacuucccaccuggcagugggaguugaggcuguguagaacccuagguuuacagcagccccugugcuguggcagagucuuggagaggcugaggauggagugggguucaguuugcaguagagguucucugcuccucagagaagcucaaaggcagcccaccuuccucugucuuccagaccugugcauccacagggccuagcccaggcuguauguacaguacuugugggagggccuuaugaaugagcaagcauucuuuauucucuccuccagaaguguuacuggggggagaggaggggcaggcgagcaggaagggggagcaggcucacaaaauggcucagcagguugcuuagggagcugggaagacuccugcuuuccuggguggcagugguggugguggaggcagggaugugcugugugugugugugugugugugugugugugugugugugugugugugugugugugugacagagagugagacagagacagagacacagacauagagaauuagauugacagcaaugcucuagugccucugccaguuugagagacagaggcagcgcaguggacacacagaaacauacagaaugagagaguguggcaggggagggagagagagcaugcucuuguuccacugugagugugugugugugucacagagagagcaugcucaugcuguucuagcuucugugugugugugugugugugugugugugugugugugugugugugugugucugugugucugugugugucuuucccgcgggaagccccccuuccucuggaugcuggaacacugcuucuaggcuccuucaggcagggcuagccuaucuucaaggccaccccacccacuguagcucacuugcaagguucccacuggaaucacggcaagcuucccuuaugggggaagggacagagcccccaccccucucgccggcccaagacacagaacccgaagcccucccuccgguccagcgcacagccgggucccuggcaccgucuuccccagcgcgugggcgccccagaggcugcgcacugguaccccaacccgggcucagcccgcccccgcgcugccugcccgcagccccgcagccccgcagccccgcagcagccacagggggaaccaaagagacagaagccuucccagcugcccggaccacagacgccaacaccccccgccccccaccccacgccgcccucgcgcccgcgccccgcacgccagcagcccacgaccgagcggcggcggcggcaggggcaggggcaggggcaggcugcgggcugcggagacggagucggcucugcgcgcuagcagccggcgcucgccaccccgggugacucgcucgcuccgccacagcggggucccuguccgcggccgccgcgcgagcccccggcccgcguuccggcacccaccggcccucgccgccucuccgcccccucaguucccgggaagggaggucgcggcagcggcccggcggcagcggugaccguggcguccgcggcggcaguggcggcggaggucgccgcagcggcggcggcagcggcggcggcggcagcggcggaggcggccgcggcgaccguggcggaggcgguggcggaggccuccguggcggaggcggaagcagagguggaggcugagguggaggccgaggucccggcgaaggccagccugggggaggcggcggcccuggccggggagaaggcagaggccggcggcgcggccgcggccgcggcgguggcagccacggaggccagccuggcggaggccagccuugaggaggccagccuggcggaggcggcugcgucgccuuccuaugggaggguggauauggacgaagagcuggcagcagccuuggcugcagaggaggaagaggcggcggccgggggcucggacgaugggaacccagacuuucccacggccucgcuguacgugggcgaccugcaccccgaggugaccgaguccaugcuguaugagaaguucagcccugccgggcccauccuguccauccgcaucugcagggacaaggucacccggcgcucucugggcuacgcauaugucaacuaccagcaaccgguggacgccaagcgggcccuggagaccaugaacuuugacguuaucaauggccggccagugcgcaucauguggucccagagggacccgucgcuccgcaagagcggggugggcaacgucuucaucaagaaccugggcaagaccaucgacaacaaggcgcuguacaacaucuucucggccuuuggcaacauccuguccugcaagguggccugugacgaaaaggggcccaagggcuauggguucgugcacuuccagaagcaggagucggccgagcgggccauagaugcgcugaauggcauguuccugaacuaccgcaagauuuucguggggagauucaagucccacaaggagagagaggccgaaaggggagccugggcgcgccaguccaccagcgcugacuucaaggauuucgacgacgacuccgaugacgaggccaccuuucgaugaagacuucccaggacccagccaguagagccacaucuuggcucccaccccguuuacagccccccaccccccaacccaccagcaguguauuguauugggagugcagguuucucucuccccccucuucccccucccucucuuccccucauccuucuccuuccucucccccuucaccccuccccgcuccucuuuuccucuuuccuucccucccucucuugcccucucucccucucucuucccuccccucuccucucccccaccccccccaaccucagagcuagcuagcuagcuuccccauccccucucugcucucagccccucucuucuaaugcccucuccuucccucccuuucuccccaaccccagcaagggccccuuguagaggauaaucccacuaaucugugccauuggagagguuaaaggcugccucuucucccggugguggucggucugauucuuaaaagcauuuuuuucugucucuuuguuuacugcacaggugaugcaauucaugguagaaaugucuggaaggagaaggaagucugaugugggagaaagaagcaagagucuaauugcuucccaccauccuaauacccagagagaagcccuuuuaucuucuuuggugugcuguuuuuccaggcucucugcuccccuucucucugccucucaccccagacccaccuucccuauuaacauucuuguagagugguucauguaugugguguuucuuaaccugcuuuuuucagcgacuaaaaccaaacagaaaucaacgcguugaacuucuuuccaugcuauucaacaggcuuaugauaagaccgucaucuucagugccugcagagugcuccuguguaucuauccauggaccuuaacauuucuguaaucauuccugcauuguuggacauucagguggugccuaguucuuucccuguguuuaaaaccaacacugugugcccugaggagugaauccuuccuugucaagccaaaucuaggcuagcauccuggaugcucucuccuuaacuguggacuugcaggauccacauauagacacuucaaagacuuucccuguguguugccaaaaggcucccuuucauaagcauuguaccaguuuguauuugugccagccagccagugcagcuaguaaaaagaaaaaaaauggguaugcucaugucuccugcacagccucaugguccgcucuaacucucucucucucuuucuccucuccucuccucuccucuccucuccucuccucuccucuccucuccucuccucuccucuccucuccucuccucuccucuccucuuucucucucccucucugucucugucucucucucucucucugcuuguguguaugucucuguaugcgugugugcgcaagcgcgugcagucaaucucaugagcugcaaauggcaucuucacuguugugguuauuucacuggaauugaaugcuguuuaccaccccuuuccugcauuccugcuuucuguccuuuucccucuugccauaaaaauaaaucagcuauguugcaggaaaaaacaaaaucacuaagcagaugauuuaacagaagaaauggaaugcuagaaugcuaucagcaaucaauccuaaugacucccaugccuucuccaacuguacucaucucuaugugcccaguguuuuuucaguaaccucugagacaucuucuuguuucucuaguauuguucuuaugcauugucauauauguauauuauaauguacauacuguuuuuauaucugcuuuucacguguguguauguguguauaugcgcauagacugcugagcuucauuccugucauuaaagauacuuuuaaaauauuuccuuuggcuguugguacuugauuuuuguguugguuaauguaaacaauauguaaaaugaaguagauagauugauucauaaauguguguacauauucaugucuauauccaucuguuuuguauuuguguacauuuuauuaacaauccauuuuuauaaucaaccuuaguaacauucaaguuuauuuccucaguaaaugcuuagaagaaauuucagguguuaaaauauguguucccugucuuuuugggcaagaaaagugcauuauuuaauugcuauacucaaagauaguguauuuuuaccuccuugagcugguccaggcuuaugagcguuccagauguacuauuauauuuaucuuguguuucuguauaugguuuaucuuuuaauagaucuaaacacuuuguaauuuuauauauuuucacauuuguuuuauauaaauuacacauaacuaugacuggaaauauauauuuaaaauuuucaauauaaaaagggccaguaaaaaagacccuacaacauuucugaauaucacuacuugcaaaacaugaaauagaucucugacaauuuauuuauaauauaauauacauuguuucauugauguacauuuuuaccaucacaguucuuuaagaaucaucaucuuguaaaucgcucaauauauucguucauuucaguuacaaauucaucacugugagauucagucauaucuacaacaaaaucaucugaagacauguucaaaauauuucuccauagaagaucaauucuaagaacacuucuuuuuucucccuuucaagugcauuucagacuaagugauauagauaugucaaauauuuuggacuuauuaaguucuuuacuuagaaauccccaccuguagugcaggagaguguacauaccacuacucagcucaguucuuucaguugcucauugugcuuuucuucguaaaacuucauuuaaaaagugaaguucuagcacagugguucucaaccugugggucaaggcccuuuggggaggggucacauauuagauauccugcucaucagauauuuacauuacaauucagagaaguagcaacauuauaguuaugaaauagcaacaauauaauucuguaguuuagggucacuauaccagacggacuguaucaaaguggucacagcauuaagaagguugagugccacuggucuagcacauuaaaagacagaagaaaaacuucauuuuaguuucucuacuuuuuccauaucucuauaagaauuuucaaacaaacguagacauaacuguguagaaguuagguuuuaaaauacuucccccuauuugguuuauuaaaguagcccuucaugcuuauuucucuuauuuccacgauccugguuaauuguuuugaaguuguauugccccuccucccuuaucccagggaaaacuaacaguuguuuuccucauucuagcuguuaaguaacacuuaaaauucaagauaacugucagaaauguuuauuagaaagaagaaaaaaguauguuuaauauaucacuugaaauguuucuauaaacucuguaaugcaaauuaaaacuaugucugccucaguaggagugauuaauuuaugucaucaaauacccuuguagacccuucuuauaggucaagacaacuuuuacaauuuggcaaacuggaaguuuuguuuuaacauuuuuguaggcuauauauugcugauauuguucuuauuauaccuuaaaaauaucuguuguaucauuuguuuagcccauccuauaaaagauucagaaauaaccucucauucacaaagauggauagcuaucaguaugacacaaagauucauguuaaacccggugugaugguguacaacugcaaucuaagaacccaguagucuaaggcaggauacuccugaguuucagacuugccugcauauauagcuagacagugucucacaaaaauucugauuauccauguucauuaccaggauggauguugccuuagcuuugauuuacuaaagauaaaauucauuucauaucuagcagcaaaauaaucugaauggacugagaaugagaucagucugucaauuucuacaaaaaaggccagacagguuuuugaucagguugugugaaacauagauugacuauuauuucuuauaucauaguuuaaaauguucuaauccauuaaccuuccuuuuacauaggucuuugaacaaaguuuuguugcauucagaguagcaguuuauauuuauuauauuaacuuucuuaaaugaaacuccuuaugaaguaugauaaguugauuuuauucccuaguuuuucuuugauuauugaaacugcacagaaauuaaaaaaaauuuauauauuggucuuauguucuauuauuuuuucuuuuauugauucuuguacuuuauaaagagauugugucauuuaaggcuagaauaaucaaagcagcaauguagcauaauuaaaaauaggcacuuuaaccacccaaacgugagcugcaagaaugaacgugucaaaagcccaugaggacucaaccuuauacaaagaaguauagacaacugagaaaagcuaugcacaagagaggggucuuccuugagaaaaaggcacaccaguugguugcccagugcuaaaugguugguccuggaagcauacauguaaguaaaauuauauggacucaacagguuauguacauauauacguauauacacacaauaacaauuagugaaaaaagaggccaugaauuuaugggagaauuuauaggaguauauagguuuggagggagagaaaggaagggaaauguaauuaaauuacaaucucaagaaaaaauucugcaggcacuaacagugaggaggugaguuugaacaaaguauaaugauauguguguguguguguguguguguguguguguguguguguguguguauacaauggcacagugaaacuaauuauuuuauggugaaaucacuuaagauauaucaguaagacaaaauagaaauacuagaaauaaacucaauaugcaggcaaaugaucuacagcaaaauaaugcacaauaaaggauuauuucuuccaaaaauuauguugggaauaccagacauccaaauacugccucucucucaguuuauacuugcauuacauuacauacaaaacugauuaaaugacuaaaauuaauaacugaucuaaacauaugacuuaaauuccuaaaaugccaggaaaaacagucaggaaaacaacuucauuccauugauauuaggaauauuuuaauggauaugauaccaaaacaggaacaaugaaaacaaaaauaagcaggauuaugagaaaggaaauauuuuugcauaggaaacaauaaaaauaaaaacaauaaucagaauggaagaaaauau

SEQ ID NO: 9670 - RNA, 10073 nt, Mus musculus
auauuuucuuccauucugauuauuguuuuuauuuuuauuguuuccuaugcaaaaauauuuccuuucucauaauccugcuuauuuuuguuuucauuguuccuguuuugguaucauauccauuaaaauauuccuaauaucaauggaaugaaguuguuuuccugacuguuuuuccuggcauuuuaggaauuuaagucauauguuuagaucaguuauuaauuuuagucauuuaaucaguuuuguauguaauguaaugcaaguauaaacugagagagaggcaguauuuggaugucugguauucccaacauaauuuuuggaagaaauaauccuuuauugugcauuauuuugcuguagaucauuugccugcauauugaguuuauuucuaguauuucuauuuugucuuacugauauaucuuaagugauuucaccauaaaauaauuaguuucacugugccauuguauacacacacacacacacacacacacacacacacacacacacacacauaucauuauacuuuguucaaacucaccuccucacuguuagugccugcagaauuuuuucuugagauuguaauuuaauuacauuucccuuccuuucucucccuccaaaccuauauacuccuauaaauucucccauaaauucauggccucuuuuuucacuaauuguuauuguguguauauacguauauauguacauaaccuguugaguccauauaauuuuacuuacauguaugcuuccaggaccaaccauuuagcacugggcaaccaacuggugugccuuuuucucaaggaagaccccucucuugugcauagcuuuucucaguugucuauacuucuuuguauaagguugaguccucaugggcuuuugacacguucauucuugcagcucacguuugggugguuaaagugccuauuuuuaauuaugcuacauugcugcuuugauuauucuagccuuaaaugacacaaucucuuuauaaaguacaagaaucaauaaaagaaaaaauaauagaacauaagaccaauauauaaauuuuuuuuaauuucugugcaguuucaauaaucaaagaaaaacuagggaauaaaaucaacuuaucauacuucauaaggaguuucauuuaagaaaguuaauauaauaaauauaaacugcuacucugaaugcaacaaaacuuuguucaaagaccuauguaaaaggaagguuaauggauuagaacauuuuaaacuaugauauaagaaauaauagucaaucuauguuucacacaaccugaucaaaaaccugucuggccuuuuuuguagaaauugacagacugaucucauucucaguccauucagauuauuuugcugcuagauaugaaaugaauuuuaucuuuaguaaaucaaagcuaaggcaacauccauccugguaaugaacauggauaaucagaauuuuugugagacacugucuagcuauauaugcaggcaagucugaaacucaggaguauccugccuuagacuacuggguucuuagauugcaguuguacaccaucacaccggguuuaacaugaaucuuugugucauacugauagcuauccaucuuugugaaugagagguuauuucugaaucuuuuauaggaugggcuaaacaaaugauacaacagauauuuuuaagguauaauaagaacaauaucagcaauauauagccuacaaaaauguuaaaacaaaacuuccaguuugccaaauuguaaaaguugucuugaccuauaagaagggucuacaaggguauuugaugacauaaauuaaucacuccuacugaggcagacauaguuuuaauuugcauuacagaguuuauagaaacauuucaagugauauauuaaacauacuuuuuucuucuuucuaauaaacauuucugacaguuaucuugaauuuuaaguguuacuuaacagcuagaaugaggaaaacaacuguuaguuuucccugggauaagggaggaggggcaauacaacuucaaaacaauuaaccaggaucguggaaauaagagaaauaagcaugaagggcuacuuuaauaaaccaaauagggggaaguauuuuaaaaccuaacuucuacacaguuaugucuacguuuguuugaaaauucuuauagagauauggaaaaaguagagaaacuaaaaugaaguuuuucuucugucuuuuaaugugcuagaccaguggcacucaaccuucuuaaugcugugaccacuuugauacaguccgucugguauagugacccuaaacuacagaauuauauuguugcuauuucauaacuauaauguugcuacuucucugaauuguaauguaaauaucugaugagcaggauaucuaauaugugaccccuccccaaagggccuugacccacagguugagaaccacugugcuagaacuucacuuuuuaaaugaaguuuuacgaagaaaagcacaaugagcaacugaaagaacugagcugaguagugguauguacacucuccugcacuacagguggggauuucuaaguaaagaacuuaauaaguccaaaauauuugacauaucuauaucacuuagucugaaaugcacuugaaagggagaaaaaagaaguguucuuagaauugaucuucuauggagaaauauuuugaacaugucuucagaugauuuuguuguagauaugacugaaucucacagugaugaauuuguaacugaaaugaacgaauauauugagcgauuuacaagaugaugauucuuaaagaacugugaugguaaaaauguacaucaaugaaacaauguauauuauauuauaaauaaauugucagagaucuauuucauguuuugcaaguagugauauucagaaauguuguagggucuuuuuuacuggcccuuuuuauauugaaaauuuuaaauauauauuuccagucauaguuauguguaauuuauauaaaacaaaugugaaaauauauaaaauuacaaaguguuuagaucuauuaaaagauaaaccauauacagaaacacaagauaaauauaauaguacaucuggaacgcucauaagccuggaccagcucaaggagguaaaaauacacuaucuuugaguauagcaauuaaauaaugcacuuuucuugcccaaaaagacagggaacacauauuuuaacaccugaaauuucuucuaagcauuuacugaggaaauaaacuugaauguuacuaagguugauuauaaaaauggauuguuaauaaaauguacacaaauacaaaacagauggauauagacaugaauauguacacacauuuaugaaucaaucuaucuacuucauuuuacauauuguuuacauuaaccaacacaaaaaucaaguaccaacagccaaaggaaauauuuuaaaaguaucuuuaaugacaggaaugaagcucagcagucuaugcgcauauacacacauacacacacgugaaaagcagauauaaaaacaguauguacauuauaauauacauauaugacaaugcauaagaacaauacuagagaaacaagaagaugucucagagguuacugaaaaaacacugggcacauagagaugaguacaguuggagaaggcaugggagucauuaggauugauugcugauagcauucuagcauuccauuucuucuguuaaaucaucugcuuagugauuuuguuuuuuccugcaacauagcugauuuauuuuuauggcaagagggaaaaggacagaaagcaggaaugcaggaaaggggugguaaacagcauucaauuccagugaaauaaccacaacagugaagaugccauuugcagcucaugagauugacugcacgcgcuugcgcacacacgcauacagagacauacacacaagcagagagagagagagagacagagacagagagggagagagaaagaggagaggagaggagaggagaggagaggagaggagaggagaggagaggagaggagaggagaggagaggagaggagaggagaggagaaagagagagagagaguuagagcggaccaugaggcugugcaggagacaugagcauacccauuuuuuuucuuuuuacuagcugcacuggcuggcuggcacaaauacaaacugguacaaugcuuaugaaagggagccuuuuggcaacacacagggaaagucuuugaagugucuauauguggauccugcaaguccacaguuaaggagagagcauccaggaugcuagccuagauuuggcuugacaaggaaggauucacuccucagggcacacaguguugguuuuaaacacagggaaagaacuaggcaccaccugaauguccaacaaugcaggaaugauuacagaaauguuaagguccauggauagauacacaggagcacucugcaggcacugaagaugacggucuuaucauaagccuguugaauagcauggaaagaaguucaacgcguugauuucuguuugguuuuagucgcugaaaaaagcagguuaagaaacaccacauacaugaaccacucuacaagaauguuaauagggaaggugggucuggggugagaggcagagagaaggggagcagagagccuggaaaaacagcacaccaaagaagauaaaagggcuucucucuggguauuaggauggugggaagcaauuagacucuugcuucuuucucccacaucagacuuccuucuccuuccagacauuucuaccaugaauugcaucaccugugcaguaaacaaagagacagaaaaaaaugcuuuuaagaaucagaccgaccaccaccgggagaagaggcagccuuuaaccucuccaauggcacagauuagugggauuauccucuacaaggggcccuugcugggguuggggagaaagggagggaaggagagggcauuagaagagaggggcugagagcagagaggggauggggaagcuagcuagcuagcucugagguuggggggggugggggagaggagaggggagggaagagagagggagagagggcaagagagggagggaaggaaagaggaaaagaggagcggggaggggugaagggggagaggaaggagaaggaugaggggaagagagggagggggaagaggggggagagagaaaccugcacucccaauacaauacacugcugguggguugggggguggggggcuguaaacggggugggagccaagauguggcucuacuggcuggguccugggaagucuucaucgaaagguggccucgucaucggagucgucgucgaaauccuugaagucagcgcugguggacuggcgcgcccaggcuccccuuucggccucucucuccuugugggacuugaaucuccccacgaaaaucuugcgguaguucaggaacaugccauucagcgcaucuauggcccgcucggccgacuccugcuucuggaagugcacgaacccauagcccuugggccccuuuucgucacaggccaccuugcaggacaggauguugccaaaggccgagaagauguuguacagcgccuuguugucgauggucuugcccagguucuugaugaagacguugcccaccccgcucuugcggagcgacgggucccucugggaccacaugaugcgcacuggccggccauugauaacgucaaaguucauggucuccagggcccgcuuggcguccaccgguugcugguaguugacauaugcguagcccagagagcgccgggugaccuugucccugcagaugcggauggacaggaugggcccggcagggcugaacuucucauacagcauggacucggucaccucggggugcaggucgcccacguacagcgaggccgugggaaagucuggguucccaucguccgagcccccggccgccgccucuuccuccucugcagccaaggcugcugccagcucuucguccauauccacccucccauaggaaggcgacgcagccgccuccgccaggcuggccuccucaaggcuggccuccgccaggcuggccuccguggcugccaccgccgcggccgcggccgcgccgccggccucugccuucuccccggccagggccgccgccucccccaggcuggccuucgccgggaccucggccuccaccucagccuccaccucugcuuccgccuccgccacggaggccuccgccaccgccuccgccacggucgccgcggccgccuccgccgcugccgccgccgccgcugccgccgccgcugcggcgaccuccgccgccacugccgccgcggacgccacggucaccgcugccgccgggccgcugccgcgaccucccuucccgggaacugagggggcggagaggcggcgagggccggugggugccggaacgcgggccgggggcucgcgcggcggccgcggacagggaccccgcuguggcggagcgagcgagucacccgggguggcgagcgccggcugcuagcgcgcagagccgacuccgucuccgcagcccgcagccugccccugccccugccccugccgccgccgccgcucggucgugggcugcuggcgugcggggcgcgggcgcgagggcggcgugggguggggggcgggggguguuggcgucugugguccgggcagcugggaaggcuucugucucuuugguucccccuguggcugcugcggggcugcggggcugcggggcugcgggcaggcagcgcgggggcgggcugagcccggguugggguaccagugcgcagccucuggggcgcccacgcgcuggggaagacggugccagggacccggcugugcgcuggaccggagggagggcuucggguucugugucuugggccggcgagaggggugggggcucugucccuucccccauaagggaagcuugccgugauuccagugggaaccuugcaagugagcuacagugggugggguggccuugaagauaggcuagcccugccugaaggagccuagaagcaguguuccagcauccagaggaaggggggcuucccgcgggaaagacacacacagacacacagacacacacacacacacacacacacacacacacacacacacacacacacagaagcuagaacagcaugagcaugcucucucugugacacacacacacacucacaguggaacaagagcaugcucucucucccuccccugccacacucucucauucuguauguuucuguguguccacugcgcugccucugucucucaaacuggcagaggcacuagagcauugcugucaaucuaauucucuaugucugugucucugucucugucucacucucugucacacacacacacacacacacacacacacacacacacacacacacacacacacacagcacaucccugccuccaccaccaccacugccacccaggaaagcaggagucuucccagcucccuaagcaaccugcugagccauuuugugagccugcucccccuuccugcucgccugccccuccucuccccccaguaacacuucuggaggagagaauaaagaaugcuugcucauucauaaggcccucccacaaguacuguacauacagccugggcuaggcccuguggaugcacaggucuggaagacagaggaaggugggcugccuuugagcuucucugaggagcagagaaccucuacugcaaacugaaccccacuccauccucagccucuccaagacucugccacagcacaggggcugcuguaaaccuaggguucuacacagccucaacucccacugccaggugggaagugaaaaucaagagcccccagccuccagggcagcccccaaugguaaguuaaagacagccaaaccugggcuggguggguugggcaagggcucagaaaggccagguccagagccaggugcuuguuaacucuuggcuggaugcccuugagguucugagguuccugaccuggaccaagaagugcacaucccugcccagaaagcaaaugagaacaggagcugaaaucgcacuuugggaugaaaugcaggguccccagucacaagcuagugcuucuggcucugugggaagggguguaaaaccccaguguggucaggagacagcauauaccuacucagugcugguguggagagagcaaccagggggcagggcaaacagaacugaaugucaggggacagucgagcugauauccuccagaguauagagcaaaaacagacucuugucccuuguccuucagaaaggaggaccagaugcugagcauucugcuaggaaucaagggcagcugugcugaagagaaaaugcccaagcacccagugguguagacaaaauccccaggaccacagguuggaagagagcuagggcucuauagcaauggccaugucacaauuccgcaucugugaggacaggggccauauggucaaaguagcagaaagugauuugaacaucagcgugcguacaaguguggcagccccccaagcccccccccccccacacacacacagacagacacagacaaaucuguggcagaacauaaagaaaacugucagacugaacuagcuccaaaggagucagaccaaacuuucccucugucugcacggccauugcaggaauagggucugaccuuuacccagggacuuggugcacaggauuuaugaagaaaccaaauaaaaauacccaaauuguggugccuuaccucaagacuucuugacugacuccacuauaauagcccaggcugccuguuuacuuaacaaauugcccugcccccagaagacugaguuguguaguuuguuguuguuguuguuguuguuguugucuugguuuuuuuucuuuuuuuccagugaaauuucauggaaaagaguaaguguguguuucaucuugacuuuuucauaacaggugucauucuaguuuguucuuucaucaugaccgcugcugucuaccaugcccaguucuacucaacauauccccuccaguuaaucccuacacucuuuaaaaucccaucugggugugcacccuguuuucuucaaguccccaucuccagaggcucaccugggcucuuucacuuuccuggcuauuguucacagcacagccaacccauggaugcacaacuggguuuuuguucucugggcuuauagccccuugugaccaaugguggcaaaacugggccauaggcugguucuguuucuagccggugaagaaucacucuacucacucccaucauggcugggccaguucacacuaaacccagaagagucccacucucccugugaccuccuggagauguguugggcucugcuuccuucacagugacaagucugacuuggguuggacgaacugcagcgaguuuuguaugugauuuccucauagcugagagguugugcacugucccaaguguuuauuggccguuugaacacagugucucaucagcucugugugaccagacuaugggguccauggaauuucacaagccagcacguguaccugucacggcacccgaguccauccuguuuauauaagugacacugacuucucuaaugagaagcugcucaggauaggacaacaugaaaucaagagcaugacccuugugugccuugaggaggcaugacuuuccaucucucccugaguagcugguacacagauaggaaccucagcaucugcaaaaacccagcucucuggaccuaggaagagcuugugccagcagaggcagggggcaaggagcuaguagggcuuggggccuaacugucauccccuaguggucuaggaugggaugccugcagauagaggggacaggugaacugugccucaccaugucaggugucuauccaagguggagggcaaggaggaagacaugacaucuguguggggcuggaagauaggagaaaugucaugugacuacaaaagaggaguuucuauggcaggaacagcagacaaaugaucggggaaaccaacuggagggugucuccagggucagggcucaacaagaguccacucugccuuaguagauaugcccacugacuccauggacaucagcggcauggcuggagacauaggugcaggggaacauguccuaugucuacaaaucuguccugguaacuggucacaguaaugagaccaguacagugacuuggacaccagcuggagacugcccaaguccuuucucugcagccuccaugaaggugcuauauccauu

SEQ ID NO: 9671 - RNA, 792 nt, Mus musculus
gggugugucaagaugaagcugaacaucuccuuccucaccaucagcugucagaaacucauggagguggaugaugagcgcaagcuccgcaccuucuauaagaagcgcauggccacggaaguagccgcugaugcucuuggugaagaguggaaggguuaugugguccggaucagcagugggaaugacaagcaagguuuucccaugaagcaagguguucugacccauggcauagugugccugcuguugaguaaggggcauuccuguuacaaggagaacuggagagaggaagugcaagucuguucguggaugcaauguggacgcuaaucucaguguucucaacuugguuauuguaaagaaaggagagaaggauauuccuggacugacagauacuacugugccucgucgguugggaccuaaaagaucuaguagaauccgaaagcuuuuuaaucucuccaaagaagaugauguccgcuaguauguugucaggaagcccuuaaacaaagaagguaagaagcccaggaccaaagcaccuaagauucagcgucuuguuacuccauguguccugcaacacaaacgccgacguauugcucugaagaaacaaugcacuaagaagaacaaggaggaggcugcagaauaugcuaaacuguuggccaagagaaugaaggaagccaaagaaaagcuccaggaacauauugccaagagacauagacuguccucgcugagagcuucuacuucuaagucugaguccagucaaaaaugagucuuuaagugcaacaaauaaauaaugaccuugaa

SEQ ID NO: 9672 - RNA, 8666 nt, Mus musculus
cuuauugaauuccauagucaaauucucuuaggguuuuaauugcugaaaugaaacgucaugaccaaaacaacuugaguaggaaaggguuuauuuagcuuacacuuccacauuacugaucaucacugaaggaacucaggacaggaacucaagcaggacagguuccuggaggcaggagcugaugcagaggccauggagggguaaugcuuacugacuugcucaucaggaguugcucagucuccuuucuuuuagaacacaggaccccaagcccaggggugucagcacacgcaaugggcuggcucccuucaccaucaaucacuaauuaagaaaaugccagauagauaaacuugccugucuacuuuccaaucuuguggaaacauguucucgguugagguucucuccccuuagaugacuuuagcuuaugucaagguaacauagaacuaaacaugacauaagucuuagauuaucuuagucauuuccaucacccuuauguuuguguuuucuugggcauuucucaggcauuuauucuuacguucuuucuccuuaauuucauucagcuuuuucuuugcuucuucuuuaaauuccaugagcucuuugaugaagucuaugauuguucuuuuaaauucuguuuccugcaguucauuuagguaauucuuacugucaagcauuucuaccagacugguaaguuuuggagaggagguacaaguuguauauaucauauugcauucugugguuagguuuuggcauguaggcuucuuuuguuaauucugacugguauggacaaagcagauugggauacaagagaagauaugugggcaguccuguguuguacuguguccugccuuucuguugggggugucugggugcugccaauaugccacugggaggaggcaggauaaaguccaaaauggggagucugguccuggucuccacucuggguacucaggugccaccuauauaauaacaggaaagggagguccagaggggaagccaggaacaagccugcacuccagaaggagaggggaaggcagguacuaagcaaacagaaugggauaugauugggagcaauggccaaguguaccagaggggcuggaggggagaaagccuuuugggggaaggaauacacaggaagagaaacucauuagcugaaggcucagguagagagcuguuccacuccugacagucucagaucucugagaucccuggugucuaagcucacucaaccuuggcaguucuuaucccugucugguagguagcacagucccacaugcccuguagcuugagccuagaaguuagaaauggcuuauguggaauaaagucagguuaucaaagacugaagugguguauaugaugcacauucuugcuugaguaugggaguagaucugccugguugaaaggauuggauugggcaugagaggauauggugggucauagccagguaggguggauucuauaggaagccuagagauugguggcaauguaggcagggguggucagucuaagcaauagcacuggaugucggaccagggcuagaucuggagauuuaggggaggguucauggaggcagacccccuggaguaagauguucagcagauggcugaguggagcaguuggaucaagagaauuuaccuuaauggaaucuugaucucuuuucucuuuaagauacuacacucaguggggcagugguggcacaugccuuuaaccccagcacuuggcugaggcaggcagauuucugaguuugaggccagcuuggucuacagagugaguuccaggacagccagggcuacacagagaaacccuaucucaaaaaaaaaaaaaagacacuauacucauucauuacauugauggaauuauauugauggaaauugcuacaucuggcuccucccauaacuaagaaagagguacaacagccaguaggacaauuuaaauauucaaggaaaaauauucuuugcuugaauguguuacucuugccaauucauuaauugaccuaaaagugcuaguuuucaguagagcucagaauaggaguaugcuauggcacauggccaggauguuguggaugcugcuuugcaacuugggccauaugauacaaugggucaaaugguguuugcagagucaguguuagccauuccuuuuggagucuugagagguuccuaaauuguacaauauuuuaggauuuugcagcaaggucaugccaucaucuaaacuaaccuugagaaauaguuguugaccgacuagugaaccuuaaauaaucacaaacuaccaaguaacaugaagugaguuauaucugacccacugauucauaaaguuaagcuugauagaaaugcucuacuaucaaauagagcuggccccgaaggcacaagaagaaaaacaccaaaaacaccugagugaccaugguucucucucuuguuaggcugcccuauugcuccaacauucuuauuuuccaauuuacaggcagcaggcuguugaaccccccauaacaacaggaaucaacucgcaaaguaacucucauauaccaugagccccugcugguuucuuuguaaaacacuaauauauaggucucuuucuuuuuguauuauaagcauuuuuacguauaaaaguguggaaaacagccaggugguaguggcacaagccuuuaaucccagcacuugggaggcagagacaggcagauuucugaguucaaggccagccuagucuacaaagugaguuccaggacagccagggcuauacagagaaacccugucucgaaaaaacuaaaaaaaaaaaaaaaaaguguggaaacauacaauuauuuuaaguaugcauaugcauuuuucucagugcuaagauuauauuuauguuuuauggucuucccucuaacaauacacaauuaauuaucugagauuugcuuaccaaauaaaagaaaagggauuauucuaaauaaauuuucaaaguaugacuuauguuuuauccacugguauuacagcaaaaccaaaauuaauuuuaguaguugaaagccuugugcagaaaaugcauacauuuuuuagauaggaauaacacaggauauaagucaauacaauuuuaaaaguggaaauuagacugcaaaauaaauguuauuuaaaaugcauuguaauguuuuucuguuuguuauacaagcauuuuuguguaaaugauuagggaacaacuaaguaauaaaacaaaaauuaagcauuggaauuugaaauuaaugacaaauuaagaauaauaaaaucucugaaaauguagaagugaaacaugagucaaucuauauauacaacaaaauuugaaagaccauuugagugaugugaaaaaauacagacaugucagauauauauuacugacauuuccauauacugauaaugucuucauugaaucgauaaugugaaccagacagguggugguggcggcccauagcuuuaaucccagcacuuggcagagacagaggcagaggcagaggcagaggcagagaggcagagaggcagaggcagagaggcagagaggcagaggcagaggcagaggcagaggcagaggcagaggcagaggcagaggcagagaggcagagaggcagaggcagagaggcagaggcagagaggcagagaggcagagagagacagaggggcagaggcagaggggcagaggcagagaggcagagaggcagagaggcagagaggcagagaggcagagaggcagagaggcagagaggcagagaggcagagaggcagagaggcagagaggcagagaggcagagaggcagaggcagaggcagagaggcagagaggcagagaggcagagaggcagaggcagaggcagagguagaggcagagaggcagagaggcagagaggcagaggcagagaggcagagaggcagagaggcagagagagagacagagggacagaggcacaggggcagaggcacaggggcaaaggcagagaggcagaggcagagaggcagaggaagagagaauggaucucuguuggaggccagccuagacuacagaguaaguuccaggacagcuagagcuacacagagaaacccagucucaaaaaacaaacaaguaaaaaacaaacaaaaacaaaagauuguggaucaauguaaagauguaaagcaugguuugauaguuuacauacaaagaauauacuuauuauaguaagcaagaaaauauguauauauuuuuggaaauacauugccuagugcuaaggaucaaguuaaaagaaauugccaauauuuaucaucuauuaauagaagcauaugaaauuauagucacuauacaacagcaacacaaaacucuaaauuugucuauaagaaugguaagggaauaauacuaaaugagagaaaugaauaucuuagcauguuuuguuugaauaaaggaaauagaaacaaugggcaacauuaaaauucaucaaaaaaugaggccagauggaaaaaucaaggcaaucaaaauagguucuucgaaaagauaaagagguaaaucauuauacagggauauaaaaaucauugauuuuuacuuuugaaacuuuuucuauauauuuaaauaaauuuauuugaaucacaaggaaauguauuuuuuacaaaaugaaaguaaacaaaaaugaguuauaguuuucagagaaugauacuaguaaggacaguuucuaauaacugagggagaauuuggucagaaaaccagacauuuaucuaacauguuaauauaaacugauacagcuaggauagcacaguuaaagaaaguuaaaagauuuuacuuuucaauacaucuuuuagguauuuaucuuaagcaaacaacacaaggguauugcuggaaauuuucauauauauucagguguucuggggaaauguuagaaacuaccuuuaagucuaagguaauguaauacuuuaaaaaaauaugauaucccuauagaauuaguaaguuuuugaaagauuaaauggcuaaauguguauuauguguuuauauagaagaaacuucauauaauguguucaaacuauauagaaaauucauuaauagaauguauuaaggaugauuuagaauuugcuuuaaaauguacauaaaugcuuacuuuaaagcaguugguuguauuuaauauucauggcacuuuuugagaaagcaaucuacuagaaaauaaaaguauccacaagccuaaucacuuugccaugacuugaaaauacaugagaaaagaaauaggaacuauuuuauauguucacauaaaauaaguucacauguuuauaggcauauauuuuauggcaagagcauuggacaaaagacauuaauguauauaaggcaauuaaauaucccuauaaguacuacaaauacauacaaguacuuuccucauaauauugaccauacugggacacccaaaacuauaaacauauaaaaauauaacaagaguaaaguuacuaaaauuauaccucauccauaaaauggaaaauuaaaaauauauguguauacuugauauuuggaaauauaaaauacucagauaguaaaaauaccucaaaaugagacauauauuuaaucuuaugcuuuuggagauaacugcuuguuuuauauacauguuccacauguuucaaauacgauuuuuguuuuuuaaugaggaugcuuuagauacuucuauuaauuuaauaaagauacauaauuuaaauggauaaaaacaaaaugucugacugaucugaaauauucugcaagugugcacaaaugaaucucauacacacuccagaaaucauacuacauuucgaaggcuucuggcucucacaugauccugagaggagaaugcaacuaucuuaauaaaugggcccucacuaugaaaaaaaaagaccuccuauuacauuucaauuuuauguuggacaauauuugauauggaaaaauaucauaagcauaaggaaaguuccuuaagguuucaaucugaagagaacuaauguagauggggguaggaggaaaucaaacaaauccagaaaaguggacugaguaaaaacauccuaaauauuccugauuccaugugaacuaguaccgcagaagcaugcauucacccagagcaccagaaguuagcucacucagacacuggaacagcaaaaauucacaaucaauauuuuaaaagaauauuuaaugacaaugaaaggaaguucaagaauaucuauacaucuaugucucuauaaucuauauuauauuuuaugcaugaaaaagcagauauugaaauuuuauauauauuaaauacacacauauaucacaugaaaaacacugggcacauagagaugaguacaguuggagaaggcaugggagucauuaggauugauugcugauagcauucuagcauuccauuucuucuguuaaaucaucugcuuagugauuuuguuuuuuccugcaacauagcugauuuauuuuuauggcaagagggaaaaggacagaaagcaggaaugcaggaaaggggugguaaacagcauucaauuccagugaaauaaccacaacagugaagaugccauuugcagcucaugagauugacugcacgcgcuugcgcacacacgcauacagagacauacacacaagcagagagagagagagagacagagacagagagggagagagaaagaggagaggagaggagaggagaggagaggagaggagaggagaggagaggagaggagaggagaggagaggagaggagaggagaggagaggagaggagaggagaaagagagagagagaguuagagcggaccaugaggcugugcaggagacaugagcauacccauuuuuuuucuuuuuacuagcugcacuggcuggcuggcacaaauacaaacugguacaaugcuuaugaaagggagccuuuuggaaacacacagggaaagucuuugaagugucuauauguggauccugcaaguccacaguuaaggagagagcauccaggaugcuagccuagauuuggcuugacaaggaaggauucacuccucagggcacacaguguugguuuuaaacacagggaaagaacuaggcaccaccugaauguccaacaaugcaggaaugauuacagaaauguuaagguccauggauagauacacaggagcacucugcaggcacugaagaugacggucuuaucauaagccuguugaauagcauggaaagaaguucaacgcguugauuucuguuugguuuuagucgcugaaaaaagcagguuaagaaacaccacauacaugaaccacucuacaagaauguuaauagggaaggugggucuggggugagaggcagagagaaggggagcagagagccuggaaaaacagcacaccaaagaagauaaaagggcuucucucuggguauuaggauggugggaagcaauuagacucuugcuucuuucucccacaucagacuuccuucuccuuccagacauuucuaccaugaauugcaucaccugugcaguaaacaaagagacagaaaaaaaugcuuuuaagaaucagaccgaccaccaccgggagaagaggcagccuuuaaccucuccaauggcacagauuagugggauuauccucuacaaggggcccuugcugggguuggggagaaagggagggaaggagagggcauuagaagagaggggcugagagcagagaggggauggggaagcuagcuagcuagcucugagguuggggggggugggggagaggagaggggagggaagagagagggagagagggcaagagagggagggaaggaaagaggaaaagaggagcggggaggggugaagggggagaggaaggagaaggaugaggggaagagagggagggggaagaggggggagagagaaaccugcacucccaauacaauacacugcugguggguugggggguggggggcuguaaacggggugggagccaagauguggcucuacuggcuggguccugggaagucuucaucgaaagguggccucgucaucggagucgucgucgaaauccuugaagucagcgcugguggacuggcgcgcccaggcuccccuuucggccucucucuccuugugggacuugaaucuccccacgaaaaucuugcgguaguucaggaacaugccauucagcgcaucuauggcccgcucggccgacuccugcuucuggaagugcacgaacccauagcccuugggccccuuuucgucacaggccaccuugcaggacaggauguugccaaaggccgagaagauguuguacagcgccuuguugucgauggucuugcccagguucuugaugaagacguugcccaccccgcucuugcggagcgacgggucccucugggaccacaugaugcgcacuggccggccauugauaacgucaaaguucauggucuccagggcccgcuuggcguccaccgguugcugguaguugacauaugcguagcccagagagcgccgggugaccuugucccugcagaugcggauggacaggaugggcccggcagggcugaacuucucauacagcauggacucggucaccucggggugcaggucgcccacguacagcgaggccgugggaaagucuggguucccaucguccgagcccccggccgccgccucuuccuccucugcagccaaggcugcugccagcucuucguccauauccacccucccauaggaaggcgacgcagccgccuccgccaggcuggccuccucaaggcuggccuccgccaggcuggccuccguggcugccaccgccgcggccgcg

SEQ ID NO: 9673 - RNA, 4020 nt, Mus musculus
aauggauauagcaccuucauggaggcugcagagaaaggacuugggcagucuccagcugguguccaagucacuguacuggucucauuacugugaccaguuaccaggacagauuuguagacauaggacauguuccccugcaccuaugucuccagccaugccgcugauguccauggagucagugggcauaucuacuaaggcagaguggacucuuguugagcccugacccuggagacacccuccaguugguuuccccgaucauuugucugcuguuccugccauagaaacuccucuuuuguagucacaugacauuucuccuaucuuccagccccacacagaugucaugucuuccuccuugcccuccaccuuggauagacaccugacauggugaggcacaguucaccuguccccucuaucugcaggcaucccauccuagaccacuaggggaugacaguuaggccccaagcccuacuagcuccuugcccccugccucugcuggcacaagcucuuccuagguccagagagcuggguuuuugcagaugcugagguuccuaucuguguaccagcuacucagggagagauggaaagucaugccuccucaaggcacacaagggucaugcucuugauuucauguuguccuauccugagcagcuucucauuagagaagucagugucacuuauauaaacaggauggacucgggugccgugacagguacacgugcuggcuugugaaauuccauggaccccauagucuggucacacagagcugaugagacacuguguucaaacggccaauaaacacuugggacagugcacaaccucucagcuaugaggaaaucacauacaaaacucgcugcaguucguccaacccaagucagacuugucacugugaaggaagcagagcccaacacaucuccaggaggucacagggagagugggacucuucuggguuuagugugaacuggcccagccaugaugggagugaguagagugauucuucaccggcuagaaacagaaccagccuauggcccaguuuugccaccauuggucacaaggggcuauaagcccagagaacaaaaacccaguugugcauccauggguuggcugugcugugaacaauagccaggaaagugaaagagcccaggugagccucuggagauggggacuugaagaaaacagggugcacacccagaugggauuuuaaagaguguagggauuaacuggaggggauauguugaguagaacugggcaugguagacagcagcggucaugaugaaagaacaaacuagaaugacaccuguuaugaaaaagucaagaugaaacacacacuuacucuuuuccaugaaauuucacuggaaaaaaagaaaaaaaaccaagacaacaacaacaacaacaacaacaaacuacacaacucagucuucugggggcagggcaauuuguuaaguaaacaggcagccugggcuauuauaguggagucagucaagaagucuugagguaaggcaccacaauuuggguauuuuuauuugguuucuucauaaauccugugcaccaagucccuggguaaaggucagacccuauuccugcaauggccgugcagacagagggaaaguuuggucugacuccuuuggagcuaguucagucugacaguuuucuuuauguucugccacagauuugucugugucugucugugugugugugugugugggggcuuggggggcugccacacuuguacgcacgcugauguucaaaucacuuucugcuacuuugaccauauggccccuguccucacagaugcggaauugugacauggccauugcuauagagcccuagcucucuuccaaccugugguccuggggauuuugucuacaccacugggugcuugggcauuuucucuucagcacagcugcccuugauuccuagcagaaugcucagcaucugguccuccuuucugaaggacaagggacaagagucuguuuuugcucuauacucuggaggauaucagcucgacuguccccugacauucaguucuguuugcccugcccccugguugcucucuccacaccagcacugaguagguauaugcugucuccugaccacacugggguuuuacaccccuucccacagagccagaagcacuagcuugugacuggggacccugcauuucaucccaaagugcgauuucagcuccuguucucauuugcuuucugggcagggaugugcacuucuugguccaggucaggaaccucagaaccucaagggcauccagccaagaguuaacaagcaccuggcucuggaccuggccuuucugagcccuugcccaacccacccagcccagguuuggcugucuuuaacuuaccauugggggcugcccuggaggcugggggcucuugauuuucacuucccaccuggcagugggaguugaggcuguguagaacccuagguuuacagcagccccugugcuguggcagagucuuggagaggcugaggauggagugggguucaguuugcaguagagguucucugcuccucagagaagcucaaaggcagcccaccuuccucugucuuccagaccugugcauccacagggccuagcccaggcuguauguacaguacuugugggagggccuuaugaaugagcaagcauucuuuauucucuccuccagaaguguuacuggggggagaggaggggcaggcgagcaggaagggggagcaggcucacaaaauggcucagcagguugcuuagggagcugggaagacuccugcuuuccuggguggcagugguggugguggaggcagggaugugcugugugugugugugugugugugugugugugugugugugugugugugugugacagagagugagacagagacagagacacagacauagagaauuagauugacagcaaugcucuagugccucugccaguuugagagacagaggcagcgcaguggacacacagaaacauacagaaugagagaguguggcaggggagggagagagagcaugcucuuguuccacugugagugugugugugugucacagagagagcaugcucaugcuguucuagcuucugugugugugugugugugugugugugugugugugugugugugucugugucugugugucugugugugucuuucccgcgggaagccccccuuccucuggaugcuggaacacugcuucuaggcuccuucaggcagggcuagccuaucuucaaggccaccccacccacuguagcucacuugcaagguucccacuggaaucacggcaagcuucccuuaugggggaagggacagagcccccaccccucucgccggcccaagacacagaacccgaagcccucccuccgguccagcgcacagccgggucccuggcaccgucuuccccagcgcgugggcgccccagaggcugcgcacugguaccccaacccgggcucagcccgcccccgcgcugccugcccgcagccccgcagccccgcagccccgcagcagccacagggggaaccaaagagacagaagccuucccagcugcccggaccacagacgccaacaccccccgccccccaccccacgccgcccucgcgcccgcgccccgcacgccagcagcccacgaccgagcggcggcggcggcaggggcaggggcaggggcaggcugcgggcugcggagacggagucggcucugcgcgcuagcagccggcgcucgccaccccgggugacucgcucgcuccgccacagcggggucccuguccgcggccgccgcgcgagcccccggcccgcguuccggcacccaccggcccucgccgccucuccgcccccucaguucccgggaagggaggucgcggcagcggcccggcggcagcggugaccguggcguccgcggcggcaguggcggcggaggucgccgcagcggcggcggcagcggcggcggcggcagcggcggaggcggccgcggcgaccguggcggaggcgguggcggaggccuccguggcggaggcggaagcagagguggaggcugag

SEQ ID NO: 9674 - RNA, 8678 nt, Mus musculus
cucuuucuucaauuucuucucuccucaugggaucagcuuaaauggaggggaugaaaaugaugauuuuuuacuuggucauaaucugcguacuuacauaauuccaagaucaguguuauuuuucucaggagaugcacuugaaucucagcaggaggguguaguuagggaaguuaaugacgaaauauaugacaaaauuauuuaugaugauuggauggcugcaauugaagagguuaaagccuguugcaaaaaucuugaggcauuaguagaagauauugaucguuaaaacagaguagaugcuuuugaaacuaacugcucuacaugcaguuacugaagacauaagcaguuaauauugucuuguguucugcauuuuuuccugucaugccaguuuaaaaauucaaauacuaauuaaucugaccuugcauuguagugguaugauguuuucaagacauguagacugugauaaaugauuaagacauuaauagucuguaguauaacccuucugaaguccuugugccauguaucuauuaaucuguggcugugaauauuauuagaagugcuaaaugagauuauuuguuugcaaagaaaauauuggaaaccuaccuaagagugcuuugcuauuuucccccuuauccucuuagugcuuuggccaauugacuuuauugugccugcuucauuuugcaguaaauaugcaguagaauuuaaaacuugaaugccuaagaggccugcauaugauugagaauuucaggcaaaaucauauuuauuauugauaacagcuagugcaaggcuucugauuguaugugacugugauaaauaauaaaacucaauuguauugaaguuacuguuuaucauugacaugugaguuacaguauuuucaaauguugcaaauauuguccuguguaauuguguaaacugugauuacaguguacauuuuuuucauaauauacugaaucauucauugaaauggacacuuuaccauuucugaaaauacauuucauauucuguucauucacugaaaaauaaaaugaauaaaaauuucaugguguuaaauguuuuaaaaaagaacuuuuaaacuauaaaggcaguauguucauuggaagacauauuuaaaauauuaaaaauauucauuaauuaaaaucagaagacauauucaccaaagaugaacacuuuuaauauuuugauuuguuuucuacaaauuauuuuucuguaaguuauucuuauguguuuauacuuguaugcagaucuacuaacacugucuaacaugcauauuccaaaauuauuuauaacugaucuaauuuuaauuuucagauugaguuacagggaaacaaauauccaguaaauuaauuucuacuuuauaaugcaauguuaauacucuuuacaaauaacagauuccuaugugcuauccuauauuuuaaauuucuuaucuuucuacaguguuauuuguauauauccccuuaugacacuggggggcagcacugacuggggacaguggaauaagcugcucacacuguccagagaugaguuugcuuuguucuuugaggacaaucagauguccccccaaaaggccuuuccuuuugacaaacucuaugaagaauuacaccuaucuuccuaggauaagagaccuucuuggucacuuuugugucacauagacacugugaguggcaaggaaaugcucacucugcuuuguuauugcugccuaccuacauacacuuccaucccaaauguuugugaagugaucucacugaacuauaacccaaguggaacaaaagcuuugcuguaacuuauucuucuacuauccacuauugaauaugcuugcuucuuuauauugugguccagagagguaaguuucuagcacugccuauuuuucuuacuucuguccaguaaaacugggaaagaaaauaaaagcuuuaccuuuucuauuccuuucuaggcaggaccuuuaaagccaagaucuucucccagaucaaguagauguucuggugcuuugcuuuugaauugcaguaaguggaagaaguauauagggaaacaggcaacuuacuaaagaaccaagcgauucugccagugugcaucccguaaauacagagagcugcauacuuuuccacaaugauuaauauugaccuuugaaauuuacuacuacccugaaacucaccccacagauacugguuucuuuuauuugugauacuguuacugugcacuaaaauaaacaaacaaacaaaaaacccaggaacauaaaaaauacuuuuaaagcuugcagugggggcauucuccuguaauuccagcacugggaagguggauaucugcagguggaucaggaguucaaggccagcuuuagcuauauaaggcauuuaccaacagcuugggcuaugugagacacuuguaaaaaccaacaaacaaacaugaggaaugugggugacucuccugauguuuugcagagaaugccuagugccuagcagcuuccuauggccuuuucgguugucccuaugugcuagaaugguuaaugugcuucgucuggauuuacccugauagcaggccaggaccccauugcuacaacuuuuauguuaggguccucuuucaaagguauguaaggaaugcaccuaggguuuaucaaggcuucuucaguucucacugcagagacagauaauacauaccacagagaauagaaugaauccauaaguguuagaacacaauggagacuuuggucuuuguaugcuuugguggaauauuuaaagaaguaggggguuguuguagauuggauacuggcaaaaguaggaaccauuuauuaguacuagcucaauaaacauuaaucaugguauaucuuggaaaacuagaaaagugauaaagcuguauuugguaaaauaguuguagccuggcuggcuauauugcucagcagggaaaggcgccugacacugagccugauuaccuguguuugauucucagaaccuacauaggcagggagauaaugcacucuugcaaguugugcucugaccuccacagaugcaugugugugcacaauguaaaaagaaaaaagaugcacacauuuuagcuucuguauuggaguauuugauauuaagaagaguuacauaguagucuuuuauuuuggaccuucuuagauaaauuaaguggacuagcuuugccucauuuuaauacauuucccaaguaaccuuauauaagguuauuauuauauaaaaugaauuaugcccaacaagagacuaacacggccuaccuguaugaaccagcucagauucucgauaucagggauugcuuuucauuuucccuuugcuuucaucuuuaucccaggaaacaguuugaggcucuaauuacuccccuagguugauuuaucuuuaguguuagggucuuuuaggucuugagguuagucuaucaaucucaggccaccacauaguccuguacuagaguuuaggucccaacuauguuaaaaauaaugauuuggaggcagaagagauggcucaucaaguaacacuguugcagaggacccagguucuguucccaacccccaugucaggcaauucucagcugucuccaguuucaggggaucuggcauccucaucugauuuccaugggcaccugcacuuauacauacccacacauagacacaaauuauauauauuguauauauauaauuucacuuuaauucuuuuuauacuuucauuuaucuauuuacccucuuuacauccugaucacagccccccucuucucucagucucaccucacaccuccuccacaccuccucccccauucccuccuccccuucucuagucacagcaggacuaaauguauccucucccacugaggcuagucaaggcagcccagcuaggggaaggggauccaaaggcaguaaacagaguccugauccaauuguuaggggaacuacaugaagaccaagcugcacaccaaaaaagaaaaaaaacccaaggguggauccuugaaucucacucagaaggggacauaaaauagacauuggaagugaugagggagggaacuggaugggagaagaggugaggaggggaacgggguggggggugggguucaaguguggggagaacaggaugggggugagagggcugggagagagaacagaaauugagagggcaucucuggaacaagccaaagaccuauacuugcauuuuuaaaauaaauuauucaugugauuuuggacucuagaagguuauuugagguaacugcuagaaaagacuucugagaauuuuuaucuuccuagggaauagccugaaacacacacacacacacacacacacacacacacacacacacacacacacacacacacaaauucccuuuuaaauacaugauaauaaaaaaauaagguauuugguauuauauauuagagggacuagucuuuaggaccaggcuaucugaauuccaaucccaaccccuguaacaauguauaauuuugacuauaaauacuauacgaaucuaucuuugcuauuuuauuaauauucauauuugugaaagauucaaaacuacacauuauuaaauuacuaauuaauaacaauuauuacccuaauuacuuuccaauguaaaugaagugacaguuuacacuuuauauuucaagaagucuccaagauauuugaucugcaaauacuaagauagucaaguugaguagcaguacuuuaauuauucacaagaucaguauauauuaguuacuuuucuguuguugagacaauacgccacauucugaagcaauuuaugaaacauaaagguggauaugauucuaucauggugggguaccacagaagcaaauagcagacaugacagcagaaacagaaagugaagggauuacauauucaacugcaaacaguaagcagagagauauaacuggaagugaaacuaugcuauaaacuuugcaggccccuucuaauaauuuccuuccuucaggagggcuacacuucccuauaacugcccaaaacacggccaccaauuggggaccagguuuucaaauaccugagucuauggaggacauuucucauucaaaccaccacaccuggcucauaaaaaggaucauaaagucaguuacuauugagguauuuccacauugccaaguauauucauaguuuuugauuuguguauacuaagcccaguauuuauuugaggccuuuuguucagugacuucugugguuugaauaagaauggucccaauaggcucacauauuugaaugcuucgucaucagggaguggcacuacuugugaagaauuaggaguauucuguccuucugggaguauauguggucuuguuagaggaagugugucccuggguugagguuucaaaggcccaagccagguccaguuucucacuuuuccuguugcuugcagauccagauaaggaacucucagcuauuucuucagcaucacggcugcccacaugccaccaugcuucccaccaugaugauaauggauuaaaccccugacacuauaagcaagucccaguuacaugcuuucuuuuguaagaguugccuuggucauggugucucuucacagcaguaaaagagugacuaagacagugacuaacaaauauaucaugaaucugauuuuaaauaugugguaaccagagacaaauagaauagagaaaguaaaaauuaugugaaauuauaugcaaucuauagguauauaacauuuaagcuuucaguuagcauauaaauauguaugauaugagguaugcuauuuauaaaacagaaaauauuuuaaaaagaaacagaacauaucugugagauauauuuucuucagauuacuugcccaaugacacauuuuaaaacuagaaaggaauguuuaaaugaagcaguuucugucugccauuuaaaauaaacacuauuaauuaucugcugguuuaucuauucuauguguucaaagacaauaaaaaugaaauucaagccgacuauauguaaccuacuuccuccauagucuucuugcucauauacugucacacccccacugacucugcauguguggguuuuugugugucugcccauuucucugugugugcacagauacagcugagguggaucaugaaguacaauaagaaugugugaggaagggcauggccauucuccauaaaggaucccaggcuucuauggcuuugcuguuuuaggaauaugaagacuaguugagccuaacuuuuggucuuugacagugaaggcauggaagcaugucuucgagauacuccauugaguggugugggagcacaugcaugcaagccaaaaggaaugggugaagcaucacuguucaggcccauggcuuuaugaacucaugauuuauguguaaggauacauguggucugugguuggugagaaacaaagauaguccugguguaagcaggugccuuaagugccuuugcagaaguugggaaauguuuacauguuuuuuuuccacuuugaagucuaaauucuucucuugugcccaccuaagugaucauagguaguguaaagaaagauugaugaucauuuuuuuuggcuuuuuuggcuaagcugaaguagaaaaguucagguggcaaucuagagggaaacaacaacuuaaguggagugucuuaggaaugggcaaugagggaggcuuucgaguaguuuagcuuugauguaacuaaggucuuaaguacccacagaauaaguauucuucugaugaaugaaauaugauugugccuuggucuuaggacagaauggaagcucaggugugcagcacgaaugugcauauacagaagaaaugguacauaaaaaggguuacugcuugugacaccgguagagcacguccauguaguccuccuauagauacauuuagaagacuagauaguacaugauuauuacauaaucugcagggcacaaaacauauuccaauacuaauuuuguguuuuugaagaaacugaggucacuuuuccuguuuucuuagagcucugucaaaagcacucagaauucuccuugugcgauuucacucuuguacuguguuuugacaacaguuuguaacugagggaauucagggcgggaacucaaucaagagcugaagaacuggcucaccuucuggauuguacucuggaucaugauuagcuaggcuucuuacaugauccaggccuacuugccuaggggguggugcugccaacuguggguuggccucucucacaucagucacuggccaagaugcucaaccugaugcauucaacuccgcagcugagaugccauuagaggacucuauagacuguuucagcugacagcugcagauacuaccuaggacuccuugucacuugucaaccugacacaaaaacacggccuuucaauuguuguuuccaagaucucucguaaagaucaaaauauaaaacacaauucaauuuuuagauuugaauuuuaugcuuaagcuuuugacuugcauuuaugccuaugucccacaugcaugcucaagugugacgguugugaaccacuaugugggugcugggaacugaucccagguccucuggaagaacaagugcucuugacaccuaagccaucccccuagucuccaacaggccaaauuuuauaaguuccacaaucuaaaaauuuuaauauuuuaaaaguccaaggucuguuuaaauauccaaagucucuuaauuguggaauacuguaaaauaaaaacaagauguuacagaauuuauuauuacaaaauggaaaaaaaaucaguguguaguuacaacgacgucaaagcaacucucaaaauccaguagugucaaucaaauacuuuacuucaguaucucauaucuggaaaucacucauggucaucugggcuccaagucacuacaguuacuugugcucugcuaucugcagcacauauaacuuguuucaaacauaaguucagguuggcucuauuccacacuccccccaccccacccccaccauccuggugagcaacccauguuccuggcaucuccaauauccugggaucucuuuacuguuaacugaugcuucacuucaccaguggucacucaggaugucucuacggugauuccaacucugccacaaagugccaagccucugcuguucucuaugacuccuucaugccuucaaaaccaauacaauauggugaccuuacccauuauuugccaaauuuucuguugguuuguuguauaccccaucucccuuaugcugacccugagaaaauacugcucagauuucaucuuaacgaugcugaccuccuaccaaccacagcugauucuuacucaaauggcccugcugaaagagucauugcuuccuuuugaaaaauuucaaaacaggcuugccuaauaagaguguuaagagaaaugcagauuauggaggccugguuuaaaaacaacucugaguacuuaccagcuuuucgacuucaaaguucugaaacguuccacaaucuuccccauugaacaacauggucauguccacuauggcaacacuacacucccaggaacaauuucuguucuaguuucauucuguugcugugauaaaccacucauacaaaagggaaccuacagaaaggaagcuuaagcuuacaagaacaagucugucaacagaggaugucaggacagcagcucaagcaaaaauugaggcagaaacuaugaaaguacacuguucacugacucacucucugaacugcauucuagcuuaguccuuaauucaugcucagguagacuuuauacaucccaugaccaccugacuagaugaugccaccca

SEQ ID NO: 9675 - RNA, 1024 nt, Mus musculus
cauggcggccuggcgguuaaguuugugcgcucgcagccuuuccgcaauucgacggcuccaggcugccccacuuugcuggaaauccagcuccuccagggcuguggucgcccaguccgcugcggcccaaaaggagcaggaagaaccgaccgugcaguggauggaggacccaaggacgaaaacguguacuugaagaacccagacuuccacaugguuacgacgacuacccgaagguggaugccuugaauaugcacgcagucuucuucuuugguuuuuccaucgcccugguccuuggcacuaccuuuguggcuuaugugccaaacuauaagaugaucgagugggcccgccgggaagcugcgaugcuggugaaacaccaagaggccaguggccuccccaucauggaguccaacuauuuugaccccaccaagaucaaccugcuggaggacgacugaguggggcuuaagcagcacuacccugcccguuuuccugcucacuccccagagaaucuacccaagggauugaaagaagaaaagaguguuacuccagcuagaucugucaauuauuuggccaaaggaccauaccucaggagcacugauugaccuaaaauauacuaaagagaugggaggaacaauuaucuccuuaaugagagaauguauuuuccuuggccgaaacucugucuuggcucuagucaccuguggggccuccaccuuguggucugcucacuuccuggaguccuaaguuccaaaacgcaucuguuucuuuuccccaucuuuugaauacuugccaaugucugggcucccuccccaccccccauugauguacugggcucucuugcuuuauuuguaucccccucuucugcuucugccaugaggcugcuuaggagccuccauuacuaaacuucauaucuaacccaagaaggcguggcuuucuccauauuucuucuggaaucggccuggauuuucagguugccugcccugcuauguuucuuuuaaacucuaauaaaaugguucuuaagccucaaaaaaaa

SEQ ID NO: 9676 - RNA, 1024 nt, Mus musculus
uuuuuuuugaggcuuaagaaccauuuuauuagaguuuaaaagaaacauagcagggcaggcaaccugaaaauccaggccgauuccagaagaaauauggagaaagccacgccuucuuggguuagauaugaaguuuaguaauggaggcuccuaagcagccucauggcagaagcagaagagggggauacaaauaaagcaagagagcccaguacaucaaugggggguggggagggagcccagacauuggcaaguauucaaaagauggggaaaagaaacagaugcguuuuggaacuuaggacuccaggaagugagcagaccacaagguggaggccccacaggugacuagagccaagacagaguuucggccaaggaaaauacauucucucauuaaggagauaauuguuccucccaucucuuuaguauauuuuaggucaaucagugcuccugagguaugguccuuuggccaaauaauugacagaucuagcuggaguaacacucuuuucuucuuucaaucccuuggguagauucucuggggagugagcaggaaaacgggcaggguagugcugcuuaagccccacucagucguccuccagcagguugaucuugguggggucaaaauaguuggacuccaugauggggaggccacuggccucuugguguuucaccagcaucgcagcuucccggcgggcccacucgaucaucuuauaguuuggcacauaagccacaaagguagugccaaggaccagggcgauggaaaaaccaaagaagaagacugcgugcauauucaaggcauccaccuucggguagucgucguaaccauguggaagucuggguucuucaaguacacguuuucguccuuggguccuccauccacugcacggucgguucuuccugcuccuuuugggccgcagcggacugggcgaccacagcccuggaggagcuggauuuccagcaaaguggggcagccuggagccgucgaauugcggaaaggcugcgagcgcacaaacuuaaccgccaggccgccaug

SEQ ID NO: 9677 - RNA, 3745 nt, Mus musculus
aggaaaggaaaggaaaggaaaggaaaggaaaggaaaggaaaggaaaggaaguuaguuuuuguuacuucucauuugauccaagauuaugguuuaauaaauugauccaauuggucaauuuaaagcuuauguaaaaggccaguagcaucuauauuauuaauaaaaauaagggcaaaugucacuugcccuugucucagacauguccucuacuuguuucccacauuaccccauguuaauuuaggaaaaagauuauuguaacuuuagaaauagaugggaaagugccuugucuuuuucaaagauaacgugguauguagaaggaagcagaauaaaugaauuaauaaugauuagaaaugcuucuuuucaaguaggcaugauagcacuagguuauuauauuucucuuauuuaaauccauuuacuuaucuucuaauaauguuguauauuaaugacaaaauaucacagaauagaccaggcacuuaaaaauugguaugauuuuaaugcuaauaagcauagaauuuaacacaguucuggaaggacugucuuugauugaagacccuaccaaaacucacuuaagaauuaaauaucccaagccaggcagugguggcgcaagccuuuaaucccagcacuugggaggcaaaggcaggcagaucucugaguuugaggccagccuggucuacacagugaguuccaggacagccagggcuacacagagaaacccugucucgaaaaaccaaaauaauaauaauaauaauaauaauaauuccccauuuuuuauauuaacaugaccuguaaacauuaauaucucagaaauuaaacuguauuugugcccagcauugccauuuuuaaugagaauuauuguugccuuugauaacuuuaggagagcucaauaccauuuguaagccuaacaacaauuagguauuuucaaauguggugagaccuuuacaaauccuuagcaccuucauuuuugcuuacagauaagcugccacuuaaaaauaaaccauuacuugaacacaaagaccccaaacaauauuuuauuugaguuuacuguauguccuaagcaaauacagaauuuacacucaucugauucauuggacuaacuucacauaguggaaauacuuuuuccuaaauugacuggaaguauucaauucauugaaauuaaguccaauuauacuuauaauuggacuuaagucugcuucuuuaaaaaaaaaaaggucuauuuuacaacuaucaaaucauucagguucccuugaguggugaacuguugggaaauuuuucgugguaaagaauaaguuuauuaauacuuguucauauacuuugugagcuaaaaauaauagaaggguaucuauaaguauauccuuccaugugugaguguguauguauauauauguguguguguguauauauguauguauguauguguauaauucuuaucuugcuccagcuuuuccacucaccugauucugagccagccuuuuuauuuugaugauggcaaccugagaauauguuccauuuucugugaauuuugucaaagucagacuuaaugaagaaacuaucuaauauuguggccccaggcaaguggucuaaauuaugugucaguguuuuccucuguaaaaguagaggguugaaccuugagcuagacaggaaaugagagguuaguuaccauucugugguucugagaagccacagaagaucuuugcugugcagugugugaaaaugguuauucucggaucugcacuugguggaaacucacagugccuugcacacaguuugaguucaguuugcuggcuggcugcuaguugauguguguuagugaaaacacacucaaagaacccaaugccugguagaccuuauucccucugugcugauaaaagugaauguaguuucccuaggaaggaggggcugggaucucuguuugccauguggaaucugacuacgcaguugguaucaggugugacauugguauccgcuuagacugugugaagaguugcaggcucaauuucacaucuccuucagugucucaccaaguucccugcucaccaaaaggaucuauccgaacggacuuagaaaauucgguggaaaggaaaauggcaugaaaguucaaacccaagucacuucugguuucauuccuagcucugcugcuuaauuccucuguaccucauguccucauugcugaaguggggacaauauucuggaccuaccucacaggggaauugagggucuuuuucaugugucugugugcuuagaagcugacuaaaagaaauauuggauagcaugauuauauaauuucuacguagaugugacuuucagucugcauuauguuuucuuucucaguaacauccuacagaguguucugacucaauuuuuuucccaagucauuuuuguugcuaaugcccuauuuguuaaacaugagugauuguacuauauuaauacuugauuuagggaggaaagcagguggguguaaacuaguggcccucagguuagaguagaugaaaaauagcaguggaaaguagccuugagccuuucucaagaaucauuaauucacauaacacuaaaggccacacacugaccuaucacauuccuucuacaccagccaaacaacacauggaaucaccaugcauuuugcucauguucuuuccuguucugucuauugacaugcuuacugacacugauuaaaagcugugaauggaagugugcuuguaauuaauagaaaugagaaagcuguccuuaaguguacuuuaauauauacuugaaaauggggaaggaauuuagagauccauauaaugaaaauguuaggagccacuuuuaagaagaacuaaaauuauuuggccucucaacacauuguguccuaguccugaaugauugggggcaagggggagagagagagagagagagagagagagagagaaaauaaaugagaauugacuagauuaagcuauaaauucagauuauaauuugccuucaguuuugguuugucucuggacucuagaacugaacugauucagugggguguguccaugcacacacacacacaggauugcaaauguacaggauugcaguguucuggugucauguucuagcauuagucuaaguaacaguuucucagcaucugaaaguaguucuauguguaaagccuguaugguaaucaaggcaauaaguucucaaaugguccuuuuacuccugcuucuuugauuugcuuuuaucuuggcauaguuuuccugcuuuucuguuuuuauuguaagcaaauaguugaaaauuguucuaaugccaggacuuuggaacaaguuacaaauguuugaaauuauauaaucuacaagcuaguuugcuguccuuggacuaauuauauauaagugugaauuucuacugcaaggacauccagauagagcuggcguuguucuaaagauuggauugaaaaaugaaacaacuucuccauuuuggccaaggauuccuguuggaacagcuuucccagaagagaaucauaguggcuaugucugucgaaccaagaacauucaugcaucuuguaguguuauguagccuguggaaugaauuccucuucccccuggaguccaggacugacucuccuggaagaacucaaccuauauacagcugugccaaaagaaggcuaccugccucugaaacucccacugcugcuucugucguuguucacuugucagauacaauuuuauucucaggaugcaaauuccaauaaaguacaaacccaugguacugaguugaaccguguggcuuuggggca

SEQ ID NO: 9678 - RNA, 70493 nt, Mus musculus
auggagguguuuuuuagaaaaauauuuauuuaaugugaguacacugucggucacuguucagauacaucagaagagguuagauaucggaucccacuacagaugacugugagccacuacgaaguuguugagaauugaacucaggcccucuggaagagcagucagcacuccuaaccacugagcuaucucuccagcccaggaacugaguuuuagcacauaucccuucaugcuuucuugugauaagacuaaaaaguguccccgaaaccugacauaccuugauguacacggugugagaaagaaugaugagguuugcaagaauugggacuaaguaaaacacagagacuaaauuuaacucuuuaauuugaugauucucucuagcauccccacaaaaaugauacacuggcuugcauaaucugugaccaguaccucgcaaguucuaaauucucuuuguacagcucauuuagaaguucucguuuauacaaagccauauccaucguggagccaggugcucuuagcugugaagagcccuuccuugggucuuuuuucccuaauauguccuaugugacuucucacuggugaugcuuuuggugugcuuguuacucugauccugaucgcucugucaacuaaaguuagacaaaguaaccuuuacuucucaauucagauaggaauccuuuugcacuccaaguuuggcuucagaugccuuggaaagauucaugcugccaccugcugguuuauucagucugugugcaucauuuauuuacuuguuaauuuguuuuucuuuuguugaaacaguuuauuuuguagcagauauuuuuccaucccuaccugaaccaccucaauaguaagauuagugaauugcuggcacuuugaucguccauaagcaaaccaauuuuguguccuuuauuauucaugggacgccuaaagggaacuuagaacagacugugaauuauuugucagcgugaaucaacgagacaacaauauccuuugauuuucuaauacccagggugucugaucucuuucauguggauauucauaguuugacaguuaacaaaauuugacaguucuuuuaaguuagcagugucucuggggcgaguaagauaccaaugagcuauuauucccucaggcuuugcuuuggcauuuaggaauuauuuuucauuacugcuagcgaguaacguacuucagugcguuuuugucccaagguauggagucaccagguucccagagaaagacuaagaugccaaugacccaaaacuaugagcguaagcccaccaaaucggucacaacuaauacucugauaauuuaggaaccaaggagccauuuugugaggcauuucuacccuuuccucuccucaucugaggucgccaacuaaugcagaagaacuucuaguguccaagacgcggagcgauacaugguuuguccaaguagaagauauauugaaauuuugcauagacaggugugugaccuaauguacauuauuuaauguuuauguggaaguucuacauaaacguuuuuagcuguaaaauaggauaauccuucauuaucgcgcaaaauaaugaaauucacgcgucaugucacugagcuuacguaccuccaucuuuauucauuuuaauuuuuuuauaauauaguuagaccuaaagguccaauaagaugucagaauugcaaucuuuguggccacuccucuucuggucucuccgccuucagcgccgcggaucaguuaaaggcgugcaacggcuugcuccagccauguuugcucguuucccguggaugugcgguucuuccgugguuucucuccaucuaaggagcuuugggggaacauuuuuaguuccccuaccaccaagccuuauggcuuauuuaagaaaacauaucaaaauuccacgagauuuuugacguuuugauauguucugguaagauuuuuuuuuugacauguccuccauacuuuuugauauuuguaauauuuucagucaauuuuucauuuuuaaggaauauuucuuuguugugccuuuugguugauacuuguguguguaugguggacuuaccuuucuuucauuguuuauauauucuugcccaucggggccacggauaccuguguguccuccccgccauuccaugcccaacgggguuuuggauacuuaccugccuuuucauucuuuuuuuuucuuauuauuuuuuuuucuaaacuugcccaucugggcuguggauaccugcuuuuauucuuuuuuucuucuccuuagcccaucggggccauggauaccugcuuuuuguaaaaaaaaaaaaaaaaacaaaaaaaccuuucucgguccaucgggaccucggauaccugcguuuagucuuuuuuucccaugcccaacggggccucggauaccugcuguuauuauuuuuuuuucuuuuucuuuugcccaucggggcuguggauaccugcuuuaaauuuuuuuuuucacggcccaacggggcgcuugguggauggaaauaugguuuugugaguuauugcacuaccuggaauaucuaugccucuuauuugcguguacuguugcugcugaucguuuggugcugugugagugaaccuauggcuuagaaaaacgacuuugcucuuaaacugaguggguguucagggcguggagagcccgcguccgccauuauggcuucugcgugauacggcuauucucgagccaguuacgccaagaauuaggacaccgaggagcacagcggacuggauaaaagcaaccaauugcgcugcgcuagcuaaaggcuuucuuuauaugugcgggguugcgggauucgccuugauuugugguagcauuugcgggguugugcuagccggaaguagaaagccaaggagugcucguauuagugugcgguguugcgcggaagccgcagaggacuaggggauagggcucagcguggguguggggauugggcagggugugugugcauauggaccccuggcgcggucccccguggcuuuaagggcugcucagaagucuauaaaauggcggcucgggggcuccacccgaggcucgacagcccaaucuuuguucugguguguagcaauggauuauaggacauuuaggucguacaggaaaagauggcggcucaaguucuuggugcgguauaacgcaaagggcuuugugugucacaugucagcuucaugucugaguuagccuggagagguggcacaugcucuugaaugugucuaagauggcggaagucaugugaccugcccucuagugguuucuuucagugauuuuuuuuuuggcgggcuuuagcuacuuggcgggcuuugcccgaggguacacuuggugcauuaugguagggugugguugguccuaccuugugccacucgaagcugaggcaaggcuaaguggaaguguugguugccacuugacguaacucgucagaaaugggcacaagugugaaaguguugguguuugcuugacuuccaguuagaaaugugcauuauugcuugguggccaggauggaauuagacugugaugagucacugucccauaaggacgugaguuucgcuugguacuucacgugugucuuuagucaucauuuuuucgaagugccugcccaggucgggagagcgcaugcuugcaauucuaacacugaaguguuggaugaugucggauccgauucgagagaccgaggcugcggguucuuggucgauguaaaucauugaaaccucaccuauuaaaagaaagaaaaguaucuaaggccauuucaaggacauuugacucauccgcuugcguucauagucucuuacagugcucuauacguggcggugcaaacuaaaacucagcccguuccauuccuuuguauuguucaguggcuagucuacuuacaccuuggccucugauuuagccagcacugaucucaagcgguucucuaagccuacuggguauaaguggugacuuuggccagagucauaguggaucacaaaucacuggugaagagguagaauccuaccuucuuccaaaaucuaccccaugacuauugcugggguugcauuuugauuucaaugaauauuuuggaugccaacgacacgucugauagugugcuuugcuaguguuugaauuuaaaaccgaagugauuguuuucaaaauguauuuacgauuugcuuacuuguugaauucauuuuaauuaccuuuagugaauuguuacuuuggaguccuuaaaguuuucaauaauuuuuuuggcagaugauacucaaauuacuuggcacuuaaauguacuuucuuucaaacucauccaccgagcuacucuucaaauuuuuaagucuuauaacacagauacuguuaauguaaagugaacauuaugacuggaugucaggaguauuugagguucuauaccaguucaggcuuugcuuuuguugcuauuguugaugcuauauugacuaaugguuuuacuugucagcaagagccuugaauuguaaugcucuguguccucuaucagacuuacuguuauaauaguaauauuaaggccuacauuucaacuuucuguguguucuugccuuuauggcaucuagauucuccucaagacucagcaaauagugcugcugcuauugcugccccagccccaggcccagccccagccccugccccagccccagccccagccccugccccagccccagccccugccccugccccagccccugccccagccccagccccagccccuaccccugccccugccccugccccacccaaccaacccaauccaguccagcccugccccagcccaguccuagccccaggcccagauacuuucagaccuaucccaagcccacuucuacuuagagaaauucgaaucuucauugauucagugcuaaaaugcaguguccaucacucagccuauaagacugagacagcccaucuauacccccuccauacugacuucuagagucauggaauuucacuuaaugcauagaaucguauugcuaaaaugcagugcccaucacucagccuauaagacugagauagcccaucuauacccccuccauacugacuuacagagucauggaguuucacuuaaugcaugcaguccuauugcuaaaaugcagugcccauaacucagccuauaagacugagauagcccauuuauaccccauacccccuccauacugacuucuagggucauggaauuucacuuaauacauagaaucguauugcuaaaaugcaguguccaucacucagucuauaagacugagauaucccuauguauaccccauacucccuccauacugacuuccagagucauagaauuucacuuugcauacgguccuauugcuaaaaugcaguguccaucacucagucuauaagacugagauaucccuauguauaccccauacucccuccauacugacuuccagagucauagaauuucacuuugcauacgguccuauugcuaaaaugcagugcccaucacucagccuauaagacugagauagcccaucuauacccccuccauacugacuuccagagucauggaauuucacuuaaugcaugcaguccuauugcuaaaaugcagugcccaucacucagccuauaagacugagauagcccaucuauaccccauacccccuccauacugacuuccagagucauggaauuucacuuaaugcaugcaguccuauugcuaaaaugcagugcccaucacucagccuauaagacugagauagcccaucuauacccacuccauacugacuuccagagucauggaauuucacuuaaugcaugcaguccuauugcuaaaaugcagugcccaucacucagccuauaagacugagauagcccaucuauacccacuccauacugacuuccagagucauggaguuucacuuaaugcaugcaguccuauugcuaaaaugcagugcccauaacucagccuauaagacugagauagcccauuuauaccccauacccccuccauacugacuucuagggucauggaauuucacuuaaugcauagaaucguauugcuaaaaugcaguguccauuacucagccuauaagacugagauaucccuauguauaccccauacccccuccauacugacuuccagagacauagaauuucacuuugcauacgguccuauugcuaaaaugcagugcccaucacucagccuauaagacugagauaucccuaucuauacccucuacccccuccauacugacuuccagagucauggaauuucacauaauguauagauuucuauugcuaaaaugcagugcccauaacucagccuauaagacugagauagcccaucuauacccccuccauacugaguuccagagucauggaauuucacuuaaugcauagaaucguauugcuaaaaugcagugcccaucacucagccuauaagacugagcccaucuauaccccauacccccuccauacugacuuccagagucauggaauuucacuuugcauacaguccuacuuuacuuguccauggacaaguaaacaaagaacucuuguccuucauguuaaucaagauacaccaaucaaacaagaguuuuauaucagagacuugccauggagguaucaucucucaagucuccuuuccuuuaaggaaagaaaaccauucugucauugcuguaguagucacagucccaaguuucuaagcaguguucagucgucuuuucucauguauuaccuugaguacugaauaauucugucagaaauauuuuguccauuggauuagacuuuagcuaguccagcccugugugcauuuagcaaaggggcaaacacaggucuguuaucagacaguuaaagugcucagucccaauuuucaaggcauuggccauuaaaggggguagaauacuauauacuguuggcaugcugucaugggugcuaucgccccaggucacaucuuucuaacugauggagauacauuuauuugcucaugauauuguauacuagucucacaugcuuucuuauuucagccaaaaaccucugcacuggaacauuuuauguggauaauccugacuaggaauugagucuuuucucaagguccuaauacuacccuugcuuuauguaaagagggugcugauuacuuaaugccucuuacacaauugugcaaaauugcaguuguucaaguccccuucuguuaguaaccaagaucccauacccucauacccuaaugggugacaaucaagggugccaaccaaugagaccacuucucuguucuggucuuucugcugugcuggggaaucaaaccuugagucuuguguacgcuaguaaagcacugucauagagcuacagccccaccguguggugguuugagagaacagccucuuauguagccugggcugggcgggacuuacaggcauugccaccuguaauguaaacauauuugugccuguugugugcacagcugcauuugucccucuuccuaagcauuggauaaagaaaccaaacuaagucaagucauuuuguugguaaucaagaagaccuuugaucuguccuguuuuuaacuuccaggcuggccuggaacuuagcauauaacccaggcuagccuugagcucaggaucuagccugcguuuaacaaguguuggcauaucugguuccuaccacuaugcccugcaugcagucuuucauauugugaaugugcauaugucauuucacuguaguaaucugcaucuggugaagacuuauuuguauugcagcaguauuuaagauccuuaacauaguaaaugugcacaguguuaacucuauuguacauauucucauguccacaguugugccuuuuagaucaggacuccuguacuuagcaaagcaaagaggcucacuaauauaaagcuucuuucaugagacuauagauugaaacgauuccaauacggucaaugguccuucaagguaagacuucugucucugaucauucauauccucuuugcuuuauggaauuauguaugugcugugcacuugaaaccccuuccucaaacuauuuauguacauacuggcaauuuuaguaggaucaauuuuacucuuaacuuugaaguacagaagugguguugaccuauaaggucccauuuuguggcuugcuaauaauaaugacugauuguaguaggccuuuucuguucacuacagaaggaaaccugaacagcguaaaacuguaauggccauaaacauguaccuugcauauuaguaugcauuuacugcacacaucucauuccauuuggauacgauccuacucucaaacccuuuugcaguacagcaagggucacuaaucuuuuggcuucuucaucuuccuggacacuggauaaggcuguccccuccuuuccacucuuuaauuuccaggacuauuacuuuaaagacuuaauauuugcauaaaggaugggguuuuuaauugauaacaugucccuugaacauuaauguauauaacagggacaugauccauucauuuuaauaaaaauacuuggccaguuaauguguaaaauuacacuuauccacaaccuuauuacuuuucggaccauuguaucucuugcacuccugcaagggauaccguuuaucucccaaggucccugcuaguggaccauuaauauacagugaaucuuccuuugucuuugccaguaaacaaaggccauacuccuucgccuuucauuugcacuauaucaggauaugcugaucaacaaggccgcauucuuuuggacuguuaucauauauuaaauguaugcguaugcacugccaccugcucugugcacuugaaaggaucccacucacuuccuuagcaccuucagcaggaagugauaauaagcucaagacuuucauuuggaaaguucacaugucuaagcacuucucuaagaacuacuguacccucuucuccgcuuuaaagcagaaagaggguuguacgaagugcucuucauuuggacuuaagugcauuaaugcaguuaguuguccaucauuaccuuuggaguuggauuuuacauccuuguacucuuuugacaccagaggcauauuaauuauuucugagcacuucucuugucaauauuaaucuguacccuuacacauaugaccugugcggcagcaaagguucugaaaugccuaccuuuugacuggggcugcugagugguaguaacuauuaguaaccucagcauuuggaugauuacuaugcaaaaaugucaaggaccugugugcucucuuugcauaccaucaaggcuacugagucccagaauuaauugcuaaguuaugcguauuuauaacuaugaaugucuggaauauuuuguccccuuuacauuauugcagagguugcugagcccccgaaacuacccgguacugucaaugagcacaggggcucugacgaaugaccugcucucuuccuuaaacugauuuugggacucuuaauaggcacaauggcaguucuggaugguuuauuuucuacuccaacuugagcaaauccccugcuaguuucccaaugauauaauaaaguacagcaguauguacacccaacaaugacccggauuucgacccuuuuugcauugcuuuaauauauacaauccuaaauagucacaaucucacacuuuauaguguuccuuuugcccggccucuaguuuguccauugaccacuuuucugaaucacuaauucucacaaacccaucauuaaggaagaguuugugcccuuucucaauuccaucaugccaucccuuuugccucuuuguuugaacaguauugacugggcaaagcccuucucuugacuuaaagucaacaacaccaguuuacucacuucauauggcuacagugucucaguugccuucuccuugcucccacugaacagagacaccucgaauucuuacauuauucuggguaauguuaauuaccccaaacacccuaugugucauuaauaaauuuugguguauuuauacacugaauagcaaaagcaggccaaaacuagguggaugagccuucaaucuuuaacuugcacuucuaaauuauuccaauuccaacugcuggcacauucuagggccaggaaccauucuugccuaccuuuauuaaugcuuuauugugcaaaauauugcaggcaaguagcucagggaguuggauugccaccuuuuacuuggggcuuuccuuuacaguaugaacugaaaauugucuuccugagaaggaagcuuagcacuuuucuuuccguucuuccuccaggaaggagccaacugucugcuuaagaaacuuuaagcccgauuuuguauauugcuacuguacaggaccaacugccagaaaaguuauugauaauuuuauuccuuaagaaaggcauuuggauugcaagguggauugacugugagaucauuagcuuuugugaaguaaaaauagccauuugugucauguuucugaagacuaagcagugucucaguguacugagggugaugagucuguggaaagaucagugcaacuauugcagaauguuuaagacaaguaucuuugcuuggucuuuacuacaaguuuaacaaaacgaaaaagucaaucuuuguguggccuuuaguaugauuaacuuuuuggaagaugaccuaagccuucuaaucauuauauuuugucugacauuggucaccaguccuugcuuauuuuuaaaaggugacuggauggauuaaauuugagaacaugucaagucgccuuugaaaauuauauaggccaucacauuuaauuaauucauucuauccaccauuaaacucuggcaauaauuugaaguagcuugaaaauuccuaaagugggaauuuauuuuagagaugauagaaccuguuuccccacuuuacauuuuaaaauaugucugccaggaucuaaucauuccuuuaaacguacacuucaaagagagauuuuccuaguaagaaaagagcuuucucuagugugaagggugcuuuguagccgccgaguacuuaggucuuuuuugggagcuauuguguaugaguguauguauguguguguguacaugcauguugcugcgcgcagucauucauucacauggugcucagacaacaaugggagcugguucgucuaucuuguggguccuggagaucaaagugagaucaucaggcuuggcagcaagugccuuuacccuccgcgugccaucuugccaucccgcugcugaguguuugauaugacauugcugaugaaaauaaucaucacaacagcaguucucccagcauuacugagaaaugauacuauuuuucugaggaggauguucaaguaacucauccagugcaggauccugcuugaacuacugcuccuccguuacaucagacucuggcuguuuagacuacaguaaguacuaccuuguuagcuacuaagcuaucuuuuucucauucgaguuucuuucugugccacccacugaaaagucaaagugacuaauaagucacuagcucuucucagcuuauccauacacaacacauaguaugccaacgaaauuguagaauuaacacauuguguacccaaucgccauuaugcugggguacacuaaaaugagaagcgaugauauuuuacaaaauuucuuccgugagaugauuauguuauuuaagacuuaauguaauauaagcacacuugagaucauuuuaggaaauguacugccugugugaauuguuuaaguauuuuaggaagucuacugggguugaaauuugacuucuuaaagagggaagugugcuuacuuugccuuguugguccagacgacuauuaguaccaucugguugguuuaucugaaugccaucuguuucuaucuaccucuuggaagcauggaaagaauauuaagagugaaagacuccaugcauuaugcuuagcuguacgccaaggguagcaagagaugagcuuguguaggaauugggaauauaaauuugauaauuugguucuuucaaccauuuuuacugcauuucugcccagaacagaccacuggacggcacuaacagcuuagacagagaacuucauagcuuacaaucuuuuuuuuuuuuuuuuuuuuuuuuuuuuuuuuuuuuuuuuuuuuuuuuuacaaaagugcaaagaaggauaaguuuuaugaacaaauuuuacuauggacuacuuuauguacccuccuugcucauuuuucuuuuucauuaauuaaucaauuaauuuuguuuuguucucuguuuuguuuugugacagggauucucuguguagucuggcuauccuggaacucaaacucaagagauccgcccgcagagauccgcccgccucugccuccaguuuagaguguugggauuaagggugggugccacacuggaccccugccagcacuuuucaacagauacuuucaguuaaaacaacaaauacuugacuccuguguagaaaauggucuagcugaaaaaacauccuuguccauaacacuuaacauuuuuuugcauuugccuuuuguacgugcaaaugacccucuaguacuuuaacccuuuuaaguccacuguaaauuccuucgcagcagguuucccccaacuccaaaggcuuagcauugucuggcucucuaggugauaauacaucuagaacuauugagucuuuuaggaaacuaggaccauuguuguacaaguaacugcuucaaaaggaaacauuugcaaggaaaaaaagcuuuuugagaugcuaaagaauguguuuggugcacuaagacaguuagcuaaagcuucggucucaccuuagcaccauuggcuacccaccccaguacaugcaaagugacccccccccccaggcuugccuaggcaccuagagcuuucagccugccuccuauggaccuaaauagagauuaggacucagacuccaguuaguggccuggaggaagcugguacugcugcuauucacaguaaacccacuaucacugacaguucccuauugaaaugaucaaguugugugagcaggcagaucauuaaucagggccaauucugucauggcaaccuaguccuacaugaccuccacggcacuguaaaauacacacuuauuuguaguaggacaucuggaacaugagcuugucugugauugaaauguccauuaggaggugccaucacacaaaaccaucuggaggccaucuuugguccccauaauugauggaauacaaagaguuccccaaauuaguguccugacccagcccucacugucaguaaucauguaauggaaagccaccaacucgccaucaccaucuucaggcugccugaacuguauacauuaagaaugagcuuucagccgggcagugguagcucgagccuuuaaucccagcacuugggaggcagaggcaggcggaucucugaguucgaggccagccuggucuacagagugaguuccaggacagccagggcuacacagagaaacccugucuugaaaaaaaaagaagaaugagcuuucuuccaagcuguccaauggcuugacccagacuuaggaguuuguaaacaaagaacccuguagaacaagugaauuugagaauguacaccuucauuaaguggugggaaguggaaguaguggauuuugccagcugauuuuacaaagcccuguggcagaaccagaccaggucuuuguaugcauacugccauauaaccuagccacuguccaaccugugcccucucucccaguccagugaaccucuucugccugccccuuacuuaguccucuggcucaucccaggggaagauggcucuauuuguguagucauaagaaaguuuuguuaauuuuaaauaaaacaggaaaagagaaagcucacuuaagacgagagcuggagagaugguucuguuagucuuccagagguccugaguacaauucccagcaaccacaugguggcucacaaccaucuguaaugacgucugacucccucuucuggcacacaggcauacaugcagauagaguacucaaauauacaaaaagggaaaagaaaugaaaggccuuugaaauguagacaugcuuucaauuuuaaaggcuguuuucacaucucuuaagaacuagggguuccaugagaacauauccucacccugaguucuuaccaccaauugaaaacgcugacaugugcauaugaagauuguauugcuaguaaucaaauuaucauuuguagaguuuaguauaauuaucauuuguuuuccagggaugaauuuggagucuguuuugugcuccugccucaagaagaaggauugccuggauuuagaggagugaagagugcuggagagagcccaaagguauuuccguuacuugguugacugagauaguaucuucccuuaaaggucuaaugugucaaguuauaccuccuaaguaaauaccucauuauuuucauguggaauuuucaacaauuuuuguagucuaaugauagccuuguauuucuucacagggacaaacaaucccuaugugagacucaaggacugccagcagccuauacagcuacauuacaucucagcagaacuucucuucaaguccucgcuacucugaacaaaaagcuuacaggccacauggagaaaaaaagguacuuuggagaauuugcuauuuggggguuucuaucugaucuccaguucaucagagaaugagggggcaagucaauaaagcacuccccaucuccugguccccuggcauagucaguuagccaaugagauccuugccuuaugaugaggccuugaaaucauccccaccauguuaugaccaaucuguaacauuucugcucugaaaugccuaaaagguagguuaucagaggaaugaaggccaguuucugacacccuagucuuuuguacuugauagaguaaguagauauggcuguugucacauucuguaggccugucauaauucuggucucugaauauccucaaacucagagguccaaugcuacaccaguuucuagggacauaugcaccauaagcacugagccaaacaaugcuauucaccuugccaguguucuggcaugguauuguuuaaagcacaaauuaaaagaagaaaauaauuuaaccccuuuauucccagaguauuugaaguacaaggacuuuaacacaaccuauaaucuaaaggaucucucauugguaggugacagaauaaaagccagaaagaacuuggauggagcaauucucaugucucuaaguuaacacuaagaucuacaaaugugaaggguucacucuccaagccccuccccaugauuuaacacaacugcugguuacuacauaaugagacaacuuucccaguauucuugauuucaagaauuggcuuuucuuucaccucuuuuccagaucuccccccagaauugugggcuugcugcuuugcagugcuggcgaccuauucccuuugacgaucccuagguggagauggggcaugaggauccuccaggggaauagcucaccaccacugggcaacaggccuagcccagauuucagugagacgcuuuccugaacccagcaaggaagacaaaggcucaaagaaugccacccuacaucaaaguagguaaguuuucugcaacaguguaauaauuuuaacuuugaucuuguuuuccauuaaagucagccuuuuacuugagauauauacauaaauuuuaucuuuuucccacaucugggaaauguaacuaaacagugcaaauguuucuucuaggagaaaagcugcugcaauaguggcacugaccuucgaggaagccauucugcucuauuugguucucucuccagaagcuaggaaagcuuugccagcuguuuacauacuucaagaugcacugcuacccuacucaugccauauaauacacaagugaguagcuuauuuaccuaccuagcuauuuacgaguacacuguugcuguccucagacacaccagaagagagcaccagaucucauuacagaugguugugcgccaccaugugguugcuggggauugaacucaggaccucuggaagagcaauaggugcucuuaaccacugagccaucacuaacauuacugaugaugaaugccucuaacuacaaauggaaaccuggcuggaauugauacagaaguaucuaucauuaggcagaauuuaaagagccaggauguucuaguacuucuuuccuggcauucauacagcuucuuuuguucuuuguagugccaucuaccaaauauuacccuuccccaaagcagcacagaaaacugggucuucagcgugaucaagcaaugugaacacacaaaaggaaggcagcuuuauaaaugacccgaggaucaacaugccugacugcagcaucuuaaaagcaauagaaugagguaagucacuagcauugcagucuucugaggauuugcauuugcuggaagauggugcuggguggagagcaucuaaugugauaaugugaggcagggccauguacacgauggaagaugaacaggcuuucacguuaucaaauggccucacagcagcaacucaaacuauuaucugcuuaccaguuauaucacaagaggaauuuagcuucuagguuuuguuguuguuguuguuuguuuuggcuuggugcccuaccauucuuacagacuuaaacauugaaaagcuuuaaauaguuuauuucuuaucuccaucugugaagcagccauuagacuugugaaggauguaaaaaccaagcccccccuuuuuuuuaauagaagaggagagugaagcugacaauuaaauaugcagucgcuuauaguguuugcugcuuacagaagcuuuuaauccauguaacagaauguugagauguucauucuguguuuaaauguaauauccccuagauguaugcccuuuggcaauuuaguucugcuaagaccugucuguuugugaaggucaaaugaaaucaugaauggaaaguguugaguacagagccuggcaaauaugcccuggaguugcaugacuaggccauuuggaagaguugacggguguguccuaugguccuauguuaaggaaaccuuaaguuuaacguugauagccugguacaguguacuaauggcaauuuuuuucuuugcccuucccuguuucuuguuacccucuuucugguggucuuugcuuacuaucaaucauuaguguguauugugggugugucuauuucuuguuuuauguaucuauuuuuuccuuggucugugugucuaauucuuuguuacaucuauuucuuccuugcuuugugugucuauuucuuccuugcuuugugugucuauuucuuccuugcauuaugucuaauucuuuguuauaucuauuucuuccuugcuuugugucuauuucuuccuugcaguugugucuaauucuuuguuacaucuauuucuuccuugcuuugugugucuauuucuuccuugcauugugucuaauucuuuguuauaucuauuucuuccuugcuuugugugucugucuuccuugcuuugugucuauuucuuccuugcaguugugucuaauucuuuguuacaucuauuucuuccuugcuuuugugugucuuucuuucuugcuuuugugugucuauuucuuccuugcaguugugucuaauucuuuguuacaucuauuucuuccuugcuuuugugugucuauuucuuccuugcauugugucuaauucuuugguauauauauuucuucauugcuuugugugucuaugucuccuuguguugucuaauucguuguugcaucuauuucuuccuugcuuugugugucuauuucuuccuugcuuugugugucuaugucuuccuugcuuugugugucuaugucuuccuuguuuuguguaucuacuucuuccuugugugucuaauucuuuguuacaucuauuucuuccuuccuuugcaugucuccuucuuuccuuugugugucuuuucugucugcagugugucuuaccuauucccauguuucuccugcauguucuuucuugcagagcuuugagcuuuguuucacuuucucuggugccuguguggucugcuuugucuucacuagcuauggcucucuguuuuaucuaucugguugcuauuucucuuagcuuuucuuucacuccugccuuucgugacuccccuuugggucacauguugcaugcaucccucucuuuuucuugugcucaccccacuuguucuuuguucaaguucucuuugucaguccauuucaguuuucuuucugcugcuucuauccuuagugaauucuuguuuacauuucuucccugccuuucuugggccacuuucucuguuuucuuuuguauuugugucucuuugcuauugguggauuucuuaucucagcaucauucuguugcuuuguguuugcuuguguuucuaucuucuacuuuccuccuuucuguucacuuugagcauuucaucucuuuacaagucugugucucucuuguauucuaaaguaauccuuucuuggauguuucuuuguauguacaugugcgugugugcauguguguuaugugugucaugugugagaggagcuucauagccccuucccaauagguccagaaugucacccguggagccguuccucacaccagacugcccugagaaauaaucuaagacaaaauacaucauuccguccggucaggauucaaguggcucugaagugaacgcccaaguagaagacagaaguuuugcgacuugagauuuaaaaggaccaaaauacacagauggcccgucuugagcuggcuggacagaaugcugacaacccaaagaagaggaacuguuucuacaggacaccugugacuuccaagagcggggaacuacguaugucauaagacacaaaaccugagcuaaguccaagcauaagaccuaaggacccaauccuauauggacagaauauuuaagagauaaaggccuauggcccagaacucuggaaggauauuucuauccuucuauccccaagaccaagaagggaaauucgaagaugagaccugccccccaaccccagcaucccuuuccauuucuuauauuucuauuuaagcugucuucacuugagauguaauuuuucauuguugccauugcccauaaaggaauacguuuuuagcuggauaguauugugcaagggucuguuuuaaacugggucuuagccauuuguuaaauuguugauguuuuacaacuuccauuucucuucacaucugcuccacuugagacggaacuaaauccagccaguguauauagccugacuauugaaacuucccuaggaauaagcaugcauacagauaugcauacugccauccucccuaccucagaagcccuaggcugacaagaaaaggaaagcaucagguuguuagggggaaaacaaugucaggcuaucuagagaaaauauaaagaguuguuccagaccaaugagaagaauuagacaagcaauaugcagaugugccaacccucugagaagcaccagccagugucaccuucuuucuuugggcuuaggugagcaggguaugguuuucuaauaaugguuuggggacaaaaugaggucugaacucccugcucauaguaguggccgaguaauuuggugcauuucaccaaaggaacuccugggucuaauaccuaccuuuaaaauuaaugaugagagacucuaaggacuacuuaacgggcuuaaucuuuuucgugccuuccucuuccucuguaagagggaaguuaaaugacacaggaugaaaaaguaacaugcucauagcacauuggcaauuauacaugguuauuaucugaaaguguagagcuuuuccuauaaggcaucagacuaaguaccugaagcuuuguggguucauggucuuaguugcauauuccuuaguugcaaauccuuuucaaaagguaagaaaaaggcacacuggucuauugccuguacuugaucaagcccugauaugaaugccagggaaugucugaguaacauuaauuuccuucccugcauauuuuuugugcugaauacuaaggcugugaugcuucacuguggucacccccagguaacaagauauuaccagguaaccaggaaacguaugaauacguaaaccaugaagccuacuguaacuuccaagucagugcugaguauguauuacauaguagcugaagucuacgccucugugugcuauaggcacaaagauugcucuaggaauaacaugcuuuguaaaaacaaauauaugaacauaacggggcuugaaugaauaacaguccauauacuuaaggccaguguguuucuucugcuuuggugaggcucaguaaguuauauuauaccagguagcagaagagaaaacacauggaaacugauuuuaaacuacaaacuaggucacuaaugcaggugauugauuacccuauucugaucaccuucuaauuucugaauacccauguucagcacugggaauaacaaagggggacauuaccacagaacuagaauuuacaaaagaaugcauuaaauaaagcauuauacagcuaucaauuguuccaugugugcaaaugaaugacuacuaacuaccucugauguauccgauauuguuuuggguacaugaaauauucaugaguaacugccaugaaauaagaauguuugcauuccauacuauucauaaggaaugagccaaugcuuaauuuaaucagucaaaacuugagugauaagggcauguuaauacaagaacauuugcccaggucacauuaugguuguggguacuuucuuaacuauaaagcaguucaguaguauaagacaagacaaauuuucuauagaaauaaagcugccuauaaaauaggcauagucucuacaaaauuuucauuguacuuuuuagcccauaaugggaagaguacaguuaacaagcugggugugguagcaugugcucugagcugaagcaacaggaccacuugagcccagaaauuggaggcuagccugggaagaccauaaggucaaucucaaaccuggaggcuaaauauugucucccauguguauauucucuuucauggguacuggagagauacacagacguacauuucaguguguccacacuugagaauaauauguacguuggcauuuuaugaacucggagguaccauauaaauguaacaauucauuuucuuacuugguaucaauuuccaggcuuuuaaaauucugccacauuuauuauacugugaaaauaaaguaaauaaguaacugugaaccacugaauauaugaagcauucaauacuugaugaguacauacugaauggcagucauuuauuacaaaacagugcccuugcuaggcacugggaugcaaagagcauucucauuguccuguguaucuaaagaaauuaugcaugagauuaauuuauaauuuguaaacugccauauauauguguauauaugcaauauuugccuggugugcaaugacuuugcuuuuaucccaggcaugcacaacagaucuguguggagcuuugugaagucuacaguucuauaaagccgggaccuaacuguuggcuuuaucagugaacagugauuacuuucuaaguuucauaauggcugaaacuuaaucauaaugcuuaucaccuaacaccaccuaauaauaauuuuaccaugcuauguguugagcgaacacauagauugcuuucuagcauuauguagcacuuauaggagugaaaucuagaccaaaacuucaauucacuucaaugaggaaaugaaaacagaaaaaaaaaauggauuugugcaaggcagugugcuaaauguuacacugaguggacuaugcugucuaggauacuucccagcuggcuugacugaggagguggaaaagguuuuauuaaugacaggaacuuuuuccauccaguuucuuaaauguuuguugaaugcugcugccagagaugaauuacaaacaccuugccaguaaaggaguuuuauagggccagagugagauaaucccagagcauggguaucagggaacaaaacgggaagaggccagagcaucugauggcauguacucaguguggcccagaaccucucgaacuagauguacuggcuggagggaccaagcaugcagaacacaacaccuaaugaaacauuguauauaaaauaugcuaaccuagguccuaaaacuaaaaugugagguggaccuaguguagaucacugaucauaggagacauggucucauaaagcccaggcugguucuaauuggugacugucacagcuucucaagugcugagauuacagaugugcuuaacccaugcccagccugaagaauauaucugauuacugagugaauaauauuuuuaaagaauuauauauuuuauguauaugaguacgcuguugcugucuucagacacaccagaagagggcaccacaucacauuacagaugguugugagcccccaugugguuguugggauuugaacucaggaccuucggaagagcagucagacucuuaaccacugagucaucucuccagccuucugaguaaauauuuuaacuauaauggcuguuugcgaaacccaaccaaggccaagauuccuucaacauaaacuggagacuuccuagcuaaggaagcuccaaaagucauuuucucauuggccuagcuugaagccaggacagacuuaaagucuguccuuuaauucauuacccauuuuccuuuucuuacuguugaaguguuucaaaggagaaucaagaugaaucgauaauucuaaacguauuuguucauugccuggcucagcgucaugugagcaagaagaauauacuaucacacucauacuuuuaacuuaagugugaugaaagugcaguucuaaguacuaaaauuucuaaguacugaaaagaacaaagacauuuaaaggaugcaacccaaaguguacuuuaccucaguaguuucugaggggacugcagucacaccuugagacuacagcucucacuuuagcugggaaaaacaucaagguguagaggaggcaaguuaaauaaaaaguugcuccccuccucaugggcaugcuugguagaguggaaauaauaaaagagguucucuauuuccucgguuccacacauugcagaagaugcuacuggaugcuaagugcaacacauuuguuccaaaagggcacucagugugacuuacagaugccccggaaagcagagggaugcucuuuauuaaacagaaauauuagcucaaacguuuucuagacugaagaacacuuuccucauuucccacaguuugccucagagguugaauacaggaagguuauuauucauucauuugcuuuauugguucgccuguucuacaaggauuugcaugucucuuaggccuucacuuggcuccugagacauggaaaaaggaaacauagacauagggaagugcuggauggggggggggggucucuuuucuggguaguggcacgacuuaguccuuaguccccaaguaauaugcaaugugaguccucauccucaugucuucuccggccacugcaaugagugggaagcugggcuuuguagcaagccugacccuaaaguuacagaagcccuccacgcuaagaaacucaauuuucuaggccauuuuagcuaugacugugaccacuacuggucaggagggaugacagccaucuaaguuccacaaucuuaggcuacuuugcauuauccuggggcaaacaagccauuuuugagcugcagcaggcuuugaaauacauugaccaauuuugccuguguucguuaaaccuuuuaccuuuuuacaugcuaaugcucacaguaauuuagaaauguucuccuuacuauaauauacucaagguggcuugcuaugguaaaauaaugccaguggaugaaaauaacauuaauguuuaacauucuugcauaaaauuuaagaauaauaaaauugacaacaaucagaaaacuggaggaacgaaagaccaaauugaaagaacuugaaaaagauuaaaaaugccugugcuuugacccuuuccauuuuucuuucacucacagagggugggacaggaggccgagugaaggaaaggguccagccugucuaucuggaaucuaaguugggacuuuaaugcaguuccacaaaauugguauuaauucgcuaaauguuucugaaaauguauuuucaucuaaauggcuaucagcuaagccuugagucaaaugggaaugaaacagauuaagucaaugugaucucuuuauccaaguugccuuagagcugaagucacaauuugcuguaaggaagcuuauucauuguagcauacgcauacuuucaaaguaucuagacuuuacuuaguaacccaaucaggacauucaggcaaaagaaaaggaacagagaagauggagccagguugaagaggucugggaguucaaacaaauuuuuuucauuuucauuaaaacucaauugggcaucaaaaguguuacuaauauuagcuuuuaauuaguggaaauuggcuggauucaguaauaucccuuuguauggguaggaaugggcuuacauuucuggaauuugcaaaggaaaaaauaacugaaagccuuccuuucacaguuacugccaucaauauugcuaccaauuaagcacauccuaccaucaucugcuuugaucacauaaaugaacuguguaccaaucuguuguugaaagacuggagucaucuucccaccaacugugaaaaaacacauggaaaacaccuggacuuugugaacggaugcggaauacagaacuucuguugacucuuggguguuuugaagacuugaaaaaaaaaacuguugcuuaccaacaugucacaaugaguccguguguggguggguggaugggugggugggugggugggugggugguugagugggugggguaguuugcuguuaaauaaaaugcuuuguuuugaaaacaucaugugcuguauaugauauuuuccuuaaauuuuauuuaaugugcaugaguuuugucuaugcauuagguuuggguguuauacccguguaggccagcagagggugucggaucccaaggaaaccaaguuacagacgccaucuuguguguagccggaauguaauucagauccccuggaagagcaguuagugcucuuaaaucaguucaccuuaugcuaauacaaggagccaacaaaaccacaaaagccucaucuacaaugugauuggcaagaagagaaagauagacagguacugcaagcgagugugagugaggcagguacaagaaucuauuaugguaucuuaaccacugccacauuccccuuuuccuuugcauggagccagaacuaggcuagccuccaagucccuaaguagccggaaugacucugagcuccugauccuccuguguuagaauuacaggcuuguaccacuaagccugcuuuucagaugauaguuucuaacucaguggcccuuuuaucauaccagauaccucaguuuuaauucccuauguaaugaaauugguuauguugcccuggccaucuggcuagccugaaguccauguagauuaggcuggcccuaaauccauagagcacugucugcuacugacucaggagugcucggauuaaaggccuacaccaccaggcaggccuagccaguuccuuggguaauuugaggucucauaacuuagagccuaaguuguucaggagaaagauuaugagaacacaaaucuaauaagaucacgagaagcaaaauauugaggcucaaaagugggaguacugguaagaugaaaugaaaagaaagaacauggcugucaagaaguccuugaauagagaaaggggccucugauaguucuaaaauucaaagugacaaaauugcgucuaggagaaaagauaaauucucucaggagagaguuuguacuguuagacauggcucugccuagccauugcuaaccaguagaagugcuccaacaaaaccgggccuucguuuccauccaaugaaugggccagaaaagcaacaacauuuuaccugaaaucaguucaccuuaugcuaauacaaggagccaacaaaaccacaaaagccucaucuacaaugugauuggcaagaagagaaagauagacagguacugcaagcgagugugagugaggcagguacaagaaucuauuaugguaaaucuuaacaucuuuggaaaauagcauuggcccaacuccaagaagcccaugaaaccuuaccauuuauuacuggcaacuaaaggauugggacacggggcacucaaacguauccacugaugaguauuuaauaguuccaaacuaugucuggggugaacuaugaaacacuaaacaaaauaaaacuagcaaauaugacagagacauuuuguaaggaauaaggggugcuggccagggcgggagggaaauugaaaguggaagaguaagcagaaugcauucuauauaccuaugaaaaauuucuaauaaaaaacccuauuuaaagccgggcgugguggcgcacgccuuuaaucccagcacuccagaggcagaggcaggcggauuucugaguucgaggccagccuggucuacagagugaguuccaggacagccagggcuacacagagaaacccugucucgaaaaaacaaaaacaaaacaaaagaccugucugagcuggagagaugauggcucagguuaagagcacuggaugcucuuccagagguccugaguucaaaucccagcaaccauaugguggcucacaaccaccuguaaugggaucugaugcccucuucuggugcgucugaagucagcaacaguguacuuauguaaaacaaaauguuuuaaaaaauagaaaggaagaaagagagagagagagagagagagagagaugcucucauaaacaacguggaaggccagaugcacaccugaaguuguccucugacuccauuaugcucugugcaacccucacccacaaacguguacacacaccauccacauucauauacaauacgcaucacacaaaagaaggaaggaaggaacgaacgaaaaagagucaagaggagggcugccagcauccuugcccugauggcuagggucgcugcacgggucagcagcacuggacucccucgucugacugucacccuggucauuuagaagccaaacacugcgauucuucaaaggcgggaucugggcuaaguaaggauguggcucagugguagagggacagccagggccucgaacucagaaauccgucugccucugccuccggagugcuggggauuaaaggcgugcgccaccacgcccggcuuuaaauaggauuuuuuauuauaaauuuuucauagguauugaagaggcacacaugagccccuucaugguuugcuagaauaaaugcucuuggugauauaacuugguuuccucagccuggguuccucaacuagaaacaggcaguuaagguccaaggcaugaguugugagcugcccgggucuuccaggcaaccugcaagugacagguucuugcuaugcaugggcauccuuauucccccugggugaggagcuuuggaaacucaggggcagggagacuccuucugaggcuucuggaaagagagaauagaugugaggaucagguagaaguucccagacugucccugccauccaagagggaggcaggagcugggcuggguaugggucacaaagccagcagcugcuagcacugaggguccuugccuuucugucccauggccccucucccaucugcacugugguugcagagccugagccagcacuucccccgacuggagaaugacagaggcagaguccacuccucccauuccggggcgggaagccaccauguugcaccugggcccagcagggccugggaacacgaggagcccacggcacccaaagcccuccccucaacccagguccuugcgcaaggucaggagagggcaggcaaguggccauuaaaacugcccucccggcacaauggcacagugaggugaagcuggcacaagaauaaagaagaggaagaaauagagcuguagauagaagagacagcaacguguaauaacauggcgccuucaagggucaggaagggcuauucugcaaguaaucucagguuaauuaguuccucugugcuuuacucgaaccaaaauuugucuccuaucagggagagaagguggaguggauaagauuaaacuaagcacacacagagacaauuguuuuugcuuuuguuuuucuuucauuuuugagucagggucucacauugcaguccuggcuggcuuggaagucucuggcauacugcuggaaacccaagcacucacccuaaccaagcacucacccuaaccaagcaugcacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacucacccuaaccaagcacacacccuaaccaagcacucacccuaaccaagaacucacccuaaccaagcaugcacccuaaccaagcacucacccuaaccaagcacgcacccuaaccaagcacucacccuaaccaagcaugcacccuaaccaagcacucacccuaaccaagcacacacuguaaccaagcacucacccuaaccaagcacucacccuaaccaagcacucacccuaaccaagcacucacccuaaccaagcacucacccuaaccaagcacacacccuaaccaagcgcucacccuaaccaaguacucacccuaaccaaguacucacccuaaccaagcacucacccuaaccaagcacucacccuaaccgagcacacacccuaaccgagcacucacccuaaccgagcacucacccuaacccagcacucacccuaaucaagcacucacccuaaccaagcauacacccuaaccaagcacucacccuaaccaaacacucacccuaaccaagcacucacccuaaccaagcaugcacccuaaccaagcacucacccuaaccaagcaugcacccuaaccaagcacucacccuaaccaagcaugcacccuaaccaagcacucacccuaaccaagcacacacuguaaccaagcacucacccuaaccaagcacucacccuaaccaagcacucacccuaaccaagcacucacccuaaccaagcacucacccuaaccaagcacucacccuaacuaagcaugcacccuaaccaagcacucacccuaaccaagcaugcacccuaaccaagcacucacccuaaccaagcaugcacccuaaccaagcacucacucuaaccaaacacucacccuaaccaagcacuacccuaaccaagcacucacccuaaccaagcaugcacccuaaccaagcacucacucuaaccaaacacucacccuaaccaagcacuacccuaaccaagcacucacccuaagcucaguuccaauagaaagaauaacuaaaagaauucuguagacaagggagggcuuucuagguuuaaaauuaauuuacuggucccuaaaaaacaaacaaacaaaggggcuggagaaauggcucauugguuaagaaugcuggcugcucuuccggaccggaccgugguugugguucaauucccagcacccacauggcagcucacaacugucuguaaguccaguuccaggguaucugacacccucauacagacuuacauucaggcaaaacaccaaugcacuaaauaaauacauacauacacaccgaacaacaaaagacuacaggucugaaaaaagccaguaggcauugcaagccuggaggugguggaccauggaucagaauucaaggcugggcugggcuacaugagagccuuuaaaaguaaguaaauaaacaaggccuuauucucuauucccacuagggaaaugaagcaaacuauaauuggauaucccucgcaucuaccuacuuggaauagcuaucuagaaccuaggaaccagcugguguuggaggcaagggccuguaaccgcggcacuugggagauuuagagcaagaagaugaagaauugggucuauccugggcaaugucaugagacucugucucaaaaaaaaaaagaaagaaagaggagagagagagagagagagagagagagagagagagagagaggaagaagaagaggaggaggaggaggaggaggggggaggggaggaggggaggggagaggagaggaggggagaggagaagaaaaagaaaggaaggaaggaaagaaagaaggacaggagagcuggaaagauggcucagugguuaccaagaacauuugcuacucuucuggagccccugaauuuguuuuuuguuuuuuuaaagguuuauuuauuuuauuuauauuaguacacuguugcugucuucagauauaccagaagagggcaccagaucccauuacagacgguuguaagccaccaugugguugcugggaauugaacucaggaccuuuagaaguacagucagugcucuuaacuacugagccgucucuccagcuccugaauuuguuuuuuguuuguuugcuuguuuguacguuuugagacagggucuuguagcccaggcuggucucaaauucucuuuguagauaggaugaccuugaauuucugacacuucugccuugaccucagugcugugacuacaagcacaccccucaccugguuuaugcagguuccggauggaacacagggcuucaggaauggcagagaagcaaguuaccugacucuugcucagccauuuugaggcuauaggaggagggggacaccaggcagugaguccccaugucaaaaaauaagucgagccaggcagagagggacgugcuuuuaaucccagcacuuggcaagcagaggcaggucgaucacugugaguuugagaccagccugggcuauacuauauagugagccagccagggcuacccuggaaaacucuaucucaagaacaaaucaauacuguacucuccucgaccuuggccagagaaguuucuucugcaaggaggagcagcuaaugcagacucagagcuggccugagacugagcaacaauugcaugcuuagcuccaaacaaggugucuauagcaacccacacacugcccaaggcccauggaacaucguggaagcagggcuggaaagaacaugagagcuaaagauggggaggcaagcugugaaaaugcuggcugccgcccucacaagcguacugcggcuguggcuaccugcauacgauuccgacaagauuagccaacauuccagcaagcacugcuaacuggacucacaggguuguuauuauuauuauauuauuauuauuauuuuaaaaggagaccucauuaagguuauaggaagacagcuucgggauguguagggagugggggagaaguacgagugaaugcauguaugaaauugccaaggaauaaauaaauauuaaauauagggaaaacccaacacuuggaagguggaggcaggaagggcaaggucagcguuggcuacggagcaaacucaaagccagcuguacugcaugagacugcgucucaaaagaacaaagguggaagaagagcucagcaguuagcagcacauguugcucuugcugagaggaccugaguuugcuagcaagcaccuaagucagguagcucacaagccucugucacuccaucuccagggggccaaugccucagacacacauauuuaaaaacaauugugagcaggguguggugccgcaugcgcaugccuuuaaucccagcacucaggaggcagaggcaggcggauuucugaguucaaguccagccugaucuacagagugaguuccaggacagccaggacuacacagagaaacccugucuugaaaaaccaaaaaaacaaaacaaaacaaaaaaacaauuguguguguguguguguguguguguguguguguguguaugugugugugugugaaacaaaacgaaacaaaacaaaacaaaacaacccuacuuucauauuuuuaccacugguaguaaaauccaacacuaaaaggaauuccuggcauaagaaaucuugaggaugaaaagucaauuuaaggguauguuugaacauagcacucugauaaagacaccauccacccauuugucuaaagugaguuagucuucccaaucaaauccucacuuaugccaaugccugccuuaaauguuuucuauguguagucuccucaauuaccaucaacauucaaaccaucacuuuccccuauaauuccauuuaccuuggacuuucacuuccagccuuauucuaauuucuugggcuuucauguuuauucgucaacuuucauuuucauuauacaaggaccugauaaguuuuuauugauaaaaguuuuauuauuugcuaugaauugaaugcggcuaugcccucauguguguguguguuuaaauaguaagcucagauguuuacuuaaaaacaaaacaaaacaaaacaaaacaaaaacauguguuuucuagccaaguuggucaggaacugacuguguagcccaagcuagucuugaacuagcugcaaucccuuucugccucugccuuuaaagugcuaacaagugugagccaccugcccagcuauaacuacuauuuuuuaaugugagcacuuucuguucucacagaggaccugguuugauuuccaacacccacauuguggcucauaaccaucuauaacuccaguuccagggauccuagcaaacccucuucugacauuggugcccaacaggcauacacaugauucacaaacaugcaaacaagcagaacacucauacacguaaaaucuaaaauaauaauaaaguagaccuauagaguauauauaauuccaaauggauuucaguagaagacccuacuuacauugcacagaaaaagcugucuggcugcuucaggcaugccaauaucagcacauguaaacaagcuuccaacuuuguuuuugaguaaucaacucauuauucaccagaucugaggcuauuucuauucaacagcacaagaaaagaagggagaagcaggaggaucucugugaguuugaggccagccuggucuacagagcuaguuccaagacaccagggcuguuacauagagaaaugcugucucaaaaaugaacacacacacacacacacacacacacacacacacacacaagcgcaagaaagaaaccauucgaauuugacugcauauguacauaaaaccuuuaaauaaaagacguaauuucaaaucaaaugaggucuuaagaauggagccuaaaccugucugucucuuuaccagacgcagggcagccagaaggcagccauucacaauccaggaagacaggaagggauaacaccagaacccaaccuccauuuuagagaggucuagccucuugagcuaugacacacuauuuguucucuaacuacccaaaguuguauuuuacuaugcuaauuagcugauuaagacauuagguaaagguguucuacaaagaaacuguaaauaaaagacauacucugugccuuagccuaucucaugauuccuuuucuggaugucuucauaaccaccuuaaccucuacgaagauacagagacacagguagcacuacagugcuguauuuguuuaagcccccaacaaacuugguggcuuaaagcaacacagaucuauaaccuuauaauuuuagaagucagaaguucagugugagacaccuaguugaaauugaaauuauuauuugaaauuaaauugaaauuauuccuucuguaaguuuuagagaauucauuucccugcccuuuuuagcuucaaauuucuuagcuaguaauugccuuccucuaugucuauagccggauguagagucuuugucaaucuuuuaucccugccauuucaaugaaacaacaccuuaccuucuaggggaaucuuuuuaucucaaggucgauugauuagaaaccucaguuucuuccuccaauguaauauaguauauuaguauauucuggggagucaguguuugucugccuacuaacacagguaagaauuugcauagguauuacaaaaucaguacuuugcaaaucuuucuucucuuccgaauugaaaacugaacauuaauccaaacauggcggcagaagccuuuaaaaucggcacugucccacugaaggcaguggcaggcagagcuuugcgaguuugagguuauuuacugagaccuugucucagaaauaaggcauuaaaaaaaaaacaaaaaacaaaauucaccccaaauccgcaucaaaaccaaagcugauuguuaauuucccuccuuucuaaacuggauucauuccuuagugccauuguuugcucgucugaacacacugaauaaacacuaccgggagggauuuuccgugccuauaguaaauaagaauaugauuuuucagauacgaaccacugagaauuguuuugccuugcccgccacccccaccccgaaaauacuccuugucccagauaguagaaacuuaauggguuuucaaagcacucagauuauuuucgaauuucaacgauaccagagaucgggucauuauguaccucggaaauaaacggaacgcaguaccaaaauuuuaggucucaacuuccaaggcuucucaaagaaaguuaucgcagacuuaguuacucguucuugguuacuucacacgcuaccaguaauuuuuccacuuuucugaaucugugccccccccccacauucuuucaucaacuuuaauccaaacgcguacaaucagaaaaccccacuaaagcggagguagaaucccauugguuuuuagcauaaucacauggcgggaaaauuguuaccaaaaaaaaaaaaaaagagcaaaaaucuuaccugaaaaagacacgugcggugagguaguauugcugaauuuggcuugagcaauauuaaaauauuaagacuauuccaaagaguuuuucggacacgaggcuuucccugaugugaguguguggauucuagacccugcuacaagucacgcccuuaacuuucuuuuccgcucuagacugcaguuuauuacccacgccaggcuuauugaacgcuuugcauaucuaccuguaacauuuuagccaaccaucucuacgcuaucccagacauuuucaucaccucugcucugcccagcagacauuuuagucgaccucuagggguugguuauaaggcagggauuuuagcgaucuccccaggucccuggcggcggcaggcauuuuagugauagcccagguccccgguggcaggcauuuuagcgauagcccagguccccgguggcaggcauuuuagcgaucuuccagauccccaguggcagacauuuuagugauagcccagguccccgguggcaggcauuuuagugauagcccagguccccgguggcaggcauuuuagcgaucuuccagauccccaguggcagacauuuuagugauagcccagguccccgguggcaggcauuuuagugauagcccagguccccgguggcaggcauuuuagcgaucuuccagauccccaguggcagacauuuuagugauagcccagauccccgguggcaggcauuuuagugaccucccagaucccugguggcaggcauuuuagugauagcccaagucccccguggcagacauuuuagugaccucccaguaagcgguggcaggcauuuuagcgaccucccagauccccgguggcaggcauuuuagugauagcccagauccucgacggcaggcauuuuagugaccucccagauccccgguggcaggcauuuuagugaccuaccagguccccgguggcaggcauuuuagugauagcccaagucccccguggcagacauuuuagugaccucccaguaagcgguggcaggcauuuuagcgaccucccagauccccgguggcaggcauuuuagugauagcccagauccucgacggcaggcauuuuagugaccucccagauccccgguggcaggcauuuuagugaccuaccagguccccgguggcaggcauuuuagugaccucccagguccccgguggcaggcauuuuagugauagcccagauacccgguggcaggcauuuuagugauagcccaaguaccccguggcagacauuuuagugaccucccaguacccgguggcaggcauuuuagugauagcccagguccccggugguaggcauuuuaguaaagucucccagucccaggcauccauuugagccauuaguccgggaacguggcauguauguuagcuaucuuuccaggucccugaccgguagucuaaccaccuguaagggacagacauuuuaaauuuuggcuccaggacccagcagacauuuuaguuauuccuccguuaugcggcaggcauuuuaacuaucgguucgggacuacgcaggcauuuuaccuucaucuccgcauagcuggcaagcauuuuaggaaucuuucugcugcuuggcaaucacuuuaaccaucucuuccgcugucccgcaagcacguagccaucgcuccacuguccugaaagcacuuugccacugucccacugucccgcaagcacuuagccaccucuccccugucccgcaagcacuuagccaucgccccacuguccugcaagcacuuagccaucgccccacuaucccgcaagaauuucagccaccucuccaccaccccaacaaggacuucgggcaccucuccaccgucccgcaggcacuuuaggcaucugcccucuccuuagcccgcaucucacccaccgcuccgcucuggccaccugucuagcuggcuaucacgcucuucuuccaucacgcgcuugccgcagccgccucccgggaguggaugcaggacucaagaugcguggauaucucggaaagugagaacagagcaagggcgccgagcgcaaguguguagcgcuugcagguacuuuugggaccgaguggagcacgacguagcgccucaccggaucuugcgagauugcgccugacacaagcgcugcacugaggguuugagggaguguggggcgggaccuaaggcucuugaggcgcgggauccugcugagagggugugguuagcacacuugaccaccugcgcagagaagagggggcagagcuuaggggaacagagcauggaccuugugggagucacagaaaagaauggcugcaaccugagcccauuugccuuugagagcugggaaagcuaggccagcagguagcagcuugccuggucgaauggcccuuggugaguguuggaaugcuggaaacccagagaccaaagcugccaggcucagcuccaacacagucucauuuguuugguuuguggcagacugccugcaccccaacccuuuccuccccagucuugccuccuccugcccccucucuuaaacucuuacggucucaaagacuggguuugagggaaaccuacuguaauggauugauauacuucuccuucaauugacaagagacuuaauguccuagagaaaaauuuuccuuaaacuguacauauccaaauuucaaaaaauguauaacagucaguaucaaugcaaacugagcaaucugccuagguaccuauaaacacacaagauaccuauaaacacacaagauaccuauaaacacacaagauaccuauaaacacaccuagauaccuauaagcacacaagaagcuuauagagcaccaauuagacuggaacagaaaagaaaauccuccugccacauaauaacccaauuuucuuuucaaagaauuuuuuaaaaauauuuuuauuuuaugugugugggugugugcagagcccauagaggccggaugagagcaucagaucucccugcagcuggagguacaggcgucugugagcugguacucgaguguuugggaaucgaaccuggguccucugcaaaugcagccacugcucuuagccacuguaccaucauuuuaaccccaaugucaauuuucaguccccaaagcuuugcugguaugugauacaaauuuuauaaaaguagaaaaugaggagaacuucuuugcaaagaaauaggauguagcccaagggaggaaacaaaaaacccucugagugaaaaaggcagauucuucaaguaaaaugaauacaaaaauccccaagaaugugauauuuuggcaaaagcccucuauaccauccaggucugaaauauuaaaagaauuagagccuuucaccaggugguggcggcgcacgccuuuaaucccagcacucaggaggcagaggcaggcagauuucugaguucgaggccggccuggucuacaaagcgaguuccaggacagccagggcuauauagagaaacccugucucgaaaaacaaaaacaaaaacaaaccaaaaaaaccaacaaaacaaaacaaacaaacaaaaaagaauucuagcaucuuucacauacaaaagaaaguaccgaggaaaagcuggaauggagcucuuucauguucuuccuugaguucuuugaacugaaacaaaugauggaaaauggcuucuccccagaagccaucaauucucaguagaaauucaagaagcccauucaugaaaauucauggaaggccacaggaagcugcacccaagcuaaucaccuaccuuugccaaguauacugaaauagcuccauguucuuaguaugucuacuguuccgugugcuuggcacaggucuguaauugcagcacuuggguguaugugguagagagagacguuucagguguucaggguuauccucuuuggcgauauagugaguuugaggccaggcuaggaugcaugagacccuuuaauuccugcacuugggaggcagaggcaggaggaucucugacuuugagaccagucugauguacagaacaaguucuaggacagucagggcuacauagagacaacaaucugucucgaaaacaaccauaaaacaauuguguguguaaaauuauuaaauuauugagcuuucuaggaauuuaaagcuuuaacagugagauacuuugcuuuuaaauaucaaugcccaauucauucauauuucuucaaaugaacgaaaaugaccaguaugcauauguuguuacuggaaugcauucuuuuuuuaccuuuagaagauagaaaguaauacuccaaaauauuuaauaaaauauuuuaaagauggaugcuacuagugauuaguauuauaaguaguuguuaacugauaacauugauuaccuaacaaaaguugacugugagaagauagcauuucuaggauguacaggagaaaacauacugauuucuagaaacuaucaccaaauuuuaaaaauaauauuuuuauuaauucuuugagaauuuggcauguguacuauaucacccccauuccuuucucuaaccccuugcagauccaccaccugccacccucucucaacuuaaucuccucauuaaaaaaaaauuacccacaguguccaauuugugcugcacgugaaugccuggaugugaaccauccacugggguggugugccuaccaaggagucaaaaaaccgugacugucccucucccaaaagcucucaacucuaaauagugcuuccuuaugcuuggaauggcgauuaacacaagcuuauucaggcagcuacaguucacaaguacagcaguuaauguccuguccugaagguuuuguuuugcucugguccggcuuugccuauacaucacaaagucuguuucuucuucugccauggucacugguccuuggggagaggggacugcuuuugaaaaugaaggucaugaaucgacuucaggaggcccauugaacuugugaaacguugugcucaauauuugcccuguauaugcuuugcagagaaaguuuucuugaugcugagaaucauuggugucagagauaaauccacagucuguaaacuguugacuguagcucucuccuuacuuagcauaugggggaugugguuauuaaauguuuuauuguaugcuuuuccuauuuuguuuuuuggaguaauuuuuggcaggaaaaaaaguaauaaaaugaagaguuugaaguugaaaaauauaaaacagcaaccaaagggaaauacucacuuuagaaaugaguacauucaaauauaccugagaaaucauuacauuaaaacuauauaaaguaaagccaaguggugaugaugcacaccuuuaaucccagcacuugagaggcaaaggcagaagcagagaggcagagagaggcagaugcaucucugagaauucaaggccagccuggucuacaaugcaaguuccaggacagccagggcuguugcauucggaaacccugucucaaaacaaaacaaaacaaaacgacuaaccagucaacaauagauaacaacaucaugcccuguauaaaauaccuacaaguuaauguuaaaacacaagucaauagaguaggggaaaggcagugugcauguggggaguacucaaauguccaacaaaaguaaaaauuugccagaaucagguguuuguuugagggaggggaaucucaggaagcuugggauaucuuguucaacucaugcuccugccuccaccauucaagugcuagcaguauaagccuucuuuuuuauuuauuuauuuauuuauuuauuuauuuauuuuuauuagauauuuucuuuauauacauuucaaaugcuaucccgaaaguucccuauacccucccuccgcccuccaccccuacccacccacuccugcuucuuggcccuggcauuccccucuacuggggcauauaaaguuuaguauaagccuucaauaacaaacauguucggccccagaauccccauauucaaagcucuguaauguagcaaaaaguccacaagauggcgauagagacaaggugcuagguuaaguagaagaggaaguucaaggcccucuuuuccgcagggaaaguuugugaaauuuuuccugguccuugcucuagcucugucugguggaauguaacaauguuggaggaagcaguuucuuuuuucgggaaggagaaagaucuagggauaucacgcucauuacuuucuacacuuaucugaacgcuaucuggagucagaaaucaaauagcugagcgcauuuggauagcagugaucaaaacucuggaaagagaaaguauacugcaggggaacagcgggcugcuaaguagguguagguagucccugcugaauaaacuaaaguagccaacgacuugaaaagaaauagagagaucugcagagaauuuaagagguuuaaaaggcacuguguacacaugugcugauuuuggaacuuccuacaaagcugcacgaaucaaaaguacauggagggguuggagagauggcucagcaguucaaagcacugacugcucuucugaagguccugaguucaaaucccaacaacaacauggugacucacaaccacuuguaaugagaucggaugcccucuucuggugugaucugaagacagcuacaguguacuuagauauaauaaauaaauaaaucuuuaaaaacagaaguacauggagguggauuugaaggucagcagcucauauugcugauggaguuuacuuggaguagaguggaaaauguggacauaacugugagucuguguucugauuguugccucccagaagaucaacucagggcauuaaugauugauccacuuacaugaacuuccucaggcagacauuuaaaaauuaauuauaguguuguuaucuagguuaugacaacauagucaaagccagcaaaagggaugcuuugaggugacgauaggggaagauagcuuugaaauuuuguuucuacgcauucugggggaacuacaaagucaucuaugugcccauuacucaagucauauucaggagaaaggggggguggaaaagguugaaguccuuaaucugauuguaaccagcuucuagguucacaaaggcaguaaggugaaggacaggacaacauugaaaacugccugcuugccgggcagugguggacuuuaaucccagcacuugggaggcagagacaaguggauuucugaguucgaggccagccuggucuacagagugaguuccaggacagucagggcuauacagagaagucucaucucaaaaaaaaaaaaacaaaacaaaaaaaaacaaaacaaaaacaaacaaacaaacaaacaaacagaaaacugccuucuggguauuaaaaguguguuucaacgaacauagagcccaucuggagagauagcuuugucucccuucuuuuugaaguuucuuuuuuauguguuuugguaauuaccagcauguguaccaccugcauggcuaguaauguggaggccagaugcuugagucagauccccuggggcuggaguuacagacagcugugagcugccaugugggugcuggaaacagaaccuaaguccuucauaagaucagccagugcucuuagccacugagccaucucuucagccccuuuguaucacaucuuuaaggaaauucugucaagucuagaaaacagacccccauggccacacacaacaaagaaugcggauuuuauaaaaauuuacaccucaaauuccaauaugcaaacacacuucaaguaaaugagcaaugggcgugugagaaaucuuugguaugggacaagcccacacaggguguccuugcaaggacauucuauaggucucagaacugagccuucguuaugcugcuggaagccaucuuuaucuagcuccguugagugagaguuugcuugggaacagaccuggugauaauuauguaacaggcagaaacuggcugaaggugcuguagcaagugacacaaauaaacuuguucauucuuggaggaggggagcaguggggucaaaacucugagaaagaaaggacaaucuauuucccaaguggcaagauuauaaaauucaaccugucacagugacaaccaaaaaugaccugguaaacaaauaggaauuuaagauuuguacauaagaaaaauagagccuuccugcucauaauguagaugugcagcuuggccuucauguggauccugaacuacuggaacacuggaacgggggcuaucacaaaagcuguugccuguccaugggauuuguucuccuagcugaguugccuggugggccucaguaggagaggaugcacauauccucacagaaacuugaugugucagggugggaggauacccaggggcccucaccagcucagagaagaaugggagggagaaggaagaaggaucaugggagggggggaccuggaguugggggcagugagcaggauguaaagugaauaagcaaaaaaaaaaaaaaaaaauugucuccuggagccaggcgugguggcgcacgccuuuaaucccagcacuugggaggcagaggcaggcagauuucugaguucgaggccagccuggucuacagagugaguuccaggacagccagggcuaaacagagaaacccugucucgaaaaacaaaaaaauaaaacaaaacaaaauugucuccuggaaauccagaagaccagacagaagauagucaaccaaagaaaagacuugagugauacuguaaucugacuguauaacacagaacaauacaaaggcauaacaguaggaaagcaagcuucucauuguaggcucggucuucagggaagacuguauccuagggcaaaaaccaaguguuuccucgggaugugcuaaaccuggugcuggcccaguauccucugcaaugauagaauucuaccuagacugcuccauuuuucagccagccucuauucagcuagacuccagaaaaacaaguucaguguuugguguuuugcuauuuggucacuagguggcaguauaagcccagguuugugcuacagacuuaaagccauaaaaaggagcuugguuggucauauuuuuacaaauacaaauauuuguaguaccuuggaugacuuuagauggaugcaguccucugcagugaucuauacuauaguuuauauguaacuccaauuaaaggcauuucaaaucagacuggauuagcauggauacauuuuugggcuguuagcuccguucuauuuuguuuacauauguuucuuuuuucacucuuagggaaacucauuccaacagucccacagcuucuugucagagguccucgauaaauauuaaaagguugaauugaaacacagcaaguuguaacacaucacacacauguauacauauauacauguauacagcaaccauaugcuagcucauagcacaugguagcccgcaacccucuauaauggcaucugauucucucuuucauuguccaugaagacagagaacacauauagauugaguaaauaaacaaguaaauaaaugaucuuuauacacauaccucuagggaaaacaauaugaauauagcucucauaaauucucaaaaacaaauuuaaaaauaaaaaaagaacuuaaccacauagaauuauacuagaaauaaaagcaaaaagauauagggaaaauucacaaaugcaucgaaauacaauuugccuaaacauccaaagaaugaaagaagggaaauuauaaaauaugaagauggauaaaagcaucucaaaguagcagcagaccagaaguuguagcauggaguaauaguuguaauaggaaauuuauacuuguaaauacugacauaaaagaaacauuaaaaagacaguuaaaaaaaaugggugcuguaaaucugaccaagaacccacaacuuggacacucaaagacccuuggggugauagugguggaccauccauuauuauuuugcuuaucagacacaucgucuaacuccucucuaaauacagaccuccaacgggagaggcuggcucagugguugagagcacuggcugcuugcucuuccagagcaccugaaugcaauuccuagcaaccacaugguggcucaaagcacaugguggcccacaaccaucuacaaugggaucuaauuuccucuuucauuguccaugaagacagagaacacauauacauuaaguaaauaaagaaacgaacaaauaaaugaucuuuuaaaugaauacuucuagacccauggauuaggguagcucucagaccuccccagagacacuucuuuguguagugaccagggcuuugauguggucaaaauggagagaauaguaucuguagagugugaagggugcucaguucuaaauggagcaucuauaucacacaguuacaugcaaaccucagagaaaaucacuuaagacaggggccaucugggcuggggguuaagcagcagugacaggaccggugcucaggagcucacagcagcugugauuccaauacuaggggagguacucgaucuaccgcugaggagccauugggaguuaaugguguggcccucugauagauccaucaaccugcaauggaugaccccaucuccaugcauauaugguugguuggcacaaacgggacccaguguguuauuaaaaaacaaaaacaccauuaaaaaaaccaccacaccaggccaaagccaucauuuuuagcaucacaaaaaaaauugaauaaaaugaacaauuucuucgacucuaucagggaaauaacauuccccaaauuacaaagucucuuagagagagcagcgacuugcugaugagugagaaaacagcuccuguccacagacagugugaacacaggaaaacaaacugacgcuuucuuggaagguuuguuugaauaaauuuaauaauaagauaauccaggcuauauccagcgagcaauacacuuuugugacuuuucuucauaggagcccuagagcauguuuuuuagugaaaaugaucuccauagggauuggaacagaaagagaaaaggaagcauucugaaacacccccauagcagucugcucuccuagcuucagccucagacaaacgugacucauuagaaauucaaguaacugagucccuuaauccccaggcugacaugcaacuccugagcucgaacauugccccaccuuagcuuucauaagacucaaaccgaccugaagggagggaaaaaaaagcccaauucuagcccaccacgcuucugcuuaaccgacgggaaggaaaacuguacaagacccaagaagaaucgcugugaugaccacaguugaguggcauagauacagcuaaugaacacccugccaccaucaaggccuccuguaauaucagagaaauacaauaacgugucauacaacucagaacuaauucaagaagucucuagagcaaccaaagcaacaaauuaggaaaaauaaagacacuuggaacauucuccaaccugggaucccucuggcuguaucaaacaguggacacaugguauagcccucauuuucaaccacaucaaacacuguauguaaagcuuacuaaaacaaaaaaaucucagcuagaaaauacagaucagaaccaaauucaggcgugguagacaucugcaaggauuagaugguacaucuaauuaugauuaacaugguaaaagugcuaaaacaaaacaaaacgguagacugguuuugacccccggacaagggacagaagugcuuauuuuacauaucaaugcagaccuggcuuccagguucuacuagcagcguucagucccugccugauauaccuuguucccaaccuugaacuuuccaguucaggggcuuagcugcccuuccacaagacguucuuuccaauguuaucuagacauuuugcgccccacccuucuccucucugcacgagcgcaccccuucuucccuuuucuccucuccccucuccccauggcaacuccucaauccuugaagccagugaacuccccgagagcaguuccccaauaagccuaccuuuaaugcaaucggacuugaauagucucguuucacgggcagagaagucauugaucggagacaacaugcaugaauaggagaccaacaccaucaacacaaccgaugcucaaaaucaauagcauuaagaagugagcauucauaaagauuuggaagcuaacacuucagagcacacuccagaagaacaaauggggugugaggggaagggauuuaguuagggauuuugcuugucauuggcggugcaucucugcaaucccccaaaucuggaaggcugaggaggaucagaagcucaaaggcugccuggaaugcguggggagaaucucccucuaccaauaaagagacaaacaaugccagacaagcagaauguaucaggagacaacuggaaaugggauaaagauacaagauaauaccuaaaaccuaauggaaugaaugaagcuaaagccgcacaaagguguguguauugggggguggggggaguuacagaugcgcauuccuaaggaaggaaucucugagucaccaccaccugcaggaaaaccuuggcagaaaacagaaaugacaaaggcucgagcguaaauacaaaauuuuaaaaugcuguuuuucuugaaaaaaaauuuuuuuuaagaagcugaugaaacuaagcuacaccaauaacaaacucaaaucacguuugcaaaaggagaccuuacaaucagucaaugcuuaaaaucucucaagagccgaagcagaagggaugcuaucuaacucaauucaugaugccagagugauccugauaucaaagccagaaagagacacaaaagaaaguuaaaaauuuauagcccacaucccugaugaucaucaucauuacaauauccauaacccgaguuugauggaauuaaaauauccaggugggauuuacucauggaaugcaagaaugauucaacauacaaaaaucaaugaacacgauaucaccacaauacaaugacgaucaucuugauagcauuaaaacaaaaacaaacaaacaaacaaacaaacaaacaaaaaaacccacggggcuggggagauggcucagcgguuaagagcaccaacugcucuucugaaggucgugaguucaaaucccagcaaccacaugguggcucacaaccauccauaaugagaucugaugccuucuucuggugcaucugaagacagcuacaguguacuuacauauaacaaauaaauaaauuaaaaaaaaaacacuuggaaaaacucaguguacucaugauuaaaaacucucgguaaaccaggaauaggaggaaauugucugaguacauaagggccacauugaaaaagcccacagcuaacauggucaauggugaaaaauugagugcuuucccuuuaauaagaugaaggaaccaagaauguuugcucucuuagauuccaauccuaauagaauugaugguccugugcagaacaguuggggaagaaaaggaauccagggcugggacuguaccacagucuguagaaugcuuuucucuagaaugcauaaagcccuaugugcaaucccaauagugguacaagccuaugacccugauacucaggacguagaagcuagaggaucacaauucaacguuacccugggcuaaagacccuguuuuacuuuauuacuuuuuuuuuuuuuaauaucugaauuguaacugacuggaguacucugcucacaaaugccaugauuauuuaugugggggacuuacgaaagucuacacacacauacacacacacacacacacacauacacacacaccauacaacucagguaauucagcuguaaaguuauaggauacaaaaugaguauauaaaagugaauugagggccacugagauggcugagcaauuacaaacacuugcccccaaguuugaagaccugaguuuuuguuugauacagcccuggcuggcuuggaaauuacuauguagaccaggcuggcuaccaauuuauuuaagaucugucugccucugccuuugaguccugggauuaaaggugcaagccacuacagcaaacuugguguuauaguuuaaauauaugguuuacuccuagcaacuuguauguugucuuggugcugaaaugugguggcaucuuuaagaggguuuaauuaauuucucaagagccuagcugaguucuuggauuuuaagaagagguugcuauaaaaugauccuagcaucuaccugauagcucuugugcauauauuauacuggacaaaauagauguuucccuaccacaacucuccuaugaguuaacacugcuuccaaccagaaacugagaaaauccuggccagcacagucuugaaugucucuguuuccagaauugugaccuaaauuuaucuuuacuauucaugacuuaaucuagguugaggaauguugcuauaacaaaaaauaaucugagauaauugcucugacuagaacauuuaauauuguuaaaauacuacuucuguucaaagugaucuguagagucaaucaauaucuaucgcacucccaauggguuuuuguuuguuuucuuuuuguauuuuggaaguagcaaaaauaacuauaaaauacauauagaugcgugaagacccaugaacagccaaaauaauccugaaaaagaacagcucuuguccaauggaccuugggggaaaccaaacgucacauuuuacacagagcaggauaagguauugguuuucauuuugccucuccagaacacaaaaccuagauuuuuuuguuuguuuguucaucuguuuuaauagggccucaucuuuagccugggcuuaccuugaauuuggagucugccucccucaguugcuauaguucugggauuauaggcauaaggugcaauuuccagcaaaaauccuuuaagggcugcuugaaacucacuauguagcucagccuggccucaaacucauaaccauccucucaagugcuaggauuacaugaaugagccacaguagcagcuaaaacccuuuacauuuuauuaggguauauucuauacaauaugagugccauuauaacaucacauacacguaagauuuuguuccuauucacucccauuacucucuuuuuuucucccucucacuuuuacugauccccuuacucugcucacacacuucugauuucugguuucuucuauagcauggaugaaggguuauuuacaggaacauggcagauucuuaccgaagaaaguaucccccccucccaacucccucagcaaacaauaacuacuaauaccccuucugcagggaggaaugaggcaucuuggucccuuacgucuagacacuguuaacugccuccucggggagggaugaggccuugugagccucuuguagcaacuguuaacuuccuacacauccuaaggaauguggggguccccuuguauacacaggccuuggguaggguaaucauaggugcugugaguuuaugaguaugacugcugcuguauguuccacaauaccccaucccuucuuccagcuuuaccuuucugcccucuuugcugugguguuucuugaaccuugcaagggaggagaugcagaucccauuagggcugaucuucaacaaucacacaaucacauauucuuuuuuguuuguuuguuuguuuguuuguuuuuuugagauaggguuucucuguguagcucuggcuguccuggaacucacucuguagaccaggcuggccucgaacucagaaaucugccugccucugccucccgagugcugggauuaaaggcacgcccagccaaucacauauucuuaugacucagagcuaaaagucugcacgaacagaaacuagucuuaccaaagcugacaguagcacaaaucuacagguauaaacauacaugguuagaagacaauuugauagucauaagguggccagcuagggaggcaauagugguaaagcuucuccauuagagccuauggucuccccagcuagaggcuuuugacaaggcaugaacuuucuccuagcaagugagccucaacuccaaucagaaaguuaauuagccaaauaaaaaaaaugguacccugugcucagcuuggccugugaguaaaucugugggacauuuucucgguuaacgaucgacugggggggggggcaguccacuuaaaccauguggguggagccacccauggacaggugguccugggagguaugaaaaagcaaagugagcaagccauggggagcaagccaggaagcuguccuuugugguuccugcccuaauuucuacugugauguggaaguacaagccagauaaauccuuuccuacccaauguauuuuugguuagaauguuuuaucacaguaauagaaagcaaacuaaaaacuaaaacaucuuucuaacuuucaugccacaguuucuuuuucuuccuuucuuuuuucuuuucuuucuuuucuuuucuuuuuuuuuuuuuuuuuuuuuuuuuuuugguuuuucgagacaggguuucucuguauagcccuggcuguccuggaacucacucuguagaccaggcuggccucgaacucagaaauccaccugccucugccucccaagugcugggauuaaaggcaugcgccaccacugcccggcugcauuuuuuuuuuuaaauuaaaaaaguugaaccuagguguguugucucgugccuguaaugcccauguucaggagagagagagagggagggcagggugauuacuaugacuucaacaucagcaugcgcuuacaucaucaguuagaggccagucugggauacagagugagaaccugucucaaaacaaaaacaaaaaaacaaaaaacaaaacaaaacaucaacuaucauaagugacuuaaauaauggauauuaaaccuaaauaucacacaacuucacuuaagaaaauucugaggacuggaaagauggcucaaugauucaaagugcuuuccggaggaagccugaacaccacaguuugaguccuaacacuuuuauauaauaagcuaagugugggcccaugcaucccuauaaguccagcacugaggcuagcagagacuggaggauuaacaaggcaaacaggcagacacgguaacagccucuucaugcaugcacuagcucacacacaugagugcgcguacaucacaaacacaagcacacacaauaaauacauuuaaaaguuuucuucuuucuuuguaagugugaaaauuacaaauuguagaauuuugauccagauaagaggaucaggaguuugaggcuagccugggcuacauaagacccuguuucaaaaaccaaacuaaaccaaaacacacacacacacacaaaguugacacaaauuuucaccauguauucgacgugucaaggcucaccugggucaugcaagacuaaauaaauuaauuguaacuaaaugcaagacuaaaugucuaaaguauuuuugaaagucuggcuuaaugcaauuugcuucgguguuuugucagaugacaaguuagauaggucauuccaugcuuguuuacgaacaagacaaguaaaauuucucgagucucugucucuuggaauaggucuuuccacuguaggugggagggaaauguuuccgucucccaagugcuggaauuuaaaggugugggucugguugaacucguuuuuuguguccuucaguggucaggugccccggcugguggguggggugggaggaggaguaucugucucuauuguuccuggacugauccugaaguguaacggaagugaaaggaagguugaguggagggcuaguggacagugacuggcccacaacacuaccuuuaagaagacaaauggaccauagugauguacaccuauaauccuagcacccaagaggcagaggcaggaggaucacugaguucaaaaccguccugaucuacagagagagagaguucaaggacaaccagggcuauacagagaaacccugucucugggggggaaaaaaagcaaggaaaaaaggaaggaaggaaagaaagaaagaaaugaagagaaagaaaaaagacuaauaggucccagagacucccaugacagugggaaagaagagucugcacacuuccuccugcuggaauucuugauaagaaauaaccuccagagaaauggcaaucauuuacaauuuauaccacaaauuauacuacacuggaacaccauaguaggccuuaggagaaaaacagacgcuuaaacaucccuacuuggaggcuuuuugaaaacaaaguaaauuaucuuuacugagcaagaaaacacuuggugucuagguaacccuguagcaugugugaaacaaaagacuauugcccagacagagccucaacuuucuccuuucuauuaaauucacaguaaaaagcaaacauguauagacauaaguaauaaagucagguguaggcauaaaucaccgcaucuuuucuacaaaagugagcuuaagcguuuuaccuuuuuaggacagagugaaaauccggaaguugucuucugauuguuacaugcugccacgguccucccugucacugcugccauugggcuauggccuggugucuguacucaaacugaaaacuugcaagcuagcacacgugcuggcggaguguggacgcacggguacacgugcgcacgcaugaacacacacacaugcacacacgcgugcgcacagacacacacacacacacacacacacacacacacacacacacauuuugcgcaugcguacagauaugugcgugcgcacacacauacaggcacacgcacacaugcaagcgaauaaaauuaaaauaugguaggcgcaugguagaacaugccuuugaucccagcauuuggaggcagaagcaggcagaacucugaauuuaaauccaaucuggucuaaaauaugaguuccaguucauccaggaccacgacaaaaagacccugucucaaaaacacaaaucacaaaauggcaaaaugaaacaaaacaaaaugaaaaccaaauaaaauagaaauaagaauucuaccuucagcugaguguguguuuguguuauauaugaauauugugaugaauaucuguaaucccagaacugaggacuuugagacagaagaauuaggaguuugaagccagccuggaaaagauggccagauuaugacuguuuuucuaaauaauaaguaaagaaauaaagaaaaggagaauaacaaccaagcauggugauaaauucgugaccucaucuucuauguauaugauguaaaagucaugaaguaauaaccucuuacaauauucaaguaguagcuuuacuuggaaagaaagauuuuaaaagaaauuuuauuuuuuagacagucaaaaauauaauuaagaaguaucguaucugugcuaagcagacaauauaaaauucgggaacaaagaacauauaucuuuaucuguuugcuuauuuuuauuuauuuauuuauuuacuuacuuacuuacuuacuuaccuacuuauuggagacacauuuuuuucuauguaacagcccucacuauucuggaacucucccuguagaccaggcuggccucgaacucacagagauuugccugccucugccucccaagugcugggauugaaggccugugccaucacugccuggcacuuuuucuuucugucucugucucugucucugucucugucucugucucugucucugucuguaucucuuccuuccuuucugucucuuucuuuuuuaucuuuaguauuuuuaaaggcauguuuuuaucugcuagcuauuuauuuuugagguagagucucacgauacagccucaacuagccuggaacucagaaagagccaucuuccuccccccaccacaccuggcagguuccuuuuaaagacauuacuucucaacucaaauaaugcuaaaaucaauugagcuguuuaucaucugacuauuguugguuagcuagaaacuucugaaguguugcaauguuuagcuaaagucuagaauuugcuguuuuuccauguguuaagugucaggaaaugcgagguagguaaguguuugaagauagugucugccauuauacaaaaugcugagugauaggcugauugaguguacaaccaaacagauccagauagucaccaacuuauuuauuaguugcuggacugguuuuuaccaaacuaugaggaaaaguaggagggauaaaaaagaguaauagaggggugaauaugcaauuauguuauaugcauuauggaaauaguuaaugaaaucuuuacuuuguacaaauaguauacacuaauuaaaaagauacaaauagcugauaugcaagauaaauaaguuuuacagaucuaauguauacauagcacaggcacuacaguuaaugauacuguguuagauccuuuuuaaagaaaacucuaguuuugcugagcgugguggcacacgccuuuaaucccagcacuugggaggcagaggcaggcagauuucugaguucgaggccagccuggucuacaaagugaguuccaggacagccagggcuacacagagaaacccugucucgaaaaaacaaaacaaaacaaagaguacugacugcucuucuagagguccugaguccaauucccagcaccuacaugguggcuuacaaccaucuauaauuccaguucuuaggggacauugacaccuucuucuggcuucuguggacacugcacagauaugguaccuagguauggcagccaaaacacccaagcacauaaaauaaagauaaauaaauauuuuuaaaaagggggauggggguggacagauggcucagcgguuaagagcauugacugcucuuccagaggaccugaauucaauucccagcaaccacacaaccaucuguaaugggaucuaaugccuucuucuggugugucugaagacagcuacaguguacucaggaaaaaaauaguuuuuuuuuuuuuaagaaagaaauucagauaucugcuguauuguacucuuuauuacugccaggacaaaauguccagaacgauaauucaaaaauagcccacugacuuuucacgugcuagaagguagaaagugauagcagauuucaugccaugcagaugaucccuguuuccacagaggugcuucucucacaagacagaagaaauggaagagcaaaagacacaaccaggaguguacuuuuagcuguucuuacaaggacagggacaguaaucgagucauggaggcauuaccaaauacauccaaaaaggccuuaucuuucuuguuguuuuuguucgguugguuuugguuuugaggcaagguuuuucgguguaguucuggcuauccuggaauucuggagucaggcugaccucgaacucacaaagauccuccugacucuaccuccugagugguaggacaaaagccgugcaccaucugaucacccuacucaugaugugugcaugcacacacacuaauaauaacaagcaaaaaauaucuuuaaaaagucuaaaaccacaacuuugagacagacauuagguagacauacuuauuccaaaagucagaaauaggaaagaagaaagggauaaauuacgccaaauaagccccagacauggcagggcaagaguucguucugugugcgcacgugcuccaaaguguuucauuacaguugcuuucagaguccugggugaggggauuauuuguaggagaauggacucccuacaaguaguuacacacucagaucuucucucccuuucucaccaacuauagaccccccagggaggggugggguaacaucagcuccucccaauaggggaagguuuuguugguguuguguuguguuguguuguguuguguuguuugagacagucuaucacuauguagccugauuggccuggaauucaucagguagaccaggcuggcaucuaaaucagagauucaccugccucuguauuuugacugcugggauuaaagguauguacaccaacauauuccccuaagaggggauggaucccagggucuagaugccauugcucucucuccccucucucuuuauaaauauaguuuuaagauuuuuacuuguauuuaucaguacaggggguggguugcuggaguaugccagaagagaguauuggaucgcuuggagcuagaguuacagggaauuuugagacaucuggggacugaauauaaguccccugaggagcagcaccccaacaugguaauacuucaucuuaaggcucaagagcaaacuuuggcuccaaguucugccucuagacacacggagcgccauuuggguucacagggcucuaagcuugccucgcuaggcacgcugacacagcacuucuugucagucggaaccaguugcuggcaccucucccaagcuguuuuugcauacugguggcucuauagcucuggcgucauaacugagagcaguguuuucauagcucuuuugggcauugcucucauugggggucuauucucugggcaaaagucgcuaagcacugugcugguagagacuuuauaucagccuuccucugguucucugcuuggcucucaaaacucauggaggaauccuuugaaaucuaggugaagcuagucaugacuccacagcucauacguuuggaggcagcaguuccuugcuaaauucuacuuugugugcauuaaugucuccuaagcaagucuaguagaaaauccuuuauaauaucaauuguaguacuucaaguuucuuccgcaucacggcaucggcugaguaacagucccccagauagauggaacaauagaagauuacaaagugagaaaaggaaggaaguagaaaaacugguguuuacuugguuccagcuguuuucugauucaggaagaaaggggccgggcauacucuacccauuuauaguaagaagauuuuuuuguuuugguggguuuuucgagacaggguuucucuguguaucccuggcuguccuggaacucacuuuguagaccaggcuggccucgaacucagaaaucugccugccucugccucccgagugcugggauuaaaggcaugcgccaccaugccaccacgcccggcuuguaguaaggagauuuaacuguaccauguaaggcaagagcuccucaugucagaguucaaaaaguaaaugugcugaaccaucacuugguuuagaacagcuuaagcccccagcccccaccccaccccaaaccaacccuugacuguuuaauugcugauaaggaauaaaagcccuuuccuauaaaccacuguuuguuuguuugcaacgaaaucagagauuuacuauauggauauuuaaaaauucagaauuugggggcuagagagauggcuuagagguuaagagcacuggcugcucuuccagagguccagagaacccaguuucaauuaccaacaaccacauacagaucacagcugucuguaacuucagcucuaagggauccuauaccaucacacagauauggaugcaggcaaaaaagcaucaaugcacauggaauaaaaauaaauaaaauuuuuaaaauuuggaauuuacaaauaaugaagaucccucacugguucagccacucaccgagguaccucacuccagcaauuuccccucaccagacuuauucauuuuuaaaguuuagauguuugaauauuuauuguaaaacagcaagcacaaugauuucuauuuuuauaauuggugacgugaucuggaaaaauacuucuaauugguaaggcaagagugauugcaaugcacucuucauuuuuuucuaacuucuuaaaguaucuucuuuuuuaaaauuaaaacuuuauuauaggggcuggagagauggcucagugguuaagagcacugacugcucuuccagagguccugaguucaauucccaggaaccucauaguggcucacaaccaucuguaaugagaucugaugcccucuucuggugugucugaagacagcuacaguguacuuagauauaauaaauaaaucuuuaaaaaaaaccuuuacuggaaggaguuacagagacaaaguuuggagcugauacaaaaggauggaacaucuagagacugccauauccagggauccaucccauaaucagccuccaaacgcugacaccauugcauacacuagcaagauuuugcuagaaggacccugauauagcugucucuagugagacuucgccugggccuagcaaacauauaaguggaugcucacagucagcuauuggauggaucacagggccuccaauggaggagcuaaagaaaguacccaaggagcuaaagggaucugcaacccuauagguggaacaacaauaugaacuaaccaguaccccccagagcucgugacucuagcugcauauguaucaaaagauggccuagucggccaucacuggaaagagaggcccauuggacaugcaaacuuuauaugccccaguacaggggaacgccagggccaaaaagugggaguggggggaaggguaugggggacuuuuuggauagcauuggaaauguaaaugaggaaaauaccuaauuaaaaaaaaaaacggggccuagcaaacacagaaguggaugaucacaguuagcuauuggaugggucacacggcccccaauggaggagcuagagaaauuacccaaggagcuaaagggaacugcaacccuauagauggaacaacauuaugaacuaaccacuaccccggagcucuugacucuagcugcauauguaucaaaagauggccuagucggccaucacugcaaagagaggcccauuggacuugcaaacuguauaugccccaguacaggggaaccccagggccaaaacgggggaguggguggguaguggauugggggggguggguauggcggacuuuugggauagcauugaaaauaaaaaaaaaccuuuacuauaaaaaaacuugcaaauaaaaaauuacccaccggagcuaaugaccagaucuuuaauaguuuuguuuuuuauauuguuauaguguuuguguucucagcacacuuaacaaaagcaacagaaaauauaagaaauuaaucuacucaacuaaacuaauuaaaguuuauuuugagacaggaucucacuauguaguccugaacuggaacucacuaugagcagcuggcuuuuaauuuaaagacccacagguuuuugccucuuuugccucuggagugcugggauuaaaggcaugagccagcagcaucccagacuacauuuuaagaaagggaaaaaagcuggucgccgggcaugguggcgcacgccuuuaaucccagcacuuggaaggcagaggcagguggauuucugaguucgaggccagccuggucuacagagugaguuccaggacagccaggacuauauagagaaacccugucucggggggggggaagaagaagaaaagaaaaaaaaaaaggaaaaaagcuagucaugauggugcaugucuuuaaucccagcacucgggaggcagaggcaggugaauuucugaguucgaggccagccuggucuacaaagugaguuccaggacagccagggcuacacagagaagccuugucucuaaaaaccaacuaaccaaccaaaccaaaaccaaaccaaaccaaaaaggaaaggaaaggaaaaaacgagguaauuagcauaauuagcaugacaaggaagggguagugagaaacagugacacagaaacgcaaagguuucaagcagaauuuauuggaaguuuggcaagcaacaaacacccuaguuggccuguagaugacuuuagauuguuuugcggugauuuucauuuugaagaaggauuuccaauuuucaaaacagccaggcucaaauuaaguauuuuccauuuauuuuagcaguuugguauagauuuguuuucggcuuaguguguagagauguuuguuuguuuguuuguuugucuguuuuccaucaggacuucauuuaugcaugagggcacaaugguagcugauggugacacguuucugccugccugcuuaaucaguuggguucauggcaccaucuguggaagaaagguuuucaauuauucucuauuuuucaguaaugccucccucgugaacaucuuuagaaaaggggccuuccaaggucuaccaagucuuaucgauucucucucuguguuuuguuguuugggagguuuuucuguguaauggcccuggccguccuggaaccuccuuuguagaccaggcagacuuugaacucagagagaucugccugccucuaucuccugagcacuggcauuaaaggugugugcuaccgccauccagcugauugcuuauauuaaagggcaaacaucaguguuucagcuauauuagaugccuacgugaaaaggcaguauggggcuggagaugcagcugguuaaguugcaugcugucaaaccugugagggugcauacguguaagaguacuugccaauacaagcaaugcuaaacaguuaaaugucuguuuccuucuuuaccuauggauguugucauugguuugcuuuguaaacuauaguuuugacgcugugaaagacagaaggcacuacagaaacuacaaaauccuuuuccuuugugugaaaugugaaaguuuuaagaaaacuuauaaagaaauugcacugauuugauuacuaaacgucaguucuacuuaaugccaagcuuagccaauaacuauuuaccucacuucuuuccaggaaaauguucaugguauuuuauuauuauuuuaaaaauuauaugucucugugucacaugagugcuauaucugcccagcucuugagcuguuuaagguuuacuguaaaugauaaaaguuguauguugggcuagagagauggcucaguaguuaagagcacugacugcucuuccaaagguccugaguucaaaucccagcaaccacaugguggcuugcaaccacccguaaugagaucugacgcccuuuucuggugcaucugaagacagcuauaguauacuuagauauaauaauaaauaaaucuuuuuaaaaacaguugugugucuuuuauuuaauuuauacaagugcuagugccuacaggggugauaggaauugggucuccuggagaugaaauuauaggugauugugagcagcuugacacaggugcuggggaucaagcuuggguccuccucuguaagagcaauaugagcuuuuaacuacugagccacaugguuuuaguucuuuauaggagacacuguuuuuuguuguuguuguuguucuuguuuuucccccuccguucugccaaguccuggagaguguucgagaccgugggucuauucuauauucucagagcucaauuguucuggaaagucagagccuaagagguaggaucucagaaguaggacuggcuguggauuggcugcucagcucuucccuagcuucuacuccuucacugugauuguagcuucagggauucuggcuccaggggcagcaguacaguuuagugcgaucugaacauuaggacccuauaaacuuguacugcuucagauccucccaguuccuucaaggucucauuucuuuuuuuucuugauaacuauuacucacaaucugguuccuacaggugaaaaccuuaucuacuccccagggaucucagcugaaccagccugcuggggcuccuccuuggccagauucaagagccuuggacuugguuuguuaacaaaggggagaggaggggcugcuuaucuggggaugucugagugggaaaggacaccagggacaguccuugagcuagaguccucccuuguggccaaaguacaguguaaucugugggaacagugaccauuugugucucuuccuuacccuugauguucuuugauugccuagaccauccucggaaugggauagggugccuucugucuccuggauacugggauugcaucauacucggcuuuuguaguacuaaggacucuaaccaaggaccucauucaugcaaggcaaguacuauaacuagugagcuacauccugauuaucccuccauugucuuauuuauuauuugguuaguuauuuauuugguagggucucacuauuuagcccuagcuugccuagaacuuguuauguagaccauguuggccuugaagucacagauacuugucaguugccucucugagugcuggagugcuaggcuuaaagguguguacccuagaccuggcuuccagugccuuuaaauucccuguauguaugucaggcugcaaggaugaaaugugugacuucaauaacaauccaaagggcaagaaagauaccugauucaguuucuuccaggucuuggucagcuuguggguucugaucagugaacaucucccuagaauauauaguguaaucaauugucaauaggcuaaauccaacaacuuagagagacaugaaaaucauucaugcacacacaugaaaauaugacccauuuauauuugaacuaagacaggcuaucuacccccaccuucuuugagacaggcucuuacuauauaguccuaaccagccuagaagccacuauguaaaucaugcucuacguagcucucaaaaagaaaucuggaaguggcaauguggugagguagagacggugauggagagcucaaggccagccuuuaucccaccagcagucugggaggcagaggcaaauggaagcuacuauguggagcaaguuggccuagaacuccugcuucugccucccaagugcuagaaugaaaggugugcacuaucuuaccugacuauuuuuccauuuuaaaggaaaaaagacaucaaaugugagccucccccugccagagccugacaaauacagagauggaugcuugaagccaacuauuggacuaagcacaggguccccaauggaggagcuaaagaaaggacugaagaaguugaagggguuugcaaccccacaggaagaacaauaugaaccaaccccaagagcucccagggacuaagucaucaacaaagaguacacauggcuccagcugcauacauugcagaggauggccuugucaugcaucaaugggaggaggggcgcuugguccuaugaaagcuugauagaugccccaguguaggggaauugagggugggaaggugggaguggguggguggguggguggaggaacauccucauagaagcaggggagggaggaugggauaaaggguuucgggggggagauguggaaaggggauauaacauuugaaauguaaauaaagaaaauauccaauaaaaggaaaaaggaaaaaaaagaagaaaaaauguaagccuccacuagcacaugacaaaugacaguacugaaaggacagagcaugaaaguucuucucuaggacauugcuuguacucaagagcagucacaugaauacaaauagacuuagggucucuuuuacucuuugaacucucugacuuccuacaaaaaugagagccaggcccacaaaaacaaaauccuacauaauuucauaccaaaaucaucugugagaaaagguacacacaaaacagaguagacaaaaacaaucuaucccauaaaggaacagcagcauauugcaacugauguguggaacuacagaccagaucacuacaacacuaugucauuacagacuucaucaucuuccuacguugcuucucaacugauaccaaggauaagacuaagcacaguuaauggauaaccaacuccuauuguauuucuccucccuggauuucccauaacccaagaacaauugagaauacauacauauacauggaggggcuugcuuuaauguugccagugaugacuuucacauuauugucuaugucucugucacugugacugguuucaucaucuucaguacaucccuauggagugauaaagacacaggggaaagucaaaauugaaguagauaauuuuuggcugucaaaggaggacuuuugucuuaauguuaacccuagaguugauagucuuaacugaugagaauaaaguugggacaaagcuuaguaaacaguuguaccuuauggacuacugcuucucucccacaucaagaucauuaguguagauaccuugauaaguuuugagaaaaugggccuuggguacaguguucuuauaaugguagauugcucacauuaaugaaagcaccagauacccugaagaaguuugacuugguucuagaauauuuuaguggcuuugguugcugacuauaauccucaauuggcuuuuauuacugcucacauuuauuuucuuucuuucaaaaucccaaaaggaaaucugaauguggcaguacacaucugcagucccaguacugaugagguagaggcaggacugagggcucgaagcccaguuuuuaaucccaccagcccucaggaggcagaggcaaccagaucucugugaguuugagggccagccuagucuacagagugaguuguacagugagaccuuguuucagaaauaaauaaggaaagaaggaggaguggagaggauuauaucugucuaggucucauucaccuuagcuccccagggcuaguguccuggcuucaggguaggcaaauagcagcuacuuggaaagaaucuuuacuuuggaaguaaauccucaauuuucauguauucuauauuagcaaauuugcaaauauuuuaauugccuuuuggucauuucagacacgcacagagaggugaacaauuugucaccugguuucagcucucaaacuuuaagcacacauccucuacauuguucaucuaauaucacaauuuccacauuuacauuccuuuugcuggcaaccuccaccccaaggcauagugcuaaaacucuaugcggugugucuaagcacacaaggcuguauugaugcugugucuuguucaaauuuuaaaguguguguguguguguguguguguguguguaagagagagagaaagagggagagggacagagagagagagagagagagagagagagagauuggcucucaccuucuaccuucucugggacaggguaagucuuauuucugccaugcugcguaguucaggcuaacuggccuacaaccuuccagaccauucugucucugccucucaccucaccauagacauucuaggaucacacauucaaggcaccacaucuggcuuuuaaaaacacuuuuuaugggcuaaaauaccuuuucacagacacacacuuuagaaaaugauacuaaaaauacacagugcgccagaagcugaaugacacacaauaagguagaacugucaccgcucuuucuguauacugugcuucaauaauucggccaagaauaaacuugcuacgugugcaguuacacuuuaguuuauucaugguauauacuaccaaggaaaauuuuggggguauauaauuaaacacauuaucaguuuguuuggauuuuuaaaaagcucuucucgcauacauaacauucugacugcauuuccccuccuuccaguccuccuaguucuccacccccagcccagccccaugagcuccccucucccccagauuuguuuggaaacuuuuaaagugaggcuuucgaaaauggaugcacuaugggcuggagaguuagcagagcacuuaguaguucucacugcuauuccagaaggccugagcuuaauuuccaucacccacauuguacaacuagcucacaagcucuuuuuguuuuuguuuuuuguuuguuuguuucuguuuuuguuuuuuugagacaggguuucucuguguagcccuggcuguccuggaacucacucuguagaccaggcuggccucgaacucagaaaucugccugccucugccucccgagugcugggauuaaaggcaugcgccaccacacccagcugcucacaagcucuuauaacuccuaacuauaggggaucuucugggaaacaauugaccaucaauuaaauacaaucuuagcgugauucaguuuucaguggacaucauuaucauuaucauuaucauuaucauuaucauuaucauuauccuaguaccauaucuauugcaucauguuuagagcuuauccacccuugacauuuguguuuuuucagagucccaucuugguguguuucugucuuccuuggaccacuuacagcuuggcaaguguccucaucaucgguacugcugacucuguccuccugaagaauaucuugcaggugaagaaauucggcagcgcuagagaaaaaugucauaauaauaaauacacuggagagucauuuaucucaaugacagacuacaugcaauucagaaaccgacauacuaaucuguugcuuaaaguaaaaucaggggccaaauaaaugauugaauaacuaugauuuacuucagaaaaaugccuugaacaaaaucuaaaagcugaagcgugucaccuagaguaaccuuuucauuguauagauuaaagaacugaaauagugaggugaaucuguuuuuugacuauaacuuuguugcacuucuacuggcuuacuugauauauguauuuuguuccccaaacacuuuccuuuuaaaagcuucaguuuuggaauuuuaucaaguuuguucuuguuuuuuguuuguuuguuugguuuuugguuuuucgagacaggguuucucuguauggucuuggcuguccuggaacucacuuuguagaccaggcuggccucgaacucagaaauccgccugucucugccucccaagugcugggauuaaaggcgugcgccaccacgcccgguuuguuuuuuguucaggucacaaucaccagccuaauuuugauucccaauauucuuuuuuuuuuuuuuuuuuuuuuuggagacaggguuucucuguauagcccuggcuguccuggaacucacuuuguagaccaggcuggucucgaacucagaaaucugccugccucugccuccugagugcugggauuaaaggcaugcaccaccaucacccggcgauucccaauauuuuuaacagaaacagauuuguuccuaacaguagucccuaaaugauuuaacuauauugcaauuugggcccuggaucauccacaguggagaaugugugcuuuucaaggcagucuagaccaagauucuacaaguagguguggcugugcuuguguuccuacccucuguuuucaugaaacaaauaggcuacauuuucuccuagaguuucugggaguuccauuaucaguucucugggacacugugccucauucacuagucuuagcaacuagaaugcuucuggccuugggaacaucccccaugaaaacugaguacaaaagagaaauugauaucuaccauguucauaacaaggguuucagaacacugugggaaauaaaaguccaaagaaaauuuuuuagucuuacugcaguaacacuuuuuuaaaaaacucacagcaacuuaccaguuucaauccacaagaagacuaaaggcucuuuucuuuuuuuugggggggggagcgucauagauucccggcuacugcucuaggaugucucauggaaguguacauuucugugcugagcaucaaauuguguggcaaggucaugcaagauguauuucuuguucacuuggguggaaaucagcugcugacaccaaaggugaccauugcugaugugaagaaaguguugcacaacuuaccucaguggcucaucugccugaucgucggugucaucaucugugaucaugaaaaaucaaaugugaaagugcagcuaggaagcaaagggugguagaaaggagggguugggaucaaaggccucuugagcuuaaacugcugggugcaggagacugcuaccugcucaaugauauuguugaagcuaaauacaacagagauuuuuuuguuuacaaccuguggaauaguuaguuggagauuggacccuuuaaacaagcaagaauauaaaaagaaaaaaaaauaaaaguugucguuuacuaccuuuuuuaguguuuuaaauuuuguauuuacacauaccaaaaaaauaguauuuucauuuauuguuuugacuauuuguaaguaaacuuggaaaaagaucccuucagcauuauuuagcacuuuuucaaacacauuagguucuugaaaugggugaaggaaaaugagcuuaaagggggaugcagaacaaaaagguaccugaguuccucuucagaccgggcccacuccagcacuaaaggagagaacccgagcugcugaguucauucccaugaaggcuuaacuguuggguuuugguuuugguuuauuuuuuguuuuugguuuuuaaagaccuagacugucaacacauaaauaaaaaccaaaaugacaacaacaacagaagcaaaaauaucaagguggggguugggggugggguuccaaggugcaauacuugcccagagcagaggacggcccaggcuggaaucccagaacugcgaaagaaacaagagagaauaaaaaggcaaacugaggauuaaaacauacacagacucaaaugcaaauaaaacuuguguuuaauguguuagaagucaaagcacuuugaaaauauccucacauguauuccauguuuuaggagguauaggagcaagaauauauagauuuuaugggcuguuauggaggaagcuuaaacaacuuuauugauauuuuguuuguuuggagguagggucucacuguauauagcccuaccuggccuggaguucucuauguagaacaggcuagccucagaguuaaagagguuuccauaccuaugccuuccaaggggcuagcauuaaauguauaugcuaccauaucuagcucacuuucuguuucuuguuuuguuuuguuuuucucaaugcagaguuucucuguguaguccuggcucucuuggaacucacucuguagaccaagauggccuugaauuuagagauccaccugccucugccuccugaguacugagauuaagggcacgcaccuccacugcccggcuucccgcguacuuucuuuuauuuuuuuuuauauauuuuuuauuacauauuuuccucaauuacauuuccaaugcuaucccaaaagucccccauacccucccccccccacuccccuacccacccacucccccuuuuuggcccuggcguucccguguacuggggcauauaaaguuugccuguccaaugggccucucuuuccagugauggccgacuaggccaucuuuugauacauaugcagcuagagucacgagcucugggggguacugguuaguucauauuguuguuccaccuauaggguugcagaucccuuuagcuccuuggguacuuucucuagcuccucuauugggagcccugaaaaugaauccaacguauauguuaaaugucuuaguuuauaaguuuuuuguuguucuugaguagguccuucaguuugauuuaggagcaauaccagauaacccacauucgaggagaacguagaaagaagaugguaacugcaggcucauacuggaacauucuaaucuauaaaagacaauccuuuccaacagucuaccaccuccagguccacaugguuaacuaacacugauuuaauucauucgcaaccgucugugucauucugguugccuccaguuaaagggaaucucugguuuaguuugacagcuuuggagaaaacuaaggauccuaggaugauauuacuuagauaucaagggagagguggcaugagaaaugaaaacccuggggagacaggagaugguuuccccuuugcuccuggggaauuugaaagaaacagugucccuggacucgugcccagaggagucacuuuccucuuuccgguaacuauaaaaaaguaaguagguuuuuaccuuugaaaagccaguuuucuucauccucgaauucuggcaaguccauugcacugcauucugcuucagaggucuuggggcuuugcuuuucagacauagcuccgggauucggcuucuguggagggagaccuuguugguggagcugauacccaagucuaggugggugcugugaauaaaggccuga

SEQ ID NO: 9679 - RNA, 22879 nt, Mus musculus
uuucaaaacaaagcauuuuauuuaacagcaaacuaccccacccacucaaccacccacccacccacccacccacccauccacccacccacacacggacucauugugacauguugguaagcaacaguuuuuuuuuucaagucuucaaaacacccaagagucaacagaaguucuguauuccgcauccguucacaaaguccagguguuuuccauguguuuuuucacaguuggugggaagaugacuccagucuuucaacaacagauugguacacaguucauuuaugugaucaaagcagaugaugguaggaugugcuuaauugguagcaauauugauggcaguaacugugaaaggaaggcuuucaguuauuuuuuccuuugcaaauuccagaaauguaagcccauuccuacccauacaaagggauauuacugaauccagccaauuuccacuaauuaaaagcuaauauuaguaacacuuuugaugcccaauugaguuuuaaugaaaaugaaaaaaauuuguuugaacucccagaccucuucaaccuggcuccaucuucucuguuccuuuucuuuugccugaauguccugauuggguuacuaaguaaagucuagauacuuugaaaguaugcguaugcuacaaugaauaagcuuccuuacagcaaauugugacuucagcucuaaggcaacuuggauaaagagaucacauugacuuaaucuguuucauucccauuugacucaaggcuuagcugauagccauuuagaugaaaauacauuuucagaaacauuuagcgaauuaauaccaauuuuguggaacugcauuaaagucccaacuuagauuccagauagacaggcuggacccuuuccuucacucggccuccugucccacccucugugagugaaagaaaaauggaaagggucaaagcacaggcauuuuuaaucuuuuucaaguucuuucaauuuggucuuucguuccuccaguuuucugauuguugucaauuuuauuauucuuaaauuuuaugcaagaauguuaaacauuaauguuauuuucauccacuggcauuauuuuaccauagcaagccaccuugaguauauuauaguaaggagaacauuucuaaauuacugugagcauuagcauguaaaaagguaaaagguuuaacgaacacaggcaaaauuggucaauguauuucaaagccugcugcagcucaaaaauggcuuguuugccccaggauaaugcaaaguagccuaagauuguggaacuuagauggcugucaucccuccugaccaguaguggucacagucauagcuaaaauggccuagaaaauugaguuucuuagcguggagggcuucuguaacuuuagggucaggcuugcuacaaagcccagcuucccacucauugcaguggccggagaagacaugaggaugaggacucacauugcauauuacuuggggacuaaggacuaagucgugccacuacccagaaaagagaccccccccccccauccagcacuucccuaugucuauguuuccuuuuuccaugucucaggagccaagugaaggccuaagagacaugcaaauccuuguagaacaggcgaaccaauaaagcaaaugaaugaauaauaaccuuccuguauucaaccucugaggcaaacugugggaaaugaggaaaguguucuucagucuagaaaacguuugagcuaauauuucuguuuaauaaagagcaucccucugcuuuccggggcaucuguaagucacacugagugcccuuuuggaacaaauguguugcacuuagcauccaguagcaucuucugcaauguguggaaccgaggaaauagagaaccucuuuuauuauuuccacucuaccaagcaugcccaugaggaggggagcaacuuuuuauuuaacuugccuccucuacaccuugauguuuuucccagcuaaagugagagcuguagucucaaggugugacugcaguccccucagaaacuacugagguaaaguacacuuuggguugcauccuuuaaaugucuuuguucuuuucaguacuuagaaauuuuaguacuuagaacugcacuuucaucacacuuaaguuaaaaguaugagugugauaguauauucuucuugcucacaugacgcugagccaggcaaugaacaaauacguuuagaauuaucgauucaucuugauucuccuuugaaacacuucaacaguaagaaaaggaaaauggguaaugaauuaaaggacagacuuuaagucuguccuggcuucaagcuaggccaaugagaaaaugacuuuuggagcuuccuuagcuaggaagucuccaguuuauguugaaggaaucuuggccuugguuggguuucgcaaacagccauuauaguuaaaauauuuacucagaaggcuggagagaugacucagugguuaagagucugacugcucuuccgaagguccugaguucaaaucccaacaaccacaugggggcucacaaccaucuguaaugugauguggugcccucuucuggugugucugaagacagcaacagcguacucauauacauaaaauauauaauucuuuaaaaauauuauucacucaguaaucagauauauucuucaggcugggcauggguuaagcacaucuguaaucucagcacuugagaagcugugacagucaccaauuagaaccagccugggcuuuaugagaccaugucuccuaugaucagugaucuacacuagguccaccucacauuuuaguuuuaggaccuagguuagcauauuuuauauacaauguuucauuagguguuguguucugcaugcuuggucccuccagccaguacaucuaguucgagagguucugggccacacugaguacaugccaucagaugcucuggccucuucccguuuuguucccugauacccaugcucugggauuaucucacucuggcccuauaaaacuccuuuacuggcaagguguuuguaauucaucucuggcagcagcauucaacaaacauuuaagaaacuggauggaaaaaguuccugucauuaauaaaaccuuuuccaccuccucagucaagccagcugggaaguauccuagacagcauaguccacucaguguaacauuuagcacacugccuugcacaaauccauuuuuuuuuucuguuuucauuuccucauugaagugaauugaaguuuuggucuagauuucacuccuauaagugcuacauaaugcuagaaagcaaucuauguguucgcucaacacauagcaugguaaaauuauuauuaggugguguuaggugauaagcauuaugauuaaguuucagccauuaugaaacuuagaaaguaaucacuguucacugauaaagccaacaguuaggucccggcuuuauagaacuguagacuucacaaagcuccacacagaucuguugugcaugccugggauaaaagcaaagucauugcacaccaggcaaauauugcauauauacacauauauauggcaguuuacaaauuauaaauuaaucucaugcauaauuucuuuagauacacaggacaaugagaaugcucuuugcaucccagugccuagcaagggcacuguuuuguaauaaaugacugccauucaguauguacucaucaaguauugaaugcuucauauauucagugguucacaguuacuuauuuacuuuauuuucacaguauaauaaauguggcagaauuuuaaaagccuggaaauugauaccaaguaagaaaaugaauuguuacauuuauaugguaccuccgaguucauaaaaugccaacguacauauuauucucaaguguggacacacugaaauguacgucuguguaucucuccaguacccaugaaagagaauauacacaugggagacaauauuuagccuccagguuugagauugaccuuauggucuucccaggcuagccuccaauuucugggcucaagugguccuguugcuucagcucagagcacaugcuaccacacccagcuuguuaacuguacucuucccauuaugggcuaaaaaguacaaugaaaauuuuguagagacuaugccuauuuuauaggcagcuuuauuucuauagaaaauuugucuugucuuauacuacugaacugcuuuauaguuaagaaaguacccacaaccauaaugugaccugggcaaauguucuuguauuaacaugcccuuaucacucaaguuuugacugauuaaauuaagcauuggcucauuccuuaugaauaguauggaaugcaaacauucuuauuucauggcaguuacucaugaauauuucauguacccaaaacaauaucggauacaucagagguaguuaguagucauucauuugcacacauggaacaauugauagcuguauaaugcuuuauuuaaugcauucuuuuguaaauucuaguucugugguaaugucccccuuuguuauucccagugcugaacauggguauucagaaauuagaaggugaucagaauaggguaaucaaucaccugcauuagugaccuaguuuguaguuuaaaaucaguuuccauguguuuucucuucugcuaccugguauaauauaacuuacugagccucaccaaagcagaagaaacacacuggccuuaaguauauggacuguuauucauucaagccccguuauguucauauauuuguuuuuacaaagcauguuauuccuagagcaaucuuugugccuauagcacacagaggcguagacuucagcuacuauguaauacauacucagcacugacuuggaaguuacaguaggcuucaugguuuacguauucauacguuuccugguuaccugguaauaucuuguuaccugggggugaccacagugaagcaucacagccuuaguauucagcacaaaaaauaugcagggaaggaaauuaauguuacucagacauucccuggcauucauaucagggcuugaucaaguacaggcaauagaccagugugccuuuuucuuaccuuuugaaaaggauuugcaacuaaggaauaugcaacuaagaccaugaacccacaaagcuucagguacuuagucugaugccuuauaggaaaagcucuacacuuucagauaauaaccauguauaauugccaaugugcuaugagcauguuacuuuuucauccugugucauuuaacuucccucuuacagaggaagaggaaggcacgaaaaagauuaagcccguuaaguaguccuuagagucucucaucauuaauuuuaaagguagguauuagacccaggaguuccuuuggugaaaugcaccaaauuacucggccacuacuaugagcagggaguucagaccucauuuuguccccaaaccauuauuagaaaaccauacccugcucaccuaagcccaaagaaagaaggugacacuggcuggugcuucucagaggguuggcacaucugcauauugcuugucuaauucuucucauuggucuggaacaacucuuuauauuuucucuagauagccugacauuguuuucccccuaacaaccugaugcuuuccuuuucuugucagccuagggcuucugagguagggaggauggcaguaugcauaucuguaugcaugcuuauuccuagggaaguuucaauagucaggcuauauacacuggcuggauuuaguuccgucucaaguggagcagaugugaagagaaauggaaguuguaaaacaucaacaauuuaacaaauggcuaagacccaguuuaaaacagacccuugcacaauacuauccagcuaaaaacguauuccuuuaugggcaauggcaacaaugaaaaauuacaucucaagugaagacagcuuaaauagaaauauaagaaauggaaagggaugcugggguuggggggcaggucucaucuucgaauuucccuucuuggucuuggggauagaaggauagaaauauccuuccagaguucugggccauaggccuuuaucucuuaaauauucuguccauauaggauuggguccuuaggucuuaugcuuggacuuagcucagguuuugugucuuaugacauacguaguuccccgcucuuggaagucacagguguccuguagaaacaguuccucuucuuuggguugucagcauucuguccagccagcucaagacgggccaucuguguauuuugguccuuuuaaaucucaagucgcaaaacuucugucuucuacuugggcguucacuucagagccacuugaauccugaccggacggaaugauguauuuugucuuagauuauuucucagggcagucuggugugaggaacggcuccacgggugacauucuggaccuauugggaaggggcuaugaagcuccucucacacaugacacacauaacacacaugcacacacgcacauguacauacaaagaaacauccaagaaaggauuacuuuagaauacaagagagacacagacuuguaaagagaugaaaugcucaaagugaacagaaaggaggaaaguagaagauagaaacacaagcaaacacaaagcaacagaaugaugcugagauaagaaauccaccaauagcaaagagacacaaauacaaaagaaaacagagaaaguggcccaagaaaggcagggaagaaauguaaacaagaauucacuaaggauagaagcagcagaaagaaaacugaaauggacugacaaagagaacuugaacaaagaacaaguggggugagcacaagaaaaagagagggaugcaugcaacaugugacccaaaggggagucacgaaaggcaggagugaaagaaaagcuaagagaaauagcaaccagauagauaaaacagagagccauagcuagugaagacaaagcagaccacacaggcaccagagaaagugaaacaaagcucaaagcucugcaagaaagaacaugcaggagaaacaugggaauagguaagacacacugcagacagaaaagacacacaaaggaaagaaggagacaugcaaaggaaggaagaaauagauguaacaaagaauuagacacacaaggaagaaguagauacacaaaacaaggaagacauagacacacaaagcaaggaagacauagacacacaaagcaaggaagaaauagacacacaaagcaaggaagaaauagaugcaacaacgaauuagacaacacaaggagacauagacacacaaagcaaugaagaaauauauauaccaaagaauuagacacaaugcaaggaagaaauagacacacaaaagcaaggaagaaauagauguaacaaagaauuagacacaacugcaaggaagaaauagacacacaaaagcaagaaagaaagacacacaaaagcaaggaagaaauagauguaacaaagaauuagacacaacugcaaggaagaaauagacacaaagcaaggaagacagacacacaaagcaaggaagaaauagauauaacaaagaauuagacacaaugcaaggaagaaauagacacacaaagcaaggaagaaauagauguaacaaagaauuagacacaacugcaaggaagaaauagacacaaagcaaggaagaaauagauauaacaaagaauuagacauaaugcaaggaagaaauagacacacaaagcaaggaagaaauagacacacaaagcaaggaagaaauagauguaacaaagaauuagacacacagaccaaggaaaaaauagauacauaaaacaagaaauagacacacccacaauacacacuaaugauugauaguaagcaaagaccaccagaaagaggguaacaagaaacagggaagggcaaagaaaaaaauugccauuaguacacuguaccaggcuaucaacguuaaacuuaagguuuccuuaacauaggaccauaggacacacccgucaacucuuccaaauggccuagucaugcaacuccagggcauauuugccaggcucuguacucaacacuuuccauucaugauuucauuugaccuucacaaacagacaggucuuagcagaacuaaauugccaaagggcauacaucuaggggauauuacauuuaaacacagaaugaacaucucaacauucuguuacauggauuaaaagcuucuguaagcagcaaacacuauaagcgacugcauauuuaauugucagcuucacucuccucuucuauuaaaaaaaagggggggcuugguuuuuacauccuucacaagucuaauggcugcuucacagauggagauaagaaauaaacuauuuaaagcuuuucaauguuuaagucuguaagaaugguagggcaccaagccaaaacaaacaacaacaacaacaaaaccuagaagcuaaauuccucuugugauauaacugguaagcagauaauaguuugaguugcugcugugaggccauuugauaacgugaaagccuguucaucuuccaucguguacauggcccugccucacauuaucacauuagaugcucuccacccagcaccaucuuccagcaaaugcaaauccucagaagacugcaaugcuagugacuuaccucauucuauugcuuuuaagaugcugcagucaggcauguugauccucgggucauuuauaaagcugccuuccuuuuguguguucacauugcuugaucacgcugaagacccaguuuucugugcugcuuuggggaaggguaauauuugguagauggcacuacaaagaacaaaagaagcuguaugaaugccaggaaagaaguacuagaacauccuggcucuuuaaauucugccuaaugauagauacuucuguaucaauuccagccagguuuccauuuguaguuagaggcauucaucaucaguaauguuagugauggcucagugguuaagagcaccuauugcucuuccagagguccugaguucaauccccagcaaccacaugguggcgcacaaccaucuguaaugagaucuggugcucucuucuggugugucugaggacagcaacaguguacucguaaauagcuagguagguaaauaagcuacucacuuguguauuauauggcaugaguaggguagcagugcaucuugaaguauguaaacagcuggcaaagcuuuccuagcuucuggagagagaaccaaauagagcagaauggcuuccucgaaggucagugccacuauugcagcagcuuuucuccuagaagaaacauuugcacuguuuaguuacauuucccagaugugggaaaaagauaaaauuuauguauauaucucaaguaaaaggcugacuuuaauggaaaacaagaucaaaguuaaaauuauuacacuguugcagaaaacuuaccuacuuugauguaggguggcauucuuugagccuuugucuuccuugcuggguucaggaaagcgucucacugaaaucugggcuaggccuguugcccagugguggugagcuauuccccuggaggauccucaugccccaucuccaccuagggaucgucaaagggaauaggucgccagcacugcaaagcagcaagcccacaauucuggggggagaucuggaaaagaggugaaagaaaagccaauucuugaaaucaagaauacugggaaaguugucucauuauguaguaaccagcaguuguguuaaaucauggggaggggcuuggagagugaacccuucacauuuguagaucuuaguguuaacuuagagacaugagaauugcuccauccaaguucuuucuggcuuuuauucugucaccuaccaaugagagauccuuuagauuauagguuguguuaaaguccuuguacuucaaauacucugggaauaaagggguuaaauuauuuucuucuuuuaauuugugcuuuaaacaauaccaugccagaacacuggcaaggugaauagcauuguuuggcucagugcuuauggugcauaugucccuagaaacugguguagcauuggaccucugaguuugaggauauucagagaccagaauuaugacaggccuacagaaugugacaacagccauaucuacuuacucuaucaaguacaaaagacuagggugucagaaacuggccuucauuccucugauaaccuaccuuuuaggcauuucagagcagaaauguuacagauuggucauaacaugguggggaugauuucaaggccucaucauaaggcaaggaucucauuggcuaacugacuaugccaggggaccaggagauggggagugcuuuauugacuugcccccucauucucugaugaacuggagaucagauagaaacccccaaauagcaaauucuccaaaguaccuuuuuuucuccauguggccuguaagcuuuuuguucagaguagcgaggacuugaagagaaguucugcugagauguaauguagcuguauaggcugcuggcaguccuugagucucacauagggauuguuugucccugugaagaaauacaaggcuaucauuagacuacaaaaauuguugaaaauuccacaugaaaauaaugagguauuuacuuaggagguauaacuugacacauuagaccuuuaagggaagauacuaucucagucaaccaaguaacggaaauaccuuugggcucucuccagcacucuucacuccucuaaauccaggcaauccuucuucuugaggcaggagcacaaaacagacuccaaauucaucccuggaaaacaaaugauaauuauacuaaacucuacaaaugauaauuugauuacuagcaauacaaucuucauaugcacaugucagcguuuucaauuggugguaagaacucagggugaggauauguucucauggaaccccuaguucuuaagagaugugaaaacagccuuuaaaauugaaagcaugucuacauuucaaaggccuuucauuucuuuucccuuuuuguauauuugaguacucuaucugcauguaugccugugugccagaagagggagucagacgucauuacagaugguugugagccaccaugugguugcugggaauuguacucaggaccucuggaagacuaacagaaccaucucuccagcucucgucuuaagugagcuuucucuuuuccuguuuuauuuaaaauuaacaaaacuuucuuaugacuacacaaauagagccaucuuccccugggaugagccagaggacuaaguaaggggcaggcagaagagguucacuggacugggagagagggcacagguuggacaguggcuagguuauauggcaguaugcauacaaagaccuggucugguucugccacagggcuuuguaaaaucagcuggcaaaauccacuacuuccacuucccaccacuuaaugaagguguacauucucaaauucacuuguucuacaggguucuuuguuuacaaacuccuaagucugggucaagccauuggacagcuuggaagaaagcucauucuucuuuuuuuuucaagacaggguuucucuguguagcccuggcuguccuggaacucacucuguagaccaggcuggccucgaacucagagauccgccugccucugccucccaagugcugggauuaaaggcucgagcuaccacugcccggcugaaagcucauucuuaauguauacaguucaggcagccugaagauggugauggcgaguugguggcuuuccauuacaugauuacugacagugagggcugggucaggacacuaauuuggggaacucuuuguauuccaucaauuauggggaccaaagauggccuccagaugguuuugugugauggcaccuccuaauggacauuucaaucacagacaagcucauguuccagauguccuacuacaaauaaguguguauuuuacagugccguggaggucauguaggacuagguugccaugacagaauuggcccugauuaaugaucugccugcucacacaacuugaucauuucaauagggaacugucagugauaguggguuuacugugaauagcagcaguaccagcuuccuccaggccacuaacuggagucugaguccuaaucucuauuuagguccauaggaggcaggcugaaagcucuaggugccuaggcaagccugggggggggggucacuuugcauguacugggguggguagccaauggugcuaaggugagaccgaagcuuuagcuaacugucuuagugcaccaaacacauucuuuagcaucucaaaaagcuuuuuuuccuugcaaauguuuccuuuugaagcaguuacuuguacaacaaugguccuaguuuccuaaaagacucaauaguucuagauguauuaucaccuagagagccagacaaugcuaagccuuuggaguugggggaaaccugcugcgaaggaauuuacaguggacuuaaaaggguuaaaguacuagagggucauuugcacguacaaaaggcaaaugcaaaaaaauguuaaguguuauggacaaggauguuuuuucagcuagaccauuuucuacacaggagucaaguauuuguuguuuuaacugaaaguaucuguugaaaagugcuggcagggguccaguguggcacccacccuuaaucccaacacucuaaacuggaggcagaggcgggcggaucucugcgggcggaucucuugaguuugaguuccaggauagccagacuacacagagaaucccugucacaaaacaaaacagagaacaaaacaaaauuaauugauuaauuaaugaaaaagaaaaaugagcaaggaggguacauaaaguaguccauaguaaaauuuguucauaaaacuuauccuucuuugcacuuuuguaaaaaaaaaaaaaaaaaaaaaaaaaaaaaaaaaaaaaaaaaaaaaaaaagauuguaagcuaugaaguucucugucuaagcuguuagugccguccaguggucuguucugggcagaaaugcaguaaaaaugguugaaagaaccaaauuaucaaauuuauauucccaauuccuacacaagcucaucucuugcuacccuuggcguacagcuaagcauaaugcauggagucuuucacucuuaauauucuuuccaugcuuccaagagguagauagaaacagauggcauucagauaaaccaaccagaugguacuaauagucgucuggaccaacaaggcaaaguaagcacacuucccucuuuaagaagucaaauuucaaccccaguagacuuccuaaaauacuuaaacaauucacacaggcaguacauuuccuaaaaugaucucaagugugcuuauauuacauuaagucuuaaauaacauaaucaucucacggaagaaauuuuguaaaauaucaucgcuucucauuuuaguguaccccagcauaauggcgauuggguacacaauguguuaauucuacaauuucguuggcauacuauguguuguguauggauaagcugagaagagcuagugacuuauuagucacuuugacuuuucaguggguggcacagaaagaaacucgaaugagaaaaagauagcuuaguagcuaacaagguaguacuuacuguagucuaaacagccagagucugauguaacggaggagcaguaguucaagcaggauccugcacuggaugaguuacuugaacauccuccucagaaaaauaguaucauuucucaguaaugcugggagaacugcuguugugaugauuauuuucaucagcaaugucauaucaaacacucagcagcgggauggcaagauggcacgcggaggguaaaggcacuugcugccaagccugaugaucucacuuugaucuccaggacccacaagauagacgaaccagcucccauuguugucugagcaccaugugaaugaaugacugcgcgcagcaacaugcauguacacacacacauacauacacucauacacaauagcucccaaaaaagaccuaaguacucggcggcuacaaagcacccuucacacuagagaaagcucuuuucuuacuaggaaaaucucucuuugaaguguacguuuaaaggaaugauuagauccuggcagacauauuuuaaaauguaaaguggggaaacagguucuaucaucucuaaaauaaauucccacuuuaggaauuuucaagcuacuucaaauuauugccagaguuuaaugguggauagaaugaauuaauuaaaugugauggccuauauaauuuucaaaggcgacuugacauguucucaaauuuaauccauccagucaccuuuuaaaaauaagcaaggacuggugaccaaugucagacaaaauauaaugauuagaaggcuuaggucaucuuccaaaaaguuaaucauacuaaaggccacacaaagauugacuuuuucguuuuguuaaacuuguaguaaagaccaagcaaagauacuugucuuaaacauucugcaauaguugcacugaucuuuccacagacucaucacccucaguacacugagacacugcuuagucuucagaaacaugacacaaauggcuauuuuuacuucacaaaagcuaaugaucucacagucaauccaccuugcaauccaaaugccuuucuuaaggaauaaaauuaucaauaacuuuucuggcaguugguccuguacaguagcaauauacaaaaucgggcuuaaaguuucuuaagcagacaguuggcuccuuccuggaggaagaacggaaagaaaagugcuaagcuuccuucucaggaagacaauuuucaguucauacuguaaaggaaagccccaaguaaaagguggcaauccaacucccugagcuacuugccugcaauauuuugcacaauaaagcauuaauaaagguaggcaagaaugguuccuggcccuagaaugugccagcaguuggaauuggaauaauuuagaagugcaaguuaaagauugaaggcucauccaccuaguuuuggccugcuuuugcuauucaguguauaaauacaccaaaauuuauuaaugacacauaggguguuugggguaauuaacauuacccagaauaauguaagaauucgaggugucucuguucagugggagcaaggagaaggcaacugagacacuguagccauaugaagugaguaaacugguguuguugacuuuaagucaagagaagggcuuugcccagucaauacuguucaaacaaagaggcaaaagggauggcaugauggaauugagaaagggcacaaacucuuccuuaaugauggguuugugagaauuagugauucagaaaaguggucaauggacaaacuagaggccgggcaaaaggaacacuauaaagugugagauugugacuauuuaggauuguauauauuaaagcaaugcaaaaagggucgaaauccgggucauuguuggguguacauacugcuguacuuuauuauaucauugggaaacuagcaggggauuugcucaaguuggaguagaaaauaaaccauccagaacugccauugugccuauuaagagucccaaaaucaguuuaaggaagagagcaggucauucgucagagccccugugcucauugacaguaccggguaguuucgggggcucagcaaccucugcaauaauguaaaggggacaaaauauuccagacauucauaguuauaaauacgcauaacuuagcaauuaauucugggacucaguagccuugaugguaugcaaagagagcacacagguccuugacauuuuugcauaguaaucauccaaaugcugagguuacuaauaguuacuaccacucagcagccccagucaaaagguaggcauuucagaaccuuugcugccgcacaggucauauguguaaggguacagauuaauauugacaagagaagugcucagaaauaauuaauaugccucuggugucaaaagaguacaaggauguaaaauccaacuccaaagguaaugauggacaacuaacugcauuaaugcacuuaaguccaaaugaagagcacuucguacaacccucuuucugcuuuaaagcggagaagaggguacaguaguucuuagagaagugcuuagacaugugaacuuuccaaaugaaagucuugagcuuauuaucacuuccugcugaaggugcuaaggaagugagugggauccuuucaagugcacagagcagguggcagugcauacgcauacauuuaauauaugauaacaguccaaaagaaugcggccuuguugaucagcauauccugauauagugcaaaugaaaggcgaaggaguauggccuuuguuuacuggcaaagacaaaggaagauucacuguauauuaaugguccacuagcagggaccuugggagauaaacgguaucccuugcaggagugcaagagauacaaugguccgaaaaguaauaagguuguggauaaguguaauuuuacacauuaacuggccaaguauuuuuauuaaaaugaauggaucaugucccuguuauauacauuaauguucaagggacauguuaucaauuaaaaaccccauccuuuaugcaaauauuaagucuuuaaaguaauaguccuggaaauuaaagaguggaaaggaggggacagccuuauccaguguccaggaagaugaagaagccaaaagauuagugacccuugcuguacugcaaaaggguuugagaguaggaucguauccaaauggaaugagaugugugcaguaaaugcauacuaauaugcaagguacauguuuauggccauuacaguuuuacgcuguucagguuuccuucuguagugaacagaaaaggccuacuacaaucagucauuauuauuagcaagccacaaaaugggaccuuauaggucaacaccacuucuguacuucaaaguuaagaguaaaauugauccuacuaaaauugccaguauguacauaaauaguuugaggaagggguuucaagugcacagcacauacauaauuccauaaagcaaagaggauaugaaugaucagagacagaagucuuaccuugaaggaccauugaccguauuggaaucguuucaaucuauagucucaugaaagaagcuuuauauuagugagccucuuugcuuugcuaaguacaggaguccugaucuaaaaggcacaacuguggacaugagaauauguacaauagaguuaacacugugcacauuuacuauguuaaggaucuuaaauacugcugcaauacaaauaagucuucaccagaugcagauuacuacagugaaaugacauaugcacauucacaauaugaaagacugcaugcagggcauagugguaggaaccagauaugccaacacuuguuaaacgcaggcuagauccugagcucaaggcuagccuggguuauaugcuaaguuccaggccagccuggaaguuaaaaacaggacagaucaaaggucuucuugauuaccaacaaaaugacuugacuuaguuugguuucuuuauccaaugcuuaggaagagggacaaaugcagcugugcacacaacaggcacaaauauguuuacauuacagguggcaaugccuguaagucccgcccagcccaggcuacauaagaggcuguucucucaaaccaccacacgguggggcuguagcucuaugacagugcuuuacuagcguacacaagacucaagguuugauuccccagcacagcagaaagaccagaacagagaaguggucucauugguuggcacccuugauugucacccauuaggguaugaggguaugggaucuugguuacuaacagaaggggacuugaacaacugcaauuuugcacaauuguguaagaggcauuaaguaaucagcacccucuuuacauaaagcaaggguaguauuaggaccuugagaaaagacucaauuccuagucaggauuauccacauaaaauguuccagugcagagguuuuuggcugaaauaagaaagcaugugagacuaguauacaauaucaugagcaaauaaauguaucuccaucaguuagaaagaugugaccuggggcgauagcacccaugacagcaugccaacaguauauaguauucuacccccuuuaauggccaaugccuugaaaauugggacugagcacuuuaacugucugauaacagaccuguguuugccccuuugcuaaaugcacacagggcuggacuagcuaaagucuaauccaauggacaaaauauuucugacagaauuauucaguacucaagguaauacaugagaaaagacgacugaacacugcuuagaaacuugggacugugacuacuacagcaaugacagaaugguuuucuuuccuuaaaggaaaggagacuugagagaugauaccuccauggcaagucucugauauaaaacucuuguuugauugguguaucuugauuaacaugaaggacaagaguucuuuguuuacuuguccauggacaaguaaaguaggacuguaugcaaagugaaauuccaugacucuggaagucaguauggaggggguaugggguauagaugggcucagucuuauaggcugagugaugggcacugcauuuuagcaauacgauucuaugcauuaagugaaauuccaugacucuggaacucaguauggaggggguauagaugggcuaucucagucuuauaggcugaguuaugggcacugcauuuuagcaauagaaaucuauacauuaugugaaauuccaugacucuggaagucaguauggaggggguagaggguauagauagggauaucucagucuuauaggcugagugaugggcacugcauuuuagcaauaggaccguaugcaaagugaaauucuaugucucuggaagucaguauggaggggguaugggguauacauagggauaucucagucuuauaggcugaguaauggacacugcauuuuagcaauacgauucuaugcauuaagugaaauuccaugacccuagaagucaguauggaggggguaugggguauaaaugggcuaucucagucuuauaggcugaguuaugggcacugcauuuuagcaauaggacugcaugcauuaagugaaacuccaugacucuggaagucaguauggaguggguauagaugggcuaucucagucuuauaggcugagugaugggcacugcauuuuagcaauaggacugcaugcauuaagugaaauuccaugacucuggaagucaguauggaguggguauagaugggcuaucucagucuuauaggcugagugaugggcacugcauuuuagcaauaggacugcaugcauuaagugaaauuccaugacucuggaagucaguauggaggggguaugggguauagaugggcuaucucagucuuauaggcugagugaugggcacugcauuuuagcaauaggacugcaugcauuaagugaaauuccaugacucuggaagucaguauggaggggguauagaugggcuaucucagucuuauaggcugagugaugggcacugcauuuuagcaauaggaccguaugcaaagugaaauucuaugacucuggaagucaguauggagggaguaugggguauacauagggauaucucagucuuauagacugagugauggacacugcauuuuagcaauaggaccguaugcaaagugaaauucuaugacucuggaagucaguauggagggaguaugggguauacauagggauaucucagucuuauagacugagugauggacacugcauuuuagcaauacgauucuauguauuaagugaaauuccaugacccuagaagucaguauggaggggguaugggguauaaaugggcuaucucagucuuauaggcugaguuaugggcacugcauuuuagcaauaggacugcaugcauuaagugaaacuccaugacucuguaagucaguauggaggggguauagaugggcuaucucagucuuauaggcugagugaugggcacugcauuuuagcaauacgauucuaugcauuaagugaaauuccaugacucuagaagucaguauggaggggguauagaugggcugucucagucuuauaggcugagugauggacacugcauuuuagcacugaaucaaugaagauucgaauuucucuaaguagaagugggcuugggauaggucugaaaguaucugggccuggggcuaggacugggcuggggcagggcuggacuggauuggguugguuggguggggcaggggcaggggcagggguaggggcuggggcuggggcuggggcaggggcuggggcaggggcaggggcuggggcuggggcaggggcuggggcuggggcuggggcaggggcuggggcugggccuggggcuggggcagcaauagcagcagcacuauuugcugagucuugaggagaaucuagaugccauaaaggcaagaacacacagaaaguugaaauguaggccuuaauauuacuauuauaacaguaagucugauagaggacacagagcauuacaauucaaggcucuugcugacaaguaaaaccauuagucaauauagcaucaacaauagcaacaaaagcaaagccugaacugguauagaaccucaaauacuccugacauccagucauaauguucacuuuacauuaacaguaucuguguuauaagacuuaaaaauuugaagaguagcucgguggaugaguuugaaagaaaguacauuuaagugccaaguaauuugaguaucaucugccaaaaaaauuauugaaaacuuuaaggacuccaaaguaacaauucacuaaagguaauuaaaaugaauucaacaaguaagcaaaucguaaauacauuuugaaaacaaucacuucgguuuuaaauucaaacacuagcaaagcacacuaucagacgugucguuggcauccaaaauauucauugaaaucaaaaugcaaccccagcaauagucaugggguagauuuuggaagaagguaggauucuaccucuucaccagugauuugugauccacuaugacucuggccaaagucaccacuuauacccaguaggcuuagagaaccgcuugagaucagugcuggcuaaaucagaggccaagguguaaguagacuagccacugaacaauacaaaggaauggaacgggcugaguuuuaguuugcaccgccacguauagagcacuguaagagacuaugaacgcaagcggaugagucaaauguccuugaaauggccuuagauacuuuucuuucuuuuaauaggugagguuucaaugauuuacaucgaccaagaacccgcagccucggucucucgaaucggauccgacaucauccaacacuucaguguuagaauugcaagcaugcgcucucccgaccugggcaggcacuucgaaaaaaugaugacuaaagacacacgugaaguaccaagcgaaacucacguccuuaugggacagugacucaucacagucuaauuccauccuggccaccaagcaauaaugcacauuucuaacuggaagucaagcaaacaccaacacuuucacacuugugcccauuucugacgaguuacgucaaguggcaaccaacacuuccacuuagccuugccucagcuucgaguggcacaagguaggaccaaccacacccuaccauaaugcaccaaguguacccucgggcaaagcccgccaaguagcuaaagcccgccaaaaaaaaaaucacugaaagaaaccacuagagggcaggucacaugacuuccgccaucuuagacacauucaagagcaugugccaccucuccaggcuaacucagacaugaagcugacaugugacacacaaagcccuuugcguuauaccgcaccaagaacuugagccgccaucuuuuccuguacgaccuaaauguccuauaauccauugcuacacaccagaacaaagauugggcugucgagccucggguggagcccccgagccgccauuuuauagacuucugagcagcccuuaaagccacgggggaccgcgccagggguccauaugcacacacacccugcccaauccccacacccacgcugagcccuauccccuaguccucugcggcuuccgcgcaacaccgcacacuaauacgagcacuccuuggcuuucuacuuccggcuagcacaaccccgcaaaugcuaccacaaaucaaggcgaaucccgcaaccccgcacauauaaagaaagccuuuagcuagcgcagcgcaauugguugcuuuuauccaguccgcugugcuccucgguguccuaauucuuggcguaacuggcucgagaauagccguaucacgcagaagccauaauggcggacgcgggcucuccacgcccugaacacccacucaguuuaagagcaaagucguuuuucuaagccauagguucacucacacagcaccaaacgaucagcagcaacaguacacgcaaauaagaggcauagauauuccagguagugcaauaacucacaaaaccauauuuccauccaccaagcgccccguugggccgugaaaaaaaaaauuuaaagcagguauccacagccccgaugggcaaaagaaaaagaaaaaaaaauaauaacagcagguauccgaggccccguugggcaugggaaaaaaagacuaaacgcagguauccgaggucccgauggaccgagaaagguuuuuuuguuuuuuuuuuuuuuuuuacaaaaagcagguauccauggccccgaugggcuaaggagaagaaaaaaagaauaaaagcagguauccacagcccagaugggcaaguuuagaaaaaaaaauaauaagaaaaaaaaagaaugaaaaggcagguaaguauccaaaaccccguugggcauggaauggcggggaggacacacagguauccguggccccgaugggcaagaauauauaaacaaugaaagaaagguaaguccaccauacacacacaaguaucaaccaaaaggcacaacaaagaaauauuccuuaaaaaugaaaaauugacugaaaauauuacaaauaucaaaaaguauggaggacaugucaaaaaaaaaaucuuaccagaacauaucaaaacgucaaaaaucucguggaauuuugauauguuuucuuaaauaagccauaaggcuuggugguaggggaacuaaaaauguucccccaaagcuccuuagauggagagaaaccacggaagaaccgcacauccacgggaaacgagcaaacauggcuggagcaagccguugcacgccuuuaacug

SEQ ID NO: 9680 - RNA, 22879 nt, Mus musculus
caguuaaaggcgugcaacggcuugcuccagccauguuugcucguuucccguggaugugcgguucuuccgugguuucucuccaucuaaggagcuuugggggaacauuuuuaguuccccuaccaccaagccuuauggcuuauuuaagaaaacauaucaaaauuccacgagauuuuugacguuuugauauguucugguaagauuuuuuuuuugacauguccuccauacuuuuugauauuuguaauauuuucagucaauuuuucauuuuuaaggaauauuucuuuguugugccuuuugguugauacuuguguguguaugguggacuuaccuuucuuucauuguuuauauauucuugcccaucggggccacggauaccuguguguccuccccgccauuccaugcccaacgggguuuuggauacuuaccugccuuuucauucuuuuuuuuucuuauuauuuuuuuuucuaaacuugcccaucugggcuguggauaccugcuuuuauucuuuuuuucuucuccuuagcccaucggggccauggauaccugcuuuuuguaaaaaaaaaaaaaaaaacaaaaaaaccuuucucgguccaucgggaccucggauaccugcguuuagucuuuuuuucccaugcccaacggggccucggauaccugcuguuauuauuuuuuuuucuuuuucuuuugcccaucggggcuguggauaccugcuuuaaauuuuuuuuuucacggcccaacggggcgcuugguggauggaaauaugguuuugugaguuauugcacuaccuggaauaucuaugccucuuauuugcguguacuguugcugcugaucguuuggugcugugugagugaaccuauggcuuagaaaaacgacuuugcucuuaaacugaguggguguucagggcguggagagcccgcguccgccauuauggcuucugcgugauacggcuauucucgagccaguuacgccaagaauuaggacaccgaggagcacagcggacuggauaaaagcaaccaauugcgcugcgcuagcuaaaggcuuucuuuauaugugcgggguugcgggauucgccuugauuugugguagcauuugcgggguugugcuagccggaaguagaaagccaaggagugcucguauuagugugcgguguugcgcggaagccgcagaggacuaggggauagggcucagcguggguguggggauugggcagggugugugugcauauggaccccuggcgcggucccccguggcuuuaagggcugcucagaagucuauaaaauggcggcucgggggcuccacccgaggcucgacagcccaaucuuuguucugguguguagcaauggauuauaggacauuuaggucguacaggaaaagauggcggcucaaguucuuggugcgguauaacgcaaagggcuuugugugucacaugucagcuucaugucugaguuagccuggagagguggcacaugcucuugaaugugucuaagauggcggaagucaugugaccugcccucuagugguuucuuucagugauuuuuuuuuuggcgggcuuuagcuacuuggcgggcuuugcccgaggguacacuuggugcauuaugguagggugugguugguccuaccuugugccacucgaagcugaggcaaggcuaaguggaaguguugguugccacuugacguaacucgucagaaaugggcacaagugugaaaguguugguguuugcuugacuuccaguuagaaaugugcauuauugcuugguggccaggauggaauuagacugugaugagucacugucccauaaggacgugaguuucgcuugguacuucacgugugucuuuagucaucauuuuuucgaagugccugcccaggucgggagagcgcaugcuugcaauucuaacacugaaguguuggaugaugucggauccgauucgagagaccgaggcugcggguucuuggucgauguaaaucauugaaaccucaccuauuaaaagaaagaaaaguaucuaaggccauuucaaggacauuugacucauccgcuugcguucauagucucuuacagugcucuauacguggcggugcaaacuaaaacucagcccguuccauuccuuuguauuguucaguggcuagucuacuuacaccuuggccucugauuuagccagcacugaucucaagcgguucucuaagccuacuggguauaaguggugacuuuggccagagucauaguggaucacaaaucacuggugaagagguagaauccuaccuucuuccaaaaucuaccccaugacuauugcugggguugcauuuugauuucaaugaauauuuuggaugccaacgacacgucugauagugugcuuugcuaguguuugaauuuaaaaccgaagugauuguuuucaaaauguauuuacgauuugcuuacuuguugaauucauuuuaauuaccuuuagugaauuguuacuuuggaguccuuaaaguuuucaauaauuuuuuuggcagaugauacucaaauuacuuggcacuuaaauguacuuucuuucaaacucauccaccgagcuacucuucaaauuuuuaagucuuauaacacagauacuguuaauguaaagugaacauuaugacuggaugucaggaguauuugagguucuauaccaguucaggcuuugcuuuuguugcuauuguugaugcuauauugacuaaugguuuuacuugucagcaagagccuugaauuguaaugcucuguguccucuaucagacuuacuguuauaauaguaauauuaaggccuacauuucaacuuucuguguguucuugccuuuauggcaucuagauucuccucaagacucagcaaauagugcugcugcuauugcugccccagccccaggcccagccccagccccugccccagccccagccccagccccugccccagccccagccccugccccugccccagccccugccccagccccagccccagccccuaccccugccccugccccugccccacccaaccaacccaauccaguccagcccugccccagcccaguccuagccccaggcccagauacuuucagaccuaucccaagcccacuucuacuuagagaaauucgaaucuucauugauucagugcuaaaaugcaguguccaucacucagccuauaagacugagacagcccaucuauacccccuccauacugacuucuagagucauggaauuucacuuaaugcauagaaucguauugcuaaaaugcagugcccaucacucagccuauaagacugagauagcccaucuauacccccuccauacugacuuacagagucauggaguuucacuuaaugcaugcaguccuauugcuaaaaugcagugcccauaacucagccuauaagacugagauagcccauuuauaccccauacccccuccauacugacuucuagggucauggaauuucacuuaauacauagaaucguauugcuaaaaugcaguguccaucacucagucuauaagacugagauaucccuauguauaccccauacucccuccauacugacuuccagagucauagaauuucacuuugcauacgguccuauugcuaaaaugcaguguccaucacucagucuauaagacugagauaucccuauguauaccccauacucccuccauacugacuuccagagucauagaauuucacuuugcauacgguccuauugcuaaaaugcagugcccaucacucagccuauaagacugagauagcccaucuauacccccuccauacugacuuccagagucauggaauuucacuuaaugcaugcaguccuauugcuaaaaugcagugcccaucacucagccuauaagacugagauagcccaucuauaccccauacccccuccauacugacuuccagagucauggaauuucacuuaaugcaugcaguccuauugcuaaaaugcagugcccaucacucagccuauaagacugagauagcccaucuauacccacuccauacugacuuccagagucauggaauuucacuuaaugcaugcaguccuauugcuaaaaugcagugcccaucacucagccuauaagacugagauagcccaucuauacccacuccauacugacuuccagagucauggaguuucacuuaaugcaugcaguccuauugcuaaaaugcagugcccauaacucagccuauaagacugagauagcccauuuauaccccauacccccuccauacugacuucuagggucauggaauuucacuuaaugcauagaaucguauugcuaaaaugcaguguccauuacucagccuauaagacugagauaucccuauguauaccccauacccccuccauacugacuuccagagacauagaauuucacuuugcauacgguccuauugcuaaaaugcagugcccaucacucagccuauaagacugagauaucccuaucuauacccucuacccccuccauacugacuuccagagucauggaauuucacauaauguauagauuucuauugcuaaaaugcagugcccauaacucagccuauaagacugagauagcccaucuauacccccuccauacugaguuccagagucauggaauuucacuuaaugcauagaaucguauugcuaaaaugcagugcccaucacucagccuauaagacugagcccaucuauaccccauacccccuccauacugacuuccagagucauggaauuucacuuugcauacaguccuacuuuacuuguccauggacaaguaaacaaagaacucuuguccuucauguuaaucaagauacaccaaucaaacaagaguuuuauaucagagacuugccauggagguaucaucucucaagucuccuuuccuuuaaggaaagaaaaccauucugucauugcuguaguagucacagucccaaguuucuaagcaguguucagucgucuuuucucauguauuaccuugaguacugaauaauucugucagaaauauuuuguccauuggauuagacuuuagcuaguccagcccugugugcauuuagcaaaggggcaaacacaggucuguuaucagacaguuaaagugcucagucccaauuuucaaggcauuggccauuaaaggggguagaauacuauauacuguuggcaugcugucaugggugcuaucgccccaggucacaucuuucuaacugauggagauacauuuauuugcucaugauauuguauacuagucucacaugcuuucuuauuucagccaaaaaccucugcacuggaacauuuuauguggauaauccugacuaggaauugagucuuuucucaagguccuaauacuacccuugcuuuauguaaagagggugcugauuacuuaaugccucuuacacaauugugcaaaauugcaguuguucaaguccccuucuguuaguaaccaagaucccauacccucauacccuaaugggugacaaucaagggugccaaccaaugagaccacuucucuguucuggucuuucugcugugcuggggaaucaaaccuugagucuuguguacgcuaguaaagcacugucauagagcuacagccccaccguguggugguuugagagaacagccucuuauguagccugggcugggcgggacuuacaggcauugccaccuguaauguaaacauauuugugccuguugugugcacagcugcauuugucccucuuccuaagcauuggauaaagaaaccaaacuaagucaagucauuuuguugguaaucaagaagaccuuugaucuguccuguuuuuaacuuccaggcuggccuggaacuuagcauauaacccaggcuagccuugagcucaggaucuagccugcguuuaacaaguguuggcauaucugguuccuaccacuaugcccugcaugcagucuuucauauugugaaugugcauaugucauuucacuguaguaaucugcaucuggugaagacuuauuuguauugcagcaguauuuaagauccuuaacauaguaaaugugcacaguguuaacucuauuguacauauucucauguccacaguugugccuuuuagaucaggacuccuguacuuagcaaagcaaagaggcucacuaauauaaagcuucuuucaugagacuauagauugaaacgauuccaauacggucaaugguccuucaagguaagacuucugucucugaucauucauauccucuuugcuuuauggaauuauguaugugcugugcacuugaaaccccuuccucaaacuauuuauguacauacuggcaauuuuaguaggaucaauuuuacucuuaacuuugaaguacagaagugguguugaccuauaaggucccauuuuguggcuugcuaauaauaaugacugauuguaguaggccuuuucuguucacuacagaaggaaaccugaacagcguaaaacuguaauggccauaaacauguaccuugcauauuaguaugcauuuacugcacacaucucauuccauuuggauacgauccuacucucaaacccuuuugcaguacagcaagggucacuaaucuuuuggcuucuucaucuuccuggacacuggauaaggcuguccccuccuuuccacucuuuaauuuccaggacuauuacuuuaaagacuuaauauuugcauaaaggaugggguuuuuaauugauaacaugucccuugaacauuaauguauauaacagggacaugauccauucauuuuaauaaaaauacuuggccaguuaauguguaaaauuacacuuauccacaaccuuauuacuuuucggaccauuguaucucuugcacuccugcaagggauaccguuuaucucccaaggucccugcuaguggaccauuaauauacagugaaucuuccuuugucuuugccaguaaacaaaggccauacuccuucgccuuucauuugcacuauaucaggauaugcugaucaacaaggccgcauucuuuuggacuguuaucauauauuaaauguaugcguaugcacugccaccugcucugugcacuugaaaggaucccacucacuuccuuagcaccuucagcaggaagugauaauaagcucaagacuuucauuuggaaaguucacaugucuaagcacuucucuaagaacuacuguacccucuucuccgcuuuaaagcagaaagaggguuguacgaagugcucuucauuuggacuuaagugcauuaaugcaguuaguuguccaucauuaccuuuggaguuggauuuuacauccuuguacucuuuugacaccagaggcauauuaauuauuucugagcacuucucuugucaauauuaaucuguacccuuacacauaugaccugugcggcagcaaagguucugaaaugccuaccuuuugacuggggcugcugagugguaguaacuauuaguaaccucagcauuuggaugauuacuaugcaaaaaugucaaggaccugugugcucucuuugcauaccaucaaggcuacugagucccagaauuaauugcuaaguuaugcguauuuauaacuaugaaugucuggaauauuuuguccccuuuacauuauugcagagguugcugagcccccgaaacuacccgguacugucaaugagcacaggggcucugacgaaugaccugcucucuuccuuaaacugauuuugggacucuuaauaggcacaauggcaguucuggaugguuuauuuucuacuccaacuugagcaaauccccugcuaguuucccaaugauauaauaaaguacagcaguauguacacccaacaaugacccggauuucgacccuuuuugcauugcuuuaauauauacaauccuaaauagucacaaucucacacuuuauaguguuccuuuugcccggccucuaguuuguccauugaccacuuuucugaaucacuaauucucacaaacccaucauuaaggaagaguuugugcccuuucucaauuccaucaugccaucccuuuugccucuuuguuugaacaguauugacugggcaaagcccuucucuugacuuaaagucaacaacaccaguuuacucacuucauauggcuacagugucucaguugccuucuccuugcucccacugaacagagacaccucgaauucuuacauuauucuggguaauguuaauuaccccaaacacccuaugugucauuaauaaauuuugguguauuuauacacugaauagcaaaagcaggccaaaacuagguggaugagccuucaaucuuuaacuugcacuucuaaauuauuccaauuccaacugcuggcacauucuagggccaggaaccauucuugccuaccuuuauuaaugcuuuauugugcaaaauauugcaggcaaguagcucagggaguuggauugccaccuuuuacuuggggcuuuccuuuacaguaugaacugaaaauugucuuccugagaaggaagcuuagcacuuuucuuuccguucuuccuccaggaaggagccaacugucugcuuaagaaacuuuaagcccgauuuuguauauugcuacuguacaggaccaacugccagaaaaguuauugauaauuuuauuccuuaagaaaggcauuuggauugcaagguggauugacugugagaucauuagcuuuugugaaguaaaaauagccauuugugucauguuucugaagacuaagcagugucucaguguacugagggugaugagucuguggaaagaucagugcaacuauugcagaauguuuaagacaaguaucuuugcuuggucuuuacuacaaguuuaacaaaacgaaaaagucaaucuuuguguggccuuuaguaugauuaacuuuuuggaagaugaccuaagccuucuaaucauuauauuuugucugacauuggucaccaguccuugcuuauuuuuaaaaggugacuggauggauuaaauuugagaacaugucaagucgccuuugaaaauuauauaggccaucacauuuaauuaauucauucuauccaccauuaaacucuggcaauaauuugaaguagcuugaaaauuccuaaagugggaauuuauuuuagagaugauagaaccuguuuccccacuuuacauuuuaaaauaugucugccaggaucuaaucauuccuuuaaacguacacuucaaagagagauuuuccuaguaagaaaagagcuuucucuagugugaagggugcuuuguagccgccgaguacuuaggucuuuuuugggagcuauuguguaugaguguauguauguguguguguacaugcauguugcugcgcgcagucauucauucacauggugcucagacaacaaugggagcugguucgucuaucuuguggguccuggagaucaaagugagaucaucaggcuuggcagcaagugccuuuacccuccgcgugccaucuugccaucccgcugcugaguguuugauaugacauugcugaugaaaauaaucaucacaacagcaguucucccagcauuacugagaaaugauacuauuuuucugaggaggauguucaaguaacucauccagugcaggauccugcuugaacuacugcuccuccguuacaucagacucuggcuguuuagacuacaguaaguacuaccuuguuagcuacuaagcuaucuuuuucucauucgaguuucuuucugugccacccacugaaaagucaaagugacuaauaagucacuagcucuucucagcuuauccauacacaacacauaguaugccaacgaaauuguagaauuaacacauuguguacccaaucgccauuaugcugggguacacuaaaaugagaagcgaugauauuuuacaaaauuucuuccgugagaugauuauguuauuuaagacuuaauguaauauaagcacacuugagaucauuuuaggaaauguacugccugugugaauuguuuaaguauuuuaggaagucuacugggguugaaauuugacuucuuaaagagggaagugugcuuacuuugccuuguugguccagacgacuauuaguaccaucugguugguuuaucugaaugccaucuguuucuaucuaccucuuggaagcauggaaagaauauuaagagugaaagacuccaugcauuaugcuuagcuguacgccaaggguagcaagagaugagcuuguguaggaauugggaauauaaauuugauaauuugguucuuucaaccauuuuuacugcauuucugcccagaacagaccacuggacggcacuaacagcuuagacagagaacuucauagcuuacaaucuuuuuuuuuuuuuuuuuuuuuuuuuuuuuuuuuuuuuuuuuuuuuuuuuacaaaagugcaaagaaggauaaguuuuaugaacaaauuuuacuauggacuacuuuauguacccuccuugcucauuuuucuuuuucauuaauuaaucaauuaauuuuguuuuguucucuguuuuguuuugugacagggauucucuguguagucuggcuauccuggaacucaaacucaagagauccgcccgcagagauccgcccgccucugccuccaguuuagaguguugggauuaagggugggugccacacuggaccccugccagcacuuuucaacagauacuuucaguuaaaacaacaaauacuugacuccuguguagaaaauggucuagcugaaaaaacauccuuguccauaacacuuaacauuuuuuugcauuugccuuuuguacgugcaaaugacccucuaguacuuuaacccuuuuaaguccacuguaaauuccuucgcagcagguuucccccaacuccaaaggcuuagcauugucuggcucucuaggugauaauacaucuagaacuauugagucuuuuaggaaacuaggaccauuguuguacaaguaacugcuucaaaaggaaacauuugcaaggaaaaaaagcuuuuugagaugcuaaagaauguguuuggugcacuaagacaguuagcuaaagcuucggucucaccuuagcaccauuggcuacccaccccaguacaugcaaagugacccccccccccaggcuugccuaggcaccuagagcuuucagccugccuccuauggaccuaaauagagauuaggacucagacuccaguuaguggccuggaggaagcugguacugcugcuauucacaguaaacccacuaucacugacaguucccuauugaaaugaucaaguugugugagcaggcagaucauuaaucagggccaauucugucauggcaaccuaguccuacaugaccuccacggcacuguaaaauacacacuuauuuguaguaggacaucuggaacaugagcuugucugugauugaaauguccauuaggaggugccaucacacaaaaccaucuggaggccaucuuugguccccauaauugauggaauacaaagaguuccccaaauuaguguccugacccagcccucacugucaguaaucauguaauggaaagccaccaacucgccaucaccaucuucaggcugccugaacuguauacauuaagaaugagcuuucagccgggcagugguagcucgagccuuuaaucccagcacuugggaggcagaggcaggcggaucucugaguucgaggccagccuggucuacagagugaguuccaggacagccagggcuacacagagaaacccugucuugaaaaaaaaagaagaaugagcuuucuuccaagcuguccaauggcuugacccagacuuaggaguuuguaaacaaagaacccuguagaacaagugaauuugagaauguacaccuucauuaaguggugggaaguggaaguaguggauuuugccagcugauuuuacaaagcccuguggcagaaccagaccaggucuuuguaugcauacugccauauaaccuagccacuguccaaccugugcccucucucccaguccagugaaccucuucugccugccccuuacuuaguccucuggcucaucccaggggaagauggcucuauuuguguagucauaagaaaguuuuguuaauuuuaaauaaaacaggaaaagagaaagcucacuuaagacgagagcuggagagaugguucuguuagucuuccagagguccugaguacaauucccagcaaccacaugguggcucacaaccaucuguaaugacgucugacucccucuucuggcacacaggcauacaugcagauagaguacucaaauauacaaaaagggaaaagaaaugaaaggccuuugaaauguagacaugcuuucaauuuuaaaggcuguuuucacaucucuuaagaacuagggguuccaugagaacauauccucacccugaguucuuaccaccaauugaaaacgcugacaugugcauaugaagauuguauugcuaguaaucaaauuaucauuuguagaguuuaguauaauuaucauuuguuuuccagggaugaauuuggagucuguuuugugcuccugccucaagaagaaggauugccuggauuuagaggagugaagagugcuggagagagcccaaagguauuuccguuacuugguugacugagauaguaucuucccuuaaaggucuaaugugucaaguuauaccuccuaaguaaauaccucauuauuuucauguggaauuuucaacaauuuuuguagucuaaugauagccuuguauuucuucacagggacaaacaaucccuaugugagacucaaggacugccagcagccuauacagcuacauuacaucucagcagaacuucucuucaaguccucgcuacucugaacaaaaagcuuacaggccacauggagaaaaaaagguacuuuggagaauuugcuauuuggggguuucuaucugaucuccaguucaucagagaaugagggggcaagucaauaaagcacuccccaucuccugguccccuggcauagucaguuagccaaugagauccuugccuuaugaugaggccuugaaaucauccccaccauguuaugaccaaucuguaacauuucugcucugaaaugccuaaaagguagguuaucagaggaaugaaggccaguuucugacacccuagucuuuuguacuugauagaguaaguagauauggcuguugucacauucuguaggccugucauaauucuggucucugaauauccucaaacucagagguccaaugcuacaccaguuucuagggacauaugcaccauaagcacugagccaaacaaugcuauucaccuugccaguguucuggcaugguauuguuuaaagcacaaauuaaaagaagaaaauaauuuaaccccuuuauucccagaguauuugaaguacaaggacuuuaacacaaccuauaaucuaaaggaucucucauugguaggugacagaauaaaagccagaaagaacuuggauggagcaauucucaugucucuaaguuaacacuaagaucuacaaaugugaaggguucacucuccaagccccuccccaugauuuaacacaacugcugguuacuacauaaugagacaacuuucccaguauucuugauuucaagaauuggcuuuucuuucaccucuuuuccagaucuccccccagaauugugggcuugcugcuuugcagugcuggcgaccuauucccuuugacgaucccuagguggagauggggcaugaggauccuccaggggaauagcucaccaccacugggcaacaggccuagcccagauuucagugagacgcuuuccugaacccagcaaggaagacaaaggcucaaagaaugccacccuacaucaaaguagguaaguuuucugcaacaguguaauaauuuuaacuuugaucuuguuuuccauuaaagucagccuuuuacuugagauauauacauaaauuuuaucuuuuucccacaucugggaaauguaacuaaacagugcaaauguuucuucuaggagaaaagcugcugcaauaguggcacugaccuucgaggaagccauucugcucuauuugguucucucuccagaagcuaggaaagcuuugccagcuguuuacauacuucaagaugcacugcuacccuacucaugccauauaauacacaagugaguagcuuauuuaccuaccuagcuauuuacgaguacacuguugcuguccucagacacaccagaagagagcaccagaucucauuacagaugguugugcgccaccaugugguugcuggggauugaacucaggaccucuggaagagcaauaggugcucuuaaccacugagccaucacuaacauuacugaugaugaaugccucuaacuacaaauggaaaccuggcuggaauugauacagaaguaucuaucauuaggcagaauuuaaagagccaggauguucuaguacuucuuuccuggcauucauacagcuucuuuuguucuuuguagugccaucuaccaaauauuacccuuccccaaagcagcacagaaaacugggucuucagcgugaucaagcaaugugaacacacaaaaggaaggcagcuuuauaaaugacccgaggaucaacaugccugacugcagcaucuuaaaagcaauagaaugagguaagucacuagcauugcagucuucugaggauuugcauuugcuggaagauggugcuggguggagagcaucuaaugugauaaugugaggcagggccauguacacgauggaagaugaacaggcuuucacguuaucaaauggccucacagcagcaacucaaacuauuaucugcuuaccaguuauaucacaagaggaauuuagcuucuagguuuuguuguuguuguuguuuguuuuggcuuggugcccuaccauucuuacagacuuaaacauugaaaagcuuuaaauaguuuauuucuuaucuccaucugugaagcagccauuagacuugugaaggauguaaaaaccaagcccccccuuuuuuuuaauagaagaggagagugaagcugacaauuaaauaugcagucgcuuauaguguuugcugcuuacagaagcuuuuaauccauguaacagaauguugagauguucauucuguguuuaaauguaauauccccuagauguaugcccuuuggcaauuuaguucugcuaagaccugucuguuugugaaggucaaaugaaaucaugaauggaaaguguugaguacagagccuggcaaauaugcccuggaguugcaugacuaggccauuuggaagaguugacggguguguccuaugguccuauguuaaggaaaccuuaaguuuaacguugauagccugguacaguguacuaauggcaauuuuuuucuuugcccuucccuguuucuuguuacccucuuucugguggucuuugcuuacuaucaaucauuaguguguauugugggugugucuauuucuuguuuuauguaucuauuuuuuccuuggucugugugucuaauucuuuguuacaucuauuucuuccuugcuuugugugucuauuucuuccuugcuuugugugucuauuucuuccuugcauuaugucuaauucuuuguuauaucuauuucuuccuugcuuugugucuauuucuuccuugcaguugugucuaauucuuuguuacaucuauuucuuccuugcuuugugugucuauuucuuccuugcauugugucuaauucuuuguuauaucuauuucuuccuugcuuugugugucugucuuccuugcuuugugucuauuucuuccuugcaguugugucuaauucuuuguuacaucuauuucuuccuugcuuuugugugucuuucuuucuugcuuuugugugucuauuucuuccuugcaguugugucuaauucuuuguuacaucuauuucuuccuugcuuuugugugucuauuucuuccuugcauugugucuaauucuuugguauauauauuucuucauugcuuugugugucuaugucuccuuguguugucuaauucguuguugcaucuauuucuuccuugcuuugugugucuauuucuuccuugcuuugugugucuaugucuuccuugcuuugugugucuaugucuuccuuguuuuguguaucuacuucuuccuugugugucuaauucuuuguuacaucuauuucuuccuuccuuugcaugucuccuucuuuccuuugugugucuuuucugucugcagugugucuuaccuauucccauguuucuccugcauguucuuucuugcagagcuuugagcuuuguuucacuuucucuggugccuguguggucugcuuugucuucacuagcuauggcucucuguuuuaucuaucugguugcuauuucucuuagcuuuucuuucacuccugccuuucgugacuccccuuugggucacauguugcaugcaucccucucuuuuucuugugcucaccccacuuguucuuuguucaaguucucuuugucaguccauuucaguuuucuuucugcugcuucuauccuuagugaauucuuguuuacauuucuucccugccuuucuugggccacuuucucuguuuucuuuuguauuugugucucuuugcuauugguggauuucuuaucucagcaucauucuguugcuuuguguuugcuuguguuucuaucuucuacuuuccuccuuucuguucacuuugagcauuucaucucuuuacaagucugugucucucuuguauucuaaaguaauccuuucuuggauguuucuuuguauguacaugugcgugugugcauguguguuaugugugucaugugugagaggagcuucauagccccuucccaauagguccagaaugucacccguggagccguuccucacaccagacugcccugagaaauaaucuaagacaaaauacaucauuccguccggucaggauucaaguggcucugaagugaacgcccaaguagaagacagaaguuuugcgacuugagauuuaaaaggaccaaaauacacagauggcccgucuugagcuggcuggacagaaugcugacaacccaaagaagaggaacuguuucuacaggacaccugugacuuccaagagcggggaacuacguaugucauaagacacaaaaccugagcuaaguccaagcauaagaccuaaggacccaauccuauauggacagaauauuuaagagauaaaggccuauggcccagaacucuggaaggauauuucuauccuucuauccccaagaccaagaagggaaauucgaagaugagaccugccccccaaccccagcaucccuuuccauuucuuauauuucuauuuaagcugucuucacuugagauguaauuuuucauuguugccauugcccauaaaggaauacguuuuuagcuggauaguauugugcaagggucuguuuuaaacugggucuuagccauuuguuaaauuguugauguuuuacaacuuccauuucucuucacaucugcuccacuugagacggaacuaaauccagccaguguauauagccugacuauugaaacuucccuaggaauaagcaugcauacagauaugcauacugccauccucccuaccucagaagcccuaggcugacaagaaaaggaaagcaucagguuguuagggggaaaacaaugucaggcuaucuagagaaaauauaaagaguuguuccagaccaaugagaagaauuagacaagcaauaugcagaugugccaacccucugagaagcaccagccagugucaccuucuuucuuugggcuuaggugagcaggguaugguuuucuaauaaugguuuggggacaaaaugaggucugaacucccugcucauaguaguggccgaguaauuuggugcauuucaccaaaggaacuccugggucuaauaccuaccuuuaaaauuaaugaugagagacucuaaggacuacuuaacgggcuuaaucuuuuucgugccuuccucuuccucuguaagagggaaguuaaaugacacaggaugaaaaaguaacaugcucauagcacauuggcaauuauacaugguuauuaucugaaaguguagagcuuuuccuauaaggcaucagacuaaguaccugaagcuuuguggguucauggucuuaguugcauauuccuuaguugcaaauccuuuucaaaagguaagaaaaaggcacacuggucuauugccuguacuugaucaagcccugauaugaaugccagggaaugucugaguaacauuaauuuccuucccugcauauuuuuugugcugaauacuaaggcugugaugcuucacuguggucacccccagguaacaagauauuaccagguaaccaggaaacguaugaauacguaaaccaugaagccuacuguaacuuccaagucagugcugaguauguauuacauaguagcugaagucuacgccucugugugcuauaggcacaaagauugcucuaggaauaacaugcuuuguaaaaacaaauauaugaacauaacggggcuugaaugaauaacaguccauauacuuaaggccaguguguuucuucugcuuuggugaggcucaguaaguuauauuauaccagguagcagaagagaaaacacauggaaacugauuuuaaacuacaaacuaggucacuaaugcaggugauugauuacccuauucugaucaccuucuaauuucugaauacccauguucagcacugggaauaacaaagggggacauuaccacagaacuagaauuuacaaaagaaugcauuaaauaaagcauuauacagcuaucaauuguuccaugugugcaaaugaaugacuacuaacuaccucugauguauccgauauuguuuuggguacaugaaauauucaugaguaacugccaugaaauaagaauguuugcauuccauacuauucauaaggaaugagccaaugcuuaauuuaaucagucaaaacuugagugauaagggcauguuaauacaagaacauuugcccaggucacauuaugguuguggguacuuucuuaacuauaaagcaguucaguaguauaagacaagacaaauuuucuauagaaauaaagcugccuauaaaauaggcauagucucuacaaaauuuucauuguacuuuuuagcccauaaugggaagaguacaguuaacaagcugggugugguagcaugugcucugagcugaagcaacaggaccacuugagcccagaaauuggaggcuagccugggaagaccauaaggucaaucucaaaccuggaggcuaaauauugucucccauguguauauucucuuucauggguacuggagagauacacagacguacauuucaguguguccacacuugagaauaauauguacguuggcauuuuaugaacucggagguaccauauaaauguaacaauucauuuucuuacuugguaucaauuuccaggcuuuuaaaauucugccacauuuauuauacugugaaaauaaaguaaauaaguaacugugaaccacugaauauaugaagcauucaauacuugaugaguacauacugaauggcagucauuuauuacaaaacagugcccuugcuaggcacugggaugcaaagagcauucucauuguccuguguaucuaaagaaauuaugcaugagauuaauuuauaauuuguaaacugccauauauauguguauauaugcaauauuugccuggugugcaaugacuuugcuuuuaucccaggcaugcacaacagaucuguguggagcuuugugaagucuacaguucuauaaagccgggaccuaacuguuggcuuuaucagugaacagugauuacuuucuaaguuucauaauggcugaaacuuaaucauaaugcuuaucaccuaacaccaccuaauaauaauuuuaccaugcuauguguugagcgaacacauagauugcuuucuagcauuauguagcacuuauaggagugaaaucuagaccaaaacuucaauucacuucaaugaggaaaugaaaacagaaaaaaaaaauggauuugugcaaggcagugugcuaaauguuacacugaguggacuaugcugucuaggauacuucccagcuggcuugacugaggagguggaaaagguuuuauuaaugacaggaacuuuuuccauccaguuucuuaaauguuuguugaaugcugcugccagagaugaauuacaaacaccuugccaguaaaggaguuuuauagggccagagugagauaaucccagagcauggguaucagggaacaaaacgggaagaggccagagcaucugauggcauguacucaguguggcccagaaccucucgaacuagauguacuggcuggagggaccaagcaugcagaacacaacaccuaaugaaacauuguauauaaaauaugcuaaccuagguccuaaaacuaaaaugugagguggaccuaguguagaucacugaucauaggagacauggucucauaaagcccaggcugguucuaauuggugacugucacagcuucucaagugcugagauuacagaugugcuuaacccaugcccagccugaagaauauaucugauuacugagugaauaauauuuuuaaagaauuauauauuuuauguauaugaguacgcuguugcugucuucagacacaccagaagagggcaccacaucacauuacagaugguugugagcccccaugugguuguugggauuugaacucaggaccuucggaagagcagucagacucuuaaccacugagucaucucuccagccuucugaguaaauauuuuaacuauaauggcuguuugcgaaacccaaccaaggccaagauuccuucaacauaaacuggagacuuccuagcuaaggaagcuccaaaagucauuuucucauuggccuagcuugaagccaggacagacuuaaagucuguccuuuaauucauuacccauuuuccuuuucuuacuguugaaguguuucaaaggagaaucaagaugaaucgauaauucuaaacguauuuguucauugccuggcucagcgucaugugagcaagaagaauauacuaucacacucauacuuuuaacuuaagugugaugaaagugcaguucuaaguacuaaaauuucuaaguacugaaaagaacaaagacauuuaaaggaugcaacccaaaguguacuuuaccucaguaguuucugaggggacugcagucacaccuugagacuacagcucucacuuuagcugggaaaaacaucaagguguagaggaggcaaguuaaauaaaaaguugcuccccuccucaugggcaugcuugguagaguggaaauaauaaaagagguucucuauuuccucgguuccacacauugcagaagaugcuacuggaugcuaagugcaacacauuuguuccaaaagggcacucagugugacuuacagaugccccggaaagcagagggaugcucuuuauuaaacagaaauauuagcucaaacguuuucuagacugaagaacacuuuccucauuucccacaguuugccucagagguugaauacaggaagguuauuauucauucauuugcuuuauugguucgccuguucuacaaggauuugcaugucucuuaggccuucacuuggcuccugagacauggaaaaaggaaacauagacauagggaagugcuggauggggggggggggucucuuuucuggguaguggcacgacuuaguccuuaguccccaaguaauaugcaaugugaguccucauccucaugucuucuccggccacugcaaugagugggaagcugggcuuuguagcaagccugacccuaaaguuacagaagcccuccacgcuaagaaacucaauuuucuaggccauuuuagcuaugacugugaccacuacuggucaggagggaugacagccaucuaaguuccacaaucuuaggcuacuuugcauuauccuggggcaaacaagccauuuuugagcugcagcaggcuuugaaauacauugaccaauuuugccuguguucguuaaaccuuuuaccuuuuuacaugcuaaugcucacaguaauuuagaaauguucuccuuacuauaauauacucaagguggcuugcuaugguaaaauaaugccaguggaugaaaauaacauuaauguuuaacauucuugcauaaaauuuaagaauaauaaaauugacaacaaucagaaaacuggaggaacgaaagaccaaauugaaagaacuugaaaaagauuaaaaaugccugugcuuugacccuuuccauuuuucuuucacucacagagggugggacaggaggccgagugaaggaaaggguccagccugucuaucuggaaucuaaguugggacuuuaaugcaguuccacaaaauugguauuaauucgcuaaauguuucugaaaauguauuuucaucuaaauggcuaucagcuaagccuugagucaaaugggaaugaaacagauuaagucaaugugaucucuuuauccaaguugccuuagagcugaagucacaauuugcuguaaggaagcuuauucauuguagcauacgcauacuuucaaaguaucuagacuuuacuuaguaacccaaucaggacauucaggcaaaagaaaaggaacagagaagauggagccagguugaagaggucugggaguucaaacaaauuuuuuucauuuucauuaaaacucaauugggcaucaaaaguguuacuaauauuagcuuuuaauuaguggaaauuggcuggauucaguaauaucccuuuguauggguaggaaugggcuuacauuucuggaauuugcaaaggaaaaaauaacugaaagccuuccuuucacaguuacugccaucaauauugcuaccaauuaagcacauccuaccaucaucugcuuugaucacauaaaugaacuguguaccaaucuguuguugaaagacuggagucaucuucccaccaacugugaaaaaacacauggaaaacaccuggacuuugugaacggaugcggaauacagaacuucuguugacucuuggguguuuugaagacuugaaaaaaaaaacuguugcuuaccaacaugucacaaugaguccguguguggguggguggaugggugggugggugggugggugggugguugagugggugggguaguuugcuguuaaauaaaaugcuuuguuuugaaa

SEQ ID NO: 9681 - RNA, 587 nt, Mus musculus
acuauuccacaacuuccuuaguguucucuucacuugaauggccuggcuguggaucagcagcggguucugguggucccagacaauguucuuuauuaaauucacgccucugcuuuuuuucauuuuccucuagaccugccacuaauuuguauacuaugcuuuguaauuguggauccauccucaaguuuuuaugagguuuggccuggugcacuauaagguugcacuuaggacaucuguugcuguguucaaaauguuuuacgaugcagcuuuuacagaaacuaugaagacauucuguaauggucgccgcaucuauuaaguagccuuugcaaauaaaacaggagauguaugggaucaucugugagagaggaaugagacgcucuuccugguuggacuccacccucucugggccaggaagccugaauccugaaccgccuugcgcucuccugcucuggguagaccugcccugccuggcagcuaaguucgcaguggcaauuacaggagaggcuuggagugggggugacaagaccucuguucccuccacucuggaaacauccuggcugcccucugggcccacuaagucacuuuccaug

SEQ ID NO: 9682 - RNA, 24369 nt, Mus musculus
guuacugauuucccagauucuugggauaugcuuucaucuuuuuauguaaaagauuaaaccaucaaccagagaccgaaaccgaggccaaauaagaaaacccaucuguccacaugcagccaaggccaucagaaucaagacugcagugaauccuccuugagucuaaaaauugcccacgaccaguuuaaagcaccagaaccuuagucaguuuccaccuuuuaaaaccccaaggaugaaaaagcacaaaugaucacuucaugcauuuuauugauagucuauauuuuaagucugcaguaugacaucguacauagggaaaaagcuucuuccuaaaagauagcuauuaauaaucaaaccagauuucaugacugaccuuucaaggucucuuucugcauuaaacaagguaaauuuuagcagguguaaagcgcuguacaaaaaguuggguacauucucaaaauucaacacaggguuucccaaccaaguuugcuggaucagauaccggagaaggguguuucuuucaggugcaaaugguaaggaaacgagaaagcagacaaagcaagccaagcaaauucacuucccuuggugcuccucuguugccuuuucaaagugucuccuggaggucaggcccugguaugacaaucacuccagucuuuugacagcaugcacacaugugcuucauguucaaagacuuaagcgcagcccucuucaaauccuuucuuaugggcuuuacagagcuuuccaggauugcugcccaguucugcacaggaacccaaguaaacaucuauuccaaagcagcuuuuccauauaaccaggccaacugcguaccuacuccacuggacacuucacagggcccuauaccuuuaaaagcagcaccagggacaaauggaacuagcaagagguaaaauccaacgcuggauacuuuaaacauguagaaaccaaucuguuaaaaaauguuaguaacagggcacugaacagaguuaaggcugggcagcuagcuggcuugccucuaacuugcaacuggaaacaaucuugagaaugagaacuaagacagaccuugaaacaaggcacagugguauguaugacaggguucacuuucacugcgcaucucuagcugcuuucccaaaugauuauaaagcagcugugggacuucaguaaacaaauccuugcuggguuggggugacacauaacuauaaucccagucaucaggaggaucacuaauuccaggccagccugggcuacaaaacaagacccucucaaaauacccaaagcaaauugucccauguaucucacuguaauuuugagugguugguaaccuuuuuaagauuugaauccagacaucuacauggacaugaaaaaaaaaucauaaaccugauacuuaaaaaaaaacaaaaaacaaaaaccccgguaguucuauucuaagcugugggcuuuuagauacaaacuauggcgacuuacaggaggccacuuccuggaguguuggauaguauuuuagaaauguuccaaugaaggugaauuugagugcuaaguaccugcauuccuaacauucaagaaagaggcagaggcacaaggacugccacaaaucuaaagccagccugguccacagaguuccaggccagcugugagcacacagcaagaucuuaccucaagaaagguaacucaaugcuaaaaaauuuaaaggguggcuauugauugagcucacaacuguuuuuauuaaacugaacuuaaaaauauucuuuccccagaucuugcacuuuaacuucccaugauacaucaacauacacuuaaaaaaauuuuuuagaagaaccauuuacuaguuaacucaauaacaacacuguuacugugcauuagacauauugaacuguacuaaaggggaaaaagaaacaccuucacaugugccuucuccaccucguuacacagguauagaaagaauacuuccagagagugaaaaaucuuagauuagccaagaaucuaagugcccugcaacauggcuuccagguacuguauauuuuugguuaagacgugugacacggaagccaguaagaaaaaacauuaaaucagcuaaggcagauuacaaauuauuuccuuucacaaaagaacuauccuccaucuguuaaaaaaaaagucaaccacaaggugccacuguauucuagcaaacugucagaaauggccuuuaacagucauuuuguaacauagaccucuuuaucacaugguuaucuggagacucauucauagaagcaggugguuaaauacaaaaugugcuaaaugcuaacccuucauaacuauaagacauugauaaaagcagagaauacuuggaacagaaacaaaguuuucccaggagaaaaaaaaacaaaaacaaaaacaaagcaaaauauugcuuaagguaacagagcaaaccaguucccuagcuuggauggagucuaacaacugugcccuagagaccgagcaucuccuggcacuaaccuuuuguuaucaaacugacaauuaccuguuccaacacuagcaugugagccuucucccucuccccaccaaagccaccuccauuuauauggaggucagggcagugcaacuaacauguucuuuuucagagaaaauguuccaaauucccaccacagcuuauucugcaugguuacuacaaacagccugccauucuuaacauguuaaauuuuguuuucagcacuaauaaaucucaacauuguaagcuguguggaauaaaauaaaacacugcaaaccuuuacacuaguaaguggauuaaaacaauuaaaaauucaaggaaaaucaggcuuuaguacuuuccccuaugcuuugaacaauguaaucccccaacauuacugcaugaaguucaaaguaggucuuaaacacagaaccuuucuguaauaaagaaaaagugcgaagauccaaaacgaaauguaaagucuuucgcaagaaaauguucccucaagaauaggcauuuggacacuggugaggaaaccaagauuccuguucuucauugcacaccugacaccuacaccaacaaccucaucuuuaacagcugcaacuaguaauauagaauagcuguggacaccaaaauaaaaaaagcaacucccacuaaaaauacuuguauccauucuagacagcccaaugucuacgagugcuucuugaaauaguccacaugcagaucaaacaaggcuagaaauguaaagacugacuuccaguguuuuugaauagcuucaacaucuacauucauaaccaguauccugauugaguucccucuaacuucaauacuucagagaugaguaauacauuuggggagguuagggaggugccugcuguccaucacuguguuuagaaugugcugcagcuguuuuugagcuauagaaaaugaaucccucuacaauggaacauuuuaucaagaggaaaacgggauguauuuuuacuuaaccaggacuauccugcagauccgaaaaccagggaaaggugacaaggaggcucacaaauauaaaggaacccugacuuuuacauggacaauucuuuuuaaaaagauaaaaauguauuacauaagcgccauaaacagugaaauaugcuucuauuaaaaaaaauaagugaagcuuuguuuggacauuauuuccuugcaagagcaguacauauccuuuguaaacaacuacgauauuuacaauuuacuuuccuuaauacuuagguaggacugaaagccagaagaaaacaugaaagaauguacuuugaaauaaucuuuacugcuaaggcaauaucagugaggguaagcagguaauuccuaaagcagauuuguguaaaacauuuucuagaguacuggacuaaccuggguaguuagcucauuugguuaaagaccaagauuguauaugcucaauccaggucucuucuggccuguuagcuuuccccagagagaaacauuuuacagaucugcuccacagccaaacuaaucuuaaccccaaucagccucaaaaaaaaaaaaaaaacccaccugaggcaagaguacugggguuaucacaaucuauucuuccuacaaaacaacaauaaagugcguguucacagauaugagacagccaccuuaucuucaaauacggcaacacaauuaaaauuugaaucucaaauaacccaacaugacuuccuuucaauaaaaaauaaaaaucucuuaauucacaacaggucuuuguggcccauuagaucugcuagacauaagagugaaauaagcaacuaagugugcacugguaccuuagaaggucucaaacaagcaaauccgagacauuuccaauagcacacacaucuguaccaacugaaaaccuuacuuuaaaauuggcuuaagucucuuuccucuacuuguuuuugaggagcagauuguaaagacaucaauuuaacuuguacuagguaguaguggcuucuuuuucaaacacccaagaaagcucugccaaauguacucaucuucugcuucaucuauucaaacagaacagugggucgggcugcuguggcucucacuguaggaauccaguucacgucuguauuacuuacugucuucaugaauaugguccauucuucagggccguuuucuucaccaucauguaucacuuccugccuaaauccaaguuaaaauacaugcucuccauuggucuucaaugcagcuggguucugcacgguccuuuccuuuucaugucacaguagcuguucacaaauacacuaaauauagauauguucugcucuugacaucuacacacuuacaaaagcagcuucguacuuuguuugguguguuuguuuuacuaugcuggcucacaaaaaagcaguucucauuucuaagcaugguacuuuacaauuuugaaugcauuaauacaacagugcauuggaaaaguacugagccucuacaaaauagcuuuacauuuuuaaacaaaugaaugugauuuuuuucacuuacacaagcauaggcuuuuuaauauuuccacaagauaaauaucucaauuaaacucuaaauucgcucuauugugugccacagugaugggcuuaggacaguuaauacauuuaaaagauccuaacuguuuaguguuauuuacacugauauguccaucaucaccuacucuggaaggugaacaaacaauauucagaaugugaaugaauuugugucaauaacugggaaugguauaguuuuaguuaaucacuuucaaaacaaagaauggaacuuagucuugaguggggacuuucuucaugccucucuuauggccugggaaacuuucaaaagaggucaaugggauauagaauauagaaaggagccacugcuaaggcggcccuuaagacaacaaaggaaaaacugacaaguggacauggguaaauuaucaguaacagguuagcaauucaucugguaccgaaaucaaauguuuaaguccuaaaauguuguuuuuaaaauauucuuuccauccugaaagagaaacuagagaaaaggcaugauacccuaagaaagcaaugacucaauucagcuugugacuuuauauuuuaagcaccacucaaaaaaaaaaguggacauaaagcaggugauuuguuugcccaucacuauuccagcuacacagcucagaguucuggucucaucacacaacacuuucucuguucccagaagauaagacugcccugcgacaaaugggacagguggaauucucagacaaccagcggucgaugcaguggacgugguacucaugggagcaagguaguuuacgaaguuuguugccuucuguguauucuguaaugcaaacacuacacguuuucaaugcaucauuuucaccaaagcuucucauugccaaguuaucgaucuguucuuuagugaguccucuagguuggucuucaucaucuucauuuaaaagaaaaaacugagccagacuaaggaauggcagagagccacuuucaucaaaugugacuggggcccuaugucgaccaucucuucuggaugggccagacgagccuccuucacuacugccuucgaacaucucugagcuacucucggaacuuucaccacuugaacuggggcuaggacuugagcuggaacuggaaccagagcuguuaccgccaccagagcucccucuuccauuccgugacucuacucucuccacauuucggcuggagacugaggcacuaggcucugaaucacugucacuguacauaaaguagcuuagcucaccaaagccugucauuaucugccuuaacaugguuugaauugcaacagauguaguuucacuuaauccaguauuuaagauucugcgaauaggaauccugauaguacucacauagguucucacaccugcacguucagaacgggaaaagguacgccuaaaaccuccacguucacuuucauaaguaacuguguuguucggagccugagaucuugaucgaguucugcuagcuauacuaucucucugccgguauucuccaggacgaacucuucuuacuugaagaucaagaacuaugguuggaggucuuuggccagauccugaggauucacuauugcuaccugugucugaagagcuuguccccugagagggguuucuugauccagaagcugcaaaaagaccucuaccuaacaacuccgguccagauaucugcugucucagggucacauggugccggguucuagaacuuccuucaggcucguuuuccgaagacugcuccaaggucggagcucuucguggaauuucacuuguuggcugcagaggggaccugcuucuuucagcucuugcucugguucuccgaugcucugggcuccggcuucuugcccuccucugagcucugguggucggcacuucuguuacugcuucagcugaauugcgcuccgcucgagaaggucuggccgaugcugauucagaugcagaauuuuccauuugccuuuggcugcugcucuccauguuuucuacacuaagacgccuaguggaugguucacuuucauucucggaaguuuggcuuccauuguuacgguuaacauuuaucucuaaacugaaucugaaaucaccgcuguuuggauuaguccggcucacugcucuccaggacugguuuccucucugaccacuucuuguuguauuuccagucugucugacugaguuaagccaaucuauuauagaaucacuguuggucacaucaucugaagacucuccagcuguuuaaaacaaagaaggggaaggggagagaaaggaacuacacgauuaggacacucaugggaugcacauaaacauuaaagaauugugcaacucggaacaaauuuuacaaauuuacauugaaaagagaaagcuaaaagacacuuaagcgucagcaguucucaaccuguggguuaugaccccuuuggggggcucaaacaacccuuucauggcuuucauggaugucaacuaagaccaucugcagaucagauauuuacauuaugauucauaacaguagcaaauuacagcuuugaaguagcaaugaaauaauuuuaugguugggggucaccacaacuugaacuguauuaaagggucacaucauugggaagguugagagccacugcucuagaagaugcugaggcugugggaaggcaugaauuuuccaggccacugucuaaacaaaaucaaacuacaucaucauagucggggguggggguugggggaguguugggguuuugguccaauuauauuucuaccaaauuuucaucaguuuuagcugucuuugauaccacgaaguuguuuuaaaauguaagaauauuuauuacagccagagcaaaacuauaaacaaggcuaacaguuuauaauuacuugaauauuugucaauuaucaagauuuucaauuucuauaaaacuaaagacuauuauuaaaugaacagucugaaccuagaguaauuuacacuuccaucauagcuccuagguuccugcagagaagcaccauuccccagcauacuugcucucugauacuaacagcaaacucucaucagcugugccaccaaacaugucuccagucauugcuaacagcccccaggaggaacaaacacccaacugaaaggugcugggcuaacaacagcauuuccuuuugcugauaaagccacauucauaaauaaggaaugaguaggagaacauuucaacggauguagaaaaccaaggggaggaaacucaacuuaaauaggugacuuucacuguugcucaauuaacaaacaauccaaaggugaggcagacacagcagugucacccuccuccccaaauagcaagagcaugacauuucucuuuuuaugaguacuuagcaccagauuaauuuguggcauuucuggauaaucuuugguugaaauucacuauucgaaaguuccuauguuuccaaccccgacccaccuccccaaacaaaauguaccucuauuuucaucggggcucuguggugguggacccucuuuaauuuguuguagucuucugagcaacucuuccucaguacuuucaccugaaaguugaacauguguugcaaaauuacaaauuaagaacagcaggucaguuucugucuuuuccacaccccccccaaugauucuuuuuaaagaaggguccauacaagaugaccucaaacucaagaaccuccugugcaauugggauuacaggcaagugccaccauguccugucaggcuuugugaucugcacuuuaaacuguuuugccagaaagcaggguaacugaauaacagcagggccagaagugcaguuaagacauucuaauuaaaguuuaguacuguuugcucaaaaagcuccgccuaagccuugcuaaaacccuaacaucugaaaaugaaugaaagugauuacuuacucuaacucuccuuucuccccucccuuccccccuucucuccacguggccaugacuggucucccucuuucuaccuucucucugcauuucuacaauaaagcucuaaaaucauugagagagagagagagagagagagagaaugaauaugaaugaaaucguccacagguuaguggaaauagucaguuguaacuaggaucaaaugagaccauaccucagugaaauuauaacuaaggacaagcuguuuacccacagcuaacucuguaggguugcaggugggacacauucagagaauaagaugagaugacaaaaugagucgaugagucuauccucgacaccaaaggcccauugguuauuuuguacccagaugcauagcuagcuaaacuguucaccucaauucuuauuugauccauuucacuaaagauuuauaauucaaaaaucacaaacaucucugacaggaauacucuaauuaugaaccaggcaauaaauauaguagcagccgggcgugguggcgcacgccuuuaaucccagcacuugggaggcagaggcagguggauuucugaguucaaggccagccuggucuacaaagugaguuccaggacagcuaaggcuacacagagaaacccugucucgaaagaccuaaauaaauaaauaaauaaauaaaguagcaacugccauuuugcaucuccuguauuaguaacuuuucauuaaguaaagaaacauuauaaaacaagcuguuucuuuaaaaacccagcaacauauauauauauauauauauauauauauauaucacauauuacaugcagcuuaccuggggugcccagcaaauuguugucucucauaagucuauaaucuucuucacugagauuauucacaaauugauagaaagccucuucccgauccaagcgauccauuugacuucugcgcugagcugcagacuggucacuuccuuuaucguuagaaucugaguucuccaucuuggugaucaaguggaaaauuaucuaaaaagcaaaaagaccaaauugaaaacagacgccauuaugcauugcguaccuuuauuuacuuggaaacuacaaugcaggaauagaugugaacuuuaagaaaaacaaauaaauuaaauauaacaaaacuuugggaaagcacugguaagguagcaaccauaguguuuguuugggccuaauucaguaauguggccuauuuuuaucuucuuuguaaucuaaaaauggcuuuuuacaugguaggaagugaaccuagggccuuccuugaauacgucccaccaugaggauacacauccagcuccuggguuugauaguuauuucagccagggaagucugugugguccagucaacucaaacacgguucuccggccuaagccucuuaagugcugggcuuauagacaugugccauaaugcuuggcuauuuucacauucucaaaaauguuugccguguaugaaaaauaggaaauacacaccaguaucccuagucuuagugaagcacagccaugcaugcuuguguuaugggugaaaugagcaacugggacagacuguaagugggucccucacuacuuugcaccgcugcucucugcacuuccaguuaccucaaugcacuugcaacuugauaugauuucaaguauggcauguguaucauccugugacuuuuuaaaaacaugcaaguauagacucuuugcaguaacugagaaacacauuugaacaacacauauaaaaagcacagcagaggcuaccuacuuuuuuuuuuaaaagauuuauuuauuauuuuauguaaauacacuguagcugucuucacacacuccagaagagggcgucagaccucguuacggaugguugugagccaccaugugguugcugggauuugaauucuggaccuucggaagagcagucggugcucuuacccacugagccaucucaccagcccggcuaccuacuuuuaaccgcauuagaugaccaagguugcacuuuggcagauacuaucaguacgcuaaaguaguauaaaauuagacuaaaauauuugucaaaauggucccaauucaagaaaaaaaaucuaugcucugcuaauuagaaaacccaaggugaaagaucucgucuaaaacauuucauuaaaaaaauacauuguacuuuuauuuagcuguuaaaaauggaaauuuacaggucaguggaugaagcuagaaaaacaaccugaguaagauaacucagacuccaagaaaaauaauguuuucucuuauauguggacacuauuuucuaaguccuugagaggcauguugccguucauauaagcagagguuagguaucagcaagcagcuggggagggguucaugugccucugguuuccaacagagagaaagggguggagcugcaugagugggaaggaucacagaaguugccaagggaaaccauggucaauauauugcauaaaaaacccuuugguuucuuccuuuccuuuccuuuuuucuucuucuuuuuuuuuuuuuucugaggcaagguuucuuucucuguguagcccuggcuguccuggaacagagagaucugccugcuuuugcugggauuaaaugcauauaccaccaccauccagccaaaaccuuuuuuuuuuucaauuaaaaaaaaaagcaaaaaugaaagcuuauucaaguuuccaaauggcucaauuuuuuuucugagcaaagaaagccauuuuaucaaugguaaaaaaaaaauuguuuaagagcagaaauguguacauaggaaauuaauuuauuagcccuaugcuuuuauuuacuauaguuauauaaaaacugaggaacuagauagaaugccauugaccaugcaagucaaucuucauggccuagcuuucugaaugguaggauuagaggugauuuaaagugguaaaaauauauggaguaggaaaaaaacugguuggacuauuuaguuuuaucaaaacucaagauguuuuaaagccucuggucacucauuuuauuuucaacaaauacuuagaagaaaauaugaauccaucauguuacugaaccaguagugucaauauaaaccucauucuuguggcuuuaaucaucuuuaguuguauggauuuguuuuugucaaaaaauuuuucuuuucuuugagaggauuucacuauauagccuuggcuguccuagaacucacucuguagaccagugcaggcucagacuuaagagaucugccaucugaguucugggauucuuucagaaaucuaccaaguuguuuuuguuuugaagagaggauuucacuuuguagccuaugcuggacuugaacucauggcaaucaauucuccugcuucauuugagccacagguuuaaccuuggcuagauuuuauuguaauuuauagaacuugggucaaagaucauuucuuuuuccuuaaugaagaugaccucaauuccuucaaaauacaaauggcuuaaggaauuagguuuggcuauaacuugauaaugucucuuaauggcaagaggacaugcaaaacuugaaagaaaugcugguacaacaggcuaucaaagacaggggagcucuacuccuuugauguuuaccagaucucugagcuccaacuacacuuccaaaaucaaaaauaaacuucauugcuggggcaacuguuuggugguuaagaguacuggcuccugcaggacagugguggcacacacccuuaaaucccagcacucagauggcagagaugggcagaucuccgagaguucaaggucagacuggucuacugagcgaauuuuaagauaggacaaccaaagcuacacagagaaacccugccucaaaccaugccccuuguccaaacaaacaaagagcacuggcugcucuagcagaggauacaaguucuguaauuaccagcaugauagcucacaaccaccuguaacuccaucucuaggggaucuggcacucucuucuuggccuccagauacuaaccaaucauuuggugcacacacaugcauguaggccagaaaaaaaaacccaaaagcccaaaaaccauaugaagcacacacauauauauaauauauuuuauauauacauauuaaaaauaaguaaaucucaaaauaaaagucauacagcauauaaccaaacuucuauuuggccuugaaggggaaauaguaacucaaugauacccuaaaaguuauacuugggaauugaaucuuuaggagaugacuaugcaccauuaaaaaaucaagcccauggauuacuaaagagcugguacaugcaagugaaaaggcauuuucaagguguaaaaugcacaaccccugcccccaaaucuaugaauaauacaaaacuaaagaugacauguuaaaaaaaaaucucauuucaagucacucacaguggacaaacauuuacaaguggucacugagguauacugacuucagacuugagaacauugcccuaaauagaaugaccaucuucucacugguuaacuuguauuagguagcaauguaauaaacuauuauuauuauacauugagauuaaucagcaacaacuuuaucaggccaaucauagcagcacaaacuuguaaucccagauacuuaggauacugaagacaaaagguuuuuuuuuuucuuuuuuuuuuuccaagacaggguuucucuguguggcccuggcuguccuggaacucacucuguagaccaggcuggccucaaacucagaaauccaccugccucugccucccaagugcugggauuaaaggcgugcgccaccacugcccagcgacaaaugauguuuuggauauauuuuuaagacaggguuuaauggaucacaaaagcugaccccaaacucuggaucacugacuucaugauccaaguauuguagacacaggugugugcuaccaugccuggcucugagaacagaggaguuugaauaccuggcuaaccugggcaacacaguaauaccccacccccacccccaaaagaaccaaaaccaaaaccaaguaaccgcaacaaaaccaacagaaacaagaaaaagggaggagugacccuucuguaauuuuagcuucucuuucaccuaagguucccaugcugaaauccuaacugucaaaguuauaguauuaggaaguaaggauuaguacauccuucuuggagaaaccuuuaagagagcuaccuuggcauuuucuuuaaugggacuacagugagaaccaugaagucaacccucaucagacaucaagaccaggucuugauucugacuacccuguuucaugagcucuuaaguuucuguuguuuauaacauaugcagcuuaggacguccuauuauaguaacccaaaccaacaaugacaguaugaaaauaaaucugugccggagaguacuauaauuuacccuccuccacauacacauguaacaauauaccagcaucuucauaaaucaguccugaaggaaaaaacaaaaccuccucaguauaguagcucacaucuacaaucguuggaagaccaagcaaggcaagaguucaaagccagcucaagauacaaggacuaucucuaaaaaauaaaaucacaacccuauuccagacuuuaaaaagcacaaagaggccugcucuuauuaaauguugcccaguuacuuacuugaggcuaaacaguguaggaauagucacucagauuccauucuacuucccauaaaccacuguucucuaaaccauccuuucacuguuuaagucaauaagaugagcaugaaaggaggcagagguguuuucaguuuccuagcucauuacuaaguuucauuuguauagacauuucugacaaguguuuuaauaacuuguuacuauggaaggaccaggacagagugaacagucauaaaaguacaugggccaagaaggcuaaauacacauaaaaaacccacacacacugccauuuuucuuacaaguaacacgaauuggcauugguaaugguagcagcaacugcuuuuuuuuuuuuaaacacagaaaaacacaaagggaaagaaaacagaacccccaagccauaauuuccuaaagaaaaccaccggggcuagagagauggcucaaugguuaagagcacugacugcucuuccagagguccugaguucaauucccagcaaccacaugguggcucacaaccaucuguaaugagaucugaugcccucuccuggugugucugaagacagcuacaguguauauauauauauauauauaaucuuuaaaaaaaaagaagaggggcuggugagauggcucaguggguaagagcaccugacuguucuuccgaagguccaagguucaaaaucccagcaaccacaugguggcucacaaccacccguaaugagaucugaugcccucuucuggugugucugaagacagcuacaguguacuuacauauaauaaauaaauaaaucuuuaaaaaaaaaaaaagaaaagaaaaccaccacuaauguuuaauuaacauucuuaaagcagucaaaauuccagacacuaaaguuaggaagaaaucuacuugugacaaaucaguaaacaauucugaagauaacguccaggugaauagguuuuaaaaauaaaagaaggcaaaaauaucauuugaaggacaugaaccuaagauaaaacucacaugccaaaaacaguggcagucuuaagaacagcuucaaggagauuaaaccuggaagaagcagaaaccuuuagaaaaaaaauggagauuuaaaaaauacuaucuaaacucaauggguuggcauacacauaauccaagcacucaagaggcagagguacacauaucucugugaguucgaggccagccugguuuacauaggccagucaggauaguacaguugaguucucaguagacaaugaagauaggcuaaaauaaaaaugaaaaauacacuagaucaaagguaacaaggcuaaaaaauacaacagaaaaaaagagaaggcacugcagugcacaucuuuaauccuggcacucaggagguagagucagaggcagauggauauaagugaauucaaggccagucuggucuacacacuaaguugcagucuagcuugauacuauaaaagacugcauuuuuaaaaaaggaggagagaggaagaaggaagaaacagaaagacaccuucaaauagaaagguguaaagcaaaggacacccagugucaaacuagagccaagaauuaacaaaaacaggaaagccaauaauucuuucuuuuuauaacaaaacugcucccaaauggagauguuuaucagcaccuuaaagcaagcaaacuaccuaaaucuauagucauauuguguagaaguuaauaaaaaacagagugaauucaaaagacccucugcacuaaaaugucauuaaguacagguauguaugucugggaaaaugguaauauugagcuguauguuccaaugacacaaaauucuaccgccuucuugguaaggucacaaaacagaauaaaagaccagcucaauuucuuuuuacguccaugacguacuguucuauagucccccuacauauucgaaaaacucuccauauauuucugcagcauauuucuuauuccaacuucaagcaaacuagcaaggccuugcuaaauagaacaguguuugcuaaggcaguggcuuccaucagaaguuuguugcuuuaguuauuuugggaacaaggagaauaauuaaauaauuaaaucugacuuaauucauuccccacuucuucccuaacucuccauccaucugcuuuaauuuugcauuggcuaagagauuucagcacugagaagggacauccaccuguggggaaagccauaaugaugaguuacaucucagguuccagaaccugagguaccugcuuaaacauuuugaaagaaaaggaaauucugaaugcaagcaguggucucaauaucagguaaaggaguccugucuuggcuguagcaugugaaaaaugguaauaaagccaagucacaauuguuugagugguggaaaauaacauuuuaaagguaaagauguguugcagacguuaggaaaccaugaucuucaacuaacuaaaagccagaauuuucaccacuguaguauaaaauaaucagcaaaaaauguugauagccuuuaagacauauaugaugaaaggaauuaugauauauuuccaguuaaacuaguaacagggaaaaagagcauagugcucaguggcagaguacuugucucacgugugaugcccugguuugcuacugugagcugagggaggagacaaggccuacacauccuuggaauccuuccacauaaccagagagggucuuuauucuaucaccucauucucaaggcuuaauauucauaacauagaucauacacuuguauauauaaguagcuucagacauuuuaaaacaguacuuuccucaaaagauuaccaauacaagucaacuguagaaaaaaauccaacuacucuuaaagcacuuagcucuuuuaccuaccucugauuauaaaauauaaaaacagaucuuuuaaaacaauuguccacuuaguccugacaacagucccaauaaguaggaaacaugccucaauuucacgcuuucacaagugagaagcuaagaacaggaaggaaugguugugugaaaacgccauggauagugacuggucagcaauuaaauacaggucuacugauuccaaaggcaaucaagcuuucacuaaaugacuacugccucccugcacaccccacaguguaugcuuuaaaauauaguccuuaaaucccaauaggcauaacuacugaaucucacaccaugugcuucuuuuaaaccaagccuuguauaaaagcuuucaaucauggggaaaaaguuuuuguagugcugaggauuaaaccuagggccuuacauaugcaagacaagcacccuagcacaaugagcugcauccuuagcauucugaggcauuuugacuguuaaccuccugccucagccucccagguagagggauuacacucccaugucauaaagcccacuagcaaaacagcuuucaauugauacucacucuucuacugaguuauaaacccagcccacaaaacauuguuuccuggcauaaacagcugaauuuuuuucuuuucugcucugcuuuuggagggccauggucucacuauggagcguagguccauguuaccaugcuggcucuguaauuuucugacaguucuggaaauggcuuaugcauaucagccaaacacucuaccacugagcaguacagcucagcuaacauccuacuucuuaggcuuuauuauuuuuaucaauaaagcauaaguucaauaauacuaacaccaaaaagaaaaaccaccuguucauuuaaccauagucaaguauggugauggacacauuuaucccagcacuuaagacaggcagaucugggcuggcgagauggcucagugguuaagagcgccgacugcucuucugaaggucccgaguucaaaucccagcaaccacaugguggcucacaaccauccauaacgaaaucugaugcccucuucuggagugucugaagacagcuacaguguacuuacauauaauaaauaaauaaaucuuuaaaaaaaaaaaaaaaaaaaaaaaaaaaaagacaggcagaucugagucugagcacagcauagguuuauauaguaaaaccuugucucagaaguucaaggccugucugugcuacaguuagauccaggguagcuuaagcaauuucaugaaacaugaauauaaaauaaaacaggguauuuggacuacaaaucaguaguagagcacuuaccugguauguguaaggcuuuaguuucaacccccagguuuguaaaaauauacaaaguuaaaucaaaugaucuacuagauuugaagucgggauaaaagguaccauuauguacaaagauauaauguuaagaauuuuucuuagucauguggugguguuauaugccuucaaucucagcacuuaggagccagaguucaaggccagauugguauacauagugagugccaggacugugggggcuacucagagaaacccuguuucaaaaaaaaaaaggaauuuuccuuuguagaauguugaaauuucauuaaauauauaauauaugcaaguagauggauggggagcugugcuugucugucaucucucacuuuuaaaaacacaaagcauuauuaaaaaaaaaaacagggcauagugcaacauaccuuuaauuccagcacucaggaggcagaaguagacagaauucgaguucuaggcuagacagugcuaaacuaucaauaacaaaaagcaaaaccaaaacaauggcagaggggauagagauggcuccuuaguuuagaguacuuguuccucuuacacaagaccugauuugauucccagcacuacauaauggcucacuacaucaguaacuuugguuccaggggaucgacauccucccuuggccacauaggcaacagacacacauacgaugcauauaugcacauauagguaaaauacuuaauacaaauacauugaauugaaaaaaaacagaacagaguuguguuacugcauuuauuuaugggaagauucugcucaccaugcacacaauuuguucauaaauuuccagcagcaugcuagcagcauauauagugcacucaacacucguaagacaccauauuaaggagagauuaccuauuacccaaacaguaaugcacacuuagcuuuucuugucauuuccuaucuuuaccucuugaaaggguaguugagaaauccaaaacagauucggcaaugucccucaugcccaagcucuuugcagaggaguacuagacuuauaguccacaauuccaccuacaagucucuaaaacaauugaaauaacuacagaguaaauauaauaaaggacaaaacugcgcuaugcuaccaauguauaggaucagguuagugggaagccacucugaugacacuccaucuccagcugacagcagucaguaaccacaguacuacuucaagauugaagaguccuuaucaagcugggccucugaaacacuccuguuaauucuagcaguguaaaagcccaagguaggaagaucaggaguucaaggauggccugggcuacacaacaaaucuuaucaaaaagcaaagcaaagcaaaacaaaacaaaacaaaaauauuuucccaaaauacucagaagaugagacaggaagauuuccaugagguuguuauauaauuagcuccaggacagcuuguacuacagaagaaaccuugccuuaaaaaaaauuaaaaauagggggcuggcgagauggcucaguggguuaagagcacugacugcucuucgaaaguccugaauucaaaucccagcaaccacaugguggcucacaaccaucguaaugggaucugacgcccucuucugguaagucugaagacagcuacaguguacugaauauaacaaauaaucuuuaaaaaauaaaaauaaauaaaaaaaaaacacagccaaaaaaggacuggccuaucaccuauaccaacaaauucauuuuaguugaggaaaacaagucuuuaagaucaaacaugauaacucuauccuuccugagguacuguugcuacacagaaaucaugugugggccuuuaacccugacucauacacuaauaagaaccuuuuauaccugcaccuaaguuaucaucaaacuaguauaucucccuaaccagaaagaaucauucccaucagacuccuuuagacugccacaggucacaaacaguaaucuauagaugugcaguuauuaccauuaaccuaccuuaagcacaugcagacagacaauuaugcugcugucuacuacagauauuuguuccacacaucuauuggugcugcuguaauuaauggaauaaaaaucucaaguuuaauaugagaaaaucuagagugaaauugacaauuacaaauuucagguggaaaauacuauguucaaaaccauauacacccauaaacaagauaaccaucuuugaaaaacaccucaguuaacugaaggaggaaagaugaacugcuuuauauacuaucuaggaaauaucccuauucaaaggugaaauaaaugaugaaggaaaaaacaaugcaacuauuacugucugagcauugguuaucaaaacuucaaaguacuguauuaacugggccccaaggauuuagaaaucuccauguuagauaaguauaccuacaaaacagaauggccucuuccuagacagugacuucaaaguccagaaccuuauuuauuuauuuuuuuuacuuuuuuauguuacccacucuagaguaaaucaaaggaacaggaugcuaguccaagagguaguucuauuucccaguccuuuaggauuauggaaaaaguacauggaaugcaauuuuauaaaugcaaaugcuccacucgucuccucuuccugaaagccuuauuacaauguuaaucaacugaaaaauaucagccuaacuuuuuuuuuuuucugguuuuucgagacaguuucuuuguguagcccuggcuguccuggaacucacucuguagaccagguuggccuugaacucagaaauccuccugccucugccuccuaagugcugggauuaaagaugcgugccaccacugcccagcucagccuaucauuucuaaagaauuuguuauuaagcuguuucuuuaaaaagacuccugauuauuuuuuuuugaaacaagauuuuacuaucuugucuggaauucacuaucuagaucuggugggcucaaguugugaugaucuuccugugucugguccuccaacugucaggauuccagaugugggccaccauggcacugacuuuucuuuuaaguaaauuucucaacuuacaccaagaauauuacuagaugaaauagaaacucuauagcaaaccacccaaauaguguauacugguugauaacucuccccucucaccugauccacugaggcaaauuacuuuagaauuuauaguuuucggauacaagauaacuuacagauuaucgcuuuuaauuuccacuagcuuucugguaacuggagaaccaacagguauagaggugaguuuggugccuucaguguugagacagaccugagauaaaauaagugcuucaaaaccauaaccaguuggcuuaggacaaucuaaguuugcauuugcuuucuuauuaaguguacugguuagcacaaguaauuuauauauuuaucuuacaauguuaauaauaaugaaaaaauuaauuccaauuagaguaauacauaccaacaugacuucuugaaucuugaagaggaaaagaaaauuauggcacagaaaguaacacauauucuauugcuauuucauuuauucacugaacauuuaaaaacaacuucuuauacccaggucucuaacaacaucuuaaaaacagcauacuuuuuucuuucuuucagcgcacaccucuaaucuuagcacucaggaggcagaccaaguggaucucuaaguuccaggccugccgaucuauagaacuaguuccaggauuacaaagagagacugucuugaaaaagagcaugauagauagauagauagauagauagacagacaggcaggcagacagaugccacagauaaagcacuuucagguacugaaaagguacccuuugaauucacaguagaaaguacccauuaugaauagccaacaccaaugaauccauccaaccacaugacuguagaauagaacguauauuuguaaaaugcauucuauuauuauaaaucaccaggagacaacacaaaaauaauuaccugucuuuuaggacauaguauugaaauccaauaaacuggauuuuagucuucuucacucagcucuagaaaaaaaaaagcauucauuauucuuccuauuacaaaauccguauuuucuuugaaauacaacaaauucuuaaaaacacauuuugguuauauauaucauaacccaaccuaacuuaauguuaguauuaguauauuuggacaaccaaggucagaaggaaccaggaguuagauaaaagauuuccuuuaaaggccaagaggcaaucuaccuuuuaauauuagcuuguuuaaaauaggcuuuuccuuaucagacuaauaauuauuuucaaguucuacgagccacuuucaagaacuuauuuggcauaccacaguagccuaaggcagaaauuaaaauaauaaaaaucaucaggacauuuuaagcuaagagauauuugugaccuuuucagcaugauuguuugcccuuaaauaguuaucuuaaagggugcuuggguugguccuuuuagauccuuaaccuguauuucagaaacugauuugaggaaaagguggaccuguaauugugccugccuccuaauuauaaagaaucaaagaaaugauuaggacuacacuuccuauucuuucugucuucaaucauucaaacgcacgguggcuaauuacaagucaagaaauguaagcaacuuauuucuaggaaaaaaaaacauauauacaguggggccugccaggagcccaugagaaucugauauaaaaucccuuuccccuccaaaagaggaaaaaaaugaccuaaauaacuagucuccuaggccucagaugccaaacgaaccuguggaauaaguauggugaaacuguccaggaaaagaacguggcugucuccuccaucuugaaauuaaucagcagaagggggaaagggacugaguauucaggaagcagaagcccaaccgguuaauacuaguuacuaagcuauggcguacguggcagguaccgcccgcccgcagaagcagagacccuuagggguuuuuuucugagugggggagggguagggcugcuggcagaucacacggaaauuaacuugaaaauagucuggcucaauucccacacuuaccagggaaaacaacccgcaacgucuuuucccuccguuuuuuuaauuuuuuuuuucuugugaggaggaaaacccuucuaguaaaaucuggccaaggauacacuuagggcuaaaggugcagggaagcaaaccacguuugucuccgauccucccggaagacugucaccguagccccagagguuaacaaacuggucaugcccuacagaagcguucaaaaugaggcucugcgaauccugugaaaaucugaagguucaagaguucccaacauccgaauuaagagcaccuccaccccacuuccccaaacccuagcccgauacgcaacgcggggcgacgacgaugggggguggggggaaccucuuaguaagaagcacuggagccauccucacgccugaggcccggaguccaggaucgccuccccggcguucguucuuagcucgggagggccgggccccgacuccacggccugggagaggaaguccugcccgacuccuuccccuucuuccacgagcggggccgacacacgccacccaacuaaaauggcagcggcgacuacgccacggagccccccacagccgggagcccagguccggaggccguagugggugucucggccgcggcuggccaacucgggccauuuugagggccgcggccccugccugccuccaguccgacaucccauuucucggggugcccguaccuucacuuacacgguguuucggccaggagggaacucaacugggcuccgccgccgccacugggaccuccgcugcgcuacugugcugccgcugccgccgcguucuaacccgccucuaaacccgggcaagagacccgccucuagaacagcgccagcucggagacguagcucaaucagccauuaucuuccccauuguuaccuagcacugacaggaaaugacugcccac

SEQ ID NO: 9683 - RNA, 123756 nt, Mus musculus
ccaguagcaucagcagcagcagccaccgccgccgccaccaccacagcaguggcaguagcggcaguggcagcguuuagcaguaguguucccagcgcuagcggcagucgcaaccgcccuccgcgucuccgucucgcggacagccgcagccaccgcgugcagagcgggcuccgggcaccgccgcgcgcagccggcgagccgggcagugcuggcgcgggcgagcggcgcggugagaggagcgcuguccugggagccggcgggcggcuguggagccucugaguuucggcgcccgagcccgacagcucugccuccaucuagugcggcggcugcggcggagccagagugagcgagcggagcgaggcgcguccaccuggcgggccccgcgcauggagcagaggcagaggagacggcagugagcgggagcagcggcggcagcucuagcagcuccggcgacggcgacggcggcggcagcccagccuugacugcgaccgucccagcucgggacgccggcagcaaggacccaccagcgacgugcgccucgggaggcggccugcgaggugagucugagcgcugccaugcagccucccccaucccccccgggccuucucccuggcuccccgggccggcuggagccggcgggcggcagcuggggguggggguggcggcugcgaggaaccgagggcuagccgagcgaggagccgagcaagggaugccggcggggagagcgugugugugugugugugugugugugugugcgcgcgcgugcgugugagugugugugagugggagagugugcgaauggcgugcgggugcugucugugugcgggaggcagcgaggccgccggggcgagggagccuggcucgcccgccgcugccgccgccgcugccgccgccgccgccgccgagcgugcgcugcaaucuaggaaaggccugugugccgccgccgggggagggggaggggaagggagcgggccggagccgccgccacugccgccgccgcucacacacgccugccugccgcagggcagcggccgcuagccgccugccaccucccaucgguucggugaccccgggggaaccucgggcgucuggggaaaguggcacggcccgaggcacgcguccgagggagcgggaaaacguaggcacgcggcgggcgccggcuggcgucccggccgaagcugcagaggugcgaaggcgccgcuggccgccguacggacgccucccccgcccgaggcucccgcgcgccccaggcgccucuggccaccccgcgguggcacgggcggcucgcagcacccgcuccaagcagccgccgcuggcgaccgacgagaaguuaggggcccgagcgagccucgcccaggcuugucaccuuugcaggaaauuggcccgcugcccuuucccgcucucccuugccgucagauugacgcuuuccuccgggacuccuggagcucgucgcugcugcgccugcagggacacugcugcggcucgaucuuauccagcccugcgggcucagaggccguggggcggccccgcuccccgaaagugugcagaccgcgcuguucagcugaggaauccagugguuucagcaugacugcuccugucucauuagugagacaccgaaccacgggcgcaaggcuuuuagucuuuuucugaaguuaaaaaaaaaaaaaaaaucaguugacauucccauuuugacaccagcacuucagauuuuuguccagcuucugguagcauuuuggaaugaccaagucucauauuuugcuucugggcuuuggcuuccaacauguuguuaaauucuaggcgcaacagcauacuuaacuguguggcuuuuucuaacguuucauuuuguagacuugucugagaauacacaauagugugugggguuggcaggacuuuuuuuuaaguaucuuuauaaaauacuuuagcgcugggauuuaaaaaacuguuuuaauugaagaagcagagugugcuuauaguucuggaauauuuugcuugcugaguaaaaggugcucuaaugguuuccucugaacugcaagagaccauuugggacuugcggggugagucgcacaucuuuaugcauggauagaaugaccaaacauuuuauuuacagcagugauguucucauagcugaggagauuuuacacuuauuaaaaaauauuuuuagaaaggaacaaaaaaaaaaccuuaagaaacugucauuuuacauauuaacuagaaaaccggcuaaucaaauaaaacuggcugagugucugaaacucuaucccagugaaauauguggcugugaauauaauuaaccaucugucuagugagcaauuuaaauuugggcugguacauuuuuauuacagucucuaauuucuggaagacuuguacauuuuacccagcacuaacaacagaagcguauuugcuuacuaggucagaaauguacuugugugguggugggauuucccucuauccccacccuuacaucuuauguagucucuauacucuuacaucuuacauagucuccauacuccuugaccagggaggucaaauaaaccucgggcuuuuuugcaagcaacauauuuacaauaggggaauucaaagccccucuggcagcuagugauuagacauuuuguuguuguuucuuggaaauacuuagcaaaaauugucucccacagaaccuagauagauugcauguauuugaguugaaaagacauaauuuuugugugugugcccauguguucaaauaggguggggugauucaagaaaauuuguaagacuugaaauuugauuucauuuacuuugucuuuuucuacuuaauucuuuguagagcacaccccccagcuugucuuccugucuccauaccccuaugccccacagaacuaggcuaagaaaaaucacacucuugucccuuuagccaguuuuuuuuuuacuucaauaguaccagaucugugauuauuaacaauaugucaagaaacuaacuuuuuuugaagaccaaacauucaaaauaucaaaacauaaaauauugugcacauuuaaauucuuccugugguaugauuuuuaacuugaaaguaauuacuugaaaaaaaacugaaaagaguuuagggaaaagauuagauuucacagacuccaaccaaauagcuauuguuaacauaauuaaaaagaaccacugauugugcagcaagccagagaaagccauuuaaaagaaaauacuuuuaaaacaaauauuugccuaaauuacagcucggauaaauggguaacaauuauauaagcacauggcagaauuugacauaugucaagucuguuaaauaaaucagucuguucaaugaauaaaucuucgaugcaucaauguuuuuuuaacacacacauacacacaugcaggcacacgugcaaaccuguaauaucccuguugccaaagucaaacaacugcagaacacugcugcuuucuguuuuacucacugucuuucuccugucuuuuucuuuuucuuuucuuuucuuuucuuuucuuuucuuuucuuuucuuuuuuuuuacaaucugauuaccuguaagcugcccagagagcaaagcgaacuaaagaugugcuguugauucccuuugcuuguguuuacggagguagaagagagaaagaaaaagcucuaacagccggauuuaaaacacucaaagacgugcucauggcacucuaacacaaucacuguggagguucuagucucacugaaguauuugcuuaggggagggacugucuuaaccaaagaagcauuuauugcaguuucucugcuccuaaauccaguucuagagauuuuuuucuucugcaagccccuuccauuguaguaagaggagauucuaguuggccuuugacuguuauauguaaacuuuuuauguguuaguauacccguggucaaaauguuccugcuggcaguaagcaaaagaagauagaagggucaaacaagugauacagaggagacugauucacugagaagcaggucauuuuuggcuucauuguuuuucccauguuggaggauuucagauuuaaacuuuauauuuuccuuuauuauuuuacuuccucugaagagucgagcucccuaguuaauaguuccucaccagagcacccuuucaaauccaaggucauaagguuggacauaaagaacuuaagcugguuguccaggacgcuuugagaacaaaacaaagagccaugacaggagcacuucaggugaccuuuaaguuuguaccuucacugcuauccagaaaauguauuuugaggcagacaugaaacaacaucggccuccugccacaguaagcauaucacaauuuagggaaggaggcaguucagggaagcugccuuuuugaggccugcuccagguagaggcaaggaucuuuugucucuucccucuguccugaauagugauucacagacuuuggcuauggaaugugcucccuuuuucuuguaaaugcuaugaucuaaugucuuuccuuguucuccagccggaaaggauuucuagcguuuguuuugcuuuuguuguguucuguuccaagcuuuuuccccuuuuccccccggagcugaagauggagcacagggccuuggacacgcuagagaagagcucuaccuuggagcuacauuuccagccaugaguguuuuuugcuuuuguuuuucauuuuuagacagggucuuguguguagcccaggcuacuuuuggauuugugauccucauacguccaccucccgaguacuggcauuacauacaauguuccaaaaaccccuggcagaauucuuaagagcauccacaacgcacacaauuuuuuuuccaaaauggcgugucuauagaucaucuuauuucucuccaguaagaugacuuugauuuaagcaauuauguaccauuuuccucaaguguccccaaauccuaugaaaacuaucaguuucauucucccauuguuuuuuucaagugucccacaaacuagcuggagaaagaagcuucugcugucuaucugcagauuaucuaaaggcuggagaacaagauuuguacacugcaucuaaacauaggaauuuugacccacccuccaucaagaacaagcauaaacccagaugugguauaaucccccacacaagaggcugagaggcaagaagauccugagcuugaggucaaccuuggaaacagagaguucgaggaaaucuugggauguguagugagacccugucuuguuucagagacgggcugcauaaaacuccauguucaauccuuagugccaccuaaacuggauguggagcuaugaucccagcauucaagaagaaaagguaggaagacaagaaguuuaaagucauccucaacuagauagcaaacuugagaccagccugggauacacaagagccuucccacagaaagaugacaaggaagagauucauuucaugugaacaaaguuaaaguauuuuuuuauuugggauuauugguagguuaccauauguuguggcacacuuguuuuauucuuuaaaaauucuaugauuacuuaaaguacagcaccuuuaaaagacauauuuccuaauuugaguugauaguuaauuuucaaaacuugauagacuagugagcuucugagagacaaugacucuuuaaccuaguucaccuuacauuugucagccaagaggucuuucuguagaagauccucagaaagauugaugcuuugugucugacagaauuggaauauuguguucaaagauaucgacacaaaauggaagucuauguuugcacauacacauguacucaaagagguacccucuacacauuggagagugcuucuugcuuucaugaaaggcugguaagagggaauauguuagggcuggggagaaggcucaaaggucaagggcacugccuguuuuuaucuagaagacaagaggcauaggcauguuuagaggcagguagaucugacuaggaguuugauucccagaagccauauggcagugcauggccaucuguaacucuaguuccaagggcucugacacacacuucuggccuccuaaagcacuagacauguacauaguacacagacauauguguaaacagagcaccacacacaugaaguaaaauaauuuuaaauuuuuugaaauacacagugaguucuaaguuuaucuggaaaccuuaggguuagaaaguacauccugaccaccguauucaugaagaaaaucuuuagcacuaagggaaguaugauaagagacaagaugcucuuuuaaguugucugccucccaguccuaagucucugugauggacuucauuaaucgggagcaggagugaaugaaaaggugguuccccaaucuaaaucugaccuaucauggaauaauaauguaaucaagaaggaaaaaaaugaagcuaguuagaagugauauuuguaaauauuuucaagcuuuuauuaccuaguugagcuuuaccagauccauuguuaauacaugagagauugucuaaagccaggaagaguugcaggggauuaccuaaacagccaaacugguaagugaauuuuguuacuguugauguaucguuaauuaucaccuuucucucuucugcaguaaccuaaguuuuguggcacgacgaaguucuuuccgacuccuuucccauuguuugccauguuguucugggcacaugugauuuauuaacccagaagcuggucuugaugacuccuauaagcagaaacucacuuucucuuucuuuacuuguuaauaagugaaccacacccagaagauacaccgccuuacuaaguagaggaguagaaaaaggaccaauaccauuuagaucaguguucccuaaccaguaaucucuaauugcagcaugaauugguaugaaaauuugaaggccacugagugcaggcucuucagagaacugcauguuuaccuacauauauaccauaugcauacauuucaggaagaccagucgugcauugugaguuuaaaaaccucugcauaaccaggagguggugucacaccccuuuaaucccagcacccgagaggcagagaggcagguagaucugaguucaaagccagccuggucuacagagccaguucugggacagccaggaaacacagagaaaccuuguuucaaaaaacaaacggaaguccaucacucaaacacuggaccaccaaacagacagcauacaccagcugauaugaggcucccaacacacauacagcagaggacugcugggucuguguucauucagagaugaugcaccuaacccucaagacacuggaggccccagggaguuuagaggucagguggggugggggcugggggcauccacauggagacagggugggguggggaggagguaugggauggggagcagagggagaauggaggggggcagggaauggaauauggaguguaaaaaauagauuaaaaauaaaauaaaauuuaaauaagaacgaaagaaaaaacaaauggaaaaaaaaacaccgaaaaacaaaaacaaaaaaccuuuuccccaguuguuacagagauccugcuauaugccugucauggucacagcaacuugaaaugaaagccacggaaaggauucucaaaaaugcauguuguuguauacucauggucuguagcccucagcuacuguuccaaauauuuuuuucugauuaacuuucauaggcacaauuucauaggcauuuuuauuaugaaaaagagccacuuaauacccauuugaacauuacuguccuuacucaaaauaaguugucucauuuuaacaaauucuagacuuuucaacuuuaggcuucuuaaaaaugcuuuuucauauacaugcauauaauaacaauuaaugaaaaagaagcuaugagagggaggaaaggcugggaagaaaugauggaauuauauuacaaucucaaaaaagaaaaaagaugaaaacaaaauacgcauguucagcucucaccccaacaacuuaauuauuaauguauuaauuaauauaacauuuauuacauuauaucacauaaaagcucuaccuugcuuacuuuucuccugucuguaucucuuuugugccuugcugucuauaauauuucacuuagccaagggauugagaaaaauagaagacuguucuuggaaccaauuguuagguauggugauagggucagagacggaaaugacagauauguucaugagaccuuugggauucaugggcuuuuuggacuauuagucauccuggagugaguuaaaagauuucauccuggaacucuaguaucauauauuaaaugccaaucucuguaagcgcugcaaaaacaaacauauggcacaucugugcuuugcaggaggaaugguaauauauggaaucccuauuuaugaauaaaugcuucuggcauuuuugucuuagcaguuuggacuauuauagaguuugaggguuaguagaaucuaacacugaaugggucuauuaguuaucauuuacaguacaauucaucaaauguuuuugagcaucuacugugugcuaagcauugggauauuggggauagcaagagaaaaaaacauaaaaugaauuuuccugucauaggaaauuaggugauugggucuucugacuauuuuuuuuuaauuuaguacaccuuuucuacugucucuguauucuauaucuuugaaaaauaaguacaguuuucuuaacagagcagaaaauuccucaguaaauagauaauagaucccagacuggaccgagacaagauuucuagcuucuuagcuuuuuuuuuuuuucuucguuuuucgagacaggguuucucuguguagcccuggcuguccuggaacucacuuuguagaccaggcuggccucgaacucagaaauccgccugccucugccucccaagggcugggauuaaaggcgugugucaccagguccggcuccgaauucuagcuucuuaaaccuuugguuuaauaggcuccauugaaucaagagcaacauguuucuuuuccuugcaguucugaggaagaugugcuauccuugguuucauuggugaugugggauugcaaaaguagcauucaucauuauauauugaugauugcccugagaguacaaaucuauacauguuuguguaugcagaugcaugugaguaugcagguaugagaaggacagagauggauggacauugagugucuucaucaauccuuccccaccuuguugugucuaaguuuuaaaauuaaauuuauucuuuacaacuuuauagauauauacuguguucugguuacacucacccuccacccucuauuuauuauuucccugucauccuugccaugcacucucuacaagucccuauuucacauuuaugcccucuugugcaccuuauuuuuuggaacagggucucggugaaccuggaacuugacaguucacuaaguggucuugccagcaacucucugggauccuuaugucaccucuucuucagugcuggcuuuacugcaccugacuuuuuaugcagaugcugaagauaugaacucauguccucaggauugugcacuaagcacuuuacugagugcuccagugccccagugcccuagugcccuaguugccugucuuugacugaguuaguuuuuaacuauguggcugguggaugugcugcuauggaugcuauuuaaaaaaaaaacuuucccaaaacuuagugguuuaaaauaaaauaaaucgguauucaguugcuguggaugucaguagucuaaaccguguuucacuagacuaaagucaaggugugaaaauagcuguguuccuuucggaaaccauaagagcaaaacucuauuuccagccauuguuuagcuucuggauacuacuuauauuucacauuuugugaagacuuucuauauucaauccuuccaguggaggacugauuuccccacaucucaucacuucaauauuguuucuaucugcaucucugauuuuuacucuuccuccucucccuuccacuuauaaauacuccuauaauugcauugcacugccugaauagacagucuccccaacucagcguagucgauuugccgccuucacgaucuacaaccuuaauuccucuuaugccauauaaccuaaaguauucacagguucugggaguagcauguggaccuuuuugcaauaauuaauagauuaguagguuaauaggacauuaaaagacaaaggggccuuguguaccacucguccaguucuuccaguuguucaaccuugcauaaccaugcauaauaucaaaaccaugaauuugccuuagucauacugacuguauaguuccaucccgucauaucccauaugcauguuugcauaacuaccaacaugaucaagacaaauauuauucaucacaagagguuugcuugugcuuuacccauuguaguuuuugcacuuuuacucaauccauaucaaacuuucauagucacuauuccauuuuccauaucuauaguuuccucauuccaagaauguuacaugaacggagucauaaaugacaugagcuuuucauggacuccuuucacgcagcauaaugccccagcuccacccacauuuuuguuuuuguuguucuugucugucuguuuguuuguuuguuuaagaaaggaucugacuauguaacccuggcuagccagaacucacuauguagaguagaauggccucuaacuuagagaucugccuuucucugccucccgagugcugggaucagaggugugcaucaucaggcccagucauccaauuuguuuuguauguaaauaguucauuccuucuugcaauucaaaaguuuuguauaguaucacuauaccacaguuuagcuuuucacuugcugagagacuuugcuuaucuacacguuagucuaucaacacacaaagcugcuauaaacauuaauguacagguuuuuuuagagaacacaaauuuucauuuuucugugaugaauuuucagguaugaugacugguguguaugguaaguaccugcuuaguuucuuuaaaagcaaaacuaauuuugaacaaacuaucccagguugggcaugguggcacauggcuauaaucuuaacacuugggagcccaagguaggaggaucuugaguuggagaacaaccugaguuacaugauaaauuuaagucuaggcugggcuacauagggggacacugguucagaaagcggcaaggaaaggagaggagagagaaagcauuuuauagagugccggucuauaacuuauuauagcuuaggaagauugacauuuuggcacucuauauuauauuuauaaccuaaugguuuuaaguauuucuucuuuauguauuuauagcuauaucagauauuauaauuuuugcuucagcuguaaaacauaauugagacagguuaaccuugcucuuucuguuguuauuuuuuccugagauuccaagaucguguuuuugcacuuuuuuuccuguuuagagaacaucauuuaacaauuauuucaaggcagguuuacgagcaagaaauucuaacuuucuucccuuugaaaauuucuuuauugcccuuccacaguaguauauuuuccguaaaguauauuuucaugggaccugagguucaagguugacaguucuuuuuaugaauguucuugagaaauaugucauucuauucuagcuuccauggauucugaggagaaaucagcugucauuguaacuauuuucccuuguuaguaagguuacauuucucucuuuacugcuuucaagguauuauuauuauuauuuaaagaaguuugaccaugauccaugauguggcucggcaugcaguuuuugaauuaaccuacuuugaaauauaguuagguuuuugaguaugaagguuugugugcuuugccaauuuuaagacuuaacaagaaaaagaaaagacaagacaagaaaaggaauaucauuugaaauuccugacccaccuccuaucauucuuggcuuccucugaugacaggaaacuuuuugcuuuaguucuauaauuccuagaggcucuggacauuuuccugagucuagucauucuuuuuuacuuggaugaaaugauucccaucauucuaguauguuaacugauucauuucuuggcucuuuccauuuugcccaagagaagguuuuucuguauuauuguaucuuaucuccaaaauucugcucuuuucuuuauaugcucuguuuuuauauuguauuuuucucuuuguuccaaaaguacuuguaauugcuaauugaaccauuuuugucacaggagcuuuaaagucuuugguaauucuauuuauuuuauuuuuuauuuucuuauuuuuuguuuucaauacaucccaacugcaguuucuuucucuucccaccccuucuuguuucuuaguacaagggagggaugccuuuccuuauuuaaauugucuuguuuuguucuugagccaaagcuccauacuguaguaguguagguuccuguggaacucacugugaaauucagacuggccuuggacucaccgcaguccuccagcauugaccacaagagugcuaagauuacugagcuugaugaacaauuuauuuuauuguuuuuauuucuuuuuauuuaaauguacagguguuuugcugucuguaugugcaucauguguauauuaaugaccauguaagggaagcagcuuccucuucacucugacuuuugcauaauggcaacauuuuccauuuugaagaaucgagucucagaaacauucaagugaguuucucagagccacacaacacacuacuuugagccauagugaugauuauaggccagaccaucaucuuacuuccaaaugcaugaugccuguuuuuacccauagcauuuaauacucagcuucaccugacucauuucccaaccugcuccuucucgguucucaauagagccuuuaacuuucccuuugauguuguuugacugcagcuguuuuccugguuuauuguguggcuggagcaagguuagacaagagaggcuugagcuccuuugugggaaaggggaucagagagggaagaaauauuuaaaacaaccauuauauuauaagguacccucaaaaagcaaagagagccuagaguuuauaccugagacauaagcgaaaagggauuacagaaggggucaggacaggaaaccagaagacacuggauugauaaaaguaaauggauucaaugaccaauaaauaugcaacaaagaggccaagauuauagagauuucuuccaaguugagauaauaaagauuauuuuuugacuaugguaauaacuugggagagagaguuaagggaggaaauaaacagugucucuucauuagguucaacuuucauaacagaacaaaguuuuuaaaaaucucaaaaguuuaaguuauugugagaaagugaauucagaaaacuauguucccuauaugauucccgggaaccagugugauauugguucaaaaaggaaugacagaauacaucuggguguguaacagauaccaugaaaagguaaguggagauaagcauugucugcaaaacucaguuaaacaaaggaauuuaaaagucauacgacaauaaaguggggccauccaggagcccuaauccugaaagagacacguuuguucagucucuggcuuacagaccagagcagaaauguguugaguuucuuuggugacuuugauguaucaaggcuccaggcccucuaucuuaucucacuaacugugucuuuuuuuuuucucucuuguuauuuuuuucucgucuuuucaaguucucuggcuuuaagguuaaguucauuugucauuuaucaaaauaaucccugaaggguaggaguguagcucaguaauagaaugcauucaagguccuagauuugaugcuugcacugcaaaagaaauccauuaacauuacugaaguauguagaaaaauuccaacauuuuuucuuuaaacuuauauauaauuuuguuuugaauaagcaaaaguauugcaaaacacugagaaucgauaauggauauauccucagcuugacaaacuucaauacuuugaaugucaguuugcuuucuuuuuugguuuuucgagacaggguuucucuguguagcccuggcuguccugaaacucacuuuguagaccaggcuggccucgaacucagaaauccuccugccucugccucccaagugcugggauuaaaggcgugcaccaccacugccaagcuguaagcuugcuuucaauuucuaucagaaagagaaaaugaaacauagcaggcaaguuaaauucuguccccaagccuaaucauauuuaccuugguuuccagggacaagcauaaagauaaauuugguguguauuuucuauuuuguuuuuauaccucuguacauguaguuauaaccauaaauaauauauaaaacuauucaguauuuuuaauuuuauguaagcaaaauccuaaauuaugugccauucuauuuuuuucuauucaacaauuuauuuggagauuaccuuuuuaaaauguucuaugucuucuuugugccuuagagucaauggugcauguacauuauuuuucuuuauaaaauacgcacaauauuguuauacaaaaauugaaaaauucaaccaauugaccaauucaacuugcaaagauucuagacagcucauuuagcccagugguucuugcaauaaaauacugaagagcaaaaugagaaggguccugagagauaacucuuugccaguuuccuaacacauuuaugaaggaacaaauggaccaaauagaaggaaaaagaacuuaacaagaacauacauccaguauuauacuugagacucccugguucccuguucuauacuugaaacuuuucgaaaaacaaacagacaaagaagcaaacaggauagauagauagaaaaagaaacguaaaauuacaauuuuaauuauaaaaugauuuauuuugauaaaauaugaggaauacagaaauguagaaaaaugaaaucuaggacuugcuauauuuuaguauuuuuauuucuuucccuauacaguuuccauauuucuguaauugcuaauuuuuucuuaaauagauauagguuauauuuauuaauuaauauaugucuuaaauagaauaguuuaaaggauuauaauuucagaaagcauauuuuucagaaagguuuuuaugcauugaaaucuugucagcaaauauuuuaggguauuuguuuacuauuuagcuauugcaaucauauagacaguaacuaccugaucauacuugucugcacuauuguuuguuuauuccuguucauugggcagaucugguuacuuuaauuuuuaauuauaauuuaucuguauguguguuuguaauuauauuuauuuuauguaaaugaaugguccuagauuugauacuagcacugcaaaagaaauccauuaacauuacugaaguauguaguaguaugaaguauuuacuuacaucuacgaauaugcaccacaugugucuaguauccgcagguauuagaagaggcugucagauccucuggaacugagauuauagaugauugggaaccacuaugagggugccaggaaaugaaccuagaacuucugcaagaagaacaaguuuucuuuuuugcucauuuauauauauaugcauguaauaguaaagauauauaugcuuuaauauguuuguuugcuugaaagcuugcauagcaccuuuugguacuaugaaaguuagucaccaggguuuucaggugagauacagcuaggauccuccaaggcuuguguccaaaguacauaauguuuucaguaauaagagcuuuaccuuugggagguaaccaagggcuacagcaauagccuguauuguuugguagucucuuggacuuuccugaccaacaauucaaaagaagguuucuagugccugguaaugagauuuuuguuagauggucuguggcucuuagggcagggagaaucauuaucaggccaauugacauaacuuuauuuaaacuauacuuggauaaguauacauguaacuuguauauaguauauguaauuuuggguaagcaaaguucugagucuuucuggcuuuuucaagcauccuuaguguuauuuuucucuuuucuuccucuccuucuguauugcccuccuaucccgcccccauuaaagcuccaaccuuuucucauauaccccuucacaucaccuguacccugcuguucuccuccagcacaacccaugguaccuuuugacuuccauggcuucuacauuuauaccagguuaucuacucacaucugaagauuuggagcuaggaaaugcauaugagagaaaaaaugugauguuuguguuucuuuuuuuuucuuuuuuaaagacuaaaucuauuuauuuauuuauuuauuuauuuauuuauuuauuuauuuauuuauuauauguaaguacacuguagcugucuucagacacuccagaagagggagucagaucucauuacggaugguugugagccaccaugugguugcugggauuugaacuccagaccuucggaagagcagucgggcgcucuuacccacugagccaucucaccagcccagauguuuguguuucuagaucuaaauuacccagucaguauauuuccuaguuccaccucuuuaccuaaaauuuucaugauuuauuuuaauuuuguuugcaauugaauaguauuccauuguguauagguaccacauuuucauuauccauucauugacugaaggauauuuaguuuguuuacauuuccuagcucuaugacuagaguggcagugaauguggcugaacuaguaucucuggaauaagauguugaguccuuugggcacaugccaaagagugauagggcugggucauaugguagauuuauuuuuagcuuuuugagaguucuccauacugauuuccagaguggcugcaccaugauaagauauuccuaaggauuaaauagugccacucauaucuuggcaggaacuaacugcugucuaguuggacuuaaagccugcucaacaggagggaaaucauggcugauaagauacuguaaaccuagccaacucccuggggcuagugaagucguggaucuuagaggagaaccuacuacaacuacuuuaauaaaccagaauaacuccuaacugaauucuaaacacuuaucucuagacccacagauaaguccaacuuucacccuucaucaaagaaacuucugucuuacaauggacagagaccauuauagaaaaccacauucagucaaaauacaguuaacaacuaaucucugggguacccacuuccagcaaauacaucuacaacacaacuccuguaccuaagacucaggaaacauugguaaugaaaggagcagaaagauuguaagagcuagaagaccagggaaucugugugagauuaugucuccuauaaauggcagggaagguucacgcaugauacaucagcaauacugcugccuaaacaagagcugaacaaagauaauaccaauagacauguuaucauggaaggggccaaucucaugggucccauccauugacaaagaacuauagauaacuaagaacugccaagagagggagacuuagucaccacacagaugagcugucuaguugguuacuaaauaccaaguagucagcccugaaaucauauacauacaaacaacacuaaauggacccagaagguuguauuaaaaaaagaaaaagaauuugaaaggaagcaaggagguagagauagggauuggagggagaaaagggaagggggaaauuaucuaauucuacuuuaauuuucaaaagaagaguaacaagcuugcuuaauccacugagccaucacucuaacucccaucccagaucugguuccuuaaaagcugacaucaaaccuuagauuccugaaaaaaaucauucuggacaauuagauagccaucuggagugcuugaggucugaccaaugacauggaaggaaauccuuucaccucuaaaauaagcauguuuuggagcacaaagggaguuccuucuagagcugcugguuccauggaaguuuaccuuggggaauaaauaguagugauuuauucugcuccauuaagugggcugggaugcuuaauuucuccacagcuggagaauaaacgggauggaaaucauuaaaaugucuuuaucacuuacuaagagaggagagguacaugucuagacaacuuguaugcauacauauacacacaauuaaaaauuguuuacaguuuuguuuuuaucauuuaauuguaauccaugcaaagugcauucaauugucaggaauuucuggaagaagggagagugguaguuuauuuuguuuguuuuuggggugugugugauauacaugcauguauaugugcaugcguguucacauguguguggugguacaugugcacaugugugcauauggaagcccaaaguuuguaucagaugucaccuucaaucauguuugaccuuauauagugaggucuugcuaaauccagagcucauuauuuaggcuauucugggucaucuguuaacuccagggauuaucuguuccuuauuuguuccaccuuuuguguacuggcauuacgaaaaagccauuaugcucuuaccugcugguauuauacacaggcagguauaaucauacccacuugacuuuuacaugaguucugggaaaucuaguccuugcugagccaucaacucacaccuggugauagauuuuuguuuuaggcaguugaacauacugagacaacaaagcauggagaaacugagcaaguugaguaucacacagcaaaaagguaugauguugauauuaaaaaauaaaauaagugggguacagagugguuaagaucagugguuaagaguguagagaccuggaguuugguucucagcacucauuucagguggcucacaucugccuguaacuccaagucaaagggaucugaugcccucuuuuugccuccauguguacaaacccacacuuagacauacacauauacacauauuuuuaaaaaauaauuaaaauaaaaaugaaagugccauuaucuuuugucucuuaauucuuacauuucuauuuuuauuuuucuucuauuucuauuguauguugggcacaucuaucuaucuaucuaucuaucuaucuaucuaucuaucuaucuaucuaucuaucuaugugaggccacauaugugccacagugaguauguugagaccagaggacaauuuuugagaguuaguucucccuuucugccauaugaggggauggaacugaggcauggcaacaagcaccuuuacccaauaagccaucuuggcaguucuccucccaggucuuggaccuuguaaagcugcaucuuagcccacgacaacucacccaugguucuacguuaaucaauuuaaauuggugcugcuuugcccuugcugcccugacugucuuaauuuuggccaaauggcagcucacaguaguuguuaugaagccuugccaauuuuaauuguucuguucuuaucuccagcuuuugggcagggcuggaaaggugcuagagucaugcuaguugguagcuacauuuugaccccaaauuuguccaauaaugguuuguguuuggaaggggaugguguucauuuacuauuguaaaucagugagaaucccaggauugagaacaucaugcuuuuauuuuuuaauauaauuuauuauuuauuuuuaguuauucucucacacauuuucauccacauucuaguuuuaaauaaaauuaaaaagacuccuuuauacagaaucauauucccuauuaaaaaagauuuuuuuguuuaaauauaccuauuucuaaaaccgcauagcuacagccaccuacuuuuugacaaagguguuaaaaauauacaucagaaaaagacagccucuucaacaaacgaugcugagaaaacauuugcaugugcaagaauagggcuaaauacauaucucuuaucuugcacaauaaccaauuuaaacuggauaaaagaccuuaauaaaagaaugaaaugcugaaacuucuugaggaaaacguagguaaaacacuugaagauacaggaauagguaaaaauuucacuaaaagcaaaggaaauaaacagcgagugaagaaacagcccacagaaagaaaaaaucuuugcuaacuauaugucugucuuuuuuuuuuuuuguaaucaacuugacacgcuaaacucaguugagaaaaugcuuccaucagauagccuguaguuaagucuauagugcauuuaaaaaauuacugauguggaaggcccaucgcauuguuugugguacacccggggugguugguuugugggaauauaucagaaagcagacugagcaagccaugaggagcaaaccaguaagcaauauuccuucgaagucugcuucuguuccugccuucagauugugccuuggcuuccuuugaugauaggcugugcuauggaaauguaagucaacuaaacccuuuccccuccaaguuguuuuuaguuuugguguuuaucacagcaguagaagcuauagcuaagacaauuucagagaggggauuaauaucuagaauauauaaggaacucaaaaauaggugucaaagcucacaucaaccgauaagugggcuaugaauugaacagacuuaaauuaaguaaauaauuaauuaacuuuacauuaugacuucaguuuccccucccccucccaguucuucuccccuuccacuccuccucccuuucuccuuagaaaagggaagaccucccaugaauaccaaccagcuuuggcauaucaaguugcagcaagacuaagcagcucuucucauauuaaggcuaaaggaggcagcucaauagggguaaagggucccaaaggcaggcaacagagucaaagacaguccgcauuccagcuguuaugagucccacauaaagacugaacuacacgcauuucuugaaagaaacacaagggauaauacauauuugaaaauuuuauuaucuuuauccaucaaugaaaacuacacugagauucuauccacagucaaaauagcugucuccaagaaaacaaauaacagauacuggugaggguguggagaaagaaccuuuauauacugcuggugggaauauaaauaaauguagccacuaugacaagcuauauggagaugcauuaguuauuuuugaccaaggcaacuuuagaagaaagaguuuauuugggcucaugguuccagaggcauaaccaucaugaugggaaagcaugacagcuuacaucuugacuuaccauaaauuagguuuuaauaggaaauguuuaugggucaaauaucccaugaagcauaauaacacaugugagaaaguaagucugaaaugcaagaauuaaaauaaaaccucgguuuuuuuguauggugguagauaaugauugauuggugaagccagaaccuagaaugugugugguuagcuuugggaauaggagugugaacagaacaaaaauuaauguuuucuaauuguccuugccugcugcagauauuaagcagcuagcucuguguuuuuuuuuuaaaaccauuuaucaaauacuaauggaaaggugcugaggugucgcuaaucccaaacaguauauaauccccaagucauuuuauuguaauauccugucauacauccacaccccagugccccuuccccgcuguucuauuuuagaagauucggagacugcacugagagauuuggcaaauggggucaacuuuuauugcugggcugucuguguuuauucacacacaggguaagaaauuuguaacugucuugucacauuuccuuuauaugugcucuagugaucugggaagaacaaaaacucuagagaaaacuuuucuccuuuacuaucuggccacuccaucaaucuuaauaucaauuuggacaaaguauaaauugugguguguacaaacuauuucaaaucagcuccucgggauaaaagauugccauaccaaaagaaccugaggcuuuuaaaguguuuugugcugaaacgaaauagccaucuaucuguggugccaccuacuggccagaauaggaaggagaaaggagcaaaugggaaggacugaauuuccuuccaguccauguuggccuuuucaacuucagugacaaauggugggaagaaacaggugaauguggacacuaucuaucccugcuuggagaguagagcuuguugacaauugggagcaccucauuuauguuaagucuuaguuuuaauguguuaugggucucuaagaccgagaacuugggaauugugaugauauaauugagucuccuagagaggaagggaaaaugaggcaggguuuuaacuaucaaaauguaugagcacuuuuuguuugccaauauggagaaaaaacuaagcccuuucgaacauaaauaaauaauaaauguuauaccccaaaauuauuagcuuuuggaaauaugguuaauguguuuuucuucuaaauuaggaaguuaauggcacagccaggucagcugugaauauaaauucagaugggucugagugaucuuguguuuaggcagcuagaaucuuuacaaaaugucugaugagcccaagaugaaacuuugagggaaagcguccacacuacuuguagaugcuaucagauuuuguauagacauaugcugaguaguuaaaaauucuuccaauuuguuucauuacaguuuucauaucuuacucuuggaugaaauaucuuccuauucuuucucugaccucaucauucugccucauauguguugaauggaugaaauuaaguauaguaguuuuaauuugaauaauuuuauugacuuggcuugccuagcugugacuuuacagcuagacaugugguaguauauauaagucuuacuaaucagauguaucuuuuaugucuauaaacacaugaggguaaaaaaacaaaaugccuggauuuuuagucuucuguuugcuuuguaccaagaggccuaagaacuaugucuacuuuaucuucucuaauggugaaauaaaacacuuucacuuuuucuauuaccagaaauuuucugcuuuuuggauuauucgguuuucuuuacuccucaacuguucagugccacaucuaacaaagcauaugguuuuucuaucaaaggagcagucauugcucuuagguaugcagggggaaagcaaaaauuacaaggguuaaaaaccaauccguuccuuucugguauuuaacuucuaagucagcaucuuuuuuuuuuuuuuucuuaaaaaaaaaaaaacaacugucuggcuuucccuccuugccuacccucacuccuauacauaaauauuuucuccuuuuuguuucuccuuuccuccuuugcuaauauuauggauggacugacagcucaaaaauacucuaauucuuuuuuuuuuuuuuuuuagcccuggcuguccuggaacucacuuuguagaccagacuggccuugaacucagaaauccgccugccucugccucccaagugcuggcauuaaaggcgugcgccaccacugcccagcaaaaauacucuaauucuaaggaacuagauuuguucuuugauauuucauugcccccgugguuuuaauuagguguaaauucuccuaugcuugcuuugaaacaugccucaggaucuuagugagauuaaugcagggagauguuucucucuucauggugcccaggcaacauuuauugucauuaaaauagugucauucaaaugagguggcugauauuggaaaauaaaugcaagguuguuuguuguucugggucugagcuauggugaagagguggaauuggaggcaacacuugaacccugcuuaugcaguauguaucuauguaucuauagcucaauagaagacuccugacaugaggacaaagcuucuaagacuauauuaggguuggggcaugaagauaccugucucuucugcuuuccaagcugagaggaaaaugugaaaaaaaaaacaugcaaaguagccaauguacucagaaggaaaaaaguggguaucuucugagcccuggguaagauccuggguaauuccuuuugcccugccaaguccuggaagcccuauaauauuuuuuucuuuccuaaucagguuuucuucugguggccagguuaaagagaaauugauuccuuuauaggcaguguuuagcuuuuguccuucugcauucaggcugucaauugagaaacccucuuuuagucuguaggacugccugcugauguuuaggcuuaaacauuaaacaaucuuacagaccuaauuaguauuuauggcuuguggccaagucaacuaauuuugcuuuguagaauuucugagaggaaaaaaaaaaucauacuuagugaaacucccuucaugauaucuccuugaaaauugaaguguugcugaccuaguggaaauauuucgucguacacuagauugggaacaacucucacaaaacauaccuuuuuauacuguguucuuuauuacaucacacuggguuaagcugugaagagaugaggacgauaguggccauuuuuugaaaaguagaauagauugaaucaaauguguagagaacacugcuugauugauuugaaacugaaggucuagccuccccagccccuugcuccauggcagcaauuucuucuuggcuagagaccuaagcaucuguguccaaaucucauauccuuuccuggauggauucagcaaggcaaaccuugaguugcuuagaguuauuuuuuuucaccauucccuaauuuaaguuaaacuuaaaaaugaaagccauuaaguagcaaaacaaacaaauacaaggauaauaagagaacauuuuguccuggcccucagaggucacuuuaaugugacuagcagcauaaaacuucacaaaggcuuucgcuggaggguuaccagaagcugcaucauucaguguguugccauauacugcuauucuuucacuuuggcauuauuuauugauuguaacaggagcacaguauuuguaccuauuaagccuuuuaguuuccuuucagcuuuuccugaguaaaaguagaauggcacccauuauuguugaacuguucucaaggcuaaaaaccuccugaauguuguuuacaugcaugguuacaaaggcaaguacugaggcagaacugcuuugccugauuugauuccuaucaaggguaaugugcgcucucucucucucucucucucucucucucucucucucucucucucucucucucucugucucugugaguguguguguguguucacacagaagaagugagugaguagaguuuuaaggaagggagacuggaaagaaaacuuucaaugaauuaaaacuacauacugagaagauccugaaauuuaauuaggaaaagauggcuguguuuuuucucucaccuccuccuccucucucucucuccuuuccuuccuccauccuucacuuuguaacagcaccaaagugaaaugagacuauucgauugaagcugcacacccacuguaggucuguuuugagaaaaggauuuuuuuuccuccccacauuuacuuggugguagcagcagcagcagcagcagaucuauugaugaauauagucgcuauguggcaucaugccaguguugugcucauuuccaucucuucuguacuacucucugguugggugagcagaguccaagcuacaaguguguucacuuuuaauguauccugugguuuacagugugcucauucaguguucaaccacuaaaacccucugcuugagagagcuggagauuuaguuucugacuuuagucagaaacucagcuuuagugugacugugcaguggguuugcccuuauggacacaggaucuguugggaacuuuuggaaaaggaauagaacauguuuuuaaccuaaggaauaagaauguguuugaaaacaaauacacaauucuaauaaugcauuuuaaacuacaauugcaugacuuaacuucgaguuuccucuuuaaauuuuaaauuuuugucuuuagagugcguguaccaaaauccauuaauaauuuucaagucaguaauuaauugucaacuuaucuaaaccagugcuuuggcauuuucuuggucuuuucugacucugguuuugguuuuguuuguuuguuuuuuucuaguauguucuugguuauaaaauuaagcuggacagugguggugcacaccuuuaaucccagcacucgggaggcagagacagguggauuucugaguuugaggccagccugaucuacagagugaguuccaggacagccaggacuacacagagaaacccugucuucaaacaaacaaacaaacaaaaaauuaaauuauaccuucuuaagaaugguggauggucauuuggcuuuaauacauuccaugaaaccccuccugugcacauucggguauaacuuccccacaugugauaaauaccucuccagcuggugaagagaggcauaaauaccagaacaugauugaggucacuggauaugcacccaaguugggagaagaguaagaauauauaugacgauggugagccugcaagaggaacuagguaccugaggggaaaugguauuggguagcaaggaccuagaauagugguucucaaccuuccuaaugcugcgauccuuuaaugcaguuccucauguuguggugacccccaaccauaacauuauuucauugcuacuucauaacuguaauuuacuuuuuugcuacuguuaugaaucauaaauaucagauuugcaggauaucugguauaugcccccuaaguguguugcaacucacagauugagaacugcugaccuagaaggaagacaaagcaggcugaaaagcacuguguacuuaguuauggucaucaccaaacaacacuuccugcuucuuguuucuuauuucugagauguguacacuguauaguucaaugcacagaagcucuauacagcauugaucauuucauucauuauuauuauuauuauuuuuuuuuuuuugguuuuucaagacaggguuucucuuuguagcccuggcuguccuggaacucacucuguagaccaggguggccucaaacucagaaaucccccugccucugccucccaaguacugggauuaaaggugugcgccaccacgcccagcucauucauuacuuuaauaaaauuuuaucacuuucaugggcuuuauuggcucuuguugauaucuuuucaaaucuuagaacuagauguaccauuucuggggguguacucuuggaagaugaauuuaccauucaaccacauacacacuuagcagacauuuuaaagacccacauucuuuauuauccuuugugauccuaaaauucucuguuacaucuguuacucugaguuuuauuucccuuguuagauaaacaggaucuucuauuugcaacucagccuuguagccuaaaacuggccaaaugaccuagaacaacuuuuuuuuuuuuuuccauuuuuuauuagguauuuagcucauuuacauuuccaaugcuauaccaaaagucccccuuacccacccacccccacuccccuacccacccacucccccccuuuggcccuggcgucccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcguuuggaugcugauuaugggguggaucccuggcuauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccacgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucccauucuucuacacgauaacaaccaguugugccagcaccaauuguugaaaaugcugucuuucuuccacuggaugguuuuggcucccuuguugaagauuaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaaggauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccaucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguguuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucucucagcagaccugggagacagauucucuccucugaguuucagugcucagagcacucucugcuggcaagcucucuuacagggaaggugcgcagauaucuuguauuuggaccuccuccuggccgaagaagaaggcccaaaacaggaccuuucucagacacuguguugcuuuggcaguucccaggugguacagacucucaccuaagcagacuaaauuccuaaguuccuuggagucccgggaccaagauggcgaccgcugcugcuguggcuuaggccgccuccccagccgggugggcaccuguccuccgguccggaagguggccggcuguccccggcccacacagggugcugccucagcgccucugugcuucugccuguuccagaagcugucagguucucuggcgcacccucucaccuguucagacuaauuuccuaaguucggagggucucagaccaagauggcgaccgcugcugcuguggcuuaggccgccuccccagccgggcgggcaccuguccuccgguccggacgguggcuggcuguccccggcccacaaagggugcugccucagcgccucugugcuuccgccuguuccagaagcugucagguucucuggcgcacccucucaccuguucagacuaauuuccuaaguucggcgggucccggaccaagauggcgaccgcugcugcuguggcuuaggucgccuccccagccgggcgggcaccuguccuccgguccggaagguggccggcugucccaggcccacacagggugcugccucagcgccucugugcuucugccuguuccagaagcugucagguucucuggcgcacccucucaccuguucagacuauuuuccuaaguucggcgggucucggaccaagauggcgaccgcugcugcuguggcuuaggccgccuccccagccgggcgggcaccuguccuccgguccggaagguggccggcuguccccggcccacacagggugcugccucagcgccucugugcuucugccuguuccagaagcugucagguucucuuagaacaacuuuuaacuugcauuauuccugccucaguaguauugaaagugugcaucaccauaccuuaguuuuaaaauaaacaaagcuauguguuuagauaaauuuaggaaauaauaaaauacacaagauaaaaugaugucuuuacuacacaucuuaaaauagucuuucugguaugcauauugugauucugguacauuacucaacuaaauuugcugaaaauaucuuuaguaauacuuuuuuucuuuuuuuuaaauuagauuuuucuucauuuacauuucaaaugcuauccugaaagcccccaauaacccucucucugcccugcuccccaacccacccacuccugcuuccuguuuuuuguuucaagguguguagauuggaacuaucauuaaaauuuauagaacuuggauaucuuaggacacauaauauuguauuuguaauuaucguuccugugcucauuugcccauugccacuucugugcuccaacaaaaggaaacuuuuuuauccugaugucaguacuuccuuccaugucacugguuuucauuuucaaagcccaagaaguugcuuucauaucccacuccuuccuuugcuauauuucugcuuuagccaugcugaaaauucauauguaccauucugauccucacagagaaguucuuucuccgcuuggcaggcuuaaacauuaguggguauaauaagcucuauauaagcuugcugagacuucuacuuuuuaagcacuuuuauagccaucaucucaugggauccaugagaccacccucaguagguaaucagugagugaagauuccauucuagcucaaggccaugcagcuaaacguaggggcaauaguguuuauagauaaauaaguuuuacuacuuuuaacucaccgucaauuccucagucuaauuccuuuucugcuuuucuuuuuugaaacucaucauauauaagaauugcuuggcaaauaugagaauuugcugagagagcaaauuuggaaaacugaguggagauuacacauggaugucucuggcugggucacucagugcuucaguauuccaugggaaguuaugaugaaaaaaaaguaccaaggcaaaccuugauugagccaucacaaagaagaaucauuacuagauaucuaggauccuuugcucuugaugcaaaggucuacaaaaucaugaaaacccauaagcuccucccugauugucaaaggccuacuggaagaacugagaaagguaauaacuaguugguccuguguauguuuuucggacaugauuauuggagacaggcuacggaaaucguuuuggcacaagacauacauucucauugugggaaaguuugcuuuuuuggacaucuggcaaugucuagagacauuuuuacuaagaacuugguugcuacugacaucuaaugggaagagauuaaagaugcuucuaaaccuacaacccaucccuaccuuacacacacaacaaaaacuaauccaacccaagacagagaaauucuggccuuagccucucuuuacaaaauuaguuuguucucuacuuucaccuccaguaccuguacuauguauguacauguguggauauuucuuaaauauccauuuuaaaagucuacccaccuaagaauagcccucagauaguacugugcuccaaagaaaugauugugcguggacuugauauuuacuuggagugaguauuagguucaugugggauuucagguauaccgcacauauaggacacaggaucaccugcuaauacucauguggauguuuucuauaguuuuucauuacugugauaaaauacuaaccaaaagcaacuugggaggaaagcucuuuccuuuuauacucccaugcccaguccaucacugagugaagucaggguuagaacucaagcaggaaccuagaggcaggaacugaaacagaaaccaugauagaaugcugcuuacuggcuugcuuccuguggcuugcucagcuugcuuucuuaaauaacccagagcaaccugucagagguggcacagcccacuauaggcuaggcaccacuucuacgucaaugauuggucaagaaaaugccucacagaaacaaccacaggucaauguaaugaagucaauucucaaucaagguucccuaguuuguguccaggugacucaaacuaacuaucaaagugcuucuuaucuuguugauuuuccaguaauucccaaacuucauaggccucagguacuacuuuggaguaagcagaagggguugugguaagcuuugagauauaaaccuaguggggauugcuuuuaagcucucugaaugcagguggcuugaauucuuuuuuuaaaagauuuauuuauuuauuauauguaaguacacuguagcuguacuucagacacuccagaagagggcgucagaucuccuuacggaugguugugagccaccaugugguugcugggauuugaacuccggaccuucaaaagagcagucgggugcucuuacccgcugagccaucucaccagcccaauugggagcuuuuguuuguuuguuuguuuuucaagacaggguuucucuguauagcucuggcuguccuggaacucacuuuguagaccaggcugaccucgaacucagaaaucugccugccucugccucccgagugcugggauuaaaggugugugccaccacgcccggcucaaauucuuucacuuaaauaaguugagcuaagaggagucggugaggagauaguuucagugauuguugucuggguuuuuuucucaguuaucuuacauguaggaagauauuuuaaccaauucagccacuacagcugucaauguggaagaaucuaaggagaaagccaugugcaugagcagaagaaguauagacauuuggugagcauccagguauguuugaucuuuugaauuugggcuucaacucagugucuuucauuuguauaacaguuucuuuccacucuuaauuucucuugacuaaguggugauuaagcauuucaauuuuggcauuauagauaauaaaauggaauucauucuuuuauacuuuacugugguacuggugccugaguaccagacaccaauggguauuggacuccacaugugcacaugcccugugugauggguugaacaagaauggaagcuauaggcucauagauuugaaugcuuaguccccaguuggugaaaccauuugguaaggauuaggagguguggccuuucuagaggaggaguggccuuauuggaggugauaggucacugagagugggauuugauauuacaaaaguccaugccaucccagucuccaccccccuccccuucaucuugauccacaggcagcagaaggggacuaugugacugacuugagcauaugaccacaaagcucugccuccacaguggcacacugccucuaacaaggccacaccuacuccaauaaggccacacuuccuaauggugccacucccuauggccaagcauucaaacacaugaaucuauggggacaauaccuauucaaaaaaccaucacuaggugguagaaagaguguaagagucaggggggauggaggacuccaagaaaacaagguccucuaaaucagcccauaugaacucagagaaacugagacagcaugcacagggccugcacaggucugcaccagguucucuguguagaacauuuucuugguaucuacauauuuauaucgauaaagauaugacccuucguuaaauccccagcacuaaaagaacagauuagcugaaugguggccuaggaaaaugacuccauuucuccuuuauuucaaauuugucaaaacaaauuaucagguugguuaaagggggaaacuauguagcccucugaauucaguuaucuucucagaauccuucgcaacacuggcguucuuuugauugucuccuuuaaugacugucucaagccugucuucuuuucuucugaguaguaucccuuugguaccuaacacgcgacagauaggaauuguuuggguuuaaucugucaaaguacaucuaagcgagaaccaucacaggauagcuggggaccacaaagagauuuccuugcaggaaagacccuguuaauuaaauuuuguauaaagacucaccagaaacaucuuuuuuuccaagccaaaaguuauaagaauuucccagagagaccucaacuaugggcuuuucugugaaaaucaauuaguguuaugauuaugaaauagcuuuccuuuaaaaaaaaacauuugucacaacgaaagucuacaccuuaucauaaagagaaaaaaauuugccuucacuuuuuugccuuucaauucucuuuuugaauagucuacaacaaauaguuauuuuguguguguaugugaguaaaacuagaaccucauauauacuagguaagugcucugucacugaaaugcauucccaccuaaaauauauuugaaaugguuauuuucuaguggauaguacaauagaucccuuuccuaugcugaauaaccuaguccucuaaauguuguuucuaccuuuagucacacacacacacacacacacacacacacacacauuuuuguguccuaaaccaaaaacuuucuugguccaggagccuauuaucuacuuaucugcauuaccauaaccuucuaauuucuuaauuuauuucaacugauaaacauuacuuaauauuagucuauuuuguguuaaagugucuuaaaauuauuuuuucuuuuuacauaauuuugguugaacaguacaaauuuguuaacagaauucuuuacuuuuaacuuaaauauuucaacuaaauucaagaacauuucuaaaugcuauuucuuuuuuuggauaauuugcucuuuauugaucuuuuuuuuuccuuuuuucugccuauuggcuccauaccuaccuucuauuucuacauauucaaaucuuccccauucuuauccuacuuaagcaaguguauaucuugagaagacaaagacuuucuuauuuaugccacuaaauaaugcccuguaacugaauacacuaaacuuuuaaaaaaugaauauuacauaacuaacuuauaaagagaagaugaacuaugcauccaagaagcuuuucuuggucauugucuuuucuuuuuugucaacuuauacaaacuaguaucugggaagaaaccucaguugagaaaaugcuuccauuagauugccuauaggcaagucuuuagggcauuuucuugaucaauaauugguaugggaggcccagcacauuaaagguggguguuuccacuccugugcagaugguccuaagaaaggagacugagucagccccagaagcaauccaguaagcagcauugcuacuauuucaguuccugccuccagguuccuggcuugacuuccuguucugacuuuccucagagauugaguguaaccugucugaugaaauaaagcauuuucucccaaauugcuuuuggucagacagaaauuggucaugagguauugcuauaauagacauagccuuguuguuuuggagaggauuguagcaggaguuuggaauuugggggugggaaaucugugacuguucauaucauaaugggcuauucuguuggggcuuggaagauacaaguguugagauuaauguagaugaugggggccuggcuugugacauuucagagggaggcaaagacuauauuagggucaugugauauauuugaaauaagaaucuguggugucucucagcuggagcugaaaaaaucggcugugauuaacaagacacaagcaucauugaagugaaacuuacauugcugggacaauugaugcugguucacuggggcauagaaaucagcugcuauuaagaacagacuuagaucaugaggugaauucuucugggaguauuucccugggaucagcacggagaagcugugguccagaguagacaaaggcugcaaauaauggaggcauaaaaacuugauaauguguaaaguaucucccgugggguacuaguuuugaagacauaagagggaucauggagaacaucugaacuuuagcacuguuugagagacuagaaagucuguuggggaaagugccaccgagucccaguggggaccccagcauauuggagaugacauaacuguggaaaaaccaucaaggauagcaguaccuaugaguggaacugguccgagccaacaggacaaaaacuguguuguggaugggaaagccagagaaguggagcugcccaggguuuggaguuuagaggauuuugaauggguaccagaugcaaagcacugaacuuuuacacuggugaagcuugguuugcuuugauuugguugugacuauacccugacuucucccucuuguaguaagacauucuguaauuuccuuuucauuuuuuacaagaucccacaauuuauuuuggauuuuaaaggagacauggauauuuuaaagagacugaacuuuuuagcauguuugaauuuuuaaacuggaacuuuuaaaguuauuuguguuuugugauguucuuguguuuauuggcacaauaauauugugauguuaacauuaauaugagauauuggggauugauuaaaaaaggaagacuuacugcaaguggcugugguuuuguuauccaaacuucuguaucccuuuuaccuuucaggcagaucaaauuuaggaauguguucauauggaaacuggacuccuuuaaaacuguccugcuguccauagcucuuuuaaaaaaaaaacuuaauuaugugggccacaguuuugaaauuuuucuauuuggcaugcuguguuugcugaaugcuauaaagaaauggaugaaugccuauauuuguuagaacugugaaauggaauuauacuaugaguauuuuuaugcugaaucaucaccaccaagguggguugaagacccaccauauucagccuaacaugaugaaagauucaccuauuacaaagacauauuuaaaacaaagaugcuccggauucuuccuaauuucaauuaguauguuagguuggguuacuauaaagcuuuaucauagucugagugcuuauaaacaauaaaguuuacaguucaggaugcuggaaggucaaagccccaagagacugaaaguuugaugggggcuuccuuucugguucacagccaacuuugaaguguaccuuauuuguagaaaaguccuugugaaugaaauuuuaaaauaucaaaaugaaaagauuauuaugaauuauuuuuguguguccugugugugcuguguguguguguguguguguguguguguguguguguguguguguuauaagaaaggaagaaucuccauaggucuacagagagugcagcccugcucuaccuugauuuuagacuucuggauuuuugaacugugaagaauaaauugccaucauguuuuuaggaauuuguuacaaaaccauaaaaauaaaaacaauuaauguuucaaauccaugauaauuugagguuaacauauauccaguaaaaagcaaacaaacaaaacaaacaaaaaccaugaaauuucugucagcucauuugaauuugauuuguuuaucauggaagaaaaauagcuuguaguguugauuaaaguauugcuuuuauuacauuuuuauucaucuugugggaagaggcacacauaacaggugaaaaaagucagaagacaacccacaauugucaguuuucuccuucuaccaugugggucuugaggaauaaacccaggucauucagacuuacuuacugacuacuaacuacuaagcuaucccaccagcccugauaguauaauuuuuaagcaaauaagagcacuuuuuaccacaagagaaaaaaauacaaauaugaaaaaauuaauaauccugaaauauuauuuaauaagcuauaauauuuugucugugaacaaaaaauuuaguaaguaagcagucuaggucagacaugagcuaucuauuggugauuauaagacaaauaauucuuccuuagaauguauucaguugauaggaggagugcucagucaagcuuggaacuuaauugucugauauuuucauugauaagagucauuuaaugagaugaauaaagugaacuuacaugucguguauacucaaauuuuuaauucauauuaauauucuauuauaugcuguuauuguuaauaauguguagucuugaauagacaauuuuuugaaagaauaguguguguguguguguguguguguguguguguguguguuuguguguguaccuguggaggccagaaaaggaugauacaagguaugcacucuuaaaauuauauuucccaaaacgcacuuguaauugagggagugagacaaggccuguggacugugauuuugaaguaaugaacauucgcuuuaauaaaucagcacuuaguuuauguuuucucccaguagugugcguagcaucuuucagcacuuucaaagcuauccaguagggaugaaaugucuaguagaguaccagugaaauuucuccuuguuucauaauucaagaauauagugucuucagcaagucauuuuauagaggguaaucuauaucaggggcaauagccuguaguauaugggucuacauauuuuauauuuuauagaggggucuaugggaacccauugcuuagcauguucagaugugguaacccauuccuuguagaggguugguugucguuuuucccagugucugaugucuacuuuggguauuucuccccauuacaggccaacugcauuuuaguguuucauauauauauacauauauauauaauauauguauauauuauacauauauacauucaauuuuaccaugcuuaccauaaaaaauaaaucagcacuuaaauauuaaaauggauauugucuucuaaauuggucacauuaggaaauauauacauuagucuuacgaaauugacauuacuuaaaaguguuuuggaauuguccaguaauauuuucuucagauacugcaauauguugcucagaacucuaugaguagaagcuaugucacuuggauccugccugcuuguucuuuuauaaauuaaccucuuuaaaguagagcacaugugugcaaaaccucagauuuguuuucuuuuuuuuuucuuuuuuucuuuuuuuuugguuuuucgagacaggguuucucuguauagcccuggcugucuuggaacucacuuuguagaccaggcuggccucaaacucagaaauccaccugccucugccucccaagugcugggauuaaaggcaugcaccaacacgcccagcucucagauuuguuuucuaaagacaaguuuguuucaaugcuuuaugaacauauuuuaucagcauugaaauaggacaucuagacuuuucuauugcaaucuaccucagcauacauggcuuccuugcuuccaauuucugaugagaaggguugauuagaaagaaauugcuauggaucaauaucuucuguguguuuccuaaucucuuuauuuuuaaguuaaagaacuuucuggccaauauaccauuauauaucaaguauauguauggguuauguauuuugcauguuuaggcaaaagucccuggaucagaagaauuguuuccaaggagcaguguuugcaagaauucaucugcauacauauucuaauaacaucuucuuaccacuuuuccagccucugccuccugccuaauucuauaaauuaguuugacucaguucaguuguuuguuauggcaacacuguacuagguacaaauuucuguuucauuuagucuuuguugcauaagaaacuaccccaaauguauucauuuaaaauaaaaaaaaacaaaauauaaagagccaauuaauaucugagacacaacuaauccacuaguaaccauuuauauuguuagacaguccuguauagcuaugagauaaaauguggacauggccaauauaguacaugaaacauagagcaaauauaugauaaauauuuauuaucugcuuauguagcuuaaaauguagcuaauuucuaauuguaccccauucugcaacaaaauaaauuauuauuauuauuauuauuauuauuauuauuauuauuauugguguuucaagacagguuuucucuguauagcccuggcuguccuggaacucacuuuguagaucaggguggccuugaacucagaaaucugccuaccucugccuccugagugcugggauuaaaggcaugcaccaccaugcccggugaauuauuauuauuuuuuaucuauaucaugaagcuucauuuauauuaaaacuguucuaaucauuaaaauaauucuccuccaagaucaacacaaucagguccuuuugucauccucacaugucaggauuuauagauaaaguauuucuaagggagaaaugaguaguaccagaaguuuguuagaguccacagaccagauauccauauggcacaaugagcuugaaaagguugagugaugaaaguaaaauauaucuaucuggaccuuaaaauauaaguagaauucagauggacugaaaaaggacuugaauggcuaagaucaaaaauucaggugacagcagaugcuggcguggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaugccccaacugguaagaaggacacaugcuccacuauguucauagcagccuuauuuauaauagccagaagcuggaaagaacccagaugccccucaacagaggaauggauacagaaaaugugguacauuuacacaauggaguacuacucagcuauuaaaaagaaugaauuuaugaaauuccuagccaaauggauggaccuggagggcaucauccugagugagguaacacauucacaaagaaacucacacaauauguacucacugauaaguggauauuagccccaaaccuaggauacccaagauauaagauacaauuugcuaaacacaugaaacucaagaagaaugaagacugaaguguggacacuaugccccuccuuagaauugggaacaaaacacccauggaaggaguuacagagacaaaguuuggagcugagaugaaaggauggaccauguagagacugccauauccagggauccaccccauaaucagcauccaaacgcugacaccauugcauacacuagcaagauuuuaucgaaaggacccagauauagcugucucuugugagacuaugccggggccuagcaaacacagaaguggaugcucacagucagcuaauggauggaucacagggcucccaauggaggagcuagagaaaguagccaaggagcuaaagggaucugcaacccuauugguggaacaacauuaugaacuaaccaguaccccggagcucuugacucuagcugcauauguaucaaaagauggccuagucggccaucacuggaaagagaggcccauuggacuugcaaacuuuauaugccccaguacaggggaacgccagggccaaaaagggggagugggugggcaggggaguggggguggguggguaugggggacuuuugguauagcauuggaaauguaaaugagcuaaauaccuaauaaaaaaugggaaaaaaaaagaaaaaggacuugaauucauccuuuauaugcucuuaaagggcuuugaaagggugcaaugaugaauauuuauuacuggcucucucugccuaaaaaaagaagagagauuuuuaagaguggagguaguugcaaauaaucuugaagauagguucauucuuuaaggcuauacccuuuaacuagcuccuguagcagcuauaggagcugaggauggcuaugaggagaaucaguaguuucugccaaaguagauccucuugcuuuuggggaaaaaaaaggauacuaauuacuguggaugcuaauuguuucuauuugaaaauucuuauagugguuuuucugaaacacacuaagugagcauuagguugguaaguaaaucacugccaguaaagaaccuucuucccuacuagugugaaaagacugaguugcauaaggaaaugagcuugguaccaccucuucuauuaugcucuucuugggagcugauaauugaaaauauuuuaagagaaaagguuauaauuaguguucuggaguugugacuugcagcuuuuuuuuccuuugagauuuuauguuuauuuuuucagugacucacuuggaggaauaucaguugccaaaacucaccaaguauauuauccacuuguauucuugaguuauaacacaaauggggugggugugauggcauauacauuuaaucuaaguacuugaaaggcaggcaggcagaucuccacaagauugaggacaaccuuguuaguuuuuggacaaccagaucuauacagugagauacugucucaaaaauaucaaacaauagcaacaauguuuggaugguauuagauuaucucuauauguaccgacaguaguagauugcaggucauuuguuguuucauuggccauacaagcccaguaaaaguuagcaucuucacucucugucuuccccucuugcucaccuucaccucguuuuucugcucaaauauaacuugagaucuuggccuauaagcuaaugaaguuuuugaaucccauggaguuucuagccaccaccuaaaacaaagucauagaauaugaguaauuugaugacaucucaauugagacaucugcuuguuuagauuuaaaaaacacaccuuacuuuguauauuuuucaguuagguauauccucauaguagauugucaauauucugaaagauaaacaagauaaaggaaaaggcauagauucuuuuuuuauaccauagugaaaauguuauuugauuauuuuuauuuaucauagcuucuauuuuuaaauauuucuccuucucugcaguacugauuacuaagguauguauaguggacacuuauuuucaaaaauguucaaauuuuaggguuuuuauuuucuaaagucagggagcaucuauuagcuaacagaugacaugugucuaugaccauuaauucugcaaacaaauggcuucucugugugagcuuguucaguaaaauaauuauuuagcuauaaccacugcuaaaaaugugaauaguaaccaaucaaugaaaacucuggcucauuugaaaagugaauguccagcugguuucacuaaaaacuaguuuuggauuuauugcuagauauuauuacagggguguuccaguucucucaugccuauguugcagaauauccuauaauguacacgagacgaagucuaaaaguguugaauuaaugaauuaaaucagaggucucaagaacuaagucauuagcagcucuccuuccaaaauguuuuauaucuaugauauaguuauagccaaaguauagaaaggauauguuuuuauaguuuaaaaaugaccaaggcucuuuagcugaacaggagaaaucaagccuaccauggaggaauucacuagaaaccucaguuucuucuccauacaccccaucuauuaaacagucauuaggauugccaugggaagugagguuuacuguaagcaaccauuccuuguuaugugagagaagagggacuugggaggcagggagaacuccugaaaaucccaaacauagcccauuauucuggaguacuuauuuauguauagaucauguuagccauguagccuaagcuggcuuugucuuuugaguccuugcuuaguuugggggaguuuaaugauuaaugguaacuuauauuuuuccaggacaauuauuuugaugguaacugaacuuaguuuauauugaugauagauaacacaccacugagagagauaauuauauccuaaggacugagcagguuacuagaguuuugccacaaaaauucacaaaggaauacaaauuguaggaguauauguguuuaagcuucuuuacguuuccauuaguuugggggcauugccauauucugugcauauaacaaugaacaacugcauaugugggauacaauuacgugagggguaguguaguucuucacuuuugcugugauucagcaccuaaggcaaagccuuaaaccccaacaguuuaaauacuggagcagaguaaaaucuuugucuacugccuggugucuucaaaggauaucaauguauuguugauguguuaauaaugucauagugccauauggcaaacuggcugaaggggguuagcaagcucaaauauauaaggaucuccauuaagaacauuaugaauuauuagucauaauaauucauagaaaugcaugccugcaaucucagcuuugagagaccaaggcaggaggacugacuuuggacuauauauaacaagacacuaucuaaaucagcagacaauauacaaaaauuuauuucauuugaaaagcaaagucaguguaaaaaucaucacacuuuaguuauuuuaaacuaaauuuccauuuaaguuaauacauuauuucauagaaauuuuuccuuucuaaaaugccacuuaaaauguucauaaauugaaauuuggauuucuagaagccucagcguucucuguguugaagcugauuaaaauuaccacauagguuguuugcaucaaguucaucuauauauauaggcuuagcauaguuugcauauacauaaaaccacaucagcauaucaagauuuuaugaauuucugcauuggaaauauagcuggaauguacaaugccauagguucaaucucuguauuguacuccaaaauaaaaaaggacaugaguuccauuuuguauucuuugaacuaauauuuauauuuagauucaagguuacucugaacugaaaguaguuuuuccuuuuggucuaaggccuaaaaccaugauaucuuauuugaggucuguuuagauuacuucuuccauauacagcaucccucucuucuguucuuuuucaccacuuauuggaaaauucacauccccacacacacauaugugcauacucacagacuuacacacagacagaccacugugcuauucccuuucaauaggaaauugcaaugucuuuuacauuaacucaagaauuacuuuuucuguucgauguuggauuuauuccucacucucauaagaacuugaucugguaguuauauacagucuuugucuuccaggggacuaguaucuaauggugccuuugaaaaauaccuugaaaauguguaaauaguaggaagagaguaaagagauugcucuuuuauaaucuaccuuuuggggcaacuuaacuguagacuauguugaaaacaaaaagauuauaaauguaugaucuuuauuaguuaauauuaucuucccucuuggguaaauaagaagaguaucuugucuguccaagaaggaagaaaauuacauuucuuauguuugcugguauauagaacuauuagaauauauagaacaauuggguaugcugaauucuguuauguuuuaugcuauuaucuaucaccuuuucuggauauuugugcaagguagguuuuuuuuuuuagcacauauagauauugucuauauugagugcuuuaguuuagauacauaggagaaaaaugugacccuuaagguugauuguuagcugcuaacccauaguauaaguaaauaaauuaauuagaauaagauuucaggacauguaaacaugaagauuuuauguuccuuuuugagugcugggauaaugaaaaugccaggguaacccugaucucagggagugaccucuuguacacguacacguagccucacauauuucuacauauugucucauaguugcuugcuacaccugaagauugcuaaacccagaacaaaucauaaguuaguuuauuugugagggaagggacaaaauacuccugaucuguucuacuguaguuuuuagguaucauuuuccuguccucauugaaaauuauugacugucaucuucuuccuuuuccucuuccucuucccuuauccauauugucuuucacccucaccuucuuauccuaaauucaaugugguuguuugaaugggaaugacccacauaaucucauauguuugaacacuuuguccacaguuggcugaucaguuugggagggaguaggagguagaaucuucuuggaggaggugugucacugggaacaugcuuuuagguuucaauggguuugugucauucccaguguguucauugccuucuguuugugguugugguugcaaaugugagcucucagauauuccuguuaccaugcuuuugucugccaucauggaccuuaacucuauggaacuguaagcucaauuaaaugcuuuuuuaaaaaaauaaauugccuuggucguaguguuauaucuuagcaauacaaaagugauuaguacagaaguugguacaauagagugggauguuucugugauagacauugccauauuugugugauguuuuguuuuguuuguuugauuguuaagaauguagaagccuuugggacuuuggacuagaaaauaauuaaauaaugcaagcagagauuacuggacugucuuaguaugggcuuagaagacuguagugcugagaguuacacaaacuguggaggcccagcucaagacguuccagagaggaacauguuagcaacuagaguagauauuguucuugugauauuuuggcaaagaauguggcuguuuuauauccuuguccuaauaacuuaccugaaacaaaauuuaaaaguaauggacuaauuuuuuuuuugguggagcagauuucaagauagccuaauauugacucuuaucaugugauuauuaauaauuacucauauguaggacuacagugaaaaagaacauaugguacagaaggaaaugaaaaaaugaacaguuugaaaaggagcaagccuugugcugaaagaaauaacauuaaggagaggucaaaucuuaggcacccuuggggcaagaccucacccagcuaagcaucugacuuguaaaaggaagaugccuaaggaauuaauaaaguuucuguaacugugauagggcaauagggcaaggauucauugcaagcaggcaacugaacuuggcagggucauucacacgauuuuuugcuuuacagccauaaaggauaugugaguaaaggguuuguggacucuucugcaguuuagugauugcugccuaggccaagcccauggcugaggaauccaugcauagaaucccucugagagaacauuguguaaacugugaaagugaacucuggauuguaauagagaaccaaaaguguguuagaggugccacagccuugagacaucugccaaggcaaacauacagggagugcaaacagacagagagacagggauauauacauguugcuggcaacaaagcuggaaaggcagagccaucuaagccuucuaacacaaacaugaaacuacaggauucauacugaguuugcccugcuggguuuugggcuuguuuuauaguccauuauuucaacacuauacccuaauuccucccuuuugaauugguaauguguguguguguguguguguguguguguguguguguguguauucugacccuuuguauguuggaaguauguuacagauaauagauugguuugagucucagaugagauuuugaucuuuggauuuuuaaaaauucaaacagugacagugucaagagugaaagaauauggagacuuuugaaguugaacuaaaugccuuuuacauuaugauauagccaugaaaauaugggggccagagagugcauugugguagucuuggacauuuggauaguuaaauccuaguguugguggcuauuaggaaggauuaggaaaugugguauugcuggagucaauaugucacugggggaggacuuuaagguuuccaaagacuuguguaguuuugaguuagcuucuaccuccugcuugcuguuugagaugugagcucuuagcuauuccuaccaccaugcuuuugcuucaccacucuagacuuuaacccacuggaagcauaagucucauuaaauccuuucuuuuauaagccaguccuuauucuagucaaugaguugcuucaaccuuccuuacagauccccgaaaacauuuaaaucccauugaauuaagucacuaaucaggaagagucuauuuaaucaguauucuauaaagaauauauacuuguuugaguugcugcuaauaaauaagcuuaauaauucagacagguggguuuuauguuuagaagauaugggaguacacaaauaaaguagugauuuauacuuuacauuuuuaaaucuugagcuucauugugaaaauauauaauuuuuuauuuuguguaucaaaaugaauaauuuuauaaaaagcaaguccaaagguaacaaauguuuucagggucaccagaaaagaucuacaauuaaaggcccauuuguaguuuguaaaggcaugaugauuucagaacgacaaguauaauugacugggaggaauccuuaaggcauuucuuauacuacaacuauaguugcacuaucuacuguaaucgauuuaaauacuagcaauacuauuuguaaaucucucaucucauauuuaguuuaaaguaguuguuugguaacagaacaucccuuaaagauauauccuuuuugcacaugcccuuauuucucacuaaaaaacuccuaaugauucccacuaccauuaaugaccacuagcauuaaggaacuucaugauccaacucuaguacauuuuaacauccucuaucauuauuucuucagagaaauuucugucuucuaauaaacuguuccauuaacuuuugccccauaugucugcauuucuauuucugucuuaacuccauucauuaaccacacauggaauucaauuuuacuaguuaccuuuggcuagccuauucaagucccaucauuuucaaagaguuuuuuuuuucaacuacuauagcucagaugaccucuuuauuuaaaccacagcucaccucuauuuuuuguucuuuaagaaauauuuugccugaguguauguauguggaacaugugcaugcucggugccagaggaagucagaauagggcaucagguccuuugaaacuggaguuacagaugacuucaagccaacauguaaggugccagguauugaacccaccugaguccuauacaagagcaaccagugcucuucaccacugaaccaucucuccggcaguaguuuuuguucuuauauacauuagcuacuguacauuguuuuacguuuuguuuaaguagaauauauauaccuagacacucuacacuacaggauaaguaucaccacacauaauuucagguuauaccacagaaccauaaugacaaaaccaccaugguuauggcacaaaauaagcacauagaucaaugggacauacuagaaaucauucauauauaucagcacgugcuguuacucuuuuagccaucuuacugguucgagucucacauaguuuguaacuguuugugucaauugcauauuuaguuguauguuguuagcuaauuaguuugugucaguuacauauucuuccuuauauucuugucuaguuguuucaugcacaccagaaauagcauccuuaagauaaucagaagccuuuuugggacugagaguauacuucucuuuuuagucccaccaguaagugucaugaaacacuuacaaccgaaauaagauauuucuggauauuugagucuggauccauuguacuauugugggccucuauaacacuuuagauuccaugguaguacugugaauguugacucaaauccagaacaugauguuauauuccuaauagauguuccagaaauguuguuagaauauuauaauucaagauucaaacuauaaaguagaaacaaauaauuaccugaaaauugagaucagacuggcuaauggauuauuuuuuacuuuuccauuugagucuuccaauuaaauuuucugacuucagaguuuccuauaugaaaaaugagacaguaauuaauacauugguaacuguugugaugguuaaauaaaauuauauguaaauauccucacaguaccaauuucuugaaagaauagguaacccauugucugagaggggauaugcuagagcauugacacucuuucugacaaauccauugaaaaguuauaguucuguguaguagcagccauaacugaugauacucaaguuacugucaagcucugaaaugcucuaauuauaacauccauaaucuuuuucauguguauugauauuuaugauaaaaaagcuuuuacacuuaccucauuugaaccucaaacuagaaauaaaaguaugaaaauauuuauuuguugagccucuaauauauucuaaacuucagcauauacucuagcagcuguauaaacaaugugugcucaauaagaccaagugcuagcaaugauauaucagagacacagacagaugaagguccuugcccucauggagcuuacauucugguggauugaauucugagugaagccaccugaauucuaguccugauguagcuacuaacuuaacaguaagaaaaaaagugugcugguggaagugguggugugguguguguggggugauacccagagggcgcuccccuucucagaggagaaggaaaggggagaaucugucuguaugaggggauacugggagcugauguuaggauguaaagagaauaaauaaauuuuuaaaaagaaauaaauaaaccaauuuugaaaacgaaaccaaaaaaggagagaaaagugugugugugugugugugugugugugugugugugugucuauuugcacauguucuuaccuagauguuuucauugggcauauauuguugcaaauaaauuauaguucaacuuuacucauucucaaagcucacucagaauauagauuuucuguggucucuguuugguagcaccugcugugucucauagaaaaucacuuuauacaaucugaagagaaaccagauguaccuaacccucaggagacuggaggccccaaggaguuuagaggucaggugggguggggaugggggcauccacguggagaaggggugggguggggaggaggugugggauguggagcagacagaggguggauggggggcggggaauggaauauggaguauaaaaaaauaaauuaaaaagaaaauuuaaaagaaaaagaaaaucaauuuauaucaaggagagacccaagaaaauuauuuaccccuuuucagcauauuagcuuacucaucugcuucuuacuuugauuuuuguuuuguuuaaaccuugaauuuaauacagaguaauguggagucugagucguuugcuuucuaucuguuuaaucaaggcuaugccaucuaauucuuguaauucuuuacaggcucccucacugaaaggaugcuuucuuucuaauguuuucuuaccucuuuucuuacacucacauccucccugggaauauuaggccuauuaguauuauugcucuuugacugcaggagaaacuaaggcauaacgggagaaaauagcuaagccuauauucucuggaauuuaaaauagugaguguacauuccucuuggucuuggaccuuauucacuaucccagaauucagucaguucaguuagccaucacauuagaaaaagcuacauuuguucugaacuuggacucagaagacuuguucuuugauccugagucuguuucuuucaugaccuugaacaagcaucuaagcccccuagguuucuauaaaacuagauaaaaaauagcuuuucuuaagcuucucauauuuuccuauucuuuggaagucuuugcccaucuuaucuucuuuucuccacuacuuuuaauuucagcuuuuauuccuuuuccuucagagauguccacucucuugcaguacugacuccuauuaucuuggaccaaucucauauuuauuucagucuuacauuguccuauguaauuuccugcauucuccuugaaguaagagaaagugagcauaauauaccaucuucagauauaccggaagagggcauuggcuuccauuacagaugguugugagccgccacaugcuuucugggcauugaacuuaggaccucuagaagagcaguguucuuaaucacugagccaucucuacagccuguaggguacuauaacuuaauucauuacuuguuggaagaauaucaaguacuaaauacaaagacaauuaaaaauccuaaauagcuaacaaugaacuucauuuaaauuauuuuuaaugaagaggcuaucaagcuguggaaacuacuuguuaauuugguauggaguguguguguguguguguguguguguguguauaaguuuggguaguguuuggauuggauaucuuaauuguguauaccaaaugaguuguugcuugugauuaauagugaguaaaauugcuucucggaugugcuaguuacuauuuacugaggcugaauaguagaaauacugauaaaaugaaacucuccuuucuaauuacucccaggguccaauucugccuucuaucuaaucuucacuaaaucauaacagccugcuuuucagcaaauuauuauuuagacaaucuguuugggagaggaaagcauacuugaaucaugcaaaugcucucuuugaagcuauauuuuuucuuuuauguucagaugggaauauauuauaugcaccccacacuguuuuuucuccaugcuuggaaaucaaggacaaagagugcaaaaguuaucuuaccacaucacccaagaauguagcauauuagaguucuaugaggaacaagagaauccaguuaucaucccaaagaaagcaaauaaaggaggaagcuggcuguauaaagcagcuuguuuauucuucaaguuaggagacuguggauuagaggaauccuaacuagccuaugccuaaagguucagaggaaugguuaagugacaucauuaugcuugaaggaauaggugaguuuuucuaagaacaaaugaacacucuuugaauuuuuuauuuuuuuauggcauuuauuuuuauuuuaagaaucucuauuccaggauggucucaaacaugcuacauugcugaagauuaccuugaacuucuuuuuuuauuuuuuaaaauaguauuuauuuauuuuuacuuauacaaguacacuguagcugucuucagacacacaccagaagagugcaugagauuccauuacaaaugguugugagcccaugugguugcugguaauugaacucaggaccuacuggaagagcagucagugcucuuaaccacugagccaucucuccagcccuacaaaucaacauuauuaacuucuauuuauuagucuuuucagucuaggcuagguaacaacuacugcuagcugaggaauauagaugcaagaaaauaccuuaagcuaauagagaauuuuuguuuaucuaugcauugugcuaaaaauaugaauuguaguuuuaacuuagggaaaauggcauacucaaucaguaagacuucaaaauggagacaagcaugaguagaguacuugcuuguguguuucuuuugggaaagaaugagaaagaccuauagaaugcauaugggaaagaagggaaaaugaaaaggaaaaucauauuuggagauaauauugggaaaauaguaauaaaccuuaucuuggaagaccuucagugcuggacugaguugauugaaacuuuaccguguauaaauacaccuagagaaagucuuauggucugaacuaaaaggggcccaacaauacaggcuuagaauuuaaacaaaagugacuuugaauuucuuucccuaaugcuuacugauagaccuuaaauauacugcugcuucuuucgcaugccucacuuuccuccuuucauggauaacaguaauugucuuagauaauuuucagucuuaaguguuauaaauguaaagugaaaugauguauauaaaacugaaugccuggcuacucaauaaauaaauguuaugaauaaucccuuugauucuaguuugauaaugauaauugguuuuguuuguuuguuuguuuguuuuuggauuuuuuugagacaggguuuuucuauguagcccuggcuguccuggaacucacucuguagaccaggccggccucgaacucagaaaucugccugccucugccucccaagugcugggaucaaaggcgugcgccaccaccacccggcaaugguaauuguuaaugaauaugaaauguagaaugguuugcuaaccuucauauauuauuuuauuuuauuuuaugcuaaucuauggaguucauuaguacuauuauacuagggaaaacaugcccaggccaaggguuucucuaguuauaaaauaauaucagagcuaggauagaauccagauuauuuaaaguucaauuugguauucuuuuuauuauacaauacuccaaaaacugaguuuagacuacuuuuacuuugauuuguuucuaacaaacuuuugguaaaucauauuggguguuuuuaaaguuaaaacuacauacuuaggcacgguggcucaaggcugcaauuaccaguacucaggaagauaaaguaagacuauugcuguggauuugaggucaacuuuggcuagagacccugucucaaaauaaugaauaaauaaguaaauaaauacacuaaugaauaaguaaauguacuugaauggaacaagguuguuacagauauacucccaauccaguauuguauguaagaagucccuacaccugcaucuuucccugucaaauccuugagaucuaguauuuauuaaaaauuaagugaacaaaauacccauuguccuuuuaaaaaaaaaaaagauuuauuuauuuauuuuugugaguacacugucacugucuucagacacaccagaagugggcaucaaaucccauuacagaugguugugaaccaccaugugguugcuaggaauugaacucaggaccuuuggaagaccaaucaaugcucuuagccucugagccauuucuccagccuuaccccuuguucuugagacaagcuuuuauacuuuucuuuuuaaaaauucugauuagaagggaccccccccaguaaauagguacaguccccaaguugagggauggugccacccaccccucucaaaauuguuaacccagaaauguuccuguccaaaggaaagacagggacaaaaaauugaacagagacugaaggaaaagucaucuagagaaugccccaccaaggaauccaucccauccagacaccaaaccuagacacuauugcugaugccaagaaguguuugcugacaggagucugguauagugcugucuccugagaggcugugccagagccugacaaauacaguaguagaugcucacagccaaccaguugaagagaugggggaaggaaugaaggagcugaaggcgauuguaaccccauaggaagaacaacauuaucaaguagccagaucccccagagcucccagggacuaaaccaccaaccaaagaguauaacugagugcgucuauggcuccaaccacauauguaguagaagauggcuuuaugugacaucagugggaggggagacccuugguccuguggaggcuugaugccccagcauagggggauguuagagcagugaggcacgagugaugggugagguggaagagcacccuuacagaggcaaaggggaggagggagaggggaugggaugggugguuuguggauggguaaccaggaaaggggggauaucauuugaaauguaaaugaauaaaaugauuaauaaaaaggaaaagaaggaaauaaagagaauauuggaggaauacaaaugcccaaugguaaaauaaaauaaauauguaaagaaauuuuaaaaagaagggauuguaguauuuaagcaauagaaagcugguucaauuuacaacuugcaaucacuaucuuacucuaucuagagaagaaaacauauugaaaguuucuucuuuuaaaaaaaaauacuaaauucauauggauuuauuuucuuccucuugacagaucccagucuauuagaauuauuuuuuugugaucuugcuuaagagucaguguaaguguaccagucauggaauuugguuuucaggguccuccuguuuauuauuuuagcuauguuauuuuuuucuucaauguaauuuacaaauacuacucuauuaaauaucacacaagauacaagcauaacugacaccagaauuccauggguuuggugacuggugugaauagugguacucuugaugcugugacagaaggaagcuugagggagagaagguuuaccuuugcuccaaguuuuaagggaagagugcaucaugguaugggauguguggcuucaggagcuugaaacaacuggucacguugugucuacacuaagaaaguacagaaggaugaacaauaguacucccuacuugcuugcuuuuuccuccgcccagggugccaacccauggaauguuguacaaccuacauucagggugggucuucccaucucaguuaaacuucucuagaaacucucacagacgggccucauucagaggugacuaucccauuaagacaacaaucaaaauuaaucgucauuguguguguuuagagggggugcugcaaaaguaauguuuuauaguucaauaggaaaaacccugguuuuagcauagaaaaucuggguucaugcuuaagcaugucacauaacucaguuuccucccucuguuaagagaggccacuaaacucagcuaguuucaucucuguauuuguggaaccaaguuucucuacaauucuuaguuggaugcauugaacuuuuaaggugaaauuugcaaggugaccgauuguacaauuuuuccauuaucuuaaauuuuuucauuguaaaguuuuucuuguuguuuguuuuguuuguuuguuuuuugucacuuugguuaaauaacccuacagguuuuauuugaaaguauugugaaaguguuuuccuuuucuugauuucuuucugggcgaauucuauuaguauauagaaaggcaccugacuuuuuuuuucuuuccuacuaaggagagaugucagauuaguaugcaaaauaauggguuucgccaugggcuauugguuuuuauauacugacuuuggacccugcuguuaaaauaaacccuucaagauuuaugguggagucaucaggguuauuuaaauauagaauugugucaucugcaaauaggaguacuuugauuucuuccuuuccuauuuggauccauuuuauuucuuauugcugaagcuaagacuuuugagcauuaugucagauaagaacaguggcaauuuacauuuuagccucaauucugauuuuagagcaaaugcuuucaugcuuucuccacuuuguaaaauguuggcugcagguagccuuuuaugccaauauauguuuuaucuauuccuaguuucuucaggacuuuuaucaguaagggauuuugaacuuugccaagggccuuuucugcaucuauaagaugauucuuuaauuuuguccuuaauauuuauguauuauauuacaucuauugauuugcauauuucaaaucaaucuugaaucccugugagaaaaccaacuucuucaugguguauggucuuaauauguuuuugaauucaauuugcaccauuuuuauugcaaauuuuugcguuuauguuugccaaguaaauugguacauaguuuuccuuaaguuauaaaauucucuagaauugaaagaucagggaggggccauaucuggcacucuugcugguaguaaugcggucaagcagaauuaguuugauaguguguucuuuacccuucuguuuuguggcaaucuuugaggaauauuacucuguuaaagauuugguagaauucaguaauaaaggugucuaacccuagacuuuucauuggggggugggggguguacuuuaauuaauacuuuaauuugcuuguuagaauauuuguauauuacuuacuaaauucuaccaggugguauauguguaggacuuugaucauuucuucuauauuuuccggguguuuugaaacauaaauuuugaaaguauuucccaagaaguccucugaaugccaucaaaaaauguugaaacaucccuccuuuaaccucuaauuuuauuaauuugaauuuuucuguuuuccuuuuaguuaguuugccucuaugcucuuccuaacuuccuuaccuuuccaaacaauuauauuuuaauuugauugcuuuugugaaugguucuuuuugauauuuuuacuaauuuauucucucaucuccuacauccuguccacaguuuuacccccuccuguccucucagucucugucaccuccucccuccccaucuguuccuccuucucccauuucccuucugaaaagagaagguccuccagggauaucaaacaaacauggcauaucaggaugcaagaagauuauguaccuccccucauauuaaagcugggugaagcaacccagcaggaagacagggaucuccaaacuauacaguuuucaaagccuauuucaguaguuucuuugaugacuugugaaauuucuugccauuguuuuuuugguuucuucauuuuuuucuaagaccuugggggaacaucauuagguaauuuauauguagucuuucugauuuucuaugugcccauagcugccaacuuuuucuuagagcugccuuaucaucugguuauauaucuuaguuuauaaaguuauuaccuaauguggugguuuaaauaaaaaugguccacaaaggcucauauauuugaguguuugguucccaauggguaugauggaaaguuuaggaagaauuagaaaguauguccuuguuggaggaggugugucacuggggggggggggcuuuaagguuucaaaaccucaccccaggcccaaucuugcucuuuuucugccuacuaccuguggaugaagauguaagcuccuggcuaaugauguaccaccguggcugucugccuguugccacgcuccaugccaugaugaacuaacccucugaaacuuuaagcaagccauuaauuaaauggauuuuuuuaaaaaauaaaaguugucgggggcuggagaaauggcucagcaguuaagagcacugacugcucuucuagagguccugaguucaaaucccagcaacuacaugguggcuuacaaccauccguaaugagaucugacaaccucuucuggggugucugaagacagcuacaguguacuuacauacaauaaauaaauaaaucuuuaaaaaaauacauaaaaguugucuugguuauggugcuuugucacagcauuaaaacucuaagacagcaccgggucaccuuggaugcggauucaguggauacucccaagguccugagaggacucuccaugugaucuuaggaccaccggugaguguaacacaacuucuguuccauuccaaucacgcaggaccugagacagcauuagggaagcagaaaacccggccugaccaggaucacaagacccuuccagucugcgccagcaccaggucaccuggacacagagucggaggacaaccucaaggucccuagaggacagcuucugaggcagaccccuuuuugggcuccagacauucggacaccuucccugccagaggagaaguguccagcccgcccgggagggcuuugcuggagcaccugguggagccaucuugguucccagaucccgcugagaguaguggacuacagaagcagacagcuucggggacaggccuuguccaccccacccaguacugggcaccccagcacacccaaaaagcuagacccggauuuaaaagcauaucucaugaugaugguagaggacaccaagaaggacuuuaauaacucacuuaaugaaauagaggaaaacacugcuaaagaguuacaaguccuuaaagaaaaacaggaaaacacaaccaaacagguaaaguccuuaaauaaaaacagaaaaacacauccaaacaggugauggaaaugaacaaaaccauacuagaccuaaaaaaagaaguagacacaauaaagaaaacccaaagugaggcaacacuggagauagaaacccuaggaaagaaaucuggaaccauagaugcgagcaucagcaaaagaguacaagagauggaacagagaaucucgggugcagaagauuccauagagaacaucggcacaacaaucaaagaaaaugugaaaugcaaaaagauccuacuaaaaacauccaggaaauccaagacacaaagagaagaccaaaccuacagauaauaggaguagaugagaaugaagauuuucaacuuaaagggccagcaaauaucuucaacaaaauaauagaagaaaacuucccaaaccuaaagaaagagauacccaugaacauacaagaagccuacagaacuccaaauagacuggaccagaaaagaaauuccucccaacacauaaucagaacaacaaaugcacuaaauagagauagaauauuaaaagcaguaagggaaaaaggucaaguaacauauaaaggcaggccuaucagaauuacaccagacuuuucaccagagacuaugaaagccaaaagaaccuggacagauguuguacagacauuaagagaacacaaaugcgagcccaggcuacuauacccagccaaacuuucaauuaccauagauggagaaaccaaaguauuccacgacaaaaaccaaauucacacauuaucguuccacgaauccagcccuucagaggauaauaacagaaaaaaacacacacacacacaaaaaacaaaaaacaguacaaggauggaaaacacacccuagaaaaagcaagaaaguaauccuucaacaaaccuaaaagaagacaaccacaaggacagaaugccaacucuaacaacaaaaauaauaagaagcaacaauuacuuuaccuuaauaucucuuaauaucaauggacucaauuccccaauaaaaagacauagacuaacagaauggcuacacaaacaggacccaacauuuugcugcuuacaggaaacccaucucauggaaaaagauagacacuaccucagagugaaaggcuggaaaacauuuuuccaagaaaaugaucugaagaaacaagcuggaguagccauucuaauauagaguaaaaucgucuuccaacccaaaguuaucaaaaaagacaaggagggacacuucauacugaucaaagguaaaauccuccaagaggaacucucaauucugaauaucuaugcuccaaaugcaagggcagccacauucauuaaagaaacuuuaguaaagcucaaagcacacauugcaccucacacaguaauagugggagacuucaacacaccacuaucaucaauggauagaucguguaaacagaaacuaaaccaggacacagugaaacuaacagaguuaugaaacaaauggauuuaacauauaucuacagaacauuuuauccuaaaacaaaaggauauaccuucuucucagcaccucaugguaccuucugcaaaacuaaccauauaauuggucacaaaacaggucucaaacagauacaaaaauauugaaauugucccauacauccuaucagaucaccauggacuaaggcugaucuucaauaauaacauaaauaauagaaagccaacauucauguggaaacugaacaacacuuuccucuuggucaaggaaggaauaaagaaagaaauuaaagacuuuuuugauuuaaaugaaaaugaagccacaacauacccaaacuuaugggacacaaugaaagcauuucuaagaggaaaauucauaccucugagugccuccaaaaaagaaacuagagagagcacgcacuagcagcuugacaacacaccuaaaagcucuagaacaaaaggaagcaaauucacccaagaggaguagauggcagggugaaaucaaccaaguagaaacaagaacuauucaaagaaucagccaaaggaggagcugguucuuugagaaaaucaacaagauagauaaaaccuuagccagacucacuagagggcacagggacagcauccuaauuaacagaaucagaaaugaaaagggagacauaacaacagauccugaagaaauccaaaacaccaucagauccuucuacaaaaggcuauacucaacaaaacuggaaaaccuggaugaaauggacaaauuucuagacagauaccagguaccaaaguuaaaucaggaucagguuaaugaucuaaacaguccuauauccccuaaagaaauagaagcagucauuaauagucucccaaccuaaaaaagcccaggaccagauggguuuaguccagaguucuaucagaucuucaaagaagaucuaauuccaguucuucacaaacuauuccacaaaauagaagcaaaagguacucuacccaauucauucuaugaagccacauuuacucugauaccuaaaccacggaaagacccaacaaagauagagaacuucagaccaguuucccuuaugaauauugaugcaaaaauccuuaauaaaauucuugcuaaccgaauccaagaacacaucaaaacaaucauccauccugaccaaguagguuugauuccagggaugcaggguugguuuaauauacggaaauccaucaacauaauccacuauauaaacaaacucaaggacaaaaaccacaugaucaucuccuuagaugcugagaaagcauuugacaaaauccaacauccauucaugauaaaagucuuggaaagaucaggaauucaaggcacauaccuaaacaugauaaaagcaaucuacagcaaaccaguagccaacaucaaaguaaauggugagaagcuggaagcaaucccacuaaaaucagggacuagacaaggcugcccacuuucucccuaccuauucaacauaguacuuggaguccuagcaggagcaauuugacaacaaaaggagaucaagggaauacaaauuggaaagggagaagucaaaauaucacuuuuugcagaugauaugauaauauauauaagugaaguagcuagauauaaaauuaacucaaacaagucaauggccuuucuacacaaaggauaaauaagcugagagagaaauuagggaaccaacacccuucucaauaaucacaaauaauauaaaauaccuuggugugacucuaacuaagguugugaaaaaucuguaugauaaaaacuucaagucucugaagaaagaaauuaaagaagaucucagaagauguaaagaucugccaugcucaaggauuggcaggaucaauguaguaaaaauggcuaucuugccaaaagcaaucuacagauucaaugcaauccccaucaaaauuccaucucaauucuucaacaaauuagaaagggcaaucugcaaauucaacuggaauaacaaaaaaccuaggauagcaaaaacucuucucaagcauaauagaaccucugguggaaucaccaugccugaccuaaagccguacuacagagcaauugugauaaaaacugcaugguacugguacagggacagacaaguagaccaauggaauagaauugaagacccagaaaugaacccacacaucuauggucacuugaucuuugacaaggaagcuaaaacaauccaguggaaaaaagacaguauuuucaacaaauggugcuggcacaacuagcaauuuucauguagaagacugugaauugauccauuccuaucuccuuguacuaaggucaaaucuaaguggaucaaggaacuccacauaaaaccagagacagugaaacuuauagaggagaaaguggggaaaagccucaaagauauggaugggcacagaggaaaauuccugaauagaacagcaauggcuuguacuguaauguaagauugacaaaugggaccucauaaaauugcaaagcuucuguaaggcaaaagacaccgacaauaagacaaaaggccaccaacagauugagaaaggaucuuuaccuaucuuaaaucagauaagggacuaauauccaauauauauaaagaacucaagaagguggacuccagaaaaucaaauaaccgcauuaaaaauggggcucugaacuaaacaaagaauucacagcugaggaauaccgaauggcugagaagcaccugaaaaaauguucagcaccuuaaucagcagggaaaugcaaaucaaaacagcccuaagauuccaucucacaccagucagaauggcuaagaucaaaaauucaggugacagcagaugcuggugaggauguggagaaagaggaacacuccuccauuguuggugggauuccaagcuuguacaacuacuauagaaaucagucuggcaguuccuccgaaaauuggacauaguacuacuggaggaucccccaagaccucuccugggcauauauccagaagauguuccaaacgguaagaaggacacaugcuccacuauauucauaacagccuuauuuauaauagccagaagcuggaaagaacccagaugucccucaacagaggaaugaauacagaaaaugugauacauuuacacaauggagugacuacucagcuauuaaaaagaaugaauuuaugaaauuccuaggcaaaaggauggaccuggagggcaucauccugagugagguaacccaaucacaaaagaacucacaugaucuguacucacugauaaguggauaucagcccagaaacuuagaauacccaagauacaagauacaauuugcaaaacacgugaaaaucaagaagaaugaagaccaaagugugaacacuuugcaccuucuuagaauugguaacaaaacacccauggaaggaguuacagagacacaguuuggagcugagacgaaaggauggaccaucuagagacugccauaucuggggauccaucccauaaucagccuccaaacgcugacaccauugcauacacuagcaagauuuugcugaaaggacccugauauagcugucucuugugagacuaugccggggccuagcaaacacagaagugaauacucacagucagcuauuggauggaucacagggcccccaauggaggagcuagagaaaguacccaaggagcuaaagggaucugcaacccuauagguggaacaacaauaugaacuaaccaguaccugccggagcucguguuucuagcugcauauguaucagaagauggccuaguuugucaucauuggaaauagaggcccauuggucuugcaaacuuuaucugccucaguacaggggaaugccagugccaagaagugugaguggguggccaggggcguggggggaggguaugggggacuuuugggauagcauuguuaauguaaaugaagaaaauaccuaaaaaauuuuuuuuguuaauuuuuaaaaauuaaaaaaauacucuaagacagaaguugguacuagggagucagguauugcugugacagggcucaccaugcuguccuuuggagaaauaugaaagaguuugagacuuuggacuaaaagcaguuugaugcuuuaaguagggcuuaaugggucaucuagugggauggucauggugaaagcaauguagacuauugaggcccagcucaagagguuacagagaagaauauuagagaugauucuugugauacuuuggcaaugaaugugguuuuuuucugcccuuagccaaaacucugccagacucaacugaagaguuuuguaccaguauuguuagcagaggagauuucaagacaauguagcauugacugucacaugguuauuauugaucucucuuaugcagaacuacaaggaaaaagagcaaagaaggaaaaaagaaauaugaaauguguacuuugaggagaaaaagaacaccagagaauaugauaagcucaaagagauaugaaguuuuuaaaaaggccugaugcuaauuguaauaaagggaugccacccucaggguaagaccccaccagcuaauuguauaaucugugaaagagaaauguccaagggauuuccuuggucuaaacaacagcaauccaaaguuuaugcaaauguaauucaaaaagggggcugaguuccagcugcagcagguagcagaauuuggcuacaugguucuggauuuagagccaagaaggaaacaggaaauggguuguggagucuuccuccaugguaaaggaacgccacaaagaccagacaugugacaggguagucccuuccugaaggccauugcaugaagcugugaaggugaaaccuggauuguguuggaaaccucaagaugugggaaagagcagaagcaugccagugagagcugcauaaaggauguggaaccagcucaagagaaaggagugugcuacaguuaacaaagcuggaaggagcaaaagauaggaagagccaucuaagucaggauguagaguuaggccugcuggguuuccgaauagcuuucauccaguauuuccuuucuuuccauuuagaauguauauucugugccauuguauguuggaaguaugaaacuagcuuuuugauguuacaggguguuacuguuaagagauucccuugagucacagaagagacuuugaacuuugcauuuugaaacauaccugauacugaaagacuauggggacuuuugaaguuugauugaaugcauuuugaauuaugauauggccauaagccuauggggagcuaggaaaugaaaugugguguuuugaauaagaaugagccccauaguccucccucuucucagagaagaaagggagagggacaugaagagaggggcuaugugaggggggaccuggaggaggggguuacaauuagcauguaaaaugaguaaauaaauuaauuagugaaaaagggcucauauauuuggaaguuugugucccaguugauagaugguuuagaaacaauuaggaaggguggccuucuuggaggagguauguauuagucagggaauccuagaggaacagaauuuauauauaggcuuguaguuacugcuccagcaccaugccuacuugccaccaaauuccccaccauaagaucauggacuaacccucuaaauauguaagcaagcccccaauuaaaugcuuucuuuuauaaguugucuugcucauaguguuuugucacagcaauagaacaguaacuaagguacguacuaugcacagaguccugaguucaaucccuaguaccgcauauauuuagcacaguuguugguugccuguaaucuugggagguggaaacaggaggaucugaccugcaagggcauccuaagcuacacagcuaaagacuugucugggauacaugagacccugucuuaaagaaagaaaaacugcggggcuaauauccaauauauauaaagaacucaagaaguuggucuccagaaaaccaaauaacccuauuaaaaaugggguacagagcuaaacaauucucaacugagaauacugaauggcugagaaauaccuaaaaaaaaaaguucagcauccuuaaucaucagggaaaugcaaaucaaaacaauucugagauuccaccucacaccaaucagaauggcuaaggucaaaaacucaggugacagcagaugcuggcgaggauguggagaaagaacaacacucacuccuccauugccucaggcucaguacaaucaaacuccagaauucuuuucaauugauaagaucuguuccuggcuaccaaagggaggggugcuuuugcccaugcauuuaacuaucuaagccagauuccugccacuuaaugcuuucuggcuuuucaguaucugucccuuuucucuuuuccaggcugucucuuaccuucagacuuuggcagauugcauucaggcucccuaaaugauagguguucccaauucucagaccccuagcauaguaaaguuucaagcaguagguucuucuuuaagauggugcuugacccugaauucugagucauaccaaguauuaaaauguaaucucucccuaauacucacccaccagacaaaggaauccuuguaacaaaaccugcauauugguuuugacucauguacggguugugggauuguccugggaguagaaccaccagucucugcucuaugccagggucuucuggcucuccuuuuggagagggcucuuaucuaccucccagucacuccuuuuuuuuucaauuagguauuuauuucauuuacauuuccaaugcuaucccaaaagucccccaccugcucccccacccacccacucccacuucuuggcccuggcauuccccuguacugaggcagauaaaguuugcaagaccaaugggccucucuuuccacugauggccgacuaggccaucuucugauacauaugcagcuagagacacgagcucugggagggggggggguacugguuaguucaugauguuguuccaucuauaggguugcagcucucuuuagcuccuuggguacuuucucuagcuccuccauuggggacccugugauccauccaauagcugacugugagcauucacuucuguguuugcuaggcccuggcauagccucacaagagacagcuauaucuggguccuuucagcaaaaucuugcuaguguaugcaauggugucaguguuuggaggcugauuaugggauggauccccagauauggcagucucuagaugguccauccuuucgucucagcuccaaacugugucucuguaacuccuuccauggguguuuuguuaccaauucuaagaaggugcaaaguguccacacuuuggucuuuguucuucuugaguuucauguguuuaguaaauuguaucuuauauuucccagucacuccugacagggaaccacacaccuaacgcuuggguuuggcuucuuuuuuauaucucaucugucuuucuuauaacauauuuucagguauccuaucacugccuuugugaauuucauaagucauuuucugucuuugaaauagagucuacuuuuuucuuauccuuuauuuuuugagagggaauaauauuuuuuuguuucaaaauuagcugacaaacaggaaugauuuccuauggcauuugcauacauacuucauuuuuguugagucccuccucauuucuuccccaacaucuuccuccuucuguuuccucuguacccuagucagccaucauugggaagagaggcccauuggucuugcaaacuuuauaugccccaguacaggggaaugccagggccaagaagugggaguggguggguaggggaacagggugaggggaggguauagggaacuuucaggauagcauuugaaauguaaauaaagaaaauaucuaauuaaaaaauuggaaaaaaaacauacacauacuguaaaagaaaaaaaauccagugguaaccgugguccuauuguuguccuaguucucuguccugauuucuacaguggcuguacacuuuuaccaacaguggauaaaaauuucccuuucuucacaucuuugucaccauuuauaaucaguuggucuuugaugguggccauacugacugaagugagugaguagagccucaguguaauuuuaauuuguguuucucuggugacuagaaaagcuaagcacucuuuugaauauuuguauuucuucuuuugagaacugucuguucaguucauugaucuauuuauguauugucauuuuuuuguuugugcagggucuugauuuuuacaauuguuuauuuauucuggauauucaccccuuguaugaagcgugacuggcaaagauguuuuccccauucuguaggccuccuguccccucuguugaucguuucuuuuaguaugcagaagaagcuuuuacaguucaugcaauccuauauuucaauuuuaggggcuauguccuguguuguuaugguuguauucagaaauguguugccuguaccuguauccucugacuguuccucauuccauacucccucccccaucuccacgagugugucuccaccccacaugacaccccacaccccaccagaccuccucacacucccuggggccuucagucucuugagggucaggugcaucuucucugacugagugcagaccaagcaguccucugauguauauguguuguggggccucauaucagcugguguaugcugccugguugguggcccaguguuugggaaaucucagggauccagguuaguugagacugcagguucuccuacagagucacccuccuccucagcuucuuccagcuuuucccuaauucaaccacaugggucaucagcuucuguccauugguuggguguaaauaucugcaucugacucuuucagcuacuuguugggucuuucagagggcagucauaauaggccccuguuuguaagcacaccauagccucaguaauagugacaggucuuggggccuccccuugaguuggaucccaauuuggaucuguuguuggaccuccuugcccucaggcucuucuccauuuuugucccugcaguucuuucagacaggaacaauuauggguuagaguuuugacugugggauggcaacccccuuccucauuugaugcucugucuuccugcuggagguggacucuguucccuccccccacuguagggcauuucaucuaaggucccucccuuugaguucugagagucucucaccucccaggucucugguacguucuggaggauccccccaccuucuaccuccugagguugccuguuuccauucuuucugcuguuuuuucaaccuauuuuugagauuauaauauaauuacaacauuucucccuuccuuuccucccuucaaacccuuacauaugacccuaccuucucuccuuaaaauucaugaccuccuuuucauuaauuguuauucaugcauacacacacacacacacacacacacacacacacacacacacauauacacuaaauauagccuuucaguccauauaauguuaccuguauguuugauagaacauuuugcuagguuuguuuuuaauuacuuacuaucaaggcuugaaaucuaucuuuccauguuuuccuggcuuuuagggaugcuggaaacaaaugugauacucuaauguuucugcuucuaaauguuaguuggccucuuuucuuuauaguucgcuccuuguguuuggauguacauuucugucucuaugauugggaaauucucagcuauauuuucacugaauagauugucuaagccauuugacuuuguuuuagaucugucuucuauucugugaauucuuggguuuugucccuugaauguaucccagacuucuauaaaguuucagucaugcuuguugacuuauuuuuauuucuauaugucaauguguauuacugucccaucuuucucuuccaucuuugauagucauucuucugaugugucuuaucuguuugaugauacauuauguuguguuuaucauuugauaaauugauucuuucauuuccaaaauuucuguuugguguuuuucagugucuuuauauccuugcugaauuuuuccucgauuuuaauuucauuaauuuuuauuguguguguguguguguguguguguagaacaaaaguuguaguugucuuccucuaucacucuccaccuuauuuuuugagacauugaacuucucaccaaaccuaguuugcuauucuguuagaccagcuagccaguaaacccagggcauacgagauucacccaaaugguagaagagucucaauucucccaaguugcccuuugacuuccccacguaugugugugugugugugugugugugugugugugugugugcgcgcgcgcgcgcgugugugucccaaauaaauacaagaaaauuucaagacuaaaaagaauuugaaacaauguauaagcauaaaugaacaguaacuagaaauaugcucagucacugcuucauccugguucaggaagagccuguccucuguguuuauauuagguccaccuaucaggacacagcauugguacagucacaaccuuggucuauugguuuggcuccuuuuggcuauggcauaaguggggaauguuggugaucucuuggcccagacucccuuaccauccuucugcuaguuccacagacuaugugcuuugggaccuguagcauauaccuagaugcaggaguacauuccccauuuugccuacguacuucccuuucacuggauuugugugguuugcugaguuguucaucuuugccagguggucaauuccuuugaagcucuuauccccaguagcaguccugucauauucugcaaugccauggguucauuguuuguuccucuagguuaagguguguguccucugcacuauauggaguucuggggccauuacagcauuuucuuuagggucacacauagaacuaggcucuuggauaccaagccaguggcauuuucucugcuuggccagaaggauuagugcagcuuuguagguuguuuguguugucucucuuuguuuagguauucuuucacuuauuaaaaauguaauauuuauauuaauguuuugauaauuucauacaauuuauuuugaucauauuuacuuuggacccuacuccuccccuuaacucccagaucaaucccuaccucccaucuuucuuuaauuauuacuauuauaaguauauacauauaaauacauaaauacaacugguucauucagugucacuugugaauauguuucuuauuuuaauuuuaaugaaauauaauuacauuauuugccaccucugucuucuuccucauacucccaccucuccuuuauagccucuuccgaauucccaaggccucuuauauauauguauaugcuuuuagugaagcucuccucagucauuuuggaguauucucuguuauuccuuuugcaacucuacuuaacagcuaucauugcucugaagacucuagucuaccaucuuaccugaaauuacauuuuucuuauucuggauguucuuuucuccagguaacaccuagguagcaucuagucuaccaucuuaccuaaaaauucuuuuuuaguguuuugagauuugaguauugaguguaacucuguagcugaggcuagccuucaaauucacuaucuaacucaaacuggccucaaacugauaugauaauucuuuuccuuaggauuuggaaguccugggaucacaagcaggcaccacaaaauccuagcccacuucuucuauuuaaugcaauauuuggaugaguauuuguguuacuucuuuuuuuuuuuuauaagacugauaguauucagcagaguauccaucugguucugggcuucuguuugcucaguucuccauacguauuacuuauauagaucuguuuaaguuguuuauauccucuugguauaauuuuggaaggccauauguuucuagaaauguauucauuucuuucagauuuuccaauguauuggaauacaaguuucccuuguacucuauaacaauccccuggauuucauugauaucccuuauaauguucucauuuucuuucuuaauuuggggcuuccuccuucucccuccuccuuccuaccuuccccaucucccucuuuuucucccucucccuucauucuuuugguuguuauuuaacugguuaaaaguuuauaacucuuguuuguccuuuuaagaauucuuuacuucauugacuuuauuuuucauuuacuuuacauuucuauaaugaucuucauuucuugcuuccuaccaaguuugguuuagcuuguucuuauuuuucugaccuugagguauaucauaaaauuaugaauucucuuugaauuuuuagaguaggcacucauacuuacaaacuucccuauagcaacugccuuugcaguaucacaaauguccugauaaaguauaguuuuauuuuaauuugauucuaugaauauuaaaauuuccucccucauuuuuuccauaaaaccaauugaucaaaugggcaaaggauaaaaguggaaagugguggauguaaauuaagagagagaauaaaaaaauugacuauuagaagaugaaggagaaaaauaaaaacacaaaauaauaaaagaaaauuauuacaaauacaaaaauaaauguauauauauguguauauacauacacaugcacguauguagguauuauaugccauucagcaauacuagggggaaagggcacaguagcacacuauuauaaaaccagaacuguaaagguagagcuaagaggaucaccaguuugaggaccaguguggccuacaacgugauuucuaagccaacuugagcuaccuuguuaaaauguuccaaaaaauguuuuagaaauuaaaauguuauguccucuggguagucaugugaacaauaguggcuguucauuaugucuaccaguuggcacuuauauguccauaugucuagaacaauaagcuuauuggagaaagcaaaugcaggugauggucaccuuuccuuuucuguugucagccaaucugacaaugugaguguuuuaguacugcauauauuguuuuaguaguggaauaccuuuguuccaugcuugcuaguaugaggugguauaaaccaaaguucccucagucagaauuuccuccaaauauauuaguugaacauacuuuccacacccccagccagagccugccugacccugagauccacauagauaauggggcaacaaacuauacaagguagagucauagagcaaaucucauguuuuucuuacucacaacuguaguuucccgaguaccagucuacauaugugcuuucucagccacugagcauuuuuaucugaccacugcacugcuuaucuaaaaggggaacaucucccaccugaauguacuacauguauuuuucaaugagcuuuccuuagcagcauucggcugggccuacacuggaugcugcaagggacagaguagaaaaauucaccacgaguuuuauagggaaggaaacuguagggagauauuucucaaagcaagcagcuugaacaugaccuuuuaaagaugugaaauguggaacacuucccaagcaccagcaugcuauguagcucccagcagcuaaguucagacuuucugcucugcaucugucucugugcaaguuaugcccacuaaaucuuucuccuuuucugauaguaccucugacaugcugccaagccacuacaggcucagucaggaugcaaccuuuucacccucugcuccaauagccagaggcucugcauuuccccaacugugugucugucuaauagcuucagugcauccccucccucacuuucugaagaagcuauuuucugacuguucugauuucuagcugggaaaagucuaaauauucuguuugcuucuaacacaaaaguuuggcauaaauauauuuccauauuauuguauaaacaucagugauuagcaacaaaaacauguauuuuaaaggagguauaagcaacucaaauguucauuguugugugauagauaaauagaacauaguguauaucuguaaugaacuaguaugcagcuucaaaaaggggaucuagucacaugcuacaagguugauggacauugaagauauugggauaagugaaauaacccaacuauauaacacaguaaguguuguaugaugguggaaaggaagacaauaaaggaagggguaaaaauguucaugauaccucugaauggugggcuagaagggggguugaaacauuuaugaacccuaaauaaaguagguguugaaaaauauaggccuacauacauguguaugaaaaugccauaacggagccauuauuuuauguguaaaccuuaaaauuggcgauaauaaaaauauuuaguugcagugcaauuguauuaaaaaguauauaccguaggaaaugauucaucugugagcuguaccuuuauagaugaaauuacugcucuugaaaaucaagcuacaacugagcuagaaacuuccuuuaugcuagauaacuuucauagugccagaagaacuauguagacugcuagaggagccuagccugcuaggccugcaugcuauaccacagaccuacaagacaagaugugcccacuguggcaauaguggcauaacuguugaguauauccagccacauucucauuugauuugaggaggaaauucaugccuauuacuguaaaccugguaacaagucuguagcuguggaggccauaagcccuagaagguaaauguuuauuuuuauuuugcuaaauggacauguuauauccaucaaguuaucaucuaaagacuuacgguugugcucauacaugagugcuguugucuguuuugauaggggaagcuuccuuuuguagugggcagcguuacugcagagauucaaaaguacucaaggugcugagaauaagugacuuauggacugcccagcccuaaaggaagcaucgcuaucaucugccccaaggcuugaggaacuuuucagaaaagggagcagaaggaauuguagcagcuagaagaaaaggaagaguguugucgacugcucucuccugccuaugacaugguuguagcacuauugaaguauaaacugcacaagauugggccuaucaaauuucaucauggguggggaaggggaucacaaaggcccacuccuccuagagaauuuauuggcuaugacaguugcuaucaggaagaggcuucaccccuuccugcagcacuauugguaguuugauugcugaaggauggaaagacauuuuuuucauagaugauaacuugcuccucuaaauuacccucauccaagcaacccuauuuaaagugauggggacacccaaaaccaagaaagagaguugguacuugcuaggaagauauauauauauauauauauauauauauauauauauauauauauagagagagagagagagagagagacuuuacauauauuuguuuuuaaggcaggguuucucuguaucccuagauguccuggaacucauuguacaccaggcugaggucacagagaucaccugccucugccuccugagugcugggauuaaaugcaugugccaccaucagcuguguuucugcucagaugaagagguaccccaccucucugaggugggacagugucccaguggaagggcauccugagacauggaagcucaggaaccgcacagcuuugagaggaagccuccugagcagaggcauugcagcgcccaggagaggguaccaccagcuuaagcugaggagcucaggacccucaccagagagucacaacaggcaaaauaaucuuaugaaagagauugaagggucuaggguauaaagggacgaauccaaggauggaugcccucugcuuccuagagcagacagaagagaauuggacaaagggacacuugcuuauacaggauuucugagggggcggagcuucucagggcagagauuuccagauugaagauuggugggauuucaaguucugagcuugggcaacucagggauuggaggauuuuccuguucagagauuguggcuuuuuuuucacucccuucuaccugcaucaggcucauggguuaaggugggaaguacuugucuacugcaaucagcuuuugcugagguaucaucuguguguggcugcuccagggagacuggagaggaggugcugccacuguggauagcuccugugagacagcgccuacaguuucaccaagaagguauugucaccguggacagcucuucaugcugcaguaggcugaggcaggaaagguguugccacuguguuccuggggagcacccugcuuaggcaggaaaggcagugcaucacuacaggcagcuccugugacugcugcaggcugaggagauguccuggugccaccauuuuaacagcucccgcuggggcaucucaccacagccuugggcugagugggaaguggggggccagucaucacuuugacugcuucugcagcauggcgggccacuuaaggauuacaucacccagcaacaaaauauagaaugacauaaugaaacccauuauuguauauaauuaauauauuuuaauaaaaacaaauuauuagaaugccuuuaaacagugaguucauucuuuaaucccuuuuguuuuaucaugucagaaacagaacaagcuaucaucuauugaacagaaguuagccuucaccacacaauaagucuacuuuuguaccuugauuguuuuaucccccaggucuauaagaaacaaauuguuacucacaaauuacccaagguauuuuaaggcagcauaaaagcauuauacaaauauuagaagagcaaacuccaaaaacaaugacaggaccaaauuaugaugaagauaucaaauaauaggaauuuuuguuuguugcuggagauacaaaauugguacagccauuuuggaagaaaguuuuuucauaaaaucgaguguacccacauuaaauggucuaguuaucaugcuauauguacuuauccaaaugaguuuuugaaagcuuagaccuacacaauaauucacaucuuauucaguucauuaagauguccuucaugggucagugaguaaacaaacaaauguguuggauacacacaauagacuauucagccuuuaaaagaaauaagcuuucaagccaaaaugacacaaagaaaucuuaaauacauauuacugaauaaaauaauuuagucugaaaagucuuuauacuguauaauuccaacuaauacaauaugcuugaaaacuaaaacuguggugacaauaaaaauuuucauaauugcaggauuuggggggaaggaauaaauacugcacagggaaauuuuaggacagcgaagucauacgaaaguggguccauggcauaugucaaagcuguuagauugagugaacauuaaacuguagaacuuagggguauguguacuucagaggauggccuuacgaauugaacuuagaguagguuuuuuuuuagcauuauaugaaauugggaggggaugggcugguggaucuggaaggcuuuaggggaacaagugggaaugaauaugaucaaaauacauuguguagauauaugaaauucuuaaagaauuacaaaugguuuauuuauuuauuuauuuauuuacacuccagauuuuauucccccucccagaauaugaucaaaauacauuguguagauauaugaaauucuuaaagaauuacaaaugguuuuauuuauuuacuuacuuacacuccagauuuuauucccccuccugguccacccucugacuucuccacaucccauaccuccuccccaccacaccccgucuccacguggauguccccacccacuaccccaccagaccucuaaacucccuaggaccuccagucucuugaggguuaggugcaucaucucugacuagacccagaccucugcuuuauauguguugggggccucauaucagcugguguaugcugccugguuguuggcuaagugucugagagaucucagggguccagguuaauugagacugcugguccuccuacaagguugccacaaaaaucccugacauaguagugcaugccuuuaaucccagcacuugagaggcagacaugggcagaucucuaugagucccaggacagucagggcuacauagggaaauucugucuuaaaaaaugaauaacuaaauaaguaaaaggaggaauuuagagaucuagagagauggcucagagauuaagaagagaaaacuugcuguuguugcaaagagcugaaguuggguucccagcacucacaugaggcaacucacgacauguaacacguuucuucacuaucccuuaguuuauuaucuuuuuuguuucuuuuuauguuuccuuuuuuucauuuauguacacuguaugcauguauaucugcaugcagcuuacaugugugaguggggguacagguccacauguguacacauguauguggagguccaagcucaauuugauauucaauguucuuucaccacaacucaagucaaggucucugaaucaaauccaaagcuaaaagauauggcuacccucacuagccagcuugcucuagggauuaugaccacacccacuaaguauuuccaugaauucuaagaaucugaaaucuggucccagcguagccaucucuccaccccaccuuugaaauuauuauuguuguuauuuggcaaguucauauauaaacauaauguauuuugguaauuuuuaccucauuuuguacuguuuuuuuuuucuauuuuauuuuccuuuuucugaccaguuuuccuuuuuuuccuucuaucucccuuuucuuuauacuucucuuccaggcaucuuucccucugauuucuccuuuuacauaggccuguuauuguugcaaacggacauugaaacuaaauauuuuaaguuauuauaauuauggauuuauuaauaaaauaaacaauuacauuuuguuuuuaaguagcaugaccaagcuacuuggagaggaaaggaauuuuuggcuuauagcuuguagucaaucauuuaaaaaagucagggcagaaacuaaagcagaggccauggagggguguaacuuacuggcuuguucagccugauuucuuauacaacccagaaccacuugccuagggauagcaccaacaaccauguccugggcccucuuauaucagucauuagucaagaaaaugcccccacagacuugccuaaaggccauauuaaaggaggcauuuucuugaucgagguucccagcauaucauauaauugaagcuucugugcuggaagaagauguauucgaagaaaguaaacaaaaauauauugugaaagaaauuauaguaacuuguccuaaauguucgccuugcucuuuauuacaguuauauaaauguauacagggcuggagagaugguucagagguuaagagcacugacugcuuuuccagagguccugaguucaguucccagcaaccacaugguggcucacagccaucuauagugagauccgaugccuucuucuggugcgucuaaauaaauaaauaaauaaauaaauaaauaaucuuuuaaaaaagauguguacaagacugccuuaauaagcaaccuuuggccgggcggugguggcgcacgccuuuaaucccagcacuugggaggcagaggcaggcggauuucugaguuugaggccagccuggucuacaaagugagcuccaggacagccagggcuacacagagaaacccugucucgaaaaaccaaaaaaaaaaaaccaaaaaaaaaaaaaaaaaacaaccuuugaagaaaaacccuuugguuucaaguucaugaacucuagaugaauugcagagugucugugguuguuugucacacuuagagaacugcuaaaaguucugacugagggaaacuguuggguuuaagcguuacuaaguuuaauguguuaguaauaaccuuauguuucuuagaauucuggcuuuccuccuccccucccuuuccucuccuccccuuccuuccccuccccuccccuuccuuucccaucccuucccuuccaaaauauuaucucaucacgcagccuagggcuagccucuaacucauuguguaacccacucuaucuucaacucacuuccuccauucugaguguuggaauuacaauagcacuccaccaugccccucuguagaagagccucuuucauuuucuugcaggcugauaagauuuggacaucucugcugaauuuuagauuuauuuccuucucuaaucuaaucuauaggcagcuagaguagacuagaaaacguuuggugcuuuaaauguuguucaaggaugacauuugaaauguaaauaaagaaaauauacaauaaaaauauuuaagauggugaucuagcccuuuaguuuugagguugguguacugugugugaguauacauauuuaucacacacagucacuaucuucgaaagugagggugcacaucuuucucagccaucucuuauuaagccauuaaaguaaugccaacaucugaagcuagcacauucugguucuagaaggucgaguuuuuccuuggaauaaacugaguuuagccugagcagagaaagaccuucauuuuuaaaguuaguaguaguaauaguaauaguaguguguguguguguguguguguguguguguguguguguguguguguacagcggccaaaggagggcaucaaaugacuuguguuaucacucucugccuuguuccuguuuuaaggucucucacagaaccauagagucaggacgagagucagaaaaccugacugacugauucuccugugccuaccucacuaggguuucuggcuuccucccagccaugccuggcuuuuauuguauacaugcugagagcccaagcucagguucucacucuuaugcagcacagaagaaaauaaggaaguuaggugacacaucagccaagguacauugagguuaccugaugcuuaaugacucuuuacacaaaacagaggaaugccuacauaaagaccagcaggaacuaggcaauguaacaacugagacaaagucagcucuaucuaaggucagcuauagucuuagaagccaggugugaggucguuacacuccuggggcaagggcuuucacgcccaagccauaguucuaauucugauuuauuguuuagcccaccaccacccagcucuuaguaaauaccuaacuaugcuauuccccagggcuagugaaaguaugugcuagggaguuccgcucuagcuaaccuucucaugaauaaugcaacacacuaguuccuccuuaaaucacagcccgaucuucuuccuaaacaauuguaaauuccuguaugugggaguuacucgccuguuauucuaagugauuuugugagggacuuucuucuauuaaguaauguagucugacauauauaacuauaauaagaauucuaaacuuacuuugcuaagcuugcccugaaauuucuaacuauauguaguagauaguaacgcccgauuucuuuugcuaucucucuuucaauacuggaggcaauucgucugaauagauaacauucuuacuaaauuccaagcccagggucagcucaaggacugccuaggacguuggugaagaccaggaagcaaaguucaaccuaauuuagguauuugucaaaucauuccuuggaggcaccuauaauaaaacaauacugaaagaaagcacacagaaccauucgccaacuauugcaaggacgaaucugaaacacaucuguuuaugggacaccagaaacuuuccaggagacaaguuuccauaaaacuuuaugccucaugacuguagccaagcuuuugggccugucaggcaguuuuuacuggaguggguguggcacacuguagcugucuucagacucaccagaagagggcauaaguucucauuacagauauuugugagccaccauguguuugcugggauuuaaacucaggaccuucggaagagcagucagugcucuuaccagcugaguaucucuccagcuccccauuuuccuuucuuaaaccacgcuuauauauuggcuuucacuuugcccucauuuccuaguguacuggcugguauugggugucaacuugacacagcuggaguuaucacagagaaaggagcuucaguugaggaaaugccuccacaaaauccagcuguaaggcauuuucucagugaucaagggggaaaggccccuugugggugggaccaucucugggcugguagucuugguucuguaagagagcaggcugagcaagccaggggaagcaagccaguaaagaacaucccuccauugccucugcaucaacuccugcguccugaccugcuugaguuccaguccugacuuccuuggugaugaacagcagaauggaaguguaagcugaauaaacccuuuccuccccaacuugcuucuuggucaugauguuugugcaggaauagaaaucccgauuaagacaccuagagaacacaaaacagauaggagauuuaaaaccauagaaguuucauucugcuucuuaacaaaucauuucuauaggauuccugguggcuggaaggcaaauugaacauucuacuuugaucuuguauuaguaaagcagaugguuuuguuaaacaacucccuagggaagauuugggucucuguuccagcuucugacauagccaaaaagaaucccagaguggauagagcugaauuggccuuucagacauuuuuguucaaucccuuaugguacauauugaaaauucaagccuagaauuggauauuguucaaggucacagucacauagugaauuucuggcuucaagagagauuauucuucccuccuaugcaaagggggaaucuaacagauacuguuuaagcuaugaacucuugugagugugaauguuucauguaugccauuauaguuuaauuuuuaauaauuggaauaauucuauauuuauaaaaaauugcaauguacaaaaaaucaugaucauugucucuuuucucuuauauugcugugguauaauuucaaaauaaaaccccagauuuuaucaguuuucuaugcuagcaucuagaaaaucaggaucagagauaacugaaaaucuuugaucuuccuauuuccuuaguuuucucaucugugccaguuuuuuagguuuaccuguaagauguuuuguacaaugucccucaauuuguugugaguuuugaaaaaaauacuacagagaugaagugucauuacuaucaagguauauauaaagugguacacaguaucaguaguuaacuuugauaauaugguuugccauguucacacaauagaaaguugaaguuuuuuucuuuucuguucucuaugcuucagaaauucacucacaccuaaguucaaccuccuugaaauaaagaauacuuguauauauuuacauguguagaaauauaauucauguuuuucuaagacaaugucuuacuguauaguugugacuguccuggaacucacuacuguuugaaacucacuuuguagaccaggcugaccucaaacucacagagauccaccugccucugccucuuaagugcugggauuaauagugugcaccgcuuuugucuaaagcaauuuauaaaaaauaaauauagaauuuggaguucuuuuuaaagaauaucaacuuuuguugacugcuauuugauuccugugcaugaagguagaaguguuuuggauguuagcuuaucuguucuguugcucacaauguucuuacuuugaccguaagugauucuuucagauuagcuucuguagccucuugacaugcagcuugaauuuuaucuucuuagauugauaauuuucugguacuucaaaauacuccaaacucacaccagcaguuucuuuaaggaauauuaauugauugggggggacaauguauuugaaaaccaagaucugagccaaucuuaccaacuaucauuguuucuguacuuucucaauggacaacuuaaguaauauauagcugaacuauucuauauauacauaugcaucuauaauugucuaucaaucuauuuuauguauauuaagcuaaauaugaccucauaucaauaccaugaaugaauccaguacuagucuucuauuccuguuuaccuauaaauuucuucucuaacagugagaaaacuguguucuaacaccuacuauacauuuguuuauuucuucaauaccaacacauauaaaacaguuucagaauugaccuauugucccuaugagaaccaaauggacaagaauaauguuuauguucaguuauuuauccuuacaauuuugugucaaaacauaauuuucucaaguaaaaucugcuuuauaucccucagugcaguuacaucauuuauguuuuauauaguuaaauucauuuucacaguuuucauuccaucuuaugaucuuccaacaucuugguugauuuuuaaauuuucauauacuaaggcuaagucuuugugaauaggagguacauaauuuuuggcagaguguuauauacucuuuacuccagcaucauugagaaaaguucuaucauuuuuaaacuucuguuguugccaaccaggacuccuucuccuaacauucugaaauuacucauggguuuccaucccuauauuccaaucuguuuuacagaauggcauaacaauauaacaauauaauauguggccuauuuggguauaguuucuguuucucagcaaaguuuaauuuaagguacaguucauauugugugaauugguaaugcauuuaaaauguuccguuuugggggcuggagagauggcucagcgguuaagagcacugacggcucuuccagagauccugaguucaaaucccaguaaccacaugguggcucacaaccauccgaaacaacuaucuggcgcccucuucuggagugucugaagacagcuacaguguacuuacauaugauaaauaaauaauuuuuuuaaaauguucccuuuugguuuggggagcaggauggggguuauagggggcuuuggggauagcauuugaaauguaaaugaagaaaauagcuaauaaaaauaaaaaauaaugaugaaaaaaugcucccuuuugucuuuggccauguuaccccuaauacgccuaaucucaccgaguguuuuguuuuauuauugacuaguauuccauuguagaaauaacuagccaauauuuuguuaaaagucauuuugaguauuucuaacuuugggaaacuaugaauaauguuacuauaaacauguacuuauagggguuuuguguuaaauauacauuucuaauuuauuuugguagacuacuagcaauauaguugguggaucauacuauaagccuauuuacauuugugcuuuuaacauauauuuccaagaaguuuggguugaaguuguuuguaggguguaauaggaucucugcuuguaagcugauuggaauaauuaucauucucuaagcauauucuguauggauagaaaauacaauauccacaagaagauagcuacauuuaccagaaugaugaaauuucuguaaaaugaccaaguauuugcuaacaucuagaaagucauaaaucuuuacaagauuauggaagcauuaaaauuuggucauuuuauauacaaaguagugaaacaauuaaauuagaaaacaaacaacucaguguuuuuaaaaauuagcuaaagagagaaacagaauucacagaaaauuaacuuuucaaugaguucaacagccuuagucaucagauaaaugcaaauuuaaacuacuuugaaucagaauagauaacaucaagacaacaaaugacaacuaaucuuggugaggcuguuggaaaagaggaacauuaacaccauugacggaaauguaaacugguacaaccacuguggaaaucagcuuggauguuuguaaaauaacugaaaauagaacgauugcauggcccaguauaccacugcugggcauauaccccaaagacuauaucccaccacagauauaugcacaaauacauguuuacugcugcacuauucauaguagaaaggauauggaaucagcauacauguccaucaacagcugaauggauaaugaaaaugugguacauaugcacaguggaauuauucagucaugaaaaaugaaauuauugauuaaauuuucaggaaaauugacagaacuaggaaaaaauauuaauugaagcaacccauucucagaaaggcagaaaccugaugucgugcccaguauucagauccuagcuucuagcuuuucucuauguguaguuaugugagaaugagugaguauaaacaccagaaaacuagaaacuggaaggaggagcuauaagggagaaggaugaggagagcaucagaauacauguaauaugaaaguggaaggagggagggaucugggcagcagggcauguggaagacaaggagaauagggagagaaguauaaaggaucagggacuuggcugugggauuuuugucuucuaauaacuucagaagcuauacccauaaguuacacacuaccaacaugucuaccaaaugugagcuaaacaagauugaaaucaacaaauuugccaaauugcaugggaaaagcccaggaggcuucaacucuacacaaagaucugcacaggcaacuuaguuaagcugggagcaugagagguaguccuccccaaggaagagcauaccaauugguuguccaguuccagucagccauccucacaacugauccuaccccaguuucccuccccaccuacucucccaucuauccaccuccuuccauuaacuucccuccuucuauccaucuucaaugucuauuuuauuuccccuucugagcaagauucaagaaaccucccuuggauuuuccuuguuacuuaucuucuuuggaucuguggauuauagcauaguuauucuguaauuuauggcuaauguccacuuagaagugaguacauaucauguaugucuuucugggucugggguaccuuacucagaaugauacuuuuuaguuccauccauuuucaccaugucauuuuuuuaauggcugauuaguauucuauuauguaaauguaccacauuuucuuuauccauucuucuguagguugccgauuugucuuaucgacuauguucuuugccuuacagaagcuuuccaauuucaugagaucccauuuaucaauucuugaucuuacagcaugagccauuggaauucuguuuaggaaauuucccccugugccaaugaguucaagguucuuuuccacuuucucuucuauuagagucaguguaucuuuuuuuguuguuguuuuuuuauuuuuuugaggcaggguuucucuguaucaccugguuguccuagaacucacuuuguagaccaggcuggccucgaacucagaaaucggccugccucugccucccaagugcugggauuaaaggcguguaccaccacgcccggcaguguaucugguuuuauguugagguccuugauccauuuggacuugagcuuugugcaagguaacaaauaugggccuauuuucauucuucuaccuacagacagucaguuggaugagcaccauuuauugaagacgcuuuuucccccauuguguauuuuuggcuucuuugucaaagaucaaguguccguaaguaacuguuuaaaaaaauucugaggauuuuacuuuucucugugauuagaaauaauuucaucaacaguaccauuguguuccuuacuaguuucacauugcaguuucuuaucaguaacuguauauuucuugguggauuguauuguaggguuguuguuuuguuuguuccaauuauuuuucauacaagcuacauuguucaacaacggggggggggggggaggcgguuggcaaagauguugaccucucaaaaaacauacagaacugaaauaguggagcagagcacagccagauucuucccagcaaaccucagggaagucucugugaagaacgguuucucuggugacuaguaccuguaggagauuugaaaaagaaucgaaauggaaaugaauuaaugugacccuaaauauggcugaaguguacagguuuuuuuuagcuaaauacuggacuuuauuuccagccagccuugaugguucuuccaaagggcagaaguggggagggagcgagguuugcaggggauggagguggagugugcucuaaggaugaagaaaaagaacauaaagagacugugccggggccuagcaaacacagaaguggaugcucacagucaguuauugguuggaucacagggcucccaauggaggagcuagagaaauuaccuaaggagcuaaagggaucugcaacccuauagguggaacaacauuaugaacuaaccaguaccccggagcucuugacucuagcugcauauguaucaaaagauggccuagucggccaucacuggaaagagaggcccauuggucuugcaaacuguauaugccccaguacaggggaacgccagggccaaaaaaaaaugagaaugaguggguagggaagugugggggaggguaugggggacuuuugggauagcauuggaaauguaauugaggaaaauauguaauaaaaaaaaucaauuaaaauaaaaaaaaaagaaaauccaugcaauuagugacacgugaaaggauagucuguuuucugucugaacccaaguagcaacggcaaacaagacuguuaaagagcuuccagagggaccacuagcaucauaauggaacuuuguuaggaaagugggugucaaauauauuuuaucucccuucaaucucuuccucugcuuuaagcuccaucccuaaaguggaucuugaggcaguucccuuuaguuugcauaugagcuuaaauuggcucauuuguuuaucugauacauuaauuuuacucaguaugucagagcaaugucagugauucuucuuugacuggccuuaugcugccagaccuuagcagcccuggaaagcuuucauauauaauguaauauggucucuuuagauugcuaaaggaagaagacagaaauaagguguggagacccugaaaucaagggaacucauaacuucuuuugaaguaaaguauuuugagguugugcauaaagaaauaagggacugacucauuccuugucuuacuacaacugcuucuuuuacccuuuucuagcaguuaaaauagcauuugcauaauuuuuauacuaaugcuuuccuauguauuauuggauccucacacuauuuuuauugaugcaccacggccaaacucaaauguuuuuucuacacaaacauugaauuuaacuucccgugacaucuuuagaaauuuuaugaaaugcucuguuguauuaagucacauuucuuucuguuuuaaauuauaguuauucauauauacauauauauacauacauacaucauuuauuauauucaaaaauggucaauggcguguucuagauaagacuuacucaugacugacauagugagcaaauaaugaauaauggaaaagaaauagaguagagggcugaagagaugacucaguggcgaagagcacugacugcccuuccugagguccugaguucaauucccagcaagcacauggugacucacaaccaucuguaaugggauccaaugcccucuucuugagugucugaagacagcuacaguguacucauauaaauaaauaaauaaauaaauaaauaaauaaauaaauaaauaaaucuuaaaagaagagagagaagaaagcaaauauuuaaagcuuagauaacauugauaaucauuuaauuacagacauagaauuuaaauaugauuuuuuucuaauuuuguauuaacauuuuguauuauuauuuuaaaaucccucaacaguuuccuugaacacacuuacucuucacaaaaauagagaugauuuaaagaagugauagaccaugagagauuggcauaaauugaugagauaaaguacguaggauuguuguacaguaugcaacuuaguugguaaagugcuucccuagcaggcugaggcucuaggcuugauccuagcauuacauuaacauaguaugcaucuguaacccaauauuggaaagguagagggaagaagauagaagcccagagucaucauuggcuacaugcaugucugucuaccugcuccaauugacuuugucucaaaacaaaacaaaaugaauagagaaugguauucugaacaaacaaaucagugaaacucauaaggagggugggagggcaugguuuguagagugacgaggccacaucuaaccuuuggaucacgucuugaaaaaucaugcagaauucugggaacauuuagugguaggaaauaaagcccaugucgaaggccuucuaagagggagugagggaggugguagagauggcucagcaagugcacugacugcucuuguacucaguugcugagugcuccugccuucugccuugaucaacucagaauaugaaguaugucuuauuaaacauaaucuaauguguguaaucccaguacuucagaaacugagggaagaugaucauaaguauuauccugucucauaaaaagguuuaaauugcucaguagcauaaaaucuuaguugccaaauuuucaaaccaaaacucagagaaugccauuuuucagguucccuccuccgcuggggcacuguguuauccuuucucuguccaacuucucuauacuggaaucagauuuauuuuuaacuacuuccuagcuuuacaaguuugguagguuucuuuccuuuuuucuuuuucuuuucagauguaaugucaauuuuuuuaaagauuuuuuucuuuuuauucucucauacaauauaucccaacugaagccuccacuccuccaagccuccccacccagccucccucucccccagauccacugcucuucccuucagaaaagugcagaucuuaucaacugaacacagcauuaaaggaugcaaaaagagugggcacaaauccucauauccaggcuggacaagacagcccaguaggagaaaaagggucccaagaacaggcaaaagagucagagaaagcucucacucccacuguucggaguuccacaaacaccccaaccuaaacaaccacagcauguaugcagaaaaccuaguacugacccauacagguuuccugauugucauuucugucucugugagcccugcuuaguugauucugugagcuguacucugcaggcaucuucaaccccacuggcuccuauaaccacuccucccauucuuccacagaacucccugagcuuaggauaauguuuggcugugggucucaguauaugcuccuaucagcugccagaggaagauuuucugaugaugacugagcuaggcaccaaucuaugaguguaguagaauauuaggagucauuuuauugauuuggggggggggguaaguccuguuuaguuuuacccuaggucucugcaccauccagcuuucaguuucuggccauccaggcaguacuggacaugggcuccuccuuguggcuucagccucaaguuagaguagucauuggugggccauucucucacagcacaucuugcaggcaggacagguguggguggaagguuuuguggcuggguuggugugccagucccaccauuggaagccuugccuaguuaacagaagaugaccaguucaggcuguauauccucuauuacuaggaguccccauuagggucacccucauagguuucaggaaguuuccguugcacuagauuuccacccacuaaauaccccccuaucucaucucucccucuuucccuccuuccauaccggaaucagaucuuguuuuuucaacuuccuagcuuuuaggauuugucgggucucucuuaauucaucugauucuuaagauuauuucuccucccauaaaagauaaugcccaauuuauaauuuuauugcacagaccaaauaaaauaacagaugugacaucuuuauagccuauaauauacugugaaaauaaaagguaguuuuaucauguuagucaagaaaugccaaaaggcacaaaauuuuaucacaucuaugaagcaugauuuuucacuagaucaugugguauauuguuucaagccuauuuauagacacagauuugcuuaaguucaguucacuuggacacuuugaguaaaguuaacauuagagaaaaaaaucuagucuuuuucugauugauacaaaggccaguagcaauuauaucacauggauauaguuagauuuuuuuucaguugguaucuuacugaaaucccuaaugaaugccuaaugaaucaccuaaugaagagugauuaaaacagucuuccuuuaacagaagaaauauuuuauaggcaauuaguaaaauguaagaaaauuagaugaaaacugaauuuacauuccccuagcuacuucuaagugugaaacauaaaucuguguuccaaaucucccaguauguagaaguaucuuuaaggaggugacaagaaaguauugaauaauccuucauugcauaccauuguaagaauuccuuccuaggaagauguaagcaaaggauuaccuuccucuuaacacucccaggacaaaccaaaguaaguuucuaucaaagucuaacuuagacaacuagugaguauuuuuuuacuuacagagaauaggugacuucagaaagucucacccaacagagaugaugaacucuucagagauacauagauggaggagacacacacauacuucauuuaacauuucccagucuguauaaucccaaacccuaauggcacaugcaguuaagguagaauuucaugcaaauaacugggaaaugaaggaaagaaucaggauuuucaaugagagugcaaugacucucccuauccccaccuucucugagagaacaccaacagucaaaaggccagucuugaugucuuuauggucuccugcaagcaggcacagcucaucugaugaaaguagcagcuguugucuuuggaguaccacauucuauaacauauauucagaucacuguguaggggcuuagugugguaguauacguaaaagucuaagguaauguagcauccuguauuaaaugguauggaacagaagacauucuggagaagugauuucagaagacugauagaaagacugcaaggggauuuuuguguauguucaggcagaaagaguaagaaugucuuccaaauagaaggaucaugucagguauggugcgugauuccagguaaggcucuugagauauggcagggacaguuucgacagaccguucuugaaauucugacagagaacacuaaguuggauaugguaggcaguggugacccuuugugaauuccugagucagaaacuugaagaggaaauaauguguuaagcagugcccagggcacguuaucguagacauaagcacuuacuaucaaaacucgcuuguaagcuuucauugugugauguaauaguagguauaaagaauguaguguuccaugcaagauauggucaaaaagagagaacaauaagaacacugggguucagaaaauucuuaucaauaagucagaagucuggcauaauagggacuuuuuagauaugcuauagaugaaccugaaauucaauaccuuccuagagcuaaaucagugaauggcuucuggaucugaccaacuuccaggagccaaaaugugcaacaaucuuuccucuccagacuuucucaaagcauaugaacucaacauuuguguuagugugugugugacugggucaaaauaaccucugcugucugaaaagaaagacaauucaaagaaaaacugaacagacucaccaccaaaagacgauacacaaagaaguuaaaggaaaacaagagaaaagucaguuaaguagcaagcuguuuuuacucaggaaaauguucacuuugacacacacaaacgcacucaagcaucugcaucugucccuacccuaaaauacuuacaucacauacuggacuagaaugauaaggcucugugacuuuaagaagguuucuuaaaacucuaagaaaccucaggcuucucauuugugcaauagaaaugcuaauuccuuucuacuucagaggauuuuuuuuguaaggguaaaauaauacaauucaauauaacguuucuagaacauagcaugaauuuaauaaacuuaguauaauuauuagauauuaagaggauacuggucagcuuauuauugguucuuaaacuugaguucauuuacaaacagcaaacauuucucucagcuuuguuguuaagugguggcuaaaggguagaauuuaaccuagugugauagcagcugcuuaaauagcaacuggguuuuaguuuauucgacuagcuacaguugaauagagguuauguuggaugaguggucagcagcuaauaaaucuaguaugcaacuuguuuuggugaaauacuauaccuuucccuuucuuuacccuuccuguuuguaaucauauuuucuguaaauaaaauaagucuacuccuaaggguaaugugacuuuaaucuaacugguacaaaauaugcauuuucucauagaguuugcuuaugauguagcuucacuugagagaacuuaagaaauaauaaaagauaccauauggaaaucauuaaaaauaagagcuauuuauugccauucaccugcauaugcugucuguggagccuauuggugcauaccaaacacaaggauacuguccauucauacaguacaugugauggcaugcuuauauuuuuggcuaugcuuggguucucguaugaauugcuuucuuuguucaguaagacugggauuuaaucuaaagaaguacaaauacuacuaugacuuuuccaggugagguuauguguacaucuugcuccuuuaccuuuguucacuuuuauguagacaaacaaauaguccuuuuuaagcauaaauaaauuagacaaaaauaacuaagacuauagcuacuauuagguauuuguggauaauuggaucuaagaugucacaauauucuccagaguaauuuagcaagugauaaaauguuuagccuaccuuggcuauuccacuauaauggaaucaaauuacuaugguaccuugcauuaccuugucaucccauagcuucuuggugacaacuauuuggauaaccaccaagauuuuagugucagagcuauagcuaugaguuggcauggcagacugaacccuuauacucuggcuaauauugugaacaaaaauuagcauucaauuuugucauguuaacucaccugaaaauuuuauagauuucagcccucuauuccuauuuaugaaaaaacagcuccuuggucucauuucuucauauuauaaagccauacguuuguuucucuggcaaguaaguucaguacuugccaguauuagcaaaauuaccaacugauucugugauguguuugcaaauaacaaggcacauuuuauuaaauagucucuguaggggcuauggaucuuuaauuacaggaucauauuuagagcauuaucuuuauaaugcuagcuuuuuaccuuuucaagagccagcaucuugggggaaaaaaagccugccaguuauucauauuauaguuaggauagagauuggaauaucuugucugaauaugguacaauuucuccagaacuguauaaauauacuggaauauuuugagaacaaaagaagugagugauagcacagaacuaguugggaaaacuaaaaaauuggagcaaaaaugaaaagaggccaauaaaaaugaagaagaaagagugaacaaaaauaacuugagccagaauaauagucccccuccaaucuuuuaauaugugucaaaauaacuugucuauaauccacagguugucucauuauauaguagguucauuugaucuaguaagauuuuuaucuagguguauauuaagagauaauuaggcugucuuuuacacugaaaaaaaaggccaaaauguaaauuuuuuucuuuaacucauaauggaagauguuggaagacauuuugcuacagcucucuccuaugacucauaacccauauuccugccaucuuacugguaucuuaguuuuaagugaggcugaaucuuugggcccuaaugguuucaggaaguaaaaaggaaauggguuaugcaauaagaaaagucuaaugucaccacacucaucuucccuucuaauccaagcguaguaccuaccuuauuuacagagcauauuguauggugaauuuuauaucugcauugacaauguuacaggucaauauauuuaucauaaaugacaauagaauggaugauccauugaauauuuauuuaaaacuucuauguaacaaagguuugauuuauuucaagaaaaccaaucacggucucucucucucucucucucucucucucucucucucucucucucucucucuguguguguguaugugugugugugugugugggugugugugugggugugugucucacauuggggugauuaaaccaagcaugucaugcauguuagucaagcugacugcacucucagaccaaaguaucuuauuuauuuucuugagguccuggggauugaaccuaagcauucuugaauccauuguuucucucaucugagcucccaacaccuuuuaaauauuaaaagcaggaauugucuucauuuugcauaauugcauaagaauaauuagauaaagccaugauuuaaacuugggcccuugcugcuuguccagcauuccucuuguuucccacuaugaccucuugugauucaacuuaaguugacuaaccuaaugugccacuuugaucacuuaucuuuucuaccaaaaacuguauugaauaaacuacaagauucaaagcccucagggcccaagcaaccccauuacaacaacaacuuuaugcuauuguuucccuggcccuugcuuuuucucaucaauaaaccaagaugacaguuacuuuacugacacgugguauagugauauucaaguguaagaauguauguggccauuuuguuaaauuguaaagccaucuguaauuauuuauuuauuuauuccuuaaauuuaacugaaagcgacacuagaaaagcagacugagacccucccucaaaaccaaaccaaacaaagcacaccagaauuuggggagggaauccuucuuacuguauuucuuuugauuaaguuucaucugacaaaaauauauugauuauaaugcuaacucuugauuucaggugcucugcaagcugagaacugacuucagucuccucuacuuuuuuauuaguuuccuguaaguagauauuauauauauaaagaguucaauggaauuguuuuugcuacagcagcauguuaaugaguucaagauuguuguuuaauucuuuuuuaagauuuauuuauuuauuauauguaaguacacuguagcugucuucacacacuccagaagagggcgccagaucugguuacagaugguugugagccaccaugugguugcugggaauugaacucaguaucuuugaaagagcagucagugcucuuaccugcugggccaucucgucagcccaucguuuaauucuuuuuuuuuuauuuauuuauuauacauaaguacacuguagcugucuucagacacaccagaagagggcaucagaucuuguuacugaugguugugagccaccaugugguugcugggauuugaacuccggaccuuuggaagagcagucgggugcucuuacccacugagccaucucaccagccccaucguuuaauucuuauaaucaguuaguccacauguuuguuauuaaucuuuugguuaucacacagagaaaugaguugcauugcgacauauccauuauauuuuguuuauuuuugcccacuacuuucuuugcuuguucuugcugguccucuauccacucaaauaguaccacuuucuauuuucauggcacacauauuccuguaucuaaucuuguucuuccuaccccucuucuuccucaccucucauaguacccuuucuacuuucaaagagagggagagggagagagagaaugagagaauuguuuuauuuucauacugggaaugucucacauugauguggcaaugcauuuguguaucauaaaugguaguagaauaaaugauccacugaaucuauguuuaugaccccaucaaagagccuuugcccucagcccuaguauauuaauacaagauaggaccaugagcuuuaccaggaauaacuuagugcuggaccuaaacccugauucccuuccuguuaguuagauggaguucaaugaguuaacuuuuucugagauuuuuuuccauauuuauuaaagaaaauaauaauauauguuuaacaaggcugcuguuugcauaaaguaauaaauauauuuaaagugcuugguaaaguaucacucaauacauguuagucuucuuuuaucacacuguaaauguaaaguauaacuaggugaguuuguggauggaucaguguagaauacauccccacuccuauagaaaguccuucugagaacauaucuuaagaauggagaguguuuccagcauccuaucugaacacuaauggcagcauuauuacagauauacaagcaaguaaauacuccaucuuuagcagcuguguuuaguuaaggaacagauuuagaaagugcagacuuuaaucuguguuuucucuuuggauuuuggcaccaucugauuuacuuuuuucuggauaaaaaguguaauuguagcuugauuuuuuuccccucccuauacacguauuucugccguccuccaaagaaaaagcugccuuuuaaaaagccuaaauaggacaacguguaaauauuugaaagacauggcaauaaguggauaccugaagaggacuuuagaguaaaaacuuuagugacuaaugccuuuuuuucuuuaaugcccaugaggaacagauaacuauagaggcaccacauccgaaccuuauuucucccuguuugaauaacugggugaguuaauagucaagaaagaagcuguuauagaguacaaaaggaugauagaaguguccauggacuuagaagcauuucucuuuccucaaguaggagcuggaggacagagcagguuucuggaacagaagccauugguucuucugaccucucucuuccaccuaaaaacuuuugauucgagauucuaccuugggauuugaaauuugauagcauagaguuauaaagaucugaggacagggaccaaauguggucuucaggguagcucuggggaugcuacgugaaagcauuaaggcuucaaccaugaagaagcuucacuacugagagggcaaagguuuucaguguauccuaaaccaugucccucuacaauccacagcuucccuucccuuacugcugcucagcaauaggcagguuguauccccaguguucucacagggaagcagagacaagaaaauuccuggaagcuuucaggccaccuagcuuguugugcacagaagcaaaugagacucuguaucaaacaaaguaaaaacugaagacccuuguccaauguuguccucugauguccaaauagaaguugucucacgugcaugcccauacauaugcacauaugugugcgcauauacaugcgugugcaugugcacaugugcauucucucucucucucccucucucccucucccucucccucucccucucucucucccucucucccucucuccccccccucucucucucucccucucccucucucucucucccucucucucucucucucccucucccucucucucucucuucucccucucccucucucucucucucucucucccucucucucucucccucucucucucucucccucucucccucucucccucucucuccauacacaaauauguacagagguaaaagagaauucauuguauauauaacccauucaccugugcuaagacucagaaaccaacuuguugauuuaauucaagacuaauuccuuuuucuccauacucuugcuucuaccuauauauaaaaaauacuacuuaaguauuuuuauaucauguaucacuagcuuuaugaacuuguugggucaggaggagaaagaaacuacauggauuuacuaaguucuaugcuuagcaccacuaaagggauguauaacaguaacaaguagcuguuguuggaccauagcccccuaagguugauuugggaucuuugauucuacagcccagacuuaauaggguugugaaaucaagaauuuaaaaccagucaauucuaauuaaguauccuuuauguuggagccauuccaugggccaugaagugccucuaguccuauuaagaucugaaacuuguggacauaauuuucuggauagguagggcaaaguauauuuuugucuaggaaaccuaaaagucaugugccaccaaauaaaauuugugaaaucacuguuaagacaucuugauuauaaauguguugaaacauaaacugugcuagaaguauagcaugugcagauguggcagaugauagaagcuuacaagauugaagauacauagcuaagccuaaaagaagguucuauuuuucuuucugccuuuauuuuuuuucauaucugaagaagcucuuaguuucuuuucauagaguuggcauuugauuuucauuuuaauuuucaugguguguuugcacuuaauuagugcuguggcagguuggcugcauguuguuugcuuuccacaaggcuugauuguaaucuagccuagguuagaagggaaauuguagagugccgcaggcaauaauauacagccaaguggaaugaaguaucauuucauuuggcuuuuagacagugcagaaacuuggaauauuguggccguucauuuuugaaaaagcaugccuuuuuaaaaaugauugauuuauuauauauauauaaguacacuguagcugucuucagacacaccagaagagggcacuggaucccauuacagaugguuguaagucaccaugugguugcugggaauugaacucaggaccucuggaggagcagucagugcucuuaaccacugagccaucucuccagcccaaagcaugccuuuuuuaagauggagaaaauauaggaccgagauaccaaaggcagagaaugcucaucuaccuuggccaauuuacacauauuuuaauugaaaaaucuccaugacuucagccaaggggagagaagaacuaucuauggauuggguguuuaagaaguuugcaaccuaccacacuccuccacugcccacaguuucuugucuuugacagaaucucccuguccuuuauaauaauguaacccaaauauggcacaguaugcaaauggcuucuguuauucccuuucucauucauggcugaacaacuugaguaggaacuaauuugauuggauuugcuguggguuuuuuguauaucuucuuagaaguuggccaaauuuauuuuagauuugugcaacugauucucuugaugucacauaaagcccaccagucuguuuuauccauccauuacuuaaaucuguucuuuaauguugucaaauuguugcccagcuagugacagaaagcuuacuuucuccuuaugccucucccuuagcguucauuuuaucuuuauauuuuucucuuaguauuaugagcuaaucuuucucccucaaguuaguuccuuuuguggucuaacaaagucaaccuuugugauagauauauuuaaagacaaaaaucacauuucuugaauuuacuccccuaaacuacuauuuugaauguucuagacuuuuccuucuuaauaauuucuaguuugccugcauugcucaucaaagcuaaucggaacauauauucuuuuccuuucugccaacuuaaugauaaccuguguuccuuguucaauuacuuauuuauauuucuguauauuuauuuguuuuuguuuguuuguuuguuugugacagaaucuuacuauguaacccugaucugcauggaacuuucuauauugaugaggcugaucuugaacucacagugauccgucugccucuuucuccugagugauagaaggcaugcuucacuacuccuguccuaguuucugauauauuuuuuagagauuguucguauuuuuaauguuagaucauuagcacugacaaauuauuuuaguuuaaacacuugccaucaacaccuucuuccuacccauccucccucccucaagagauaaacauucuaauuuggcaugacauuaucuggccuaacaguaccuggaauaugaaggaccuaaaaggucaucuuccacuguuuuagccuuccagagugguugaauuaaguucaaacucgggauguuuuugaaaucuuaaaucucucuggagauguuuuucauaacaucuuugaacuggauaaugcuacaauaaauaaaauaugcugcacuggauuaaaagguuauuucccuaguguaucaaguuaacagacaacaugaaacuucccauuaugcuuuggacaucucuggcugucaguguaguaacccugccuccauuaggucccuaaccccugcuguuccauaaaaaccuuagcuuguaagcuaccuuucagagugaaugcugaauggcagcaagaccaaggaaacaagacauaaaaaaagucuaaaauaaacaaaagauaugagauacuucauaagcucauaaucugaguccagagaaucagagccaaagaacaauggaaacccauuauuugaaauuaagauugggaaauaaaccccauuugagacaaacaaaauugacaaugauagcaacaaucaauaauuaacaccaguaaauuaaaauaauaaagggcagggcagguuagaauaccuucaguuaaaagugagaucacauagccaaaugcuuucacuuaugagucucuuaaagucuuugugugugugugugugugugugaaauaaagaauuuccauacaaugcuaggcuguguauucugaguaucuaucaaaaugaaaguagaaguacaaacucugguaaguauauaccauagagcauucuguagcagauaaaaauuuaaagcauguaauauuugcauagaagugugaaaaaaucuuacaaauguguuauauaacaaugaaaauaaugaggccuagcaugguggugcaguccuguaaugcagcacuuguagaagaaccacugcaacuuugaggccacccuggucagcaaugaauagugagaccuuagcuugaggaggaaaaacccuuaaauggugagaucuauaacaugauuccauucacaugugaacucaaagcaugaacaucuaacagcacuccuuuaaauggguauguggacaugcacauuuagcacauugguaggguuaccugugacagagauuaggaauaagcgugagcagcugagugguuuacgagaggaaaguuuugcuugguucauugagaccaacaaaauaauaaaaaucaugcaagccugcacaaacagagaaaacgacuaggugauuagcaaguaagaacagcagugcugaccugcuugcaucuguaugauaauggaaauggucugucuuggcuacacuagccacgugucauuacugaacaucugaaauaugacuagaaugguugaugagcugcuuuuaaucuaaucguauuuaaauuuaaauuuacugcugacuacuagccacagugucaaaagguaaaauuuagauguuccaaaaaaguagauggauguuacaguuuuaaaaaaaaaagucauuauaauacuuggcucuauugauagauaaguggauaauaaaagaauguaagaaaaccaggaagaaugugauuguccuugcuuucucagaaacuauuuuucucauuaauaagugaccuacaagccuagucccucacuauucuucccuguguuuaaagaaacugaggucacaagacucucucccaagcacucagaaaucucacacuacuucauuuuugaacuguguuccaacaaucacugaaaacucuuaauauuuuucauuuguaauguugucucuaguccuucuucucacuccaaaauuuuuccaacgcuguuuuaacuuggucuuacuaaauaguugaauucauuuuagcacuuugagauuaaaugaaucccuagguccagucaucuuccaacuuuugguucucuguauaguaaccugauuucacacugggaaaaacauauugugcuuuuacuucaggauauacaucucucucucucucucucucucucuguguguguguguguguguguuuguggugugugcuuuuacuucaggauauacaacucucucucucucucucucucucucuguguguguguguguguguguguguguguguguguguguguguaauaggaacuaaucugcuuuauuguacaacacagaacucuaaaaucugaaagcuggauuuagcagaaccuuugucccaggugaaugagaacuuuuuucucccaccccucuuuauuucaucuugagauaaacaaggauggcucuuggauuuguaacaacauuucugccaauaaagaaaaacaagaaauuagaaguaugauuagugguucuuuuauuuguaauuuaucucaccuaacaaaacuugaugcagcugaggauacuucuagacuagaaacuaauacacauauaguauaguguaaauaaaaccaacauacuuuuugguauuggcaaauacuuucuccuuuuggaacuuguuuacugucuguaaaguggggaauuugggauuaaauuaucuuccaagaucuuucaagaaauacaguucaguaacuauauuucuaaaaauaauuuaauagcuuuuaaaauguuauuaacaggaaauaucaguauuuaaaaaagagauuagaaaccauauggaaaaaguuuuuaaaaauuuacccaaagcuaucaaacucaggcuuuaaaucuaccucagugcugccuggcaacaaagucucucugauuauaucuuauauaaacucauucucaugaaguaccacacucaaugaugagguccuuccagggcacaccaacuuguacauaccaauagauguauauagguugguuuguuuuaaugugcuauuauacuacuuguaugaguggaucuaccaucugacaaaucaugauagaacuccucuaucauuuucugaaccugagagaaaauaauaguucugaaaauaaaacucuaggaugucccaguaaaguugagcuacauacaguauaaauaucuagaaaugaaaacuacuucuuauaaguucccauaaguucuucuguucuuucuuuaucucauucagaucuuaguaaauauuuuacuuucuacccuuuguauaacccuauaacauaggcaguuaauuuuuuuuaaucuacuuucauauugauuucuguucuuacaaauguagucuacuuggaagucucuuuaaugucacaaagauggugcagauaagacuagaggagaaaggaagugaucaaguuggaaggcucacauguugagcuaggacaaacuguaagcaccaucauuuuucauuaggauccucuucaaagagccucuccaggccugugagguugaaaguaauggguaugcccggugucucauaaaaugguuguuccagagaaguggugaaggccauuuuauuuugcuuugcuuucgugucagggucuuacuauguagaccagacugaccuugcauuuaaccuuugccuccugaauacugagaugucaggugagaugcacauggccuuaguguguaggauaaaaacuugacugggaauagugguuagggauagaaguuaguuaaaauuaauagggauuucuagaugucaugguggcacauaguagucaccuuuaucgcaaauggacucauccaucuaucauuuucuuuuuuaaaauuuuuuuauuagguauuuucuucauuuacauuuccaguacuaucccaaaagucccccauaccccccacuccccuacccaaccacucccaccucuuggcccuggcguuccccuguacugaggcauauaaaguuugcacgaccaaugggccucuccaaugauggccgacuaggccaucuucugauacauaugcagcuagagacacgagcuccggggguuacugguuaguucauauuguuguuccaccuauaggguugcagaucccuuuagcuccuuggguacuuucucuaguuccuccauugagggcccugugauccauccaauagcugacuguaagcauccacuuuuguguuugcuaggccccggcauacucucacaagagacagcuauaucaggguccuuucagcaaaaucuugcuagugugugcaauggugucagucagcauuuggaggcugauuaugggauggauccccagauauggcagucucuagauuguccauccuuucaucucagcuccaaacuuuaucucuguaacuccuuccauggguguuuuguucccaauucuaagaaggggcaauucuaaaagaggcaaacacuuuggucuucguucuucuugaguuucauguguuuugcaaauuguaucuuguaucuuggguauucuaaguuucugggcuaauauccacuuaucagugaguacauaucacgugaguucuuuugugacuggguuaccucacucaggaugauguccuccagguccauccauuugccuaggaauuucauaaauuaauucuuuuuuaauagcugaguaguacuccauuguguaaauguacgacauuuucuguauccauuccucuguugagggacuucuggguucuuuccagcuucuggcuauuauaaauaaggcugcuaugaacauaguggagcacguguccuucuuaccgguuggaacaucuuauggauauaugcccaggagagguauugcaggauccuccgguaguacuaaauccaauuuucugaggaaccgccagacugauuuccagagugguuguauaagcuuggaaucccaccaacaauggaggaguguucuucuuucuccacauccucgccagcaucugcugucaccugaauuuuugauguuagccauuaugacugguaugagguggaaucucaggauuguuuugauuugcauuucccugaugauuaaggaugcugaacauuuuuuucaggugcuucucagucauuugguauuccucaggugagaauucuuuguuuagcugugaaccccauuuuuuaaugggguuauuugauuuucuggaguccaccuucuugaguucuuuauauaaauuggauauuaguccccugauuuaggguagguaaagauccuuucccaaucuguugguggccuuuuugucuuauugacaggugucuuuugccuuacagaagcuuuguaauuuuaugagguuccauuugucgauucucgaucuuacagcacaagccauugcuguucuuuucaggaauuuuuccucugugccuauaucuucgaggcuuuucuccacuuucuccucuauaaguuucacugucucugguuuuguguggaguuccuugauccacuuagauuugaccuuaguacaaggagauaggaauggaucaauucgcauucuucuacauguuaacugccaguuguucaauauaccuaauaucuaaguaaguggggaaaaacuacaagcuucuuuucauaaaaucuagaucuuacuuaugcucacauuuuuaaaaucuugauguguuuuaagagaaaugguugucaaaauucuauugaagucauauauauaagucaagaaauuaagguaucuucuaccucuuucaauuucagaaauaacuuaaaauuauccuagacuuuacuuugcaucuuuccuaauugggcaacuuugaauaauaugguuguuaauaggaaauauguaccuugcauaguagguguaagcuauuuaauaaaaacagaaguaaugaagccagucuagaaaacagaucccagggagcauuuuauaaacccuauagcugaaauaacauguaaaauacaaaauaagacaaacugaaugacugacacuguauauuucaaaugugcagguuggacaacauuugaaauuggaaugaaacaguaagaggcuacauucauggauaaccaacaagauaaaguuauugcugccucagccaauggagacaacaaucugauuaauggggucaaaaacaaugguaagaaaguuuaaugaugauauacauucucuuuucugguagucuuuucuuauuaauguggauuuugaguauagaaaccugagauagguugaauccaaaauguaucugaaguugauguaaaucuaaacuuuuuucuaccagaucuuuaacucaacuagaaggaucucuguaagaucucagauaaauuucucagauucauuuguuaaaaaaaaacuugucaaaauuacuaguaaauuauaaguauguucugaugugagacuuuuauaguuucacuaugaacuucucuaacuuaacuuuucaaguaugggcacgugucuuaaagcauaaaucaugaauagcccccugugcaucuuccccucugaaagcuuugacuuuccaaucgacugaucaguccaguucuuuccugacuucugauggggacucuaccuuuuccugggcugaaaaaaaugauuauuuuucacauauaugaauguuucgguaugaaauuagaauuguuuuuauaauguuuaggugguaauucauaaagcuaagaaacagaagcuuaguuuauuauaugauguucacauaucagaaacuaaucaagggaaagagauuugagucucaucuaagagccuuaacuuuauuccugccuuuuuaccccuuuuuucuagacucagaggaccaggaaguggcaaugaagucauucguagcucuagaagcuacuacuccaauccagccuauaccagugauacaaaaagaguccccgauguuucccaggggccuucuuccuccgccaucuaagaagccguguaugcagagcccuccaucuccuuuggcccugauugaagcacccgaucauucugcuaauagugcuucugugaaugccaucucccucacaucuggaguugcaaaaggccugaacacauggucacugcccaacgagugugagaaagcuccauuugccauaauggaaccugcaggcaugucagcucugaacggagacugccucaugcagccaagcaggacuugcuuagguugcuucauggaaucaaaagaagcaguagauccugaaccagggaucagucugaaagucagugaucuaaaucgagauuaugaaacaugugcagucucugacauagggauucaaugcauuaaugcuggggaaaacauuaaguauggagagcagcugcuuucagaccagcuguuaggcuucccccugcauaagucaagggcaggagauagacgagaaucugagaaaccugacaucgacuuggaagauccaacucagaaaaguuauuaugaggcauuacuauuagauaagugcaacacggaagaagcuuugcuggcaaauuccaaucaggauugggguuacuuugagacuuuuauuagugagaguaagauugagcuacuugaccucuguuccaagaaugaacugucuguuaaccuuuucucugaagaagauguggagaacuauauguucgaugaugaugagucaacccugggcagugaugucugcucccucaaaauucgauaugaguccuuucaggacaauguucgagacaagaccacucuucugaugcaggaagaugcccaauucaauuuuuuccccagugucuuuacuacgugucccaagcgggaaucuaagaguggaauccucaagcagagcagugaucuuucucaauucaaggucccugaugugagcaucaucuggggagaagaagauaaaaacuuggacaagaagaaaggcaaagaggaaguacaugaagacaaaagcauagagacaaaagaugaaaaagauaauggagaaaagccugcauuaaacaauaaaccaugugguggucuugagguagagcaauuuaagaaccuaaaggcugaccaacuuacuaauucccuggagacaucagggaauuucagugaugacaguuccuucauugaggucucauaugaugccaugggggagaucaaagacuguagccgcuauauggcucgggacacuaauucuggaaguucauccucccagcagaacuacggacugcgagccaagagaaaagucagauacagcgaagauuaucuauaugauguugacucgcuagagggggaaaaaguaaaugagagaaaggaauggccuccaggugguuccaaagaagaagaugaugaugaauggugucccaaaaagagaagaaaaguaacacguaaagagcccccuguuauuauuaaauauaucauuaucaaucguuuuaaaggugagaagaacauguuggugaagcuaaguaaaguagaugccagugaaacaacaguaaaucugagugagaaucagcucaguaaguaugccaagcuaucaccuuugaaaggauucuggcaaaagaagaaaaagcagaaaaacagcaacacagacucagucaaaacacccuuaugccaaaagcaaagcuuugaaccagguagcuuugaggugucauuccugccuccugcucguaaacgaaaaucuaagcuuggcaacagacacaggauucaaaggauccaaucuguggaaacuucagcaaguaguaagcagguuucauucugcagugaucagaaacaagcuuguaaucgcaaagaagacgguguaaaagggacaccaaaaucagcacuucuuacugacccaagcugugccaauggaucacauuuacguggccucauagucuccgacucgguuaaagucaaagcucaagauacagaguucaagggcccagagaggaaagugcuuaacaaaauuaaauuuaaaagugaagcuagguuaaaauccaaaaaaaucaaagcuggacaagaaaacaaaccaguuguucaaaugagcccugucucagaagacacauccuccaaggcuaauuuaaaaaaugaagucacuccuggaaccucaaacaguucccauaugucugaauuucacgagacaaaaguuaagaauuccacuuuccuaccaaccaccugcucuucugaaaugccucuaucaucugcuaauguugccacuaauauaccuguuauuccuggaggguaucugcaaacacuguuagaugcuucugacuuaucaaauaauacuaguaucucauacuucaccaaccauucugcagagcaaaaugaaggcagccucacucaaacggaaaaagcauuuguaccucuccagucugcucaagacugugugcugucuucaucuucugauucucagcugcaacaaucaucucagaacuucaaaauggaagcaagcaacuuuggaaguuuguggcccgacaaggauacaucuggcucccaggaauucaugacugaagucucaagggagauagccacaaaccaaucuagugaauuugaagcuucccaaguugucuccauggagaauaaccucacagcuauaacauacaguccuguaugccucaauagugaugccagugguugcaacaagguucuguaugccucuuugcaggacucacaucucccaccugaagacuuguaucaauugugucacuuuaauaauggagagaucugcuuuccguuccagcagggcccacucaguacagaugaugauggccggcucuuuagcuuugauucgaugacuucccuuacuguuaguucaagcaauuauuguuccuuaagcuugaaauccugugaaaaggauggugaugaugaaaucaaugaugacuuucuggcccacugcagccccaaacuggugauccaacagagcauugaugaaauagcaccacuaaaggaguccacugaccuccuugacaucuccaacuucacuccugacaaguuccgacacucuucucucuuagaaaugucucccccagacacccccagucuuucuccucagaguaccagaugugagaguaucaaaacacuaggaacaaugaaaggauuccaagaaggugucccaggaucguugagcaccguggaaaaaaucaagugggacuguaauacccuuucacaacaggcccaagcagaugauggcuuuacauuaaauagccaucaguuucaguuccauauguucaaugaugaggacucuguuggccugcuccaaaaaagcccuugccugucaacauuugaugagccagcugggcaaauuaauaccaacagcaaagugucaaaaucaagaaagaaaacuucaccuggcaagaguggggcuguaagccaaaguucuucucagaaaaauuccaggaaaaaaucgccaaaagcaagcaacaaagggguugaaaagccaccuagcaaaaccucccgccagguuccuaaaucaacaaagaaagggaaauauguggcugcugucaauggagagaaaaugcaaauugggauuggccauagugggggccaacccaauaguacauccuccaaugcaaagacacugacugaauguauucagcauggugguccuguugccucuaugaagauaccaagucagaagggacuuucuggagauugggcuuugggaaaggaaagcaggccaggcuggaaugacaugaguguagucacuaauaccaacaaccuucuggaugaugaccaacgagaguuucaagagccuuccuauaucuuauccaauauugccucugguauggcagaugugcaaagauucaugauggccuccauggagccccuuugggaacccauggagcaccaaggggaguccaacacauucuacuccccugauuccaauagccuaaaauuaaaaacccucaaaauacuggcuggaacaccacaagaaucuaagaaaaagguuacuaaugggucuucaggagcuacuaagaaucacaggucagucaaagcugugagcaaaagcaacgggaaagcggcaauuggugagccuggucaugcagauaugccugguuccagugaggacucucgaucugccuucuuugauaaaaaguacaguaaugugaacacuuuaggcaauaauggaccaacacacaaaaaauuauaucgucacaaauccagcuccaagggccugcgagaugagaaauauaagggaaagcgcguggaacgagaacaggcccacaaggaugaggcuggaacaacuucuuuugaaaaacugagguaauacugcaccaaaauggcucagaugagaugcgcccuuggcuuuccuacuaccugcugagcccagaguuccuauuuuucccucuugaaagcgaaguuuugcaugagagacucuuucccauucuccucuuuuuuucaaauuaaaaagaaaagaaaaaaaugcauggaaaucccuguaccuuuaagccacccaaaauauugggcaauuuuauuguggcuuagcuagggauaaguucuaacaaaggcuacauuuuucuucuauucagcguuaauuuuugcuuauuaaggaaauagaacuaaaacaugcucuugaaugauuuuuggaauggaagggcuuugcaauaaagacagauucuggacaacauauucaaaaagucauguagacaaaaagccaagaucauuuaaacaaaagagcauuaguugucagcacaugacaauuaggagugcuuucucuaccuuucugcaucauacaacaucuaguaugguguuaauauauuuacaggguaugaucccuucgugggacauacacuaaaacuuacuaagauggcauaaauucuuugauuuuucugcagggauuccaacuacaaucuccuaaaagcagaaacagcauuugggguuuuaccuguguuugaagaagagacucacauuuuccagaaagacauuugauguuuguguuuucuuucuuucaaaauaagcuuugugguauguauguugaccuguaagugcuuacaagaaaagaauuuuaaaucgugggaauaagucuuugaaaucaaacuuuaaucugauguucuguguaaaagacuuuaaaagucauacaguugcacgaguaguuuaugcacuguuugcccacaaggaaaaaaauggaaaacuuugugccaaacuacaaauaaguaacuguauuguauauaguuuuacuucuauaucaacauuugguugugaguauuugggggacuugucccuguuaauuuacuagaaacauuccagugauucuugcuauuaaccacccccacuuuuguggauagcaccuauagaucacaguggaaaauauguuguguuauacaguuuaccaaaacaaaggauaauguuugaauugugccaaauuuucuuacuucaucucacagauucaccccacaguuuaaaacucauucaugauuauuaaauauauauauacauauacauccauacauucuuuuaauguuuuaaacucuacuauccuguguggaaauaugaacaguuaaacaaggcacaauaaagauguguuuguuccaucaucuaaggauuaaaauguuggaaaagcuuaggucacaacagcuaaguccaucagggacagaguauacacauuuacagaaccuugcacaaggaaaucaaacagcugcuuugaaaguugguuuuccaaagcaaaaucuguagcagaaaagaauuuaaagugcaaaguuauauugcugauacuuuauaucucaguuuuauauauuuuauaauagccugggauaaauuauaaaauaacuauaaaauugacacuaauaauaaauaaaauacauagauugcuuuuauuuaaguaguuuccuaaauguuuuauuccaguuaugucaaaagugcacucacaacauggcuuuaguguucuuuaaauguugaucuugcaaugccaaugucauuuuuuaaaaugacaucucagauugacagaauuuuucuuccuaugauuaaauacauauaccaccagguaaagcugaacaauauguggaaauaacuaauuuaggccaucuacauauagucugaggaugacuacucuuuugauaucacacacuaaacauaaaucucaauuuuuaauuaccuuuuaaauucauauuuuugguucaacccucccuuucacuacuuagaaacuucacaguucccacauuccucacuacuagccuuuucuuccccuuucuucaccacuugacuuauaccauuugaucucuuuuccuugcacaguuaaggccuaugugccuaaugacugaugcauuguggcacagaugagauaauggaugugaaagcgcuuuguagaucauaaagugcuauaccaauauaggggacuaauauuauuaauguuguugguuguuguuguuguuacuauucuuacuaauauuguuacuaaccuauuaacuugugaauauagaggcuggggugggagggaggaggauaagggggugggagaaggggacuuaauaaaacagggaagauguuucaaaagacauuuuugaauaaaauaugagcaaccuaccuagucauugacaccuaaauauauucacaaacagagaagcaauguuuucaaguagucagagagaaauggaagggagccuaucauguauauaaacauacacauuucccagcccaugauuccuuucaccagcuuacucuacuacuuacagcuagguaggaaaaugaacaagcccaugaucuagauuguguguguucucagcaucagucucuuuugucuguggggaugagugggugaggagaaaucugugaggagaguucaggcacauuccuaggcuuugacacuguguucaaugagcccuggaaaaugauuuagugggaaggcaccaacugaaacaagucucuugcccuacaaugaccauccaaaagagaaaauaaucaaacuagaacacuuucuuuuguuucuugguacucuaauagcuagcuguuuguauuaaaugugauggcuacuuccuaggaacuggucuuuguucaguuuugguuuuugucuuguuuugcagcugaccuuuugcuuagaaucaucaccucagccuguauugugauccccaagacuccagaccucaaacucaucuugcuugguuuuaggaauggagugcuuucuauguaaccaaaaaguggaaauuaaagaagaaauaaagaaaauguucuaugaguauaauguguuuuuauaaaaguaaauaugggagcaguugucccagauuuuuuuaaaguaucaugauguucagcuuuggagaaugggguaagacugggguaggauagcuugaaacuguuucuaacaguuucauugucagaacuugaucaucaguccuuuggaguggauacucuuucaguugcuccuauggagcccacuaggggccaauuuuagggcaugguucauaucuuucuccaaagagaacugccauuuuaaagcaccuuuuuaucggccugccaugcauuguauguucuuaacauauaaacuagugacuuguaaccagucauuuuguauugaaacauaacaagaaagugaauuugaggagugugcaauagaccaaggcagagauguuauuguacacuaugcucuacauuguugagcacuuugcauucuguugguccugccucugcucucagaauuauuuuccuuucugucacaacauaguaggccaaacuuacuggagaucucuuauucaaccagcugccuuaguggagugaggaccaauguaugaaaauaguguuuugcccuaucacugauuucuucaacucaaaaacccuggauuuuccuugaucugaaauuucugacuacccccuucuaaccucuccuuucugagaagcugcauccuauuaaugccuccucauuggagucucauuuaaucuuuacuuuccuggaaauuauauccucccuuguucuucuuucuugacuuuuaucagucuuagaauuuuucuucuuguguaguauucuauucaauaucccaaacugucaaaguuuaagaacuacagcuagaggcuuucuuuuggaaguuuagaggacuaccuucccugucuuauucacucaaaauacaaaugcacgagcacaugcacacauagcauugagaaaagacugaaacugcuuucucuugaaggugugugauaacagguccaaucucuuauuguggucaggugcuguacuacauggagcagagugcagauacaauggccccagccaagggucuucaagacauugaggguuguguugggacuagaguaaauagcuugaaccuguggccauccucuaugccucuccagugucucagaucucagcugcuucacauaugcugcucccucacagcuuucccuacugacuucuugcugcucugugcaauuauauguuaaggccuuaucuuuuccuauaucuuuucaaacuuucugcacuacuucauucaucacuucuuuagccaucucucugaaguccuuggugcuaggugggcuuuugugacaaaaauuuucaccuucucugacucuuuucuuugcugggaagaaucguugggggguagggaacacaaaggaggguauguguguguguaagagagaagcauaaaggaugcuucaaaugcuguaaucaacucccauccuguguuauuucacgugaggucuugcaguucuagugaauuuccauuuuaguggcuuugaaauaguguuuacugcguaaaggagaaaagcauauccaaggaccucuuugccuugcucuuaccaaacugaacuaguguuuuggagaucuacaauuuauagaugcacucagaacaguucugagaaaugaggagaguuagaguugaguuucuaugcugaagagguaaauggaacacuagcuaguccuagcuguugcuagaacuagaaauguuuguuuucuccuguuugacugaaagguugucaaauuauucauuuucauuuagggcuuuuaaugcugccagucauaacagaaauaucuccuuuuguaaaauaaaacuaaugcaaguuuuguuuuuuaaucauaaaauucucuaagccaauauuauguuuagaaggcuuaguaccaaaaucaaacauuuucaugacaaacagagaucuugucaacauaauguaggccagggauuuuauagagauuucucaaagacccgaguuaaggacagaaauuaguugagauguuuaguuugggaaacacuacuaccaucagcuuaagaguccucagccagcauggaguuauuuuggugacuaugcaggcuacccuuuaagacacaguuuucacucaacauuaaacaguagcuacagucaugaugcagagaucccauugcagcuauaugauacuugagguguacucuugguuugagaaucauagcuaaaugcuaaaacacuggggaaagacacuauaagagaguggcuuaguggaaaguuuuaaggaaugaaugaggcuuuuaaaaaucaguguuuggguaaaucaauacuaaauacacuaaagaaacacucacccauacaauaugaaaaggaugucuguguauccaacaagcucaggguucucugggcccacugaaaaugaagaaagguaaccaggcauggaggcucaugccuggaacccuaggcaggauuguugggaguuccagaccagucuggucuauagugugagacccagucugaaaaauaaaaauauaaaagaaagaaggaggaugaggaaggaaggaagaaaugaaugaaugaacaaaugaaagaaucaaggaaggaagggagggagggagggagggagggaggaaggagauacugaaaucauucugccucuuugagagaugccuaguuuuacagcacaaaagaaaaaggcuugaaugaaaacuaaaaggggccuuuuuguuuuucacucccagggagguggagagcuucagagucuccacugggauagcuguagcacugacuggaguuugcugccuacagaguuuugaauguacuuacuagacuuuaguuuccauagaacugaaugcaccucuucaguaagugaaaugcuuuauggugcuaaagaaaaugauuauccccauuuuucuucuucgccaagccccuuaagcauuuaagaaaauuuaaaguaaaagcauuuagagacccuuuuuaugaauguaaccuguuucuguuugacacaugacacugcaacuuuaaaguuaggaaauuauuugccuuuuucuuuuagaauuaagcuuuauaaauaaucuguagagucaauugaaguauaaagcuuaaggaucacucuuaagacgccuacaaaaucuuguauauuuuuaagugugccaauuuguaacauauuuuguaaguguauauuuuucuuagaaaagugcugugaagugucuguaugugagaguuuuccuuuuuucugcaccacuaugugcuaauaaaaggauauuuacuucaaaguuucugguuuuagaaaccacaauacaaagaaaaaacacuuuuguugggaauuuuguaacaaaaaauauguugugaaagaguguagugaucuugugcaaagaaaaugaacauuugugagcuucuugcuguuuuauagaauuucuuguaaauuauucuuguaacaccucugguuuuguuguucuuguugaaaaaaguuuuaaauauuugugacugaauguauggugaaacugucauaauguuaccuagcugaguuuuguuauuguuuauggaauaaauaaaagaaaaguuuaaaauac

SEQ ID NO: 9684 - RNA, 658 nt, Mus musculus
ggacaagaaaaauaucuccuuuacggaugggccgauaagcuuccaggaaguacggcuuaagguauaccucaaagagauugccagugaugccuuccacugugucaucgauggguagaacguggauacguuugccauacuuuacaucagggcauggcuggaugcugaugacaucuccuaggcgaacucggagguuauuccgaacaacucuauucauucgaaucuucucaucagaacacgugucaucagaaagaacaaugcauacagcuucccgucuuuucuuuccuuuuagcaacaccgugucaccucggaacaacugcaguucauccaucuugggcugggacaaggacaccacgcuguuaucuucauugauggcuucaucaacaauuaaccgauugggucgguucuucuguuugagaauggcuguugauaaaucaucaccuuuugaaucggcuccagaggccauggcgcgcgccucucccggucggcggcuguggcggccugaggguaacggcuaugagaaaggcaggcgaccgacuaggcccgggcuggacucgcugaggcggaggagcaacagcagugacaaacccucuggcagccucccucucgcuuccucccaggggcaccggggcggcaggcgggcgggcgggagacgcuagcu

SEQ ID NO: 9685 - RNA, 658 nt, Mus musculus
agcuagcgucucccgcccgcccgccugccgccccggugccccugggaggaagcgagagggaggcugccagaggguuugucacugcuguugcuccuccgccucagcgaguccagcccgggccuagucggucgccugccuuucucauagccguuacccucaggccgccacagccgccgaccgggagaggcgcgcgccauggccucuggagccgauucaaaaggugaugauuuaucaacagccauucucaaacagaagaaccgacccaaucgguuaauuguugaugaagccaucaaugaagauaacagcgugguguccuugucccagcccaagauggaugaacugcaguuguuccgaggugacacgguguugcuaaaaggaaagaaaagacgggaagcuguaugcauuguucuuucugaugacacguguucugaugagaagauucgaaugaauagaguuguucggaauaaccuccgaguucgccuaggagaugucaucagcauccagccaugcccugauguaaaguauggcaaacguauccacguucuacccaucgaugacacaguggaaggcaucacuggcaaucucuuugagguauaccuuaagccguacuuccuggaagcuuaucggcccauccguaaaggagauauuuuucuugucc

SEQ ID NO: 9686 - RNA, 978 nt, Mus musculus
ucaugacaucucucauuaguuuauaaugcuucuacagaauuaauucaagauuacuuaccugccuuguguaaaagguuugaaaaugagccugguguaguuaugccugcuuuuaauuccagcaauccagaggcaaggacagggggacauuggaauuugaggcuagccugguuugcauagcaaguuccaaguuccacaguagccaggccuuuauaaagagaagggagagagagagagagaaagagagagagugggagagagagagggagagagagagagagagagaaguguuuaaggagagauuuuugagaaugcauuaaugaaauuguaccuucuugacuccagguuuucaaguagcauuuauauuuggaaauuguuucccacccagauacuuguaaacauauuuccaugguauuugguuugauuauagugcugacaaaauaauacaaaugugucuuuaaauaugcaguuuacuauauaacauguucacuuaccauccaccuagcaguuuuuaaauaagggacucugaagaaaccaaagggaagagcuacaaggaggcaaauuaauggaaugaaauauguguguaccccgagagcuccuugucccaacagcaaaagaccaaaggcaaaucaggaaaauaaaagguuuuacaaugaaggcggcgacucucacuugugaagccuucuccaggggaaaacuugucuguacuuuaauccucaacguuaaugcacagggagaaugagaguuaugcagaguggagcauggcauugaguuggagacaagaaaggaaucgaauggcagacaagauaggguugucauauuuaccaaagcaacacuugggacauaauuaucccaaucauuuguuuuuuaucugaaauaacauuuaaguggguaauccuguauuuuaucuggcaacgcuaagagagaagaacaaugguagucugauggucugggcugugcaagaaaaagcccgagucacug

SEQ ID NO: 9687 - RNA, 5373 nt, Mus musculus
agaguauaucccggaauuuuauguugccauuuauguccucacuuaauuugcaggcccaagauguccgcuuaacuugucugcuaagccguuguauuccucaaggcuggcucauuuccccaagugggaauugagggaagguacuuaccaagcuguaacauggugacaaagacgcagggucuuuucaguaacugaaucuguaacaugagucuacagagacuaaaccaccgaugccugaugcugacccaagagagcucaaucagccuucuacaaaggaauugguguagauuuuucuaagaugugggggaaaguagaggcuuugcuuuucguggccaauaaggaaaucaaaacgguucuuugguuguuguuguuuuucaagguaggguuucucuguguuccucgggcuguccuggaacucacuguguagaccagguuggccuugaacucauagagauccaccugcuucugccucccaaguucugggauuaaaggcaugcagcacaacacaauaugcaauacgguucuuuuuaauuuaguuguuucuauuacuugcuuuugguuuggaacuuaguuauuuugcaugucuuaugacuauaccuguauuaaaguagagaauacauaaagucuuuuaaaauauauaagguuuguauguguucauauuuaagcuucugaaaggagaggaaacaauuuuagaaucaaucuuugcacuuuugaaaugugcuuauaaaacccagauuccuguuuuacauggauauugugguggcugggugauuacuugauuaauuacacucucauggcccugcagagagcugcuguggggcucuguugaaaaguauaagaaaaaguacauaggaauuucuuagaacugaagcugaaaaggucagugaagcucaagggaggaaagcaaccuggaggaaauugacuggacuuuaccuuaugguucuagccuacuaaacuucacuguacuguuguuguuguuguuguuucuuugaggcagagcuucucuguguaguccuggcuauccugaaacaugcucugaagaccaggcuggccuccaacucagagauccaccaaccucugccuuccaagugcuaagauuaaaugugugugccaccaugcccagcuacuuuguuuuugguugugagccuagccuucaauggcugagccaucucuccagcccuauuuuugaagacuauuauguaauaaaauuaaaauucaucaaacaguuccuuccauaguagaauguugccuucaaguucuuccugaaauuuuuuugagauagggucuccuggcuggcuuguaacacauagacaucauccugccucuugagugcugggauuaaaguugugcugaaaguuauauuuauauuugauauuagguguccuaagaaugaugugagugcaaauucagauauaacggaucuguugacauuguuauugcacugaaucaguagaaaagacaauggaugcucacuaacaugggugugguaggaggauuucaacuuugaggcuaguguaaguaacugagucagaucuugucucaaaaauuuuguuuugcccacuaaccuaagaauugcugugacucaauugaauuggugcuugucuuggcugcaguauuaucuuugaauaugagauaauuucaaacuccacuguagggauaaaaccauauuuuaagcaaacucuuuuuuaaauuuugaaucaugucuucguacauaggcuagcuuugaacuugcuguguagucaacucugaucuugaacuccuguucucacugccuccacugacuucugguaugaaaggcuuaccaccagcaugccaauuuaaaacaaauuauuuuucuaccauuagccauuuagauucaaaugucuguugcuuuucagcaauaaaugugauuaaaaguuaacuacauuugauucucacauggaagcuuaguauaaacaguaggaauuauucaauaaggucauauucccuucugauguuuguacccuacaacuccugcagauauaacucuggucucugaauuuuggaaugcuuuagcaaacaaauucguacuugcagggcuaaucacuugcaggacucuauuuucuaaagucaacauaagauuaacagacuauuaaaaguaagauugacuuuagugacaugaacuucagagcaguauaaauugugcagguucuuuauugaaaaauagaagcuagagcaaaaugaugugcaaauaacacaaagcugugauucucaaaguauggcauacaucauaauuauucccaaugaugugcuacagauugcugaaccccaaauuuacagugucugauuuaaugucuugauuuccaacauugauucuuuuuauaauguaggccuuugaugauauaaaacuuuccauaaggauuuagcugauuuuugauauguuuccauuuugauuuucuuuuauauuucuucaacccagggucauuuagaagcaucaaccaacugcaaauauucacaccauuuuccauauuucucuuuacuauuguuuccuaauuuaacuccauggaggucagagaauaugauugucaugauuugaauucuuucaauuugugagauuuuuuagacaaaggcucuuguccauaaacuauuguuaugugguaagccuccuuccuaccacuuguucuacugauuauuaggagaaggauauugaaaacucagauuaaaaguguuguauuuauuucuucuuucaauucuaugaagguuuugcuuuguguauuuugaagcacucuuguuagguguauacgcuguuaggguggcuguagucucuugaugauaugaccuguuaauacucuuugugcugaaaucccagauuucuuuugagucgauuuacuuuuaacaugguuauguuuuaaugugaauuuauuauagucagguuuggagcugugucuugcuuuuuuugauccuuuuuuuuaauuagauauuuucuucauuuacauuucaaaugcuaucccaaaagucccccauacccucccccccccacuccccuacccacccacucccacuucuuggcccuggaguuccccuguacugggguauauaaaguuugcaauaccaaggggccucucuucccauugaugugucuugcuuguuaaaaaauccauuuugacagugucagcuuuuuguugcaguguuuagauaauuuuugugucauguaauuauugacaugauugguuuuagaucuaccauauggcuauuuccuucuauauuuacuuuuuuuucauuuucaucuuuuugauuauuauuuaugauucuauuuuaugucuucaugauguuugugucagcucuuuccacugaauccuccaggaucuuggcccaaacucuuucucucucucuauuauauagcucuagcuguccugaaauuuacuguguagacuaggcugcccuugaacuuguagugccaggacuaaaggcauguaccaccaacuuggccagccuagucucccuuaaaggaagacuucuguauuuuucugagcauuuacauuuaauauagcaguuguacaacagacaaauuauagaaauaauagcaugaguauaucugacguuuggaggauucuaugcaaaauauagacuugaagcaguuaaucauuuauaaagccauuauauacaucucaaauauuuuauauuaaucugauuauuuucccuuugucuaccauuauuugaccauuaugacaagcucauaugggacugauuaucauauuaauuuguuaacuucaucuagcuucucauaucagucauuuuccuuugauaucacaucucaaagaagcguaaauaaaguugcucaauacauauaauuaucagugcauuauuugaccuguuuaauauacuugaauuuuaccagcauuucuaaccuuccaccauaucacacaaauacugcaugguuaguuuauucuacaggucacucagauaaccauuauacuuugcccccauauaauuggcucuugaccaagugccagauauuguuuagggaaaggugauguuauaguugagcaagauuuguuuauuuccagguuucaaaucaauauuuuaguuuauucgagcuguuguaaaaauaccaguguagguguuuuguuuuguuuuguuuuguuguuucucuguguaacaguccuggcuguuguggaacuaguuuaguagaccaggcuguccucaaacuuagagagaucugccugccucuaccuccugggugcugggauuaaggacauagaccaccacuccuggcaggacugguucuuauggcaaaucuaagcauguaguuuagaauuauuucuacgucugcuguaaaaucaaguacaacuuccuuugcucuguucuuggcaugagggcaggcagugcauauuaguguaagcugguuuugccuucagagaauuugaaguuuggaggcugaguuuggagguuuaaaggaauucugcaaguguugaugugccauugucuaucucgaagggcuauugauucauaucuggggcaggcuccaacuguuuuaaauugguuuaaagacccuauuuguucauggcuuugcccgacugugaguacuaacacucuccagcuuuauucaaggaaucugccugucccagguugcuaaagccuuaccaggcugauuccugucuucuggaagagugaucuuucuacugauuuaaucuacuuaaauuaccauuuucuucugaaugucauucauuaaaaggaaaucucuuuugcucuagcagucacacuacugaguauguaagcagagagaaugaaauuaccaugcugaagagacaucugcacuccugaguucauugaagcaguauuuucauuaauuaaaaacuagaaacagccaaaguguacaucacaugauaaauguauaaagagaggauggugcauuuauaugauagguuacuacucugccauacaaaggaaugaaauccugucuuuugugacacaaucagauguaacuggagauuauguuaagugagugaaacaagccagucacagauuacaccauaugauuucugcucauguagaauccagugaaaaaugaucucauacaaguuguuaccaaaagcugugggggagaugcccaaaugggaaaagguugaacaagggucacuaaguuacaguuacuuagaagaaaguucugcugugcuauuacauacuugugugucuguagaucaucauuaauguacuauacaugaaaauuagaagaaaauauuuuguuaaguuuuuacuaugaagaagugauaaugaggaaagagauaaacaugauuuaaauauuauacaauauguacauguacugaaauauaugauaucucauuaauauguacaaaguuucuuuuuauggcucacuuaaaauaaauuaaaauaaauuaaaaauaauaacugacuuua

SEQ ID NO: 9688 - RNA, 43188 nt, Mus musculus
cggagggugagagagcgcaugggcgauggacaacgcuuccccagagaccugaggagaaaaaaaaaagcggagcugaaugagcgauucuuugacuccuugggccgcucaccaccccaucuccacuuagguauuuaaccaacuccagaguaguaucucaccggcucuucgcuuucgccggcagcauccaugucgccgcuagguaagugcggcuuucucgucccggaagugaccuguugcgcgcgcugcuuucacaguuaacugaaagcaauagggcggaaacagagaccaguuucuccgucugcgccugcgugcgcccucccucugcagaggaagcgguggcuccgccuuauccgggccacgcaggcgccagcgaacgcguguuguuaccuagcaacacuguuccucuagccuaggugauagaauauucaauaaaucaauggggaaaauaaguuauaugaaaaaaaaaacauuuuuaaacgaugcuguuauuaaaucccuugugugccguguuuccaguucacgcgcgcgcaaacacacacacacacacauacgcccgccuuaaccacuuacaagcaagguucuagaagcaggacgguggaauucugggaugaagaagaagaauuugcuaccuguuuuggaagaacuagcagagugagguaacaacgaggugugcuucauuauacacugugggagcauaccugagcugagucaugaugggugcuuaaccaagcaggucagaaagacucaagacagagggaacgugcaugggcagagguauuagugaaaaggcauuagaauaucuugcaaagaacaaucuagcuggaacagauugcagucaagagcuuuguacggugaauuuuaaugagaugagaauuaaaaaaaaaaaaaaaaaaaaaccacaagucaagggguuuuuguuuuuguuuuggauuggcauuuguuuguuugagacuucuccacucucauuuccacagaagcuguucgaguuuggaaucucaccaaaagugaacaagaauucccauucccacauccucaccaaaauuucuuaucaguuguuuucuugaccuuaaucuuucuaaauugggguaacaugaaccucagaguuguuuuaauuggcauuucccuaauugcuauagaugcuaaaguuuuaacgauaauccuuagccaauuuuucaucucuuuuuugguuuguuuuuguuuuuugcguuuuuuuguuuuuguuuuuugggguuuuuuguuuguuuguuuuuuuguuuguuuuguuuuguuuuucugagaauucucuauucagaucuggagcugcccccucccuccagccauuuuaaacuggauccuuggcuuucuggaauccuuuuuuuuuuuuuuuuuuuuuccuuccuauauucuggauaguuuaucagaugaguagcugccaaauauucucucccacuaugggcuuccucucuauuagcuuauuguuccauuuucuguacacaaguauuuuaguuuuaugaggucuucuuuguuaauuguuugccuuaauucauaauugaauggagucccgcucaaaagucucuugcuacaccuauauguuguagggcuucacccaucuauucuuauagcaguuccagcuuuacagguuucacauugaucuauuugauccauuucaaguugauucuaguucaggguaaugcauucagaaugcuguaaaacuacaugcauucauguuuggacuucuauuuuguucuguugauuuccuagucuguuuuggugccguuacuguaguuuuuuauuauuauuauuauuguagugcugaaaucuuaccaaauuguauaacuaaaacuauacuauuccuugacaucuauccaaagggcacaguguccuguuuuacagauacuugcucagccacauucaucacugcucuguucauaacaguuggaaauuggaaacaaccuaaaugcuuucucucucugauuuguggauucuagaucugaaucuuaagaggugaguguagaaccugaaguuaacacagaaaccaugaagguuaaaggagagaauggggaagggguaaaaugagcuauaaagcaaggugaagagaacgaauugggcaauuagaaaacugaagaggcuuuaucuagcaggagggagggcaauccagaugaaaagggagggaagggggauaaagagaacuaaaagucauugaaaaagccacagccauuacagaaacauuauuuuagguuugcuuaaaauaaauauguaauauaauuaauauauguaaaugaaaauguaaugaaguuacagcaaguguagugacaaugcucccuccaauccagacugcuuaacaaaaaucucuggugucagauauugggacacuucccuucaaguuguugcucaggggaguucaagggacuccccaaacaauaaaaagauguggaagguuauaacuugaagacaaaauuagaagcagaccagcuugaaggggguagaugauacaacacugacaguugcagaaugaauaaugcccucuagaacaauuugauauggaguauaaaggagaauuaggguccuagugugaaccacaggcuuuccagcaaaacugggaggagggugcuguuacugacuuagaagacacaggaggaaagcugagugccauuugaggagcuuaguuggaauaucuuuuuuuuguuuguuuuuuuguuuuuuugagacaggguuugucuguacagcccugucuguccuggaacucacuuuguagaccaggcuggccuugaacucgacaauuggccugccucugccucccgaguacugggauuaaaggcgugugccaccacgcccggcugaguuggaauauuuuacuggacucauagaaucgauauggcagagagagaccugagcagagauauauauuugauagcaggcacuguguaauugugcuuugcaugaggaaaaugguaagacuguaaaggcucaaaaagacacaagccaaggacaucaucaacuaugaagaggcaggaaaacagacuaaauauuaaaagaguuguaacugagauaacagcaaaggauaaagagaguuucacaaaagccaaaggauccgaaaauuucuagaaauaaguggugaacaaaguccgauacucugaguauacugaggccagaaaugcugagagauaauugaaaccagaugggcaugggguaaagagggcauaggggacagagauggcaguauauagagaaaguucugaaaagucaaauauaggaggagcuaucagguuuaagaccucugaauugugauaaaggacaaaaaaaaaccuuaaaauuguauuauuuaucuauuuauagguaaacaauucaacaguguuacauauucacuuauucaugcuuuucuacugcaacucucuaacaauguuuuauguugcaaaacuaaaacuccauguuuaguaaacaauacauucccauuuccuuuucuuccaagcucuugaaagcaccauuugguuucucugaauuuggcuauguuagacacuggugcaguuuucuguuuugugacuagcuuauuuugcuugaccuaaugacuuauaggauuucuuucuacuuuagagcagaacagcauucuaugguauauagauagcauaucuuauuuauggagggagaagcacuuuuauugcuuuuaacuuuugaaaaauugugaauaaugcuguugaaaguaugaguauguaaauaucacuuucaaauucugccuuuaguuauauuucuggauaguaccuuugauaguguaguuaauggauuuuuuuuuaaguuuuucacuuauuugcagagccucugggacuuuuaaaguuauuccuugagguuuggaaagacuucuauuuuuagaacuuagccucaugcagaagacuuuugguugggggagggggaccuagguaaccuacacagcaacaggcagcagaaguagggaguugagguguugccuucaggugccacuuguucucugguacaaaauaccaggggacagcugagcgaaagagauguacugaaguacaucuugggaaaacugccuuaugacuguugaauagccauucacaaaaauggaagaaccaauuuaagaagcagauggaagguuugcaaggaacagcuaacacaagagaauaugauccuguuucuguguuccccagugaucagaauauaggauggauuguccauguggauguuggauguuagcaaaugcucaauacacaagaauaacauaaaggggcagacugaagcugauaacccaauugcuacauuacaaguaaacaugaguaaacucaagagacucaacaagccuuuuauuucaggaagcaaccaagguaauuugcuucguuuaauguuuuaggcagacauguugcuuuaaauguuuuaauuaaaauauauaauaauugaauagcauauuagaguuacuuuuaauauuuuaaaauaaaggaacuguuuauuacucaacuuuuugcagacagauauuuguguugaauaguaauuagauccuaacuguccgauaaguuuacuucuucuaaccuauaauuguaggagaugaagcuaucaccuagaguuuggcuuuuguuugugucuguuugcuucuuuuuuuuuuuuuccucaccaguaagucgggaaacuagaccagguagguuuauuauaauaauuauuuuccuuaugccuauuggucagcuguucaaagauuggagagaagaaaggugcagaaguaaauggcacuuuaugaagauucaguggacuucagggaagacauuaugaugaccuaauagcagaaaacaguuguuaaaaucuaauguuaacuacuggugcuuauuuuucugucuguguucuucauucaugagguguauugacugcccaacccaugaaaaaugaaaaagaaaauguucucccacggaaagaagguuuuuguuuuguuuuguuuuguuuuguuuuguuuuguuuuguuuguggaauaaagguugaagccaaagagauugguacucaaauuauauuuaauagucuuuguuuuugcaagaguaacucugauacuuugccauuauuuuguuuuguuuuguuuuuaucaucaugccucuuaucauuuacuuauuuggggaagauuuuguggguugccauaguuugcuuuggacuuuuaguaaucugagcaaguuucuuagucucuucaguuggcaccaaauaucuggagugacaaagcaaugguaagacaugcuaguaggugguuuuuuagaauuguucuaaaaucugcuauuuucuuuucuucuuuuuuuuuuuuuuuuagcguccauucucuuuuauuuuuuuuucuuuuuccauuuuuuauuagguauuuagcucuuuuacauuuccaaugcuauaccaaaagucccccauauccacccacccccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccugugauccauccauuagcugacugugagcauccacuucuguguuugcuaggccccggcauagucucacaagagacagcuacaucuggguccuuucaauaaaaucuuucuaguguaugcaauggugucagcguuuggaugcugauuaaaucugcuauuuucaaaugugugauugaaaaauuauauccuuggaaaauuuccaaaacauuagaaaugauucucacuucauaaugagaauauguauuauaagugaggcaguuuauuuuuugaccuuggaaaguaagacaucagccuagaauggcaggcacacacaguguagagagcuguuuauacagccuaaaacauggcucuguuccucuccucuuugaaaguuuucuauuguaaaguuuuuuuuggauuaguggggguagcuaaguagaguuuggguaggaaaaauagcuagacuaguaggaauuagcaguccuaauguuuucugucacuuuauacguacacaugagauagcucaagguaccuuagaaaaguuaucaaucagauucuauuucugacaagaagaauguuauuaaacaaugugcuaauauccugacucaaauuucagcuaacuucccaauauuucuaucaaugauaacaaagaaaucaaauuguaucuuggaaaaaaaaaucuguuaauuuguuuccucaaccauuaggaaagucagugucgaaagaaucccagcaucccagcuacaagagauauugugaggucuuucucacagaugcaugcaggaaauagaugcuaaagcaggucucuuauagccugauuguucuagugaagagaugugacagguauuuagcuagagauaaaaacauggcaccaugugaaaauuugaagccuuguaaauagaaaagcaaauauuaccauuguauuuucucaaugcauugaugccugucuuagucaggguuucuauuccugcacaaacaucaugaccaagaaacaguuggggaggaguuuauucagcuuacacuuccacauugcuguucaucaccaaggaagucaggacuggaacucaagcaggucugaaagcaggagcugaugcagaagccauggagggauguuccuuacuggcuugguuccccuggcuugcucagccuacucucuuauagaaccaagacuaucagcccagagauggcaccacccacaaggggacuugaucacuaauugagcaaaugccuugcagcuggaucuuguggagguauuuccccaacugaagcuccuuuuucugugauaacuccagccggugucaaguugacacaaaacuagccaguacaaugccauaguggaaugcucugucacgccuuuuccgaccacagauagcuuuguuugguuguuucuucucccugguugugggaacacguuuuaaggcuaaucauuuuuacuuaguccaauugccgacaacuccauaauaaucaugccccaaagaaugucuacauggcaggcgugcuguuugauucaugcugaacaaucaaugaccuuauuucguuuucccuaauuuauacuggauaagguuucaaacuuuucuguauaaacugaauuucccauuacuuuuugaaaacuuauaaggauuuuuguuauuguauauguauauauaugaauuuucauguagauguauuugccuguggaagccagaauaaggcauuagauacuauggagcugaaguuauaagcagccuucagcugccagauauagggauaaucucuugugcacuguguaaaaacauucaccugucaauaaagagcugaauggccaauagcaaaucaggagaguugcaagccaguggaggaagaagaaaguugggacuaaaggggagguuccuaaggagucacaugguaggucauaggccaggccaguauuguuggguagaauagcugagaaucugcccagcuuuagugcuaaagcuuauaguaaauguaagucuccugaauaaaugucuuuauucagaucugggucaggcacagaaaguuuguacaguuauagccauaggugcuggaaaccccaaauaacuauuaaccguugagccaugucuccagucccacuuuuugaauugaauaucauguacuauaauguaauuaccaaacauguuccaugcuggacaauaacgaggcuuaugugauuauugcuuucagaguuuaguuuauaggcacucauuuacguuuguucauucuguuucucagaauuucuaaauguuuguuuauuggcugucucaggguuucuauugacaugguaaaacaccaggaccaaagcaacucagacaggaaagggcucauucccuuuauauuuaugucuacaucauaguccauuacugaagaaaguuagagcaggaacuacaggugggaacggaagccaaagcaaauccagcucacaggcuggcuccccuaggcuugcucagucugcuuucuuaugccaccaaggaccacaugcccagggggugguuaauaaauaaaucaauaucaaucaagaaaaugcccuacagaauugcugcuaggccaaauuaacaaaggcauauucucaguugagaguccuuguucccaggugacuguugcuuuugucaaguuuacauaauccuaaccaggacauuggccacuugauguguugucucuuaacuuugugucauaguccagaaucccacuuccauccugccuuauugccaucaagagcugcugcaauuuucccagugugugaagugaaaguuuccugcugaaagaguauucuucuaagcuuccuaucuggacaucucugccccuacaaggggcccauagaaccauuuccccuuguaggcauuuucaccauugcucaugugggugacaagaugcucccuccugugacuaaacaugguccugccuaaggucaaaccaaaccucucuuucuuuccaccuucugucucucuucagaugccuuuuaauaaucuaccaugaaguaagaaaauuaauuccaagaggccaaacaagaacuccagcuacuguguuuuugcacccagugaacagauuugcuuuucaggaaggaaaaacuagagaacaucaaauacuuuuaauuccaacacgugauaaauuaaguugauuccuaauuaugcuauuuuaaaauagucuuguacauauaaaauuauguauguuauauauaauuuuauauaugcacacacacauacucacuuguaaaaugggaacaaaacuauccaacuuguaguuauucuauacaaguucaugcaguguggagcaccagcuaacauaguuuuauguucaauuuauggcaguuagcuacaacaguauuaauauuuuggucacagaacuuaaucaguaaggcuuggaggcaugggcuuuagaaguuuugauggagaacccuuguaaacaagauuaggcgauuuuuauuaaaaggcauggcaugggagugaauuccuugacaucucuuccaucuuguaaugaaacaguuccucuggaauagcaagcaacaaggcucaaagcacugaggucauaaccauuucguuccuuuguuuuauaauuaccaaccucuaaaaugugaaaaguuaauuuauaaugguuagaaaguaugcagucucauauuauuaauagaagcacaaacuaaacuuccaugcuuuuauuuaccauuauaagcugcuguauuuuuaaaaaaaaauaaaaauaaaaauuguacucuaugggagauauugcuguccuaaccaaaaaaaaaacaaaaaaaaaaaacaaaaaaacaaaaaaacaaaugcauauccgagaaaguauacaguaagccaguaucaaaauaaagaaauaguaaucaaagaaacacauuaaaaauauuuuuuuccagucauuagauuggcuuagaaucaggaaaaccuggggcuauaaaaugccagagaagauccaaauuucuguaaggaaguaguuuuuugacugagguguuguuuuuucuaaacacaaagggcgggggaagagcgggucugagcgcaucagugaaaucaugcugccaucaagcggcuauuuuuauaaaguaaaaaacaaaguccgggaguguguuuucuuuaugcacgacuuuggcuguuuguucuggaagagaccagugaagguacaaagagacaaaauguaaaaggaaggcuaaagccgacugaccaggaugccccaccguuuagcuccggagauugccccggaagugaauucgcaauugauugacaccuaguuucuucaaauuagagucuggaaaccauggcagcagcaggaaguuccggcuguuuuaaagucgcgguuccgguguucaggaugccagggaugaugggaagccuguucuuguuuaucgguuuguacggaacuucacccgcgguagaguacggccugagaauuuuguuccagcaccggugugagguggcugccuuuaucgauggaaaugaaacccggggcuggggcugggggaugaggggggagcgggggagaccuuagucucccgaccuuagcacaaaaaggaacagucccuguccuauuugcacaugugcacugggcuguacugaauuacccagucugcuguguuuucugggccagaaagauguuuggcgggaaguuuguuucgucagggcugggguuggcucgggggcgguugcgggggacgggagggggcgggcaucuagcacuggaauucuaagggcauaaauccacacaccugucuagacauccauccauccuuucauucaggaaaacaucugagcccaugaauugccagacccuggauaccugagacacauccacuugcuucucagguacuguuuauucuaguaucuggagccagacuauaaauaaaugguugacuuaauuucagauaaacaugaguaauagaaaguaaaacaggccaagcuauacagcagggaguacccuuauuuuaacuaaguggucagaccuuacuuccuuuagaaaugaugauugaggacaucaggaaugguggcaauuaaugacuuugaaaagacuucagguacagaugauuacugcaucauuucuaguaguucuagaaaguuggacuagagggguucaguggauccagaagugccagcucuagaucuuggacaacagugugugcauguuagggcuuugagcauuccaguuaaaggcuuccucugacuuagucccagcguccugaggguggggaugccugauucccuuccauuuucucuucugcuuucccaccgugucuucauucucucuggguccugggaucucauccuuucagauuggacaucugugggcuucccuuugcuaugacguaagugugguacaagcggagcuccagugcuauccgugaauacuaguagaguucuaauucugguuaagaguuugggauggggccuugcugcacuguaacugugaagguguuuuauaaagaaucuugugaugauucagcauugugaaauagugacaacagcaugguaaauugaaucaaauaaacccagacauauuguuugugggcaaaauuagaacccuuccaguuaucccagguacaguucaugcuugucuuguuggucccuuccuauucuguaucaccuuccucuucucucacuucccucuucucuccaucucuucccucccagucugggucccgucguccccccacccccgcccucucucccucacuuuuauaggguuuccuguaguuuagguugacuucaaccuugaauuuucuauccuucucccauguccugagacuauagguguaugcuagcaucaccuuuggccuguuucucucucuagguuuggagugcauaaugaggagaaauaaaaacagaaagaucuccagaaagaagccaugguaagauucaagguuucacaguccaagcuaaugccuguggacacuugaccaagugaucugagaaaauuggauuucuggcaaaacaaguguaccuagacucaggcaagguaaguguccagguaggcagggaaacaugagcugcgguugcaggggggaguugagaaugguaaauggauuggcacauugcuguaauguaaggacaguguggacauuuuucugcauuuccugcuuaaagacacuuuacuacuugacuucaguuggaauauuaagggcaccccagcaagcuguuugugucgcagacaauggcauuuuuuugucccauuguguuggauggcagcuuguaguuggcuaggaugcaguucuuucuguagucagcaccuuccucuuuuccagauacaggcuguagaguaauuugucuucuuuguuguaaauacuaagauuuaggacuauauuuugcauauaauguagguacauuuuuuugaggacagacauuucuuauaguugggaaaagcugcuuagaggaaguaagaugucaugccacgguguguuuugagccauaaucauuacugacugcuugcauccauuuguaauuuagcaaacacuaaccccugcuaagggcuuccuccguauucccacauucaaaugaccuggacagacugauagcugaacuccuuaaauauaagaaaccaaagcaguuuaacaacaaagaaauacagcauggucucaguccagcuucaucucuaacccaauguuucuacaagcagaauuccagaccaacaacaccauaagccuagacucauuacaucaaaacuggguuucuggcccagccacuguuuuauguacuuuucaguugauucugacauguaauuaaauuugcaaaccacuaaccaguaucccagcucuucacuaaccaguaaaucugcacuuuccagaggcuuugaugcacuuacauaucacaugcauagucugagucauaggcugguccauggaccauacuguaggccuugugcuguguuggacccuagcuuucuuaggugagcaugguuauugaugaugggaaggauuagccucuaaaguccugacuucuaaaagcagacaggcuauaggauucuuaguuauccacacugucugugcaugugugugugcgcguguuauuauguauacuauaauaugcuauagagagaaauucaggaugcaggcgaagggaaguagaagaaaccaucagacaugaaugaggcuggagauaacugcaaggauucuaauuugggccaguggguagaaauuguuccuaggcuuuauucaggaaauacugggcccuggugaaaaaaagaggcaaugagcagucugagaacuggcucccugagugagaugacgugcuuauaugccagcaaucaccucaaauaacuuaaaauguguauggggggggggggauauguuggaauuaucaugcuguaaaugaagaucuuauuaccaaacugguaauaaauaagucugguaugccucucccuauguguguauaggggguaguauccaaguaguuucuguuuggaaugcuguuuguucucagcuguuaaagugaacuaacaugaaaggguacacuuccuuguuuucuaguaagugacuugguguguauuuguuauauauaugacaaaugaggacaaggcgaaaacagauugugcuugauuuguggcaggguggagaacagagggcgacuagauuaaauggaaagaaugcccaggcaucccauugccucccuuugacguuccagaacuucaucaagacagugaugagcuacauguacaccuggaggagguaggugacuuacaggauauccuuguugugggcuaggcaguauaugagcauaagaugcuccuugaagacccaacucuccugaccaaagugcuucgaugagucacuucauagauccugguacuugauggcuucuguagagcaugaagggcaaguaguguccaaaaauauaguucuuguagcuaccaccaugcuguagccuaccaacucucagguauuguaauuguccuuauugagaucuaacgacuaccauggaucucuugcuuugugacauauugauaagaaugguagcuaagaagcaggacaaucuauggaggucaauagggaaggaccauguguaaaggaacuuuaauccagcagcagcuggauuaaacagcucuggcaagggacuauacaccuuuaauucaucuggcuggaauccagacauaccuuuaguacauaccuucauucccaaaccaugaaaguaaaguuaguuuauaguaggaaacaucgacauuugaaaaugacaucuaacuggaggacaguucagucaguuugaugcaguucaguugagugaguguagaggcagugcuuugaguuuguucaugaguuccugcaggagcaauucaaggcaaagaauaaaaaggagucagaagauuagaacagauugccagcauuaguuuaaggcugcacagaggaauucagugagaagcugagagaagccagauuuaaucaaucagcuuggaaaggaguuugagccagaacagcugaauugaaccaggcagccagaguucagaaagagcuagugugagcuuauucaucaguaagccuccaggacagcacuaacaucaggcgaauaaaguuucuuuaccaauugugcagcaaucuacuuuaguucauaucaguguggacugaaccauccacaugucuuccuucggaugucaggaacuguaaagggagggcccaggauuguugugggcccaaccugccucccaaaugaacuuugguuaaagagaagucgagcauaucugcucagugguagaaugaaagaagauaacugccuagagcacaacagaguagaggaaaacaguggaaucacugugauccaaacauugguggggaaagcuccccuuccauauacgaaggcgccuggcuuuuguguauguuaauggaggaggcacuguuacagucuuuguacagccacaaguuugaauuccuuaggaccuuaaauagugaaucaaauuguccuaucucccuccuaaaguuuucauuuguuuaauacucuguguguggaguuuagggacaggaagucuuuugcugucaugaaacuuacaagaaaagcauugugaaggugaaccuucaucuggaagaaucuauacauaccuauguguauguagguacauagauguguguacugcaaagagauuguuuuuuuuuuccuuaaauacauuuuagaaagcauuuugguuuaagcauguuaacuccaaguauuggauuuacuugggcuagcaauagagacuucuuuccuuuucuugaaguagcauggcuuuuaguuccuaauagcaucagaaugaagacugaaacauuucauaggaccuguagguauccauauggcaguuuggacuaaguaggccaguuagcgagucccuauuugaagauuaugaacgguaguaagucuuacugguuucacuuuugcucugagugacauuucuggaagcuuucucauguuuauaagccccaagucuuaguggguuaugcccaguaggccuguucggggcucuucagcaugaccaaaaggggaaccauaaaggggaacuuacugcuuccucacauugauacaugccucuuuguuuagcaacaucuaacccgcauucagggguagaaagacaacaaaagcacagguuuugaaugaguugcauagccugagaacaucuucuuagguuuucauccauaucuucaagcuauucacucucugucaugcuucugucccuucccacauuacuaucucacggaugguguuauuucuucaaaugucuuacauuauguccauccuggucauaauuugaauuaagucacuucugaagacccaugcauugacuacuuuguguucugcucugccgcuacugggaggcuuugaggguggaacuauuaggaugguuaggcuaagaagaaggaugguaugccauguuggacaugccuuugaaagugauagugacuuccugcuucuugacuaccgugggugaaacaggccuccuggccauguacgccugccaugucacuauaaagccaaaucaacagggucaggacgagcucuuccuccuuugugguuauuuaucuuacguauuucccacagaaagcggacgaaugagccucucccuucucuucgcugauucauugcauaagacucugcccaggcuucaaauugaacuuguauagcuuucauauaaacggucauauucacaauucuccggggcagguaacagcaacuacuguucuuuuaaucauucaugucacaggcugagaaugacuuugcuuuuuucuuccccccucauuuuucaucuuucaaaaaaucuugugaguucugucaaauaguuguggcguuagaugagugacuucacugccaagccaccaucagugucuggguuauaagaauuguuuccuaauucuuucccugcuuuguccuucucuuauccacacugaugaccuagaauuuggaguacuuaguacuucuauuaaacaccuaugcugccagcaugcauagguguuuggguucaaucccuagaacuuugagaaaaaacaaacauagagugaaagcuaaugauugccucugccuugacuuaaaaacaacagggccccuuacaugugucucuaagucugucuaugauuuuuggguacugauguauuagaauagcaggucgcaucucagcagcacacuaggccaaagcaguuccaugugggagagguuuuauuggaagggagagacaagguaguggcagaaagagaagagggggagagacagugaggaaggggcauucuccuuauuuauauggaaaaugauguaacacagguaaaggugggaggugagccaagugaaugcugggaauauggugccuguugucuuggcaaccggucugcagguugcacuguugccuaugagaugucauagguuugggauguccugaugccaacauaccucccuuguuauuauaaagaaaaggaaagaaaaaugggagggggacaccgauggugaaaagggaacgacggcguugugucucuuacgcuaaucccugcugucuaggggcgucacucauuuuggaguguagcuggcuuucaccuucaggguccacuugguaaacguugacaucagcuuccucuguggacaacggcucuucugugggcagcggcugguaauccuguaacaggagcugauuugguuagaaauuuuuuguauuugucauugaaggaauguagaaacaagauuaauaaggcaaggagcaaauaauaacgccaggaagaugacuagaaaagguguuacaaaagggaguauccacuucgauauaugauuuucgaaaaucccaaaacuguaggucucauggucucugaaguucuugaugucugacuguggcuccuggauuuuauuucucacuaucccagauugguugauguagaaacagcacucuucuuggaagaacaggcaaagaccaccuucuuuagcugucaggacauccagcccccgucgguucuaaagcaccauggcugccaaugaaucgaucugcuucuggauaauaagcacaguuuuagucauuucuugaagauugcuuuuaaacugggaagugaauguauuauauugggucauagaaguuguuaccccugcaguuccaauaccagcaccuauggcuauucccguagcgaccaagaguggcaugaccugaacugcccucucauguugaacagcuaucaauaucuacaacugggauuggcaggggcucauucccuuggauuacucccaaugcagggaaaaggaguaccaacgugcaaacuucugaccagcuggccgguaggcgaugauaggccugagugcuacaaagaauugacauguuccagacugcagagcauuguggcagagaugauauaucaaggguuaugguccuauuucagucuagggagcuuaguguuccuauaaaacgaguccuggaggucuuacaacaguuugucacuccaaagagagggauagagguaagguauggagucauggcaacaucagagucagggcagcuaacagagguaagguuacuuggcaguaucacuggagaggcugugacaauugugaguuaauuccagaggguacgcgcaaccagccaucuuuaaagcaaccaggucuggugacauuaaggaguugguaggccgaggucaaggucugaagcaaaaagcgaaauggcaaguuagugccauauaugaggguugaugucaaagagguaaggacucagaggaguguuugguugucucuccugcuuuuucuguauccugggguugggcgauugagacuuauuuucucuggauauggaugguacuuauuggggaccugggcugauuuuuacgguagaguuuaccaacagcuccuguuucccaccuggaaucccaugagucuuguuuguagaaaaagagugucugagguguuguuagaagaaaugauucgucugugauccuagcauauauaucugaaaagaccaauaugggcagcccccauauucaucuggccauuuucuacaauuaucuuuugucuggucaaagagaaagcaaguauagagaucauaauauuuagaugggauagcagauacagggaugauagcaauuuggaucgguuccuggcaucuggcuauggagaaguuuccugacccuauuuggaaagaauuuuuguuaucuguggggauuucuugaaccucgaaucaccagauguaagggcuacagcaggggaaagacuagaaacccaugucuaauucagugagguugaacuggaguggagucucauuuucugggauuggggacaaggugggugaucucaacgccuuccggaacuuaacagagcaugguccuguuagggucgauguguaugaagaagggucaucuuuagguggaggaugagacaguuggugagacagauggacccaaugagagagucccuugaguuuagcagcuguagggggcacgaggauuaccuuaaaagggcccugccauuugggagagaggggugagggccaauaaucuggagggcauagaaggaccuggucuccaauguuaacaggcaguggacaggagacaguguguggccaugguagaugcuggucaacaaaguuccauaagcgagaacagagguggcaaaguaaugggguaaguagauggucugggggcagaaagcacuuagguggaagaccaggaguuaagacuggacgaccauacaugaguucaaagggcgaggugaggagaggucgcuuggggagagcucguagccugaaaagagccaaagggaugaguuuuacccaaucaaggugaaguucuugugacagcuuaacaagagugguuuuaaagagcaguuaguucuuucuaccuuaccugaagauugagggugguagggaauaugaaaaugccaggggaugucgagggccuuagauaggauuugagaaacuugggaaguaaauuuggaaccauugucugaugggagagaggcugggacaccaaaccgggggaugaucuuuuggaggagaucagagacugacugagcccuuuuguuaguugugggaaaugccucuacacaccccgaaaagguguccaccaagaccaggagguacuuggugcaucugacagugggcauguggguaaagucaaguuguaagauugaguaauauagugacacacuuuaauaaaggcagaagaguuagagguauaagaacccagccucuuuucugucugagaaaguucacucagugagaaaggaacauguacuccgacaaggccgucuacuccagcaacuucucuuagaggaagaaccguuuguugcuggguuggggggaaggacuuggggauuugacuguggccuuagagcgagugauagguggggugaagguaggugccaauguagaacguuuggagggaccuguggcuggcacagaagaaaggaaguuaaagguagcaggcucugggguaucucagugaggagaaacugaggcagcaguuuggguuucaggggugcagagacaggucugcagcggaaaggaggugguuuguuagcuggaucuaacauuguggugucaucuggcagagguuguguaguuuucauggcuaagaggaguuggguuggagaacaaggagcacacauagaaggauuggaacgaagauagauaaaggcuuuaacauaaccucuuuccauuuaccaguucccugacaguauguauuaagaucccuuaaaauaauuggaucuaggguaccauuaaguagccauuuggaaccauuaucuagcagguacuaaauccagaccuuauugcagagguauauuaauuuugaugccuucaagucaagcguuagcuucaaagauuugagauuuuccaggagaaaucccaguggggugccuggggguacguucaaagacaucauauuaccuguuugggggguuacuggauuauuccuaccagcgucccaagaacaauccagaaaccaaaaaagaagucagccaggcuagauauguaagucaucacaagggcuucuaguggccacccaguaagccccaggcuuacaguggaaaguauucuacccuggauccagggauuucaagcugcugcaagagccuggaaguaagggguaggggacaaaagcaacuuuugagggggcaucauccaagcagucugucuuaacucguauaucagcuggaagugugacuguaaaaugccagucccuuaguccccagaaaaggcuggccaacccuaccaauuaauaugcuggugucugugugagaauuuuagcaaacugguaaauagaagcauggaagccaggccuguaagaugaaccagaauagcacagcucaugugguugagcugcaguuccgguggcagcaggucacuugguggaagcggcagcauuggccuugguguucagccgggcaacgagaguuaaggcucuguccacuggcaguggguacagcugcucugagcucugagcagcgagacuccuacagcagccaugaccacaagccccuggcccacguggcugugggcccaccgccucugcugggguccuccugccacagcacucugaagcagcuggugguauucucgcugaguuuucccagguuucgggaccaaaugauguauuagaauggcaggucacaucuuaaccgcacacuaggccaaagcaguuccacguggaagagguuuguuuuuuuuuuuguuuuuuuguuucuuuuugguuuuucgaggcaggguuucucuguguagcccuggcuauccuggaacucacucuguagaccaggcuggccuugaacucagaaauucgcuugccucugccucccaagugcugggaucaaaggcgugcgccaccacgcccaugccuggcagaagagguuuuauuggaagggagagacaagguaguggcagaaagagaaggggagagagagugaggaaggggcauucuccuuauuuauauggaaaaugauguaacacagguaaagauaggaggugcaccaagugaaugcugggaguauggugccuguugucuuggcaacuugucugcaggucgaaggucuggcuauugccuaugugauaucagguuugagauacccugaugccagcaggucccaguuucuuuccuuagcugcucucuuggugcucccuuuccuccuccuucccugucuaugaccagcucacugcuccuaaaguagacgcuuucuugcacucugcucuuuuuucuugggggcauucuuccucggguuauaucacaugccuauuuuucugaucucucaagccuuugauuaaauggcaucuuacaguguggccuguuucugaccauguuacuucaaaugggaauccacauccaaauacacgguucccuuuuagcuuguuuucuuaggauucuuuuuaaaaauugcauuuuguucuuuuuaaguacuuaguucuuugcuaugaauuuugcuuguuauuuuugcuuacuaggucaguuauaccaagcuggcuuuuguuguuaucuuuaguguauguuugguuguugacuaauuuuuccuguuuggacuagcuguagaggcuucauucaugacuauugaguggauaaauauauauugccaauauugugucuuuauggcuauuuuuagaucuagugaagaaugaguaugagauaugaaaacgcccuauaacauuaccuuucuuaguuuuuccuuuuaguuauaccaucauggacaaaauaaaagcaaauuaaauaaaacaaugauauuuguuacauauacaacaagcaaacaguaauaacccuaagaaaggaacacaagguggccauggugguggaucccuauaacugaagcacuccguguugaguuuggggcaggaggcucacucaaaguucaaaacuagccuuggcuacauaaaaagauccugucucaaaaagaaaauaaaaaaggacuggaaugcauagugcuaaaauucaugaggccugggcccacauaagccccguguaguggcacauacuuuuaaucccagcauucuggagguggaggcaggaagauuagaaguucaaagucgggcuggagagauggcucagcaguuaagagcacugacuguucuuuuggagguccugaguucaaaucucagcaaccacaugguggcucacaaccauaauugggucugaugcccucuucuggagugucugaagacagcuacaguguauuuauauaaacaaaauaaauucuuuaaaaaaaaaaaguucaaagucauguuuggcuaaauagggaguuccaggccagcuuuggcuagagaucccugaaggaagugaaggagauagggagguaggaaaggaaacaauaaauaaugucauagagcaaauuaauaaacagcuaaaacacauugacacccauaauacauguagacuguguggggcuaguuuaggggugauggugacugggagaaagcaaacagcuuugguuuaacaguccucacugugaggguaagaacagaacuccauauuauucucuauuacccuuccuuguuccucuccucgcuuuagucagacuggagucagcucacacuuuuagucacacuuuuuccauuuaaaauuacuuuugauauuuucauacacauauacaaucuguuuugguccuaucuuccccucucccaacuucucccugauacuucccacauccugucccaacuuuaaacuuucggucuuuuauucuuuuguuuuguuuuguuucaaguauaaacccagaguucaaaaucagugcucauaaacuccacgugggugugaagucauccacuggauuguaggaucugcacugcugggaaucgugccuccaaagaaaggcuuccuuaucaaccagcaguagcuuugcagcuaguggggggccuuguaaaccccuuuuaucucccuuucaauggcaagugugaugacugccugacugacugacuuccuuccuuucuuuccuucccucccuuuuguucuuucauucuuuauauauaaauauauuuauuuucuuucuuuuuuuacaucccaacuacaguuuccccuccuucuucugcccccaguccucucucccaccucccuucugcccuucccucauccacucuacuguuuuucuuuagaaagggcaggcuucccauggauaucacuaucaaguugcaguuagacuaggcaucucuuuucauauugagacuggacagggcaacccaguauaaggaaagggucccugaagcaggcaaaagagucagcgacagccccugcuccuacaagaagaccaagcuagacaacuguaacuuaugugcagaggccuagggucagucccaugcaggcucucugguuguccauucagucucuauaagcucuuaugagcccagguugguugauuuuguggcuuuucuucguggaguccuugacccuucugguuccuacaauccuucuucagcaagauucccugaacuccaucuaauguuuggcaguggaucuccgcaucuguuucuaucacauuugggccagggaucaauuuauacguuuagcagcguaucaucauuaggagucauuuucuaucugugcagccucugggaugauggcuuuuuuaaacuagcgcaaccaguguuauaugcuacauguguuuuuaaauauuuaugaaugaagucaaagauuucaucuauggaguauucuauacaaggaaguuugucuuccuucuaugccuccuuaauacaggacauguuugucaaaggauaccaaguucaauuagaaccagagaaguaacuuuuguugacuucaguguggugacuuaauuagauauuguguuaagucauuuuugguucucacuauucaaagaaguauuuuuggugauguauguguucauuauuuuaauagaagcaguucacucuguguguguguguguguguguguguguguguguguguggcucaggagaugguucauugggcaaaguacuucucaugcaaguaugagggacuggguucaaaucucuagaacccauguaaaaccuggcaugguaguaugugugucuaauagcaguauuccuauggugaucuaggagguggcaacaagaaaauccuagaagcuaucccaaagcuaccguaauaagagcaaagaagucauuuuuuuucccuauaaauucuuuucuucucccuuuccccuaccagcuuaggaaaugcuccugacuaacuguaauagaacauggguauagauaauuuuuuacaaaagacugcauauuaaucucuuuacuuccugcauuguauccuugagcuuugccaugagggcaaggaggauuuauaaagcaaucucccuccccaccauuaauaaagugauugugggacauaacugcuugaucuuuuguuuuuuuguuuuuguuuguuuguuuguuuguuuuguuuuguuuuuugagacagggucucacgaugucgcucuggcucucugggaacccacuauuaaaccaggcugcccucaaacucacagagaucuaccugucucugccuccugagugcugggauuaaagguguacacuaccaugcccaccaagcugccugauucuugacuucauguugggaugacucucuucuuuagcaaugcuucucuguaugugugaauacacgcguguuugugcagauacaugugcccauaugugccgguggucaaaauuacauguuucccucuguccccaccucauuuauuauauauuuccuuuuucuugugugugugugugcgugcacgcgcgcgcacacauugcacauuugugugagugugguguggggagauacugaguuaucaguccuucccaucuucauaccgagucuuguacuuuugcugcuauguacaccacaucaacuggcuugugagcuucuggagauuuucuucuuugcauuuugcuauaggagcacugagauuggagaugcaugcugcugcacuaggccucaugugagcuccagggacucaaacucagguccucacacuuguacagcaaacgcuauaccuacugauccagccgcccagccucuaugcgguguuauagucuaaauugugcaguuuauggacuuguaguuuuuaggcauccuaaguuuuuaggcaucugcuuuucguugagugaucuuucccaugucauagcucuaagugugagcuaauauacaucucugugcagaauuccaaacaagcaccccauuguccaaaauguuuuaaaucagaaacaguagcucaguaugaccuuguuauagacugaguauucauaucccuccauugaaagcuaauauguaauaugauggcacuuaguucuguauauugaaaaaauaagucaugaaugugguacuuaguuaugaauaucaaggaaguaauuaagucaugaaugugucacccuugagaauuggauuaucucccuuacaucaagaggccagagggccagcuccugcuguguacguauacaagauguuggcaguuugcagccuggaagaaaauacucaugagaucccagcugcacggccacugugaucucagacuuucagcccccaacucuguaacagauguuuacuuccugcacuguauccuugaguuuugcugugaggacaagccucauagcuuaguagccagugguagauagucuguagacagcuugucuaacucccauuuaugaaguaauugggagacauagcugcuuguuucuugauucauaacuuugacuuuguacuagaaugacauuuauuauuuacaugucaucuaguguauaauaguucauaauagcagccaaaauuaauguaagccuguaauucaguuauaguacauuugggcacuguggccuaacacaguuucaauaguuacaagaugagguaauucuaaacacuuucucagccagucagguuugccuuuuccuauguuaaccaucugaaggaaaaggcugucucaacauccugcaucccagggccuagaagauaaagauuccuugggauauucucaguggaaaucucuguccuauuuauuucuaaacuuagaaaacaugggcaaaacccaguccagcuuaacuaacagcucagggcuccaagcucuguagucuggcaggcuauacucaucuaacauaggaagaccacacauagguuuuacauauugacaacaggaucaauggcuauuuacacuaagauauacaaguacaaacuugggacacauguuuuuuauuaaaggauuacaagugaccugaaggguuauuauauuucauucugauguugaacaccauggagacacaguaacuugggauuuucuucuuaguauaucuuacagaguauguuacuuaguagccauaaaacuuucuaccauugaaauuuuggaaggaccucucuugaaaaugaaauagcucuguuaauuuaccuccuuaaacugucuuaggacuucuagguuuauccuccuaaagucccaggaguauuuaaugaugugcucagagagauucucauacacguuugaguaucucacuguuggagcacuaugaguaucaucugacacaacccaccagaauuuuaguuguguuuuccccuggaggucacgcagaauaagaaccauacccguggacagagccuucuccaacuggaguacaaguuuucauccucuggucuauaguucuauauucagcuuauuccacaugacacagauuuugaaaauugcccgaaacauuuuacuuguuaccuguccccagcaucagucugccuacucauugaaagucacuccucaugugagacuccuugacugggaauagggccaagaccuucaaaagagcuucuggcuuaucauugcugcucuuccuuuuguaucauaggucauaguuuucucaucaucuuugucauaguccugaaagcucuccagccucucuguuugugugugugugugugugugugugugugugugugugugugugugcguauaugccauggaaauugcaguuuucuugccucuucuuccuucuguauugccauucucuugcccacguugcugauacucucaucaguuuugcugacuuucuccucaauguucccucgcaucuuuacuuuccacaucuagcauuaaauucaucggcugcuuuguauccucuuucaggucauugaucauucuuaccaguaaaguuuuggaauucuuaucuagcauuuuaccugucaguauuuuugagcucuguaguugaggaaguaggaucuuucugggagagucuuauggccuugcuuuauguuacuuguguucuguguugcaaguuauaugucuuuugguaaaucuucugguuuuauuugggucucuucuuguugagcagccuuuuagguccccacuccuacugagaaaagaagaaaaugcuuuagacagugacuugucucaccucccuccacuagugagucacagcuuaguuccuaccaauuuguugccuguccuugcacaucucagguuuccccuuccuuuguggauguccaaagugcuuccucucuuuggacuagugucuggguucucuuauucuaauucuguccuuuguaaguuuauaugaaggcaucuucuggucuaccauuuauccaaaaguaucuuacucacuucuuugacauagacucugacagucauggguggcuuuccucaacucuuaaaccaacagaugguagaagcccaaacgagcuuaaaagaaagucacagaaguagagucuucuugggauuuucuucauuuucagacuaaaucagauuucuguugcacuguauuuagaucugaaacuauggcagggaagagaauuauaaacuggaaaccccaaaauagaaauuuaaaagaaaugcacuauuguuuucccaauuuuaaugacaacauguuuggcaaaauacauuaccagggcuaugggaaggaaacuguuaugcauuguugcuaacaguguaauugcuauguuuagugaaggcaguauaaauucuugucagauuuugagugcacauagacuguagcccagcaguuuugcuucagaaaacauauccuacagauaugcuaguguuuguguauauguuugaaaaacauguauaccaagucacucacugaagcauuguucauaguagcaaaacucagaugucuaucaaagcacccaugaaauacaguuuuguaaaacuauacagugaaucuacaaggaaugaggaaauguucuauauaccgccauguaaaggccaagguauaccguugagugaccaggaaaugucuguuaaaaugcaugcugaauauuuuauaucauauugggggcuaugucuuuacuugaacauaagcacauguacuugacauguacuuuagugagugggucauugggagcaaaggauuuggaagauuauaucgcaaagaauacuuuucauugcaucccuuauucucagggcuuuuuuuaauuauuagauauuuucuucauuuacauuucaaaugucaucccaaaaguccuccccccgcccugcuccccaaccaacccacuccugcuuccuggcccugacauuccccuguacuggugcacauaaucaucgcaagaccaagggccucuccucucaaugaugaccggcuaggccauccucugcuacauaugcaacuagagacacaguucuggggguacugguuaguucauauuguuguuccuccuauaggguugcagacucuuucagcuccuuggguacuuucucuagcuccuucauuaggggcccuguguuccauccaauagaugacugugagcaaccacuucuguuugcuaggccccggcauagccucauaagagacagcuauaucaggguccuguuagcaaaauguugcugacauaugcaauagugucuggguuugguuguuugaguuaauuuuuauauucaacuacugcacugaugcuguuuaucagguuuaggaguucucugguggaauuuuuagggucacuuauauauacuaucauaucaucugcaaauagugauauuuugauuucuuccuuuccaauuuguauccccuuggucuccuuuuguugucuaauugcucugguuaggacuucaaguaauauauugaauagguagagagaaaaugggcagccuugucucgucccugaucuuagugggauugcuucaaauuucucuccauuuauuugauguuggcuacugguuugcuguauauugcuuuuuaucauguuuagguauggcccuugauguuuuggauuuccucagguucuguuguucagucuccuuuuucauuucugauuuuguuaauuaggauauugucccugugcccucuagugagucuggcuaaggguuuaucuaucuuguugauuuucucaaagaaccagcuccugguuggguugauucuuugaauaguucuuguuguuuccacuugguugauuuugccccugaguuugauuauuuccugccuucuacuccucuugggugaauuugcuuccuuuuguucuagagcuuuuagguguguugucaagcuggguaugguagccugggcuggcauuuguuuucucuuagggucuguauaacaucuuuccaggaucuuuuggcuuucauagucucuggugagaagucuggugucauucugauaugucugccuuuauauguuacuugaccuuuuuucccuuauugcuuuuaauaugcucuauaucuaguguauuuguuguucugauuauuguuucaggaggaauuucuuuucuggucuagucuauuuggaguucuguagacuucuuguacguucaugggccggcccucccucccucccucccucccucccuccuucccucccucccucccucccucccucccucccucccucccucccccuuccuuccuuccuuccuuccuuccuuccuuccuuucuuucuuucuuucuuucuuucuuucuuucuuucuuucuuucuuucuuucuuuaagacaggguuucucuguauagcccugguuguccuggaacucacuuuguagaccaggcuggccuagaacucagaaauccaccugccucugccucccaaguacugggauuaaaggcaugugccaccacugcccggcagggcaucucuuucuuuugguuagggaaguuuucuucuauaauuuuguuaaaaauauuuacuggcccuuuaaguugaaaaucuucauucucaucuacuccuauuaucuguagguuuggucuucucauuguguccuggauuuccuggauguuuugaguuaggaucuuuuugcauuuucuuugauuguuguguccauguucucuauggaaucuucugcaucugagauucucucuuccaucucuuauuguguugcugaugcucacaucugugguuccugauuucuuuccuaggcuuucuaucuucagaguugucucccuuuggauuuucuuuauuguuucuacuuccauuuuuagaucuugguugguuuuguucaauucuaccacuuguuugguuguguuuuccuguaauucuuuaagggauuuuuguguuucuucuuugagggcuucuaccuguuuagcaguguuuucguguaauucuuuaagggauuuuugugcuuccucuuuaaggccuucuaccuguuuagccguguucuguauuucuuuaagugaguaauuaauguccuucuuaaaauucucuaccagcaucauuagauaugauuuuaaauccaaaucuugcuuuucagguguguugggguauccaggacuagcuguguugggagugcuggauucuggugaugcugaauggucuugguuucuguuaguaagaugguuauguuugccuuucgccaucugguaaucucugguguucguugcuguagcuggagcuuguuccuccugugauucuguuagccucuaucagcacuccuuggaguccaacucucucccgagucucaguggucagagcacucucugcaggcaagcucuccucuugcaagcaagugcgcagaggucuggagcucagcccugccuucugucugaagauaaaggccggagagggacccugucccagaagcuguguugcuucugccgccugcgcucucuccugugcacauuggucucuuucggaccugggauacaagaugguguucucaccuggucccgcggacagagccuuauucucaguuuuuaauuaaaacauuuuuuguuacuagagcuugaacuuggggucuuacacaugguaguaaaauuggcuacugcugagcuaugagauacauuccuagaucuugggguuuuuguuuuucguuuuuuucucuuuuaguuaaaaauuucucauucaauauauuuuguucauguucuggccuuuccccaacuuuucccagauccugccccuacuuacccaacuucauguuuauuccaucuccucaaaaagaaaugaacaaaaaaugaaaaaaaaaaucaaaaaacaguaagacacacauacaaaaugccaaaacaaaacagaauccacccacccacacaaauacccuguggaauuuguucugugucggcuaacuucuacuaggcauagggccugcccuggauuugguugauacccaguggcacaucauaggagaaaacugauuuuccuuuugccagucaauaucaacugcaaauaacugcuugguuaggggugggauuccaugacaaacuuuuccucaguguugggaccucaucuggcuugaaccucuacagcagucuccuuucagaggaaggcuucaugaauacguccuauuuagggugagugcuccaaagucucucacuuucugcacauugucuaauugugagucucugcaucuauuguaaaagaagcuucccugcugaggauaaaaugaugcagugaacuguggcuuuagcaguaugucauuaggagucauuuuauuccugggauccuuagaguaauaauauuggguguuucccuaagcccaugaccuaucuagucccagauucuaggccacuuuaacagagcccgguauagguucugucucauguagugggccuuaaauccaaccagaaagugguuaguuacucuuaaacauuugugccacuauuggagcagcauaucucauagacagguuguaguuguaggauuuguagcuggauuacauauugaugccuacguuucuccuccaggaccaugcagaauaccauccagcgccaugaacacuagucagucagucaguaauggugggcuucuuggugugcuccagcucaauuuucucauguuugaugauuguaaguauuaucuucaguaguagaaccuuaccaucagcucauggggagcaaccaauaguuuuugcaauagucuguaauauuuagggaagaaccauagaacucccuuggccagugacucaaaauguaauccauuccugguacuggagguuuuacuugguggcauaaaguguccaguuuggacauuguuucccccauuauauaguaacucugucugaauuccuuucuuauguauauuuuaggaagcuucuacaguaguagguuuccauauguuuuuaguuuugguuuugguuuugguuuuucgagacaggguuucucuguauagcccuggcuguccuggaacucacucuguagaccaggcuggccucgaacucagaaaucugcuugccucugccucucgagugcugggauuaaaggcgugcaucaccaugccuggcuuuccauaugguuuuuuaaaaggcuuuaguguugucccuucccauaauccguuugauguuguucuuccuuccuuuccccauuuaguccucuuauucuaguuuuuccuuuaucuuuccauaguacuagauucuauuuacucuuucuuagacgauccucucuuccugcccugggccuuuguggauagccaagcuuuaguguucagcccuaaacacauauacauaagaacaucaacaguaaauggacucagcagguuauauuucuacucaugcacacaccccccaacacuaauuaaagaauaagaggucaugaauuucagaaggaguggggaaaacacugucucuacacagucucacucuuucaauggaagaggagguacagguagagacgggaggauggaagugaccgaaaugcgguacucacauaggaaauucucaaaaaagaauuuuaaaacuuuaagauaaaauauaaaguauuccuauuuaaauaaaauaucauucuggaagaauuauuagugguaugaaaaaaauacucaacucaaaauauuaccuagcauucuauaaaauauaaucuccauuuuguuauguguguagguucauguauguacaguuaccugaauaaucuguagaaaaauguacaaauccaucaaaauggugauugguaauucugaguuaccucuuugcuuagcuuugacacuugugaauuuuucagaauuucaacaaugauuggcauacuaauuugaugaugauaagguaacaauaagcuuauuuagagcauaaagucacaguaaaaaaaaagguacacaaacacuucugugaaauuacagggcuagugagaugucacagccauuaaagguaccuaucgccaauccugauggcugagcucaaucucuggaaccuacaagguggaaggagggaacugacuccuccaggcuauccacuguuuaacacacacaaacacacccacgcacacacccacccacgcaugcacagacacacugaauuagggauagacccccuuggagacauuucuuuccuauuacaugguaaucauuauaaacaccacaaaacaauccuuaaagcaggagauugaaaagaaagggcaaccaaaguagaaguaaccacucagggcaguggccuagggacuuaggcuaucuacaguuuauagccacugaucuuuguacaagcccuaccagucaugacaguggacuaggaguguaaggguccgaaaauugcugaaggaagacaccggacucagauaauaugcaaaaccaaagaacauuuauucuacagaaacaaccagcaugcagggucagccauccuuugaaauggcgacccuggacaaaggcaugcaggccucuggauaaggagcucucuagaaggauuuuagguaaucuaaaauuucauugguggguucuaggggcucacaggugaucaguggucuauauuccuaugucaugagcauucaaucaugugaugaaguagggcuguauagugcagauggaucauucugagauaaaauauuuccccauuuuugugguuauccccaggcuguucucugggagaaaguuuuaugaucuuguucuggauuuuaugcuguuccuagaucuagugucuuaagaccuagauccugggggaagugggggggaggguaugggggacuuuugggauagcauuggaaauguaaaugaggaaaauaccuaauaaaaaagaccuagauccugggacuuagggucuguucugaaaccacugccuuacggccuuucuuuuuugaaaucaguccugguccucaaaauggagacaaauggguuuauauuacccuuuugggggaaggacaagugaguucauuuaaagaaaaggauuuuuaaaauucuucuaggagcuagagagaaggcucagugguuaacaaugcuugcuggagccaggugggguggcgcacgccuuuaaucccagcacuugggaggcagagacaggcagauuucugaguucaaggccagccuggucuacaaagugaguuccaggacagccagggcuauacagagaaacccugucucagaaaauaaaaaaaaaaaaaaaaaaacaaacaaaaaaaaaaaacaaacaaaccaacccacaguccuugcugcucuugcagaggacuugaguucagucccaaacacccauguuaggauaucauaaccaccagggaacucagugcccucuuccggauucuacaggcauauacacacauauuacguacagucacacaugcacacaaaaugaaaauaagccuaaaauaaaaguaagucuaaaaacuuaccaauuugaauggaaauagcgacaacacgugccagcuucaucaacacuuggaaccaggcacacuucugauggcauuuauuuaauucuuaacacuccuuugaauauagggacugcuguuagauuuuauaucuaagggaagaucuaauccuagaucagagaucacacaucuacuuaguagauuucucuaggugcuguuuggaucuuaaagcuuucguguagacccugaauauuaaaaacuuggugugcacccucuagaacuguugaaagacagcagaacuuuuaguauuggaauugaaugaacgaaaguuagauaagcaggggaaugcccuguaagggcauauugagaugacaggcucuucccauccuccucucucccucucucccuccccucucccuccuuccucuccccucccugcuucccagcugcuugaagugguuaauccuccucugucacuuacuccugcuaugauggauuaugucaccauagacacaaagcaacgggaccaugugacuauggacugaaacugaaggagaauaauuccuuccuucuaaguugauugagguguuuugccacuguuacaacugaggaacaugucaggccuaucacaggaauccaacacuaguuaaauaugcucaguuaugguuuuuuuuuuuuuuuauuaccugagguucauuuccuaggaaacugggguuauaagcauacacugcugauaaacuaguggaccuuugcuugaaacuuucauuugaucugugccucaaaugauaacuuuauagauguuuugcuccuguugcuccuaauuugaggaaaugucaagaaauccuugcaacuuggaauguguuugcaacuugauuuguuuuuuaaguaauuccuccaaguuaacugagugcuucuuccucucucucucuuucucucucucucucuuucuuucuuucuuucuuucuuucucucucucucucucucucucuuucuuucuuucuuucucucucucucucucucucucucucucucucucucucucucucucuuucuuucuuucuuucuuucuuucuuucuuucuuucuuaacagaguucaggaucaagcucagaagcgcacagcugccagcaagcagucuacuacugaacugcaccaucucuccagccugugcuuacucuugaauagccccaaaguagucaaugguauggcaaaauaaaccuccauuucauuuagauuuuuauaguauuuuuugccacuuaaauuauuuuauguaguugaguaugauuuuuuuucccccuaaggaauucuauguaucucaauuucaagagucuucagccuuuauguuauacauaauuuccuauagauuucaaaguugcuuuaauaaaaaguuuaauguuaaaacaguuguggauuuacauguaguuaugugacuacauuauccuuuaccuuuuuucucuaaugaaauuaucuuccaaaaauauaucacaagcagagaauggacauuaauauaauagauuaaucugauuccuguuuuuuuccuagauauagguacacucauauauguguaugaguuuaauuuuauguaauuuuauuacguguagguuugugaauccaugaccaucauauuugggauacagaauguuuaguaccacaaagauuccuuaaauguuguccuuuuauaaucauaccaccucuaccuccuuauacuccaugccucuccuuagcacuuaaagaacauaaaucucucauauaucucucuaauuuuguacuaucaaaaauguuacauuacuaccucugguccacaccccacagcugcccagcauggucccucaagccugaacccagcuuacuuugccuuugguugcucaugucacaaccauuccauuccuuugcuucaaggugugggcccugaaaggaacuguauaccugcucugcccaugacugcuucugccucuaccucaauguacuguaacuguuuaacaagguugcucuggcucaggcugagaaauugacuccacccuuacccugacgccuggcauguccacaugugguccuguguagucagcaaccccagguaugguaaggaaccuucccaucccaaguccucagccauugaccucuggccucaacccaaacucggucagagaccuugucuuuacccggagccgagaccccuuagcauggguucugccaccucagaggucuccccaagcucuaucgccuacaauccaacuuugcauucugaccugguggguaaaaaacccauaccaaaauacagcugacaauguaaauccagaugcccagguuacagcacaaaaacuagauaaacuaaaccaauaucuaauuguucucuaaaucaccaaucucauaauaauguucccuaaagagaacaaguuacaagaaauuaaagacacggaauuccaaaggacaauacauguucaacaagcucaaaccauucagagagggcacagaaugaaauuaaagacaacaggaauaaaauucugggaguccaaguauacaaaaacacagcucagcaacacauggaacagcaagacuguaaauucucaguccagcuauggauaauuuaggauccuuuguaggugagucagucgguugguugugggucauagguggugguugugucacuuacauugcucugucguuuuauacauuuguugaaguggauuccuuuugacuuuccuccucuucugagccuauuauauucuauuugcugccuagaggaccauuuggaugaagcugagcuuagggaacuggugaaaccuagugauaauuauugaauggguugcugaaaucucaucuuggcuaugugucaacaggaccaaaaccuuagucuuuccuuagauuauaugaacaugcuggaaaugggcuaucaaauuucagaccuaguaaagucugucuacuaucuggagcuuagaaaaucuuaaugaaauggauauuuuucuagauaccacuuaccaaaguuaaaucaacaaauauuuaaauagucccauaaccccuaaagaaauagaagcagucauuuaaacucucccaaccaaaaacaaaacaaaacaaaacaaaacaaaacagggacagaugguuuuaguacaaaauucuacuagacuuucaaagaagaacuaauuaaugcuaauuuuuaguugcauuuuaaaaauaauaauaaagcauauucuuuuaaggucuauaaagaauaggggcucacagagacuaaacugcccacuagggagccugcaugggccuaacccaggcuuccugcaccuaccuuaugguugcauaguugguguucuugugggacuccuaacagugggagcaagggcugucucugacucuguugcccaccuuugggacccuuuccuccuacugaguugucuugucuagccuuaauaggagaugcacuuagucuuacugcaaccugauaugcaauggcugguugauauccaucaaggcuggcuauuuucugaagagaaauggagaaggaguugauggcaggaggagugagauuaaggagaggagggaggggaaacuggagucaggauauaaaauaaauaaacaaaaugacaauaagucuuauauuuuaaaauacuaaaauuaaauuuucaagaucucaaauaauuuuacuguauaccuuuggaaaaauaaggcuaauccaaaccccaagacacuagauggggagaaauaauuaagagcaaggaagaaauuaaugaaauagaaaugaaaaaauacaaagaaucagugaagacuugguucuuugaaaagauaaauaagauugacaaaccucuagccaaaccaaaaacaagagaaagaagacccaaacuaagacaauuggagucagaagggagacauuacacaggcugagaugguucuauuuagaaacauacauguauauagaguaugaguguuaacaguuaauuuuuuuuauuagauauuuucuuuauuuacauuucaaauguuauucccuuuccugguuuccccuccgaaaaucugcuauccucucccugcccugcuccccaacucauccacuccugcuuccuggcccuggcauuccucuauacuggggcauagagucuucacaggaccaaggccucuccucccauugaugaccaacuagaccauccccugcuacauaugcagcuagagccaugauucccuccauguguacucuuugauuggugguuuagucccagggagcucuaggguuacugguuaguucuuauugaacaacaguuaauuuagaagaggccaugaauuuaaaagaaaguaaggagggauagaguucuguagaguuugaugguaggaaaaggaaggaggaaaugauacaauuaucaaaaaaaauuuaaaaauugaaaauaaagacaaaaaaggaaauuauacacuaauauccugggugagcauaaguguagaaauucucaguaaaaugcuggcauaccauauucaaaaucacaucaaaaaauuauucaugaucaaguuauuuccuuccugagacugagaggucugauuugccauaccuaaaucaauaaauguaauacagcacauaaauggacucaaggacagaaaucacaugauaucaagugacaggguaaagaugaaggcagcauacugcaacuuaauuagaggcuaucuaugaaaaaccuauagauaauuucauauaaaacaaagacaaacucaaaugcacugcuacuaaagacaagguuguucauauucucuacuauguuaauaacaguacuugaagucuauuugauacacauagggaaagaagucaacaugcacauaaaugaaacuaaaacuagaacuagaucuuuaucuaguuucaucugaccaaaaaauaagagagagagagagagagagagagagagagagagagagagagagagagagagagagagauacccaagaccuuauacucugagauuucuauagcaaaaaguagggaguauguuucaacauauggucacagauggagauguucuaaauaggaaucugauaguauaggaacuaaaaccgacaaaugagaucuuaugaaaacaaaaaguuucuauauaagaacauuauuaaucaacagcccacagaaugggagagucuuuucaaacuauacauuugucagaggauuagugucuggaauauauaaagaauuuuuauuuugcuaucauugaaaucuuaauuacauuucuuccuuccuuuucuuuccugaaaacccugccaccuucccugcuguccuucaaauucauggccucuucacuaauuguuauugcgugcuauacacaaauauauacacacacauaugcauuauauauuauauaugguauagcauauauaugauaauauucuuaaauauaaccuacucaguucauauaauguuacuuauaccuauguuuuuagggcuauuugguacuggacaaccaauuggaguguuguuugcgggggaggaccaccucuccagguagaaucuaaacaucagaaaaucaacaacccaguuaaaauaaucuagagcacuaaccagagcguucucagaagaagcacuacaaacggcuaagaaacacgagacugcucaacauccuuugccaucagggaaacacagaagcucacuuuucaguuuucaucuuucuggagucagaaugguuaucgucaagaaugccagugacauggauguagaggacggauuccuucauugucuaagucucuggaaauagugcagaagaguagucagggacuaaaagauggaagacagaaagggcugcaaaguuccauccuagagacucaauacagccauugcaaugaugaacucacaaaaacugcauuuaccugaacuuagccugcucaagacauugaaaguguuucaaaguagcuuuuccuguugugaauguaccucucagcuagucugguuucugguucagagcucuuaggcacagaguugucuugaacauuugcuuacaggcacuuguguagauaucagcugcuuuuuuuuguuaaaucucugaaauaaaugccuaggcguucaauggcaauguuauaucaguauguauuuagcuuaguuuuaaaauaagaaacugucaaauacuuuuguagaauuacuggaccauuuuacaccccugccaacaaaguaagauugauccagcuccccacauucucauaaacauuuguuuuuguuucuuuaagaagacaaguuaaccauuccauuuauugagaauuuacuuaccauucagugcauugcuuagauauguaguauucaguuuuuaguacacauacaagguuguguaucgauuacuacuaauuccagaacauuuccauuaccauagaaaaagaaacccaauauucauuuucaucucuccucuauggacuuaccuaaucuagauauaccaaauaaauggaauuuuuauaaaauaugaccuuuuguuuggcuucuuucauuuagaauagaauuucaagguuucuccauguucuaccagccuucaaauuaauuucaguuguugugcuuucagguuucagaauuucuuuucauuuucuguuuauaauuucaaaauuauuguuuaauaucuauuuaauaaaacagguguuuugaaauauauuuuauuaguucuuugaguauuuaauauauacuuuggucauuuucacccccuuccauaaacuccuuuuaauuauuugccagcagcuucucuguugggguguauccaccuucccuucccaugcagagcucuagucuagcuuaggcuugcacaggucuuuugcugucacaaccacugugaguucauauacauaacuaagugaacauaauguuaaccugacauuuauacucauauuuuaauaaaccuguccacguucacuagagcagcuucucuuuuuaguaguuaguagcacagagacccacaacugacuaugguguggagaaaaagacugggaaucucuuauucuagucuuuucuagaucaaauccauuauaguaagguaauauauuccauaugauuuccauuguuuuauaauugguagaauuuguuuuauggcccaagaagcaaucuaggcuccuguuuuugauacacauauuuccauucaucugaauucucuaugcauuaauuuaagaacuaauuauuugcacaagaauuccccauucauuauuuccacuuuacuucaguagcuauagucagagucuaaaggaacgguaaguuucuuaaauuucuucugcuuuguguguguuugaggaugcgcguggaaugugaauuucaggacaagagacagcauuucuuagcuguaauuuauauaauugccugcaggugguagcaaagcaacacaaaaaaauaucaacuccuuuuccuucauccuuuguuucaguuugggaugugugugugugugugugugugugugugugugcuuguuuguugugguuuuguuuuugauacaggguuucucuguguaguccuggcuguccuggacuagcauuguagaugaggcaggccuccaacucacagagauccaccugccucugccucaagcacugggauuaaaggugugugccaccuugcccuggccaucauuuguguuuuaaagaaacaaaaaugaguguuuuuugcugccuugaaagcugguaaacuugcuuggaaaauaucccuuuuaaauauguuugcuaauuuuggaaaugaaaaagauuuauuauuuguaagugccauuuaccaaugguaggcuaaguuuacauuugcauguuuuuauuggcuauuuuccccucuaauuuaucuauuuguuuuuauuguuaauuuuccuguucaagguuaagaggaaaacucugcuuuuucuaucuuaccguuauuaaaguaauacaucucauuauggaaaauuaaaaauaccagaaucacucuaaaaagaaaaaaaaacccuacauaguaccauuauuaccaucuuaauacauuuuacucauuccuauauuauuaauguguuggugggauauugugagcuuagauuauuuuguccaguuuauuuccaaauuucuaaauaaaauugaucgugacccucugucuuccuagacuuuuucuguauauccuuuaagucaaccauuuuaaaugugagguacuaccugaaaaagaaagugaagaauguuagaggaagauacuugacauggaacuacagccucuucaugcauauaugcauauguacacacgugcauacacacuuaaaauaguaaauaauaaaguuuuaugcaagcuaugauaauuaacuugaaauugguauacuuauuugugaagaaguuacauaaaauaauuaguuuuguaugcauggaacaauaauugaugaaaaaugagcccaugaauuugaaaaagagcaaggaggaguaaaguguaugggagcauuuggugggaggaaaaggaagaggaaaaugguguaauuagagucaca

SEQ ID NO: 9689 - RNA, 3570 nt, Mus musculus
aggcgagcauucugagacuagcguucacagucggcuagaaccuucguucuugcccaccaccucuaauuucugcuccugcgacuugcucgggccuggcagcagcagcauuccugcucuagcggcaguuccgugcagaggcgccuacauaccucucccccucgucugugagaucgcgggccugucagugucagcuuccacacgucggucgacaggaccaugucgcugguaagccagaauucgcgccgccgccgcgguggaagggccaaugcgcgcagaaacaacgggaagggucacccugcugcugugccaggcccagacgucccucgggaucgcaacgauccuaagauccuccagggccuccgcgccucugagggcccuggcaccuccaugcugcccaccccccgggagggcccaagcgccucugugccgcccaccgccucagagggcucaagcgccccuaggcaguucaucauuucccaggggccgaacaccuccgagaugcccaccuccaggaagggucggggcgccucccggccuccugcaguuuccgcagggcugaacaccgcuaugucaaucaccgccucggagggcccgaauagcccugugccgcccacugcuccuaaaggcucaaaggccuaugagcaucucccugucucagaagggcuggccaucucugagcagcgucacucugaugggggcccuaacauggagcccacccugggugagggcccgggaaucucggugccgcccaccuucucugaggaaucgggcauuucugaugagggcuugagcaucuuuaugucgcccaacaucucggagggaccggguaucaacgagcccuacuccguuagugaggacccaagcacuucggugccgcccacugacucuaauggacugggcaucaaccugccgcccaccuucggugagggccugagcaucucuaugcuguucuccgcuuuggaggaacccgacaucuuugcgccgccccccuccgcugagggacuguucgccuccaugucgccccccuccggugagauccagagcuccugggugucgcccaucauaauggagggauguaacgucaacgugccgcccaccuccaaaaagggacugcgcaccucggugccaucagcugcuugugagagcccgagcaccucagccgagggccugagcucgucccugucauccauuucugcugagggcuucugcagcucgcuggcgccaugcgcugcggagggauccugugagcugcuucccugcggggagggccggagcaccucggagcugcacugccugggggaggggucgagcaccucgcagaugucccuagcugccgagggcccuagcgcuucugggaugcccacugaagcuaauaaccccgaggaagcacugagcugcugugcuucugagcgcaggaacaagagcaccucccgugcucugcaaaaggccaaggauccaucuguacgcccaaagcgugaagaccgcuuccuggauuuccagguccugagagacaguaagaauuccaacuccaucaccauuaugggccugggcaccucccgcguugcucuuaccuugaagccucaggaucccauggagcaaaacguagcagaauuguugcaguuucugcugcugaaggaucagaccaaguacccuaucaaggaaucugauaugagggaauucauugacaaagacuaucgccaccaguucccggagauccucagacgagcagcaguccaccuggagugcauuuuucgguuugaacugaaggagcucgacacugaggagcacaucuacauccugcucaacaaacugggaccagugcccuuugaaggguuagaagacgucccaaaugggccaaagaugggccucuugaugaugauucugggacacauauuacuaaauggcaaccaagcgagagaagcugauaucugggagaugcucuggagauucggagugcagcgugaaagaaggcuuucuguuuuugggaacgugaagagacuucugucuguagaguuuguguggcagcguuacuuggacuauaggccacuaacugacugugugccagucgaguaugaguuuuacuggggcccacgaucccgcgcagaaaccaccaagaugaaaauucugaaguucauggcuaagaucuauaacaaagauccuauggacuggccagcccuguacaacgaagcucuggaagaagacgcugacagaguuguuguuaauaacuucagaguugcucguccauuuaggaggccccuuuuugcagaaguugcuccagagcuagaugcuucuggcucaaaauauucuccccauucuuggccugagucaagauuagagagcaaggcaaggaaauugguccaguuauuucugcugauggauucaacuaagcugccuauaccaaagaagggaauccuguauuacaucggucgagagugcaccaaaguguucccugaucuccugaaucgugcugcucgcacccuaaaccacguguauggcacagagcuagugguccuugaucccaggaaccacuccuacacccuguacaaccgaagagaaauggaagauacagaagagaucauggacaguccaaacaggcccggcaacaauuucuuaaugcagguucugagcuucaucuuuaucaugggcaaccaugcgagggagucugcagucugggccuuucuaaggggcuugggaguucaaaauggcagaaagcacgugauuaccugucgguauuugagucagcgcuaccuagacaguuugcggguuccugacagugauccggugcaauaugauuuuguauggggcccuagagcccgccuggaaaccuccaagaugaaagcccugcgauauguggcccgaauccacagaaaggagccagaagacuggccggagcaguacagggaggcaauggaagaugaggccaacagagcugaagcugggcgucguccguugaucguucgcaacuugcgauagauugugucaucgaggccuuguauggccaggccuagagcucugguucucauguauuaggaguggguguguguguguguugggggggggguacguauuguauuugauacuuguguuccaguuccacuuauguaucuuuucauauuuaguucuuguuugguaucuugaaaaguuuccauuguuuuaguaauacuguccauuaauguaaaugugauugaccacuuacugucucucugguguacuuugugcugugagcauuuugauaguguuauaaaguguuuuaggacucuuuccaucuuguugcauugucugaaagagaacauauagcagauagcuauagauauaggcuuuuccuugaaagcuugaaaaaaaaucaucaguaaagugaucuaguuucagauguuaaacaaauauagaacaacugacaaaguacuaaguuguggcuggcuucccuuuugucugcuauuguguaaagaauacuaacguuucccuguauuugcuuuugcuguacuaaaguguguugaaaaauaaaaguguaauaaaucaaauaaugcuaauccacuaauuuauucaauaaauauauauuaaacuccucucaua

SEQ ID NO: 9690 - RNA, 1189 nt, Mus musculus
uuuaaggcucagcuuucuuccaaacaguguaaaauacccacaauuccaaguaugaagggacacagacaaucucuuuugagaauuccacaagacaauacagacaccccagcuguucgucauagagcgacagggcuucaguaaaguugacacaguuccccugugugaaguauuuuccagccuguuucagaaccuucaucaacaggucgagaaucagucugaggaacucccaugugcaaucuucuucuggagaguagaguuagggacaacugucaaaucacuaaucacauaaucaaacucucucccuucuuuggcaaaccucuucaguacugggauucagucuucuauaagacccugauagcagucuccuuuaagauugucuaagacaucuccacauguucuccgcaugcauuucuuacauccaucagugaccauuuggucaaucucuaccauagugaccaucuuuggcuucaguuugacaauuucacacaauaugccuccaucgccgccucccagaaucaguacaucuuugccaguguagucuuuuuuaccacugcccaugauggcacggguauaugccaagucacucucugccaaauuaacauccccgcugaggaugagaguauucccaaacugcucugaguguaggauuuuaauguucugauagggugaaucuucaucauacaccacuucaucuaugucauacucagccaggcgcccaucagcaguaggccaguaucugucaauggccccuccucgaacuaugggugguaauugcuucacccgcccaguacugucuugacucaauucuuucauuuuuuuucuucuauuuuguucaaaaggcugucaguuucuuguuugccuugcacaucacugucguaacucugaagguccagcaacaccaauccauguggauaaauucacaaauuggcaaagcugccauucuuguuuguguaaguugcuaaauauccaugguccugccaggugugcacugacucugucauccccugcuccugaaaaauggacugaaggccuuucagaauggccucaccaucagcuuuggcguaaagucgagcgugcugugucuugcugcugccauaguguggcgaggcccugugccaugacuggggagccgaccgcaggagacugaggguccacgcggcgugucaggcugcaggccggcggggagugc

SEQ ID NO: 9691 - RNA, 1239 nt, Mus musculus
ggcccaaguugcucccucuuggaagcgcucucaacguuccagagucucuggccuucuuccugcccugguugcacccagguguguuggcgagccauccccaggacauccagugugugucugcaagauaaugaugcuugaacugaacuacuaaugauucuaaaucaaaacuuaccuuauuaauaauggcaggaaaaucgucucuuuuuaaaauaauucuucuuggagaugguggaguuggcaagaguucucuuaugaacagauacguaaccaauaaauuugauucccagcucuuccacacaauagguguggaauuuuuaaauaaagaucuggagguggauggacauuuuguuaccaugcagauuugggacacagcuggucaagaacgauucugaagccugaggacaccauuuuaccgagguucugacuguugccugcuuacauuuaguguugaugauucacagagcuuccagaauuugagcaacuggaagaaagaguucauauauuacgcagaugugaaagagccugaaagcuuuccuuuugugauuuuggacaacaagacugacauaaaagaacggcaggugucuacagaagaagcccaagccuggugcaaggacaauggcgacuauccuuacuuugaaacaaguacaaaauauuccaccaauguugcuacugccuuugaggaggcaguucuaggaauucuggccacugaaaauaggucagaacaccugauucagacagacacagucaaucugcacggaaagcccaagccaaacucaucuugcuguugauggcauuaaagggauaguuggugcauucuaaccaacacacacagagagaaagguggagaaacaaauuaguaugcagaagaguucaucuacuaauaaaauucaguuaacgcauauuguugccucauuagucggucggggaagggacacucacucuggaggaaucuauuuacucaguaauggcacauuccacuuauaaauuguaauuguugccuaaugcuucuuuaaauuaaaacauuagugcuaauaagaugaccaagaacugacuuaacuguaauucagacaacaaccuugacuauucuagaaguacacuuagauuguuuugacccacaaggaaauggagaauuacuuuuauauguguauauuuuuauguaauuagcauuguauucuuggucuaggaaaguaaauuccuacagcagauaaaaaucuaauaaagauuaaaauuuaaugcaaa

SEQ ID NO: 9692 - RNA, 870 nt, Mus musculus
cagucccuggagagcuccgcuauggcucggguggccaagaaaguccacuggucuagagcagcuacagcaguagccgccacugccaaagccaaaagaucgaagcuuaagaagaccgcugccaaaagaucgaagcuuaagaagacugcugccaaaagauucaagcuuaauaagaagcgaaacccuagaucuaagcuucccaagagaucucaucacuccuuaauucauucuuuuauucguucucguuccugugguugcugucauuguugcugucauuguugcugucuucauucucguccuucuuauagaaaaaguacauuuaaggugagauaucccaagcuaagcucauucacucccuucuucggucauucuuuccccuaagacguucucgggccuacaauaaacuucacaucuaccucugccccuuuacacgaaucgccauccacauucuaucuuuuccccaaaccagugcccuuaugacuguaguucuuucagauuacaaagaagggggaacaaucacuucgaaggagaauuaggagacgaaucaagcgugcuacugaacuucgauugaugcagagccaccuggagcggagccaacuaaagcucaucgaacuggaaccgagcgagauuacaguggcauuguucucucaugagaaugucaaugugucugagccacaggaaguuccaccaugccuugacagugacccauuuccaaauguagacuuggccagcuucuagaccccgaacagguccaaagacccaugaaacaucaguaaaugggucugggagcugagcugugguccugucaaggccagucuucaccacaaacuaauuuuuaugauggugaaaauaaaaucaaucagaugugaaaau

SEQ ID NO: 9693 - RNA, 3960 nt, Mus musculus
acaggcucaguuuucuuuaaagggcuggccacugggaguuugaccaggcuauggauaacacaaauuggucuuguuuucuucuccuccuccucuuucuccuccucuuucuccuccuccuucuccuucuccuccuccuucuguuucuucuucuucuccuccuucuccuccuccuccucuuccuccuucuuuuccuccuccuccuccucccuuccuucuuccagggagggcagacuugagaggacuaggaagugagugcgaugggguuucacaaugucaaauuccaaauaaucaauagaaguacugugaaaagacauaaaaaaauguauauuagaggcugaagagacugcuuagugauuaugggcacuugcuguucccagcaccuacauuggguaggucauaccugcuuguaacuccagugccagggguccaacauucucuucugcagugugaggacuuguguacauauauacauccaggcucucucaaacauacauacaacauuuaaaaaccaaaucuuuauauguuaguuagccaggugugauggcauaugccuuuagucuaaguucucagguggcaaaggcaguuggauuucugagcugaaagccagccugaucuacagagcaaguuccaggagagccagggcugcacagagaaacucugucucggaaacaaacaaacaaacaaacaaacaaaaaccuagucugauuguuggaaugcauuguuugaaaagagacucuucucuugucauucuaguccaaaacugcaacccugacaucuaagcaugaccaaaacuguugcauauuucaggaaaaauaaacagaaugaacaaaauaaagggaaugaacauguguuccagaauaaaugugggcacaaaguuggaaacuucaaauuuagaaaacuuauuugugauuugcagagauuaugaaugaaaaaugaaaugagggggaaacgauuuggaucaguugguaagugagauauacccccaaucauaucagauugaacuaauggcugaccugugugugacaauuucaagauuguucaauaucaaaagaauuagaugucaauguccaguugaucauauauauauaaauaccuguaaguauccuuaaguaugaugggguacaccugucuucuaagcacuuugggaggcugcaaggacaguccaaguuugaggccagccucauauacauguugaguugcagccuagucaggacuguauagcuagaauuuuucucauucucuuuccacaaaagguaaaaauucacacguguaagcguuggcaagcugaauauuauaaugaaauauauagaagaaaaauuaagaauauuauaaaauaggaaagaaaauauuuauauuuuggguggcuauggagauuaaugauuaagagugugcaugugggggagggguuaggacauagcucaaugauagaguauuugccuaacaugcacaaagccuuggguuuaaaacagcauaagaauguauguccacccuccccgcaaggauggauguuuggcugaauguggaacuugugcauugguauccucacccauuaaaauguuaggucugccuacuuuggaugguucaagcaugagauuaagauaaaggaucuguguaguggucgacauauaguaaauucucaauaaacguaaauggggugucauuguuucaccaauuauguggaaguagagagguuggaccaagagcgcauuuucaggauaaugucaagauacaucccugacacuuugaggucagcaguaacugaacuggaccccacuaagaagagguggaggggaucaaaugacgucgaccgccuuagcaacaggcucccaaagaaggugaauuuccguagccaauaagacacugagcucuggcagagguagccaauagaugacggaaagaggaagagggaggacgcgccaauucuccugcccaagccucggcccaacaaaauggcgucggcauaggccuugcuuuguuuccguggcucuugcagcagcagcagcagcagcagcagcagcgguagcggacucugagcugggaggacgauccagcacuaucugcggugacuacuaagaucccaguacuuuucguucagccacuggcgccgaggagcgcagaacgguacccaagggguugccaagccaagcggccguccgagccaaaaacaugaccgcugagcccaugagguaaaacgcaagcccuugucacgggccccggcguucugcucccgggcgccuuccacucgagugggguguuugcaaagacgugcgcuaggugcccuaggcccgcgcgcggcuucgcggucagcggcaucguuuucccucuaggugagcggggcugggggagcgcggugggaagccccagcuggggcuuggggugugugugugugugugucuauguguguaugugugugucugucugucugucugugugugugucggucgggggcggcaugcggcgcgcgcguugccuuucccgccucccgccgcugcggagccgggagccccugcucggcucacgccuccgugcccgcggcgucgaggccugggggcggggggugucgcgggccaccgaacgcuugcggucagucuuucgaaucucggggccuagcgacugcguggggaaggaggggggagggggggggagaagguggaugggggagggggaggggcggaggauggggagggggaggggcggcgggaggaagugagauccuggaacuagcgaaccccaauggucgccuccacuggaaguccuccagcucuccgcggcuccgagaggagagccgagcauuggagguaggagggccgggcccggaagguaccucuagaaggugccuuuucgccccccgacuccagauccuggaggguuaucuuggggaccccugggcggcugagacggagagcgggcagcccaaugcgggcuuuugcuuucugagaacagcggccgacgacuuugcaggagaaguccgguuuuugacgggacaucgguuguuguuacccccugcgguuugggacacguuccgugaaguaguuagaucgugcuuuuauuuauuuguuccacgaggcauguggagcggguuaacggggauucaccagaagauuuauugcaaagguagaagagagcccaggcccgauguuagcgaucaaauacguuuacgauucaggcuguuuuuccacgcguuucugauuugcuuuuugauuguuuggaguaguuaaucugaaauggauuccgcuuuuaugcagauaccuugcuuuuuuaggcaguuugauauuugaccuuuuaucccaagauugaauucggugauuuuucuucucgaaugagaugcaagcuuggugaauaguggcaaaacgaaauuauagguagcguggaucauaauugcaucuguaauuggcaaaaugugccguugggugacuaggacaucauggcuuugagcacuuuagauuguagaauuugagaacgagccuauccgauuauuuucuaccuuagcaaacagugcaucgaugcucucuuuacuuagggaaaauauacuucaguucuguuuguuuguuuguuuguuuguuuuucgagacaggguuucucuguguagcccuggcuguccuggaacucacucuguagaccaggcuggccucgaauuaagaaauccgccugccucugccucccaagugcugggauuaaaggcgugcgccaccacgcccggcuuauacuucaguucuuaaaauacaggcacuuaguuguguaaagaucauugucuuccuuuaugaauuuguguuaacugacccaaguaaaacaaaucuuuuuuuuuuuaaauggaauauugagcaguauuggcugguuaauaccaggcauucaugcucauuuacuuacaguucaguaugacuucuagguuuuacuucaugucuuaguugucuguauuuaaaaccauaguugcuucuuuguggauggugaagcuggauacug

SEQ ID NO: 9694 - RNA, 10359 nt, Mus musculus
uugaggcacaaaauggcuuguacguuuaaaaauggaaucaucaucuagaaagcguuccuuccuuuagaacuguuugauuuugagcuggccuaaguaacaaaagccucuaauccacgcauuuugaaugugaaagcaagagcaucaauuguucaaggucaucuuuggcuccauuguccggaucccaggccaccugauuaauguaagauugucucaaacauaaaggagcccucgugauuucucccagccaaacucccagguuugggagguggaaguggaggcaggacgauuaggaauucaacaauucaaggaaccuucagaguuccauucuagccaaguccaagggaacuacguggucuaaagcagaagcuugcauuauacccucugguaagcaaaauuaauuucucagcccaaaccucagcgcugacaacacccaaaacauccaaauaucuuacaucaaaagugguuuuguuuuguuuuguugaaauuugcuccuuuaguauaauacucugggacaggugcuggagaaaugucucaaggguugagaacauuuaacuguuuuugggagaagacccucccgggaccggcaugguggguaacagccuaguagucccaggagaucugaugcacucuucugaucuuuacagagaccaggcacacacccauugcauguacauucacgcugccacccccccacaccaaucuuuuuuucaagcacauacuauucuugaagauggcuuaaguacuguuccuaugacugcaacuccugaugaaguugcuuuggucaggguguuauaacauggcaacaguaacccuaagacauuggggaaauauagaucaguugauaggacauuuaacuguuauuuguaaacacauagguuuaauccucaauauuuccucaguauacacacaagcgcgugcacacacacacacacauuauaauuuggauuuauuuauuuauuuauuuugcagcacagggcacaguaaaggauugaguaaaggaccccacacaagcugggcaagcauuuuaucacaacuacauccaaagcccaaggugcauuuauuuugaauguguggaacauacuaugugauuauucuuuuagguccugcuagaaagcaaaaaccccacagaauuauaauaauuccacuauuuggagaguuaaggagaugauuguugaaaggaaaguaacugcuuuaaaagagggacgggcuggaaaaauggcucagugguugagagcaggcccaaaagauccugaguucaauuucuggccaccacaugguggcuuauagccuucuauaaugagaucuggugcccucuucuggccugcaggaauaaugcaggcagaaugcuguauaaguaauaaauaaaucuuuaaaaaaaaagaaaggaaaguaauuggucuccacauaaagagauaugaaauaaaaugagccuggcggugcauaccuguaaucucaguauucaggagauagaggcaggaggauaucagggauuaaugccagucuaggcugcauagggaguuccuccuugagcuacaagagacccugucucaaacaaaacaaagcaaaacaagacaaaacaaaacaaaauaaacaaaaagacagaugagaagagagcagaagagagacagacagagagagacacacagagaaagcaauagccacaugugguggcauacuccuguaaucccugcacuugggagacuagagugggaaaaucccaacuuugaggcccacauagguuacauggcgagucccuguuucaaaggagaggagaaaguaggauaugaaaaaauuaagcugggccucauaggucaguuuaacuccuacuugggaagcugggguaggaggauuacaaguucaaugccugucucucuacuuuagagugaguuaacggcccauaugagccacuuggugugagcuuaccucaaaauuuaaaaagaaaaauuuuuaaaugguuaaauuauuagguaugucagcucacaccuaucaucuugggaaacugaagcaggcagcuugccaggagauugaggccaggaguggcuccauaguaaauuccaagcuagccucuacuacaggaugaaaucuagucuccaagaaacaaacacaaaaauaacaaacaaggggcuggagagaugacucagcaguuaagaacacugacugcucuuccagagguccugaguucaagucccagcaaccacaugguggcucacaaccaucuguaauggggaucugaugcccucuucccgugugucugaagacagcuacaguguauuuacauauaauaaauaaauaaaucuuaaaaaauaaacaagcauaccaaauaagcauggugguuugaguaucucuguuuuaugcucacucagguugcuuuaggcauaugaacugcaguggucauacagacacagugugguaaagaauuaccaauggauacaaaacauaguggauagaagcuuaugcagaauaggauagucauuaugcauuggaguuaccuuuuuuuuuuuuuuuuugcacacaucccuccuuuccacucaagauacuuuuuuuuuuuaauuacaaagggaaagcggugacuuuaaaguguagaaaucugguaugcagugcuuggauuaaaugauuaaguucauacuauuacugaaugggacaugcuaagauccuauaccuuuugauaggaugcucuaaaaagcagaguuugauuuguacauuauuuaucuaaucaugacacuagagaagcuaaggcaaaagaauugcaaauucuaggccagucugggcuacauaguaaguucuagccagucuggguuacauagggagaccuggcuuacacagaguuucuuuuuuuuuuuuuuuuuuuuuauuuauuauuuauuauauguaaguacacuguagcugucuucagacacaccagaagagggcaucagaucucauuaaggaugguugugagccaccaugugguugcugggauuugaacucuggaccuuuggaagagcagucgggugcucuuacccacugagccaucucaccagcccuacacagaguuucuuaagaagauacauauauaguauucuugccagaugcacaugaacuggaauccuuaggggaaaaaggucaauugaucucccagcacuugggaggcaaaggcaggacuuuuucugugaguuccaggccagcuuggucuacauagagaguuccuggucagccaggacuaaauagagaggccgugucucaacucccccacaaaaauuccaaaaaaaaaaaccaauaaagguaaaaccaauuaauguagguaauaggagacagaaugugaaaaauuugaagggacuguaauuggaagugagacacuagauccaauccucuggaguuuuagcaccauuuugaugcuggugccuuauguaaggucggugucucagcucuccuuuguagaguccgaaaccuuuguccaaagaguuaaccucccugcuuaguaaauacuacuuuauggaagccaucaagcuugaaacuacauuucccaaagaccuuccuauuuccucgcaggaacuaggaugacaauuucuauaggucaaccccuaaaucucgcgacaucucaccaauucucauuugggcucccugcugaaagccauuuuguuuuucaggacgcuuugcaaggguagcuggggugaauuugcaccaaggcagcagcauagucgccgcaguuccaucuucgucuccgcgauguugcccuuagccaaaaacgcacuaagccgucuccaaggugagcagauaaugugggcgaguucuuuacaacacccgggauccggcuguccucgugcucuucugcccucuuccuccgccccaaauccugcggguuuuaauucuaggugcaugguccccugcguggucuccagucacugggaagggaagcuagccauaacagagguagcugugacaguggcuuuaucauccuguccuuguguuccuaaccucguuaugcauucucuuucuucagagaccuaugauuuccaggaagaacgcuuuggcggacaccuugcucuuuuagcgaugaucuaaauuuuagcucugggaguguauuuacguagaagaacugaucuccuacaauaacggugguaggaaacuaaaucuaccgcaucuggauucauagcaagggguugaaaaccuuaagccuggcagcuuugaagaagucaucuguagauuauuaacggaauauuaacuauagcgaaaacaaucauggucauuuuuuuuuccugcuuuaaaguuaggcaaguacguggaaacuugagacuagcaguauauauggaaaauacacuggacuggaaagaaaaaaauucauuuuuguaauugcuuuacccugaaggugaccuucaguaaugugaaugaaggugaccuuacacaauacuuacuugcuuuucuagccauggauuuaguuuuauuuuaccuuuagaucacaugcuguguucuaaguacugaaguacuuugggaauaauugaaaaaaaaaaaaaagaaagaagcccaacugaucuuucaucugcuacaagcuguguuuauuauuucuuucacuuuggacaaaugauuuagcguuauaaacuuguuuuuguaaaacagagguuaguaaguaauaccuaugucaaagaccauuaaccaaucucuggucacuaaacugggugguuuuguuuguuuguuuguuuuuaauuuuauuuugguauagaggggagaucacuugguaaaucagaguguugaaacaacaguuguuugguaaucucaauuucuuugaucuuuaagugacuuagggacuuuuaaaaauacuguaggaaaaguuuuuuuaucauuuuuuuuuuuuuuuugagacaggguuucuuuguguagccuggcuguccuggaacuugcucuggagaccaggcaaaaagaugauuuuuuaguuuauuuuguuguguuucuguuucucauacucacccuuuuaaauguucuggagcagaauugauuauggaauguuuaugaauuugcuuauuccggcuguggcuguuuucugagggagggucucagguacacuagguuggccugccauuuuaaucuguagccaaggaugucuucaaccccugauccuuggccuccauuucccaagugcugggcuugacaaaguccuucccaccuuuauagaccuaauuguguuugcuucugaaguguuagcaaucaagucuagggaauguuaggcaagcacuacaccaaucccgcuacauuuauuucccuggguguggcugguuaaaggugaaaguggaaccguaaguaaagcagcuaauauaaugguuaaggaauuauuaggauuauaccacauagagaccauugguggugguggugguggugguguuuguuuugggggugagagaggauuugauagaauuugaacccaaagcucugccacugaauccaggcucuccccagccugaaacauuagugagggaacagcaguuuugucuuacccugcagcccagccuggcaugaaaauugaguauaguuuucaaccuuacccucccaaguacugagagaacagcuaugaaccgcugcaccucaauucaacauugcuuuuuccucugugucuguaaguaccuuuaaagaccuuuaaaacagggacuggcgaaguggcucagcgguuaagaacaccaacuacucuucagaagguccugaguucaaaucccagcaaccacaugguagcucacaaccaucuguaaugagaucugauacguucuucuggugugucugaagacagcuacaguguacuuacauauaauaaauaaaucuuuaagaaaagacacacaguaaagaccuuuaaaauaaugaggugguggugucuagauuugaagagaaaaacuauugacuuuuugguauuuaccacuuuuuucgaguuuuauuccuuaauaagcuaccuuuauaaccuuguucuucauccaaacuugauuggcucucugguacaguagaucuaucuaucucugucgauauuccauuuuucuuuuucuaauuaauuaauuuuuauuagauauuuucuuuauacacauuucaaaugcuauccugaaaguucccuauacccucccucugcccugcaccccuacccaccuacaaauccuacuugccuaaaugcugaguuaauucuacuuucuuguacaacagagaucaugucuucacauauaauacucccuucuaggcuagaaauuaccugaugauaaaaucucuaucauaacauuuuuucuacucuguuuuuugagacaaggugucaugcaccguaggcugacuccugauccuccugcuuuuaccuuccacgugcuugccugcuuauauacucuuauuauauaaucaaaaaccucauucuuuaccaauuauuuuaaaauccugcuuaccauagcuugggggcauaauuuuaaggugauaaacauuugauuuuuauuuuugcugugaaaauuuucaguaaugcagaaaaaaaugagaauugguaugaagaacauuuaccaucaugugucaacauuuuauuguauuuuuaaauguuucuguccacgugucacuuuaucauuuuauuucuuuuuuuuuuuuuuuuuuuuuuaaagauuuauuuauuguuauauguagguacacuguagcugucuucagacacaccagaagagggcaucggagcaucggauaucauugcagaugguugugagccaccaugugguugcugggauuugaacucagggccuuuggaagagcagucagugcucuuacccgcugagccaucucaccagccccuuauuucuuuuuuuaaagacuuauuuguuuuauguauguuaaguacauuguagcuguccucaggcacaccagcagggggcaucagaucccauuacagaugguugugagccaccgugugguugcugggaauugaacucaggaucucuaggagagcagucaaugcucuuaaccacugagucaucucucuaguccucauauuuguuuauuuuuuugaguuggagucuuuaacuggagcucaggguagccuagaauucacugucuagcccaguuuggccuugcacuugcggcaguucuccugucucagucccccaagagcugagccuucaggugugagccuggcaguugguuuuacuuucacagcgcuugagaaggugcuugucugcccaccugucuaaccuucuguucuuucuuucuuugauuuuguuuuguuuuggauuuuuuagagacaggguuucucuguguagccuugucugucuuagaauuggcuucuaaccaggcuggucuucaacacagaaaucugucugccucugccucucaagugcugggauuaaagaugugugccacuaccaccugaccacuuguucuugugguuaacauuuaguagucuguggaguugcuuugcuuuccuuauuggcaguuguguguuuuuauuuugauaacugauccauauacuucuguguucuuuucuaaguucgaagcauucagcaagugguggcaaggcagagccaccagaagagggcaccuaguuuccaugacaaauaugggaaugcuauauuagcagguggagccaucuucuguguuucuacauggacauauguaaguacuacuaguugauuauuucuucugcaguucuagggauugaacucaagguaucacacauguuaggcaagugcucugucauugagcuauaaucucaggcucaguguuuuuuaauuuagacauguuuuagucucaucuagucuaugaaaauguucaauuucuaguuaaggaaggauuggaaaggccaucugaucaucugaucauccacccaaugugugugucuuccuuugcauucagcaugcauucauccucuuaaugaccgguaacaaaguuuuuguuggauugcaaggcagcccuuuucugucuuguguaacuguaagaagaaucuuauuuguggagcccaagcaugaugguagaugucugcaaguaugagguuagccugggcuauauaauguacauagugagagcuuaccucuaaaacaguuagaauauucuaauguugaguuaaauauguucccuuucgaaauuuguacaucaguucauugcaguagagaaauucugacucaucauauuuccauaugacgucagcuaaaagauugcugucauauguuauaaaguaugugauuaacauugacagggcucuugaaaacaucuauagauaaguuggccagguuuuuuguuguauaauuccuggaguuucauauuuugagucaccuuccuagauauacuucagugacuggauuuccuuccaaaauucuguagucaaagcugaggcacaagccagucugguuggagauacacagcugcaaugccagcacuugggggguugaggcagauagacugaaagaagaguaagagcagcuagaacuauagcaagccucaggucugcugaggcuacauagcagacuuuuuguuucaaagcaaacaacccccaaaacucaaauguaauuuucuugauagaugaaauauaccuuguuuccauauuuuaggguucuacaucuguugucuaacaacuuauuuucuaguuaaaagucauaauuuuggaauuuuaauaaauauauuucuguguaaaugauacagauggcugugugagguggcacacaucuguaaucccaacaguagagauacaggaagaucaagaauuuagggacaucuuugcuacauaacaagucuaagguaacccugggccacauugaaccaaaccuggcucaauaaaacaaaagggauaauucaacccuugcuugaaaugaaauauacuauuaauauuaguucugaggauugaacccagggucuucuguaucuaagcauauucaugcaccuuuaaugaucuguacuuuugccuugucagauacugaaauaaaugaauucucuuagguaguuaugcuugacagaagcaauauuuuagagggagagaaaaauauaaaauacaguuuuuauaaaaaaagcauuuauucauuuuacauauacgaguacacuguagcugccuucagacacaucagaagaggacuucagaucccauuacagaugguugugagccaccaugugguugcugggaauugaaaucaggaccucuguaagagcuuuuaacuucugagccaccucuccagcucuaaaauauaguuuugauuuaagaacaauuucaaaauucauuuccucaguuuucuagccacauuccaucugugcuguuuuggguuuggggguaguuggagacaggguuucucuguauagucuaagcuguccuggaacucaugcuguagaccagggugcccucaaacucagagaauugccugccucugccucugccuccuuagugcugggauuagaugugugugccaucagacauuccaaccacuuaacauccagauguggccagugacuccuauauuggacagugcagauuuagaacauuuccuucagcucagaauggacagcaguuugcuuugauggcuauguaaaucacuauauccugggugacuugcuguuuauuguuaaacuaaggagcagacaaaauuucuuuguaauuuugaagauauaguuuccaaguugaggauguacugugguuuaaauauguauaacugacagccuuuuaauucuuacagacagccacacaaauuggaauagaauggaacauguccccuguuggcagagucaccccaaaggaauggagagaucaguagucgugccagcugguacaauaaucaaggaauuguuuaaaaccaacuuauaagugaaugccaagucaaagaaucauguacucauuauacuauggcagauugaagaacaaauaaagaaauaaaguaccuuaaccuucauucuaggcuuuguuuuuuuccuuuguaaaugaagcccaagcauggugacuucucauuuauuuaagcuguauugucucuuaaaauggcuuuuuacccuaugaggugguaugagggaaaucuaugaucaggagggcaccuuuauaguaagcugaaauuacagagaaugaagaaauaagcacagagcuguuuuaggagcccacugggucauuggccauauagguuaugcuuacugcccucuaccucgugguuauauuuggaauugccauuagcucccuucugcuuagagacuggacugucaccaaacccaaggggauagugauccuguaaugauccugugugaacuagguuugcuaaagacuaccaccuccuuacacuguauggcauauucaucugaaauaggugcuaauuuuucagcauaauccuuaaucuuuaggaucugucauacuuccuaguaauuuaacuguugcugaagaaauaaaggcuaucuguuaauccuggguuuaaagugauaagcuuugauacucau

SEQ ID NO: 9695 - RNA, 10359 nt, Mus musculus
augaguaucaaagcuuaucacuuuaaacccaggauuaacagauagccuuuauuucuucagcaacaguuaaauuacuaggaaguaugacagauccuaaagauuaaggauuaugcugaaaaauuagcaccuauuucagaugaauaugccauacaguguaaggaggugguagucuuuagcaaaccuaguucacacaggaucauuacaggaucacuauccccuuggguuuggugacaguccagucucuaagcagaagggagcuaauggcaauuccaaauauaaccacgagguagagggcaguaagcauaaccuauauggccaaugacccagugggcuccuaaaacagcucugugcuuauuucuucauucucuguaauuucagcuuacuauaaaggugcccuccugaucauagauuucccucauaccaccucauaggguaaaaagccauuuuaagagacaauacagcuuaaauaaaugagaagucaccaugcuugggcuucauuuacaaaggaaaaaaacaaagccuagaaugaagguuaagguacuuuauuucuuuauuuguucuucaaucugccauaguauaaugaguacaugauucuuugacuuggcauucacuuauaaguugguuuuaaacaauuccuugauuauuguaccagcuggcacgacuacugaucucuccauuccuuuggggugacucugccaacaggggacauguuccauucuauuccaauuuguguggcugucuguaagaauuaaaaggcugucaguuauacauauuuaaaccacaguacauccucaacuuggaaacuauaucuucaaaauuacaaagaaauuuugucugcuccuuaguuuaacaauaaacagcaagucacccaggauauagugauuuacauagccaucaaagcaaacugcuguccauucugagcugaaggaaauguucuaaaucugcacuguccaauauaggagucacuggccacaucuggauguuaagugguuggaaugucugauggcacacacaucuaaucccagcacuaaggaggcagaggcagaggcaggcaauucucugaguuugagggcacccuggucuacagcaugaguuccaggacagcuuagacuauacagagaaacccugucuccaacuacccccaaacccaaaacagcacagauggaauguggcuagaaaacugaggaaaugaauuuugaaauuguucuuaaaucaaaacuauauuuuagagcuggagagguggcucagaaguuaaaagcucuuacagagguccugauuucaauucccagcaaccacaugguggcucacaaccaucuguaaugggaucugaaguccucuucugaugugucugaaggcagcuacaguguacucguauauguaaaaugaauaaaugcuuuuuuuauaaaaacuguauuuuauauuuuucucucccucuaaaauauugcuucugucaagcauaacuaccuaagagaauucauuuauuucaguaucugacaaggcaaaaguacagaucauuaaaggugcaugaauaugcuuagauacagaagacccuggguucaauccucagaacuaauauuaauaguauauuucauuucaagcaaggguugaauuaucccuuuuguuuuauugagccagguuugguucaauguggcccaggguuaccuuagacuuguuauguagcaaagaugucccuaaauucuugaucuuccuguaucucuacuguugggauuacagaugugugccaccucacacagccaucuguaucauuuacacagaaauauauuuauuaaaauuccaaaauuaugacuuuuaacuagaaaauaaguuguuagacaacagauguagaacccuaaaauauggaaacaagguauauuucaucuaucaagaaaauuacauuugaguuuuggggguuguuugcuuugaaacaaaaagucugcuauguagccucagcagaccugaggcuugcuauaguucuagcugcucuuacucuucuuucagucuaucugccucaaccccccaagugcuggcauugcagcuguguaucuccaaccagacuggcuugugccucagcuuugacuacagaauuuuggaaggaaauccagucacugaaguauaucuaggaaggugacucaaaauaugaaacuccaggaauuauacaacaaaaaaccuggccaacuuaucuauagauguuuucaagagcccugucaauguuaaucacauacuuuauaacauaugacagcaaucuuuuagcugacgucauauggaaauaugaugagucagaauuucucuacugcaaugaacugauguacaaauuucgaaagggaacauauuuaacucaacauuagaauauucuaacuguuuuagagguaagcucucacuauguacauuauauagcccaggcuaaccucauacuugcagacaucuaccaucaugcuugggcuccacaaauaagauucuucuuacaguuacacaagacagaaaagggcugccuugcaauccaacaaaaacuuuguuaccggucauuaagaggaugaaugcaugcugaaugcaaaggaagacacacacauuggguggaugaucagaugaucagauggccuuuccaauccuuccuuaacuagaaauugaacauuuucauagacuagaugagacuaaaacaugucuaaauuaaaaaacacugagccugagauuauagcucaaugacagagcacuugccuaacaugugugauaccuugaguucaaucccuagaacugcagaagaaauaaucaacuaguaguacuuacauauguccauguagaaacacagaagauggcuccaccugcuaauauagcauucccauauuugucauggaaacuaggugcccucuucugguggcucugccuugccaccacuugcugaaugcuucgaacuuagaaaagaacacagaaguauauggaucaguuaucaaaauaaaaacacacaacugccaauaaggaaagcaaagcaacuccacagacuacuaaauguuaaccacaagaacaaguggucaggugguaguggcacacaucuuuaaucccagcacuugagaggcagaggcagacagauuucuguguugaagaccagccugguuagaagccaauucuaagacagacaaggcuacacagagaaacccugucucuaaaaaauccaaaacaaaacaaaaucaaagaaagaaagaacagaagguuagacaggugggcagacaagcaccuucucaagcgcugugaaaguaaaaccaacugccaggcucacaccugaaggcucagcucuugggggacugagacaggagaacugccgcaagugcaaggccaaacugggcuagacagugaauucuaggcuacccugagcuccaguuaaagacuccaacucaaaaaaauaaacaaauaugaggacuagagagaugacucagugguuaagagcauugacugcucuccuagagauccugaguucaauucccagcaaccacacgguggcucacaaccaucuguaaugggaucugaugcccccugcuggugugccugaggacagcuacaauguacuuaacauacauaaaacaaauaagucuuuaaaaaaagaaauaaggggcuggugagauggcucagcggguaagagcacugacugcucuuccaaaggcccugaguucaaaucccagcaaccacaugguggcucacaaccaucugcaaugauauccgaugcuccgaugcccucuucuggugugucugaagacagcuacaguguaccuacauauaacaauaaauaaaucuuuaaaaaaaaaaaaaaaaaaaaaagaaauaaaaugauaaagugacacguggacagaaacauuuaaaaauacaauaaaauguugacacaugaugguaaauguucuucauaccaauucucauuuuuuucugcauuacugaaaauuuucacagcaaaaauaaaaaucaaauguuuaucaccuuaaaauuaugcccccaagcuaugguaagcaggauuuuaaaauaauugguaaagaaugagguuuuugauuauauaauaagaguauauaagcaggcaagcacguggaagguaaaagcaggaggaucaggagucagccuacggugcaugacaccuugucucaaaaaacagaguagaaaaaauguuaugauagagauuuuaucaucagguaauuucuagccuagaagggaguauuauaugugaagacaugaucucuguuguacaagaaaguagaauuaacucagcauuuaggcaaguaggauuuguagguggguaggggugcagggcagagggaggguauagggaacuuucaggauagcauuugaaauguguauaaagaaaauaucuaauaaaaauuaauuaauuagaaaaagaaaaauggaauaucgacagagauagauagaucuacuguaccagagagccaaucaaguuuggaugaagaacaagguuauaaagguagcuuauuaaggaauaaaacucgaaaaaagugguaaauaccaaaaagucaauaguuuuucucuucaaaucuagacaccaccaccucauuauuuuaaaggucuuuacugugugucuuuucuuaaagauuuauuuauuauauguaaguacacuguagcugucuucagacacaccagaagaacguaucagaucucauuacagaugguugugagcuaccaugugguugcugggauuugaacucaggaccuucugaagaguaguugguguucuuaaccgcugagccacuucgccagucccuguuuuaaaggucuuuaaagguacuuacagacacagaggaaaaagcaauguugaauugaggugcagcgguucauagcuguucucucaguacuugggaggguaagguugaaaacuauacucaauuuucaugccaggcugggcugcaggguaagacaaaacugcuguucccucacuaauguuucaggcuggggagagccuggauucaguggcagagcuuuggguucaaauucuaucaaauccucucucacccccaaaacaaacaccaccaccaccaccaccaccaauggucucuaugugguauaauccuaauaauuccuuaaccauuauauuagcugcuuuacuuacgguuccacuuucaccuuuaaccagccacacccagggaaauaaauguagcgggauugguguagugcuugccuaacauucccuagacuugauugcuaacacuucagaagcaaacacaauuaggucuauaaaggugggaaggacuuugucaagcccagcacuugggaaauggaggccaaggaucagggguugaagacauccuuggcuacagauuaaaauggcaggccaaccuaguguaccugagacccucccucagaaaacagccacagccggaauaagcaaauucauaaacauuccauaaucaauucugcuccagaacauuuaaaagggugaguaugagaaacagaaacacaacaaaauaaacuaaaaaaucaucuuuuugccuggucuccagagcaaguuccaggacagccaggcuacacaaagaaacccugucucaaaaaaaaaaaaaaaaugauaaaaaaacuuuuccuacaguauuuuuaaaagucccuaagucacuuaaagaucaaagaaauugagauuaccaaacaacuguuguuucaacacucugauuuaccaagugaucuccccucuauaccaaaauaaaauuaaaaacaaacaaacaaacaaaaccacccaguuuagugaccagagauugguuaauggucuuugacauagguauuacuuacuaaccucuguuuuacaaaaacaaguuuauaacgcuaaaucauuuguccaaagugaaagaaauaauaaacacagcuuguagcagaugaaagaucaguugggcuucuuucuuuuuuuuuuuuuucaauuauucccaaaguacuucaguacuuagaacacagcaugugaucuaaagguaaaauaaaacuaaauccauggcuagaaaagcaaguaaguauuguguaaggucaccuucauucacauuacugaaggucaccuucaggguaaagcaauuacaaaaaugaauuuuuuucuuuccaguccaguguauuuuccauauauacugcuagucucaaguuuccacguacuugccuaacuuuaaagcaggaaaaaaaaaugaccaugauuguuuucgcuauaguuaauauuccguuaauaaucuacagaugacuucuucaaagcugccaggcuuaagguuuucaaccccuugcuaugaauccagaugcgguagauuuaguuuccuaccaccguuauuguaggagaucaguucuucuacguaaauacacucccagagcuaaaauuuagaucaucgcuaaaagagcaagguguccgccaaagcguucuuccuggaaaucauaggucucugaagaaagagaaugcauaacgagguuaggaacacaaggacaggaugauaaagccacugucacagcuaccucuguuauggcuagcuucccuucccagugacuggagaccacgcaggggaccaugcaccuagaauuaaaacccgcaggauuuggggcggaggaagagggcagaagagcacgaggacagccggaucccggguguuguaaagaacucgcccacauuaucugcucaccuuggagacggcuuagugcguuuuuggcuaagggcaacaucgcggagacgaagauggaacugcggcgacuaugcugcugccuuggugcaaauucaccccagcuacccuugcaaagcguccugaaaaacaaaauggcuuucagcagggagcccaaaugagaauuggugagaugucgcgagauuuagggguugaccuauagaaauugucauccuaguuccugcgaggaaauaggaaggucuuugggaaauguaguuucaagcuugauggcuuccauaaaguaguauuuacuaagcagggagguuaacucuuuggacaaagguuucggacucuacaaaggagagcugagacaccgaccuuacauaaggcaccagcaucaaaauggugcuaaaacuccagaggauuggaucuagugucucacuuccaauuacagucccuucaaauuuuucacauucugucuccuauuaccuacauuaauugguuuuaccuuuauugguuuuuuuuuuuggaauuuuugugggggaguugagacacggccucucuauuuaguccuggcugaccaggaacucucuauguagaccaagcuggccuggaacucacagaaaaaguccugccuuugccucccaagugcugggagaucaauugaccuuuuuccccuaaggauuccaguucaugugcaucuggcaagaauacuauauauguaucuucuuaagaaacucuguguagggcuggugagauggcucaguggguaagagcacccgacugcucuuccaaagguccagaguucaaaucccagcaaccacaugguggcucacaaccauccuuaaugagaucugaugcccucuucuggugugucugaagacagcuacaguguacuuacauauaauaaauaauaaauaaaaaaaaaaaaaaaaaaaaagaaacucuguguaagccaggucucccuauguaacccagacuggcuagaacuuacuauguagcccagacuggccuagaauuugcaauucuuuugccuuagcuucucuagugucaugauuagauaaauaauguacaaaucaaacucugcuuuuuagagcauccuaucaaaagguauaggaucuuagcaugucccauucaguaauaguaugaacuuaaucauuuaauccaagcacugcauaccagauuucuacacuuuaaagucaccgcuuucccuuuguaauuaaaaaaaaaaaguaucuugaguggaaaggagggaugugugcaaaaaaaaaaaaaaaaagguaacuccaaugcauaaugacuauccuauucugcauaagcuucuauccacuauguuuuguauccauugguaauucuuuaccacacugugucuguaugaccacugcaguucauaugccuaaagcaaccugagugagcauaaaacagagauacucaaaccaccaugcuuauuugguaugcuuguuuauuuuuuaagauuuauuuauuuauuauauguaaauacacuguagcugucuucagacacacgggaagagggcaucagauccccauuacagaugguugugagccaccaugugguugcugggacuugaacucaggaccucuggaagagcagucaguguucuuaacugcugagucaucucuccagccccuuguuuguuauuuuuguguuuguuucuuggagacuagauuucauccuguaguagaggcuagcuuggaauuuacuauggagccacuccuggccucaaucuccuggcaagcugccugcuucaguuucccaagaugauaggugugagcugacauaccuaauaauuuaaccauuuaaaaauuuuucuuuuuaaauuuugagguaagcucacaccaaguggcucauaugggccguuaacucacucuaaaguagagagacaggcauugaacuuguaauccuccuaccccagcuucccaaguaggaguuaaacugaccuaugaggcccagcuuaauuuuuucauauccuacuuucuccucuccuuugaaacagggacucgccauguaaccuaugugggccucaaaguugggauuuucccacucuagucucccaagugcagggauuacaggaguaugccaccacauguggcuauugcuuucucugugugucucucucugucugucucucuucugcucucuucucaucugucuuuuuguuuauuuuguuuuguuuugucuuguuuugcuuuguuuuguuugagacagggucucuuguagcucaaggaggaacucccuaugcagccuagacuggcauuaaucccugauauccuccugccucuaucuccugaauacugagauuacagguaugcaccgccaggcucauuuuauuucauaucucuuuauguggagaccaauuacuuuccuuucuuuuuuuuuaaagauuuauuuauuacuuauacagcauucugccugcauuauuccugcaggccagaagagggcaccagaucucauuauagaaggcuauaagccaccaugugguggccagaaauugaacucaggaucuuuugggccugcucucaaccacugagccauuuuuccagcccgucccucuuuuaaagcaguuacuuuccuuucaacaaucaucuccuuaacucuccaaauaguggaauuauuauaauucugugggguuuuugcuuucuagcaggaccuaaaagaauaaucacauaguauguuccacacauucaaaauaaaugcaccuugggcuuuggauguaguugugauaaaaugcuugcccagcuugugugggguccuuuacucaauccuuuacugugcccugugcugcaaaauaaauaaauaaauaaauccaaauuauaaugugugugugugugugcacgcgcuuguguguauacugaggaaauauugaggauuaaaccuauguguuuacaaauaacaguuaaauguccuaucaacugaucuauauuuccccaaugucuuaggguuacuguugccauguuauaacacccugaccaaagcaacuucaucaggaguugcagucauaggaacaguacuuaagccaucuucaagaauaguaugugcuugaaaaaaagauugguguggggggguggcagcgugaauguacaugcaaugggugugugccuggucucuguaaagaucagaagagugcaucagaucuccugggacuacuaggcuguuacccaccaugccggucccgggagggucuucucccaaaaacaguuaaauguucucaacccuugagacauuucuccagcaccugucccagaguauuauacuaaaggagcaaauuucaacaaaacaaaacaaaaccacuuuugauguaagauauuuggauguuuuggguguugucagcgcugagguuugggcugagaaauuaauuuugcuuaccagaggguauaaugcaagcuucugcuuuagaccacguaguucccuuggacuuggcuagaauggaacucugaagguuccuugaauuguugaauuccuaaucguccugccuccacuuccaccucccaaaccugggaguuuggcugggagaaaucacgagggcuccuuuauguuugagacaaucuuacauuaaucagguggccugggauccggacaauggagccaaagaugaccuugaacaauugaugcucuugcuuucacauucaaaaugcguggauuagaggcuuuuguuacuuaggccagcucaaaaucaaacaguucuaaaggaaggaacgcuuucuagaugaugauuccauuuuuaaacguacaagccauuuugugccucaa

SEQ ID NO: 9696 - RNA, 16602 nt, Mus musculus
cgggggcgggcucaggggcgggcucaggggcggggcgggcgcccgaagguccuccggaggcccggcauucugcacgcuucaaaagcgcacgucugccgcgcuguucuccucuuccucaucuccgggccuuucgaccucacgguguugccaaaaugucgcuuuccaacaagcugacuuuggacaagcuggacgugaaggggaagcgggucgugaugagguaauuccguacugcugcccucaagcccucggggccacauucucucuggccguggcaagcacgguuuucccaucaccuuaaguugcacuuauuuuucagcugggucuuggggguccuggguuuggagguuaaggcuguuccucucaccucauuggggcggagacugugucugaguuugcuuuucugcguccuaacugcuucuagcuuaaaaagcgaccaaauguguccuuuagggaguugaucccacugauaaagggcucagauucucaggacucaaucuuuuucccauuucugaagugcaguuucaucucuuguagcgagaauggacguaguacuuauccugcaaaucucuaggccccugcugagggaccuugaaaggucauuuagcuaguuucccuucccccaagauucuuggaccauccgugacgaauccgaaaccgcccacguuucauugguccugguacaaaugauuucuuucccaaaagauguugcucaaaguccucucgaguggaggucccucuccccaaagaauugugggugggagggugaggcccacuggaugaagcucuguauggcuuauauaacaggccucugcugcccuaccuugcgguuggacuccuggcccugggguuugcaucaggauugugacacaugcaggguguggccgccgggaguuggaggccuguaaccucacucgagagguggcuagagaagcaggaugucagaacugaggaaggcucccacgcacguggcacaugugggucccaggucacugacuuaacuuggcuucucccuuaccugaaagaauuacuaggguguaugcgucuucuccuuuuugccuuucauaauguauacuuuuuuuuuuuugccaggagucaaggaugaugguuagauacauaacugaugggccugguuguucauguaacaacuauaggacccaaggaugggaauuuuuaagggccauugauggucgcagugacugacuacucugccugcuugaccuucuuuggaaguggaugacugauuggcaguaauccuggucccuuugaagauuugggccaguucaagugagggcauccuuuagauacuaacacauguaagggaacagagguucucuggcuucuguacaggcacuuauuuuaucguagccaauauugguagguggccuucucuuccugggcugauauccagaaccaacccacuguauuauguucaugcaaaacacuuaauguuaccccaaaugggauagaauaaucaggauggagcagaaaucccagccacccuaaucauagauaaagggcagguucuagcuaacuuuucauucuguucuaaggacaaaagauucauccugugagggagacaggcacuacuggcuugaggcugaccuuuucagaugcaugcagcugcucaaagacaagacagugggccauugugcuggucacuuuugugggauggcaguuugggauuuuaugcuauuuucuacagagaaacuaucuuaaaggaauuaacuccgguugagggugagacaggaggcaacaguucucuuuugccccaaaucaagcuucauuuaacccagguuaaccuuuaagccuggaaaagacuggcuggccuccuuuggcugauggaaaagggcgcugugaagguuauugaggucuagagaauguagcagaggcaggacuaggauuugggucucuuuagcuccuugagccugacucaggaacagguugggauagacuuuaucugucgaguuugcaguccuguauaauauggauacauuguacuugguugguauuuaggccacaguggugaaguugcuugguuuccagauuaaugcaucuugcauggggaguugccuuguaggcuucugugaggagucuaggcagccaugccugggugagcucaauaccuuuuuuguuucagugccuuuugugguaguugcuggcagugcuucagaaauggggccuccugcauccugggcccguucacucaccuccuuucugcccuguagaagggugcucuuguuuucugacuagucccuugcuuuaaguuggcaagggaaguugauuuguuguugguaacuuuuauuaguuuucauuguguuggggaaucuaacacuagccaccuugugccugagcacccuaccacugagucaccccaguuccuuuuggagaaacuuuaaaauaagccagaaacaccaacagguuccgccucacucuaguugauuuuacaaggcucugugaguacauuuccugcugauuuuugucaugucauuuccuuuucacccauaggucccuagucauccuuugcuugcuggcacuucucuuucuuguacguuuucuucccucaaccucacugguuuucuuuugggacuuucgaagcaacagcucuggugggaagaggaaaacggagagcagacaccaucguacuagcagacuuuagcaaucaguccacaaggcaguggugggcaugguuccuucccauaguuuuaguagaacagggccuggaaucucgagauuucaacaaagacgugauauucuaauuuaauguucucuauauaaaguuuuuguuuuguuucuuugcuuuguguuuuugaaguccuggaacucaccaaguuggccuggaacucuugccucugccuccugcggggugugcuguagccaccaccauucugcuuugaaaaaguuuuauuuuggaguaauuauggaguuguaaaagauugcaaagacugcacagaaacucaguuuuucccaguauauacguauuuagauguauguaugcucaguauauauguauauauguguguguguauacaccacguuccccacccccaagugaacaagugauuuguguaaggaacguuguuccugcuuuggagucuucaggagagaagcuaaaggccgaguuguaagucuaggagagagugaaggucaaaggcaaucaagaggucagugagaacuaauccaguuuucaucgguaagcugaugucaucacagcuuggauagaagccacagaugguuggauauuuuagcccaaaggcauucauuccuucuuguaagguucugggugcaggaagcagcacuauccacccugugcaguuaacccuuuugucuauuaucuucucuaggaggcugcaagagggggaacucaguccugguaaugggauauuggaucugcuguggucugcacuuuaaggcuggcaagggccugcucaggauauuuaaagagggugccuuaagugccugaaaccaacuagagugcauuucuuuuuucuuucuuucuuucuuucuuucuuucuuucuuucuuucuuucuuaucuuucuuuucgagacaggguuucucuguauagcccuggcuguccuggagcucacuuuguagaacaggcuggccucgaacucagaaauccaccugccucugccucccaagauuaaaggugugcgccaccacaccuggcuuagagugcauuucuuuguucagaggcacacugccuuuuaauuuuaaaucggaaucaagaaguaugucccucaagcuccuuugugcgguagauuggucuucaggguagagaggaagccagugaccugcaggguuuguggucacugcagacgggaaagaccagugaaaaugggaaagauggaguuucauaaucaagaccaguggcagucuugaccccucauugcagccccuuagugagugguaccaaaaguaaugcuuuuauuaucguucuuucaaauagcaguuauaguuuggggaaucaauggcauauaauaacuaacaccagugugauacuagguggcacuucuaaaccuuuuaacauuuauaacucuuagccagauacuauaaucauuucacagauuuaagaaaaaaauaaugaaaaaugucuuggguggaugucuugguauauacuugaucuuaguauucauucaggagaugaaugaaggcaagcuacauggcagaaaaaucucucaaaaucauggcagacacaacuuaguaaaaucaccaccccguaggaaaggguucagaaucgguuccuaaugguaaagcaggacugggggugucgugcucaggucccuggguucaauccccagcaccagcacaaaaaagaaaggcagucaucuguuaggucagaaggagcaucuucauuguauuagcuuguauuuucuugaucauaugccucccacuuaucuauugucagugggccgaggcacaucucacucauuuucccccccucagguuuuuuugaaagccacuauuaucuaauauugaaguauuguuuugccuauucaaguuccaaucaggcauucucuagaaagaaggaaauucucuugcuguguuuuuuuguuuuuguuuuuuuaaaauuucuuuucuuuggggaauguuaucccaaggagccagaagcaauaucaagauaacuagaaucaaggggcguuacuuauuaccuguuccccacucagacugcuacagagaccaucacacuaaacagaauuaagcucaggcccuuguggaguugagacaauaacuugcuuucuuccacccaugggucuuggggauaacacucagguagguggucaggcuugccaacaagugcccgugcccugagccaucuugccaacccugucuuuuaacgacuucaauaaaauacuuagggaccaagaaauugaucauggcuacgaaacugaaaccuuuuucuuuucuaggguggacuucaacguuccuaugaagaacaaccagauaacaaacaaccaaagguaagauuccucuuaaaccuggcuuagguuauauuugaguaucuggacuacaaauuucuuucuuuccacacugggaguacagcaguugaagccaugguuuugauuuacuaaccugucagugugggaguuaauauucuaaauuuaugaaaaaauauuguauuaaaaaacaguccuaagcagggugugguaggguaugccuauuccuuuagucccagcacuugggaggcagaggucucaucuugagaccgaaaacaaccuggucugcacaaagaguucuaggauagccaggucuguagagagauccaaggaaaaaaaaagcaaaaaaucaaaaaacaaaaaacccacacaaacaaaacaaacaaccuccucugcuggucgucccccccgccccccccaaauauagcuugacauaaugguguaucccuuuaauccuagcgccugggagucuggauuuaggaggcccaugaguuuuaaguugaaaguagccugagguauuacaaagccaguuucaggucauccuaggcuauacaacgagccaaaaaaagugaggggucaauagcaucauaaaaagaagcagaaaauuccagaccuucccuggcccccuccccccccaggaaaagacccucagcuaccaacagccaaaacaucccaagagaguccuuauuuaaaaaaaaauuaaggaauuuggaguuucuauuuuuuaaaagacuauugaaguuaaaugcuaauugucuuaugaaacaagcuauuuaagagaacuguuaauaucaguaaauuuuagcauugcauguagucuugggguuuguucuaaauagcccagauaaaguauuuuuguuguuguuggugguggugggggaguuugguuugcuugugccucuaauuuggguacuagcuuaagaagcaaaguuucuuugcuuuuuuguuuuuuguuuuuuuauugagacaggguuucucuguguagcccuggcugucuuggaaaucacucuguagaccagguuggcuucacucagaaaucuuccugccucugccucccaagugcugggcucaaaggugugugccaccacugcacagguagaauuucuuuguaaagauuuauuugugugugugugggggggggggaggggggagugguugccuguggaggccagaagagggcauuggauggauacacuggaggugaaguuaugguggcuguaagccaguugauggcugcuggaaacugaacagcccucuagaauagcuacaauccuucuuaacuacuguguacucuccagugccccugcagaaacggaauuuuuauauaauagcacuguugagaaaauuuauaagaaagacuuuauuucagaacguuauucugagacauuguuucaguuuaugcugggcuugaccugcggaccuucuugcuuaggccuuccaaguguugguuuacagguguauucuacaaagccuagcuuuuuauuuuaaguuaaaacauuuuuuaaagauuuauguggguauagauguuauguuuuguuacugaaugguaccuuguuuucuccaucugcuguugggcaaugagguagacuauuucagccauuacuagccaaugguauaguaaacucucgcauagaaaucuuuuuguauguuaauuucacuuccuuugggucccuaccaaaugacucugcucacacggguaccuucuaccuagcagcuaccguuucagcccgagggagcaggugucgauuguguauuaccuugcuuauacagaauguaagaaacagugaacagcuguugucagagcacugaggggacgacacuuuaaaaccuggggccauuuguuugcaggcauggccucauguguccgaggcuggccucaaauuugcuguuacuuacugaggaugaccuugaacuucggagucucucucuccucuaccucccaagugcuggcaucacagaugggcaucaccaugugcaguuuguguggugcugaugauagucccagggcuuugugcaugccagggaagugcuuuaccaacuaagguguguccccagccccugaaccagcuaacccaggcaggugcuucaggcuugcuaaguuguuuucugcaugaggaacagguccauaaugagacuauguaaggccagguggcagcuuuguaucauguuugucuucugaacucaucggaauucugcaacuguuagaccugaggaaccuuggaggagaaagggagauuuauuuugugaagucaugaguucaaauaguucccacuaauuccucggaauaacauuguucugccuucuguuuucucuugguuauaggaucaaggcugcuguuccaagcaucaaauucugcuuggacaauggagccaaguccguuguccuuaugagccaccugggccggccugaugguguucccaugccugacaaguacuccuuagagccaguugcugcugaacucaaaucucugcugggcaagugaguacagacagggcuguggugcuggcgagcuguaagguagucagcaggcugccugccacugggucucagcuuucaggccacuccagucucuucaucucuuguucccccuucccccagggauguucuguucuugaaggauugugugggcccagaagucgagaaugccugugccaacccagcggcugggacugucauccugcuggaaaaccuccgcuuucauguagaggaagaagggaagggaaaagaugcuucuggaaacaagguaggaccugugauuuugauauuauugggccauagggucucaauuugcaugaggccaugaugaaagaauaggggaaacuuuucccaagcuuuuuuuuuuuuuuuuuugguuuuucgagacaggguuucucuguagcccuggcuguccuggaacucacuguguagaccaggcuggccucgaacucagagauccgccugccucugccucccaacugcuggaauuagaggggugugccaccacaccuggcccaaacauacauguaacauacauguaaaaaugcauagauggggggugcucuauggaugugguaguggacaaugcccuggguacaaacaauuguauaaaugcacagcacgauguuucugaauuaccaaagcauaaucugucauggaauggaaugugaccagcagugcagauggucucuuucuguucaugucugaaauaccuuugaaaacauccucgauuggauaacugauaugaguauugagugaagguaauggcaauagugagauuacuuuaaggaauuccuuuucuuuugaguuggguaggugugguuugagauaaguucucacguagcuccugugcuguguggcucaggcuggucuuaaauuugauguagccuaggaugaccuugaacuccuggucuuuuccaucuucgcagugcugggauuagaggcauguccuggcacaccuggcuaaaggcauuuuuuaaugaaauauaauguuuucauuaacauguguagguaugucaucaucauuugcuaaagaaaggggguuucagaaaggcagucauuuugcugaagucacuguugcuuuauggguucaugaaaguccauuagaucuguaagcucuacaaagauccacaugguaaauguuguagacuuuguggaucauguaguuaauugugcacaguuugaaucuacuccccugccauuauccuagaaaggcuguuguaggcaauccacuagacuggcuccuagaccugacagcagaauucaacuaccaaaaguguucaagccgccuuuuugagcaugguauuggauuuacccuuugguuagaaggggcacgaauggcacuuccuaguauuuucucuuuggcucuucaaugaugugagaacaagacacucugcgguaucaguucuccuuugaccucugacauuucuuaaggcaucuggaguguuugcuuucaagcaguuucuuuucuuagcagcacaggcccugagcuuggcccuauccuccuuugcugugcuugcuagcuacuacaguacuacuaguuaaaugcugaccuaaaauuugcugcccuuuuaaacugaaacucaagacucaagcucuagugcuuagaaauggcaggagcaacuggaaagucgaugcagaguguuuauucaggaaucaaugaacugacucuguaucugacuuaguugggucaguugcuauucagagucuaauggcuuagaaugccugaaaguucaaacuggacacaaacauaagacaguucaacuuuauuuuuaugauguguauguauauguguguacaggugcacaaagagggccacaagugccaggcacuguugugagacugccaggcucacugguugugagguccaguauguguuguggaggagcagcaagugccacuggaccaucuguccacccucaauggaauguuauucagugugucuacauuguuauuuuuagaauuaacauugccuuccuuguacccauugucaggucaaaaaaugggaauugucacgauuguugguuucuauggcaucuuuuccaugaaaagcuuucaauuucuuauuuucccucaaacauuuuuguuuugaaaaauuuauuauguauuuagugugugcauauauauguguguauaguuuuccgggagaggcagaggggauaagaaaugagcaaaugauugacccucuugcuaguugugaaacuuacuguccuacuaagucagggucuugaagauguucaagaggauucuugguggucugaaaugcuuuuggaguuuuguggagucaucaacauuuucuauauuagauuuuucuuuuuaaacuucucucugcagguuaaagcugagccggccaaaauugaugcuuuccgagccucacuguccaaacuaggagaugucuaugucaaugaugcuuuugggacugcacaccgagcccauagguaccaaaaagaaccuugucaguacuaggcagagcgcacugaucuuaggcaccugagacauucagauucugggcuguuuuuagagauuacaaucuucuauugcauugguugugauuuagacacucaaaucaaaagcauuuugggcuggaggguuccucuucgagggagcucuagguuguccuagguugacaauaagaaccaagagauauuuuuaacuucucucuacuuggugcuauaugaaccuuguuaaauauccuguuucaaaguggaaauacagauaaaaaauugggaguacuaaauaaagcuugucuuguauagcuucaggaacaggcuucuccaacuucggaugccuuuuguagaauuuucuuaccuuuggaaacauacuaucaaaacauguucucaucaacuggcugaucauauucugugauuaaccuccggccuauugaaaacuauuaacuaaguauguuuuuccuuccuauuguguuuugccugcauguuucucugcaccauguauaugcagugcccucagaggccagaagagggcguuuguuucccugggacucgaguuacagaggcuuuugagcuguacuuuggggacuggguuuagaauccagguucuccaagaacagcaaaugaucuuaacuccugagccaucuuuccaacccuuuuccuggguaucuuccacgucaguucauugcuuuuuuuugcccuugauuauaaacuauuagucagaaaaguuacguaagauguaaguggcuuuauugcaauuuagggaugaaaccagucucuuaguaucuuagugaugaaagcaguuuagugguauggaacugacuucuagguggggacaugguacaauuugacuagauuuugaauacauuuuucuuuuuuucccuagcuccauggugggugugaaucugccacagaaggcugguggauuuuugaugaagaaggagcugaacuacuuugccaaggcuuuggagaguccagagcgacccuuccuggcuaucuugggaggguaugaaagaacacuuuuggaucauacuguaaauaguguuggccugguagugguuauaacaugggguaacugaggacaguuuaauaaagggacaguuuacagaggucaggucagggaugcagggcugaucaucugguagaggaacaaggaacuuggacugcuuggacgagaaagcugcauuuuacuuagcauagcuguuaggcagcagccucuuucugcuuagagaaccaugacccuucaauggacuguucccccacccuccaugacuaaugcauacucugcauuuccucaugaaaaauugacucuaggauugucaguuucacacaacauaguugcucccuggacuucaugagcucuguuucagggucuccuuagagaaaccaagauguguauagggcuuuguguugucuuaaaauccugaaaacugccaggugugguggcgcacgccuuuagucccagcacuugggaggcagagacuggauuucugaguucgaggccagccuguucuacaaagugaguuccagguuagccaggacuauacagagaaacccuguuucgaaaaacaaacaaacaaaaaauccugaaaacuuugaaccuuuuuuuuuuaauguaguuuuauuuaauguaugagcgcuuugcugcauauacaucugccugccugaagagggcaucagguccccuauagaugguugugagcuaccaugugguugcuggggauugaacucaugaccucuggaagagcagccaguguucuuaaccucugagccaucccaccagcccugugaaacuuuuuuuuuuaaaaauaucuuuuuuuuucuacuuuauuuuuuauuggauauuuucuuuuuuugaaccuuguuguuuuuuuuuuguuuuuguuuuuucaaggcaugguuucucuguguagcccuggauguccuggaacucacuuuguagaccaggcuggccucgaacucagaaauccaccuaccucugccucccaagugcugggauuaaaggcgugcgccaccacugcccggcugaacauuuuuuaaugaguuaaaagcaucagacucuggucuuuggcuucuucacguuaacauuugagcuaucuggguuuguucugaaugaagaucuggaauaugggagugaaugcccccugcuggugauauugagguuucagaauaagccugaaauacagcagucuuccuucaaccacaggggauauguuggaagauuucugaacacuuaaagcuaaggauagugugaacacugaucuauaggcaguaggcagggaggcacacugggccuaguauggaauuuggaaaccuuaaagcccacucccagugacauuccuuccaacaaggccacaccuccucauccuuuccagacaguucagcuggggacuaaguaugcaaguaggagucuauggagacuauuuucauucacacccuuaguuacuaaucuggcaaucugggccuugugaauuuuggaugggagcaugguuguuuagauaggggaauuuugcuuuucuguuuauggugcugagaauaaacccagggcuuuacacaugggaucaacgcagagaggguuggagaaauggaaacuuuaggcaguacuuuuguugcuuuccuacuguggcuuugaguauuagcacuacacucaucaguugugcuguccuugaugauucuugcuuuuucuucuagcgcuaaaguugcagacaagauccagcugaucaauaauaugcuagacaaagucaaugagaugaucauuggugguggaauggccuuuaccuuccuuaaggugcucaacaacauggagguagggagccaauggcaaguggcugugacaugguucgcuaaggagcaguuuauguaaacuugaugugaauccuacagacauuuccauucaaucugugaaguugcuuuugucccuguauuuauagcugaggguugugaccccuggguggguuaaaaauugacccuuucacagugguugcauaucagauaaucugcacaucacauauuuacacuacaauucaugacagaaacagaaucacgguuaugaaguagccaagaaaagaauauaaaagggucccagcauuaggaagguugaaacucauagcuuuauaguguguuaugauccuguguguuuuaugagucaguuccguucuuaguauaggggcugaucuucaucuccuugacuuucuuguauagauuggcacaucucuguaugaugaagaaggagccaagauugucaaagaucucauguccaaagcugagaaaaauggugugaagauuaccuugccuguugacuuugucacugcugacaaauuugaugagaaugccaagacuggccaagcuacuguggccucugguauaccugcuggcuggauggugagucagcuggcuguucgcuuauggaagggaucagaaauuuuuggcaucauucauucauccauucauucaucuagcagauuuuuuuugugacauuggagauccaucugugugucucauagauguuaagaaaugagcuaccccugaguucuucccuccaaccgucuccaugggaacugucaacacugcaaaugaugcagugaggaccgaccugagggcaaaucccugggguaaaagcagugcuggcacauuguugcugucuucauuaauaagagggcaaacccacuugauucuuuuucaguguguguuuuagcacuaugugcuacagggaguacuauguacuuucuuuuuuuuuuucuuuucucuucgagacagguacuauguacuuucaugguuugaacuggucuggauuccagugcuaauagcuacaagccauuguaagcacacauucaggccggugagacggcucagugggucaaagugcuugcgacccaagccuggcgguccugcacuggaaggaaacaguuccaaaaauuguccugacuucuacaugacaugcgcgcggucccacaauaacaaccauccuaagagauaaaaauuaaaagcuuucacaaaacauagauaaucagaguggcugggcagugguggugcacgccuuuaaucacaacacucaggaggcagaggcaggaagauuuuugaguuugaggccaccuaucuaaaggacagccagggcaauaagacaugaacccugucuuaaaaacacaaaacaaaaaagauaaugaaauugagcuucauuguaaggaauguaugaaaaauauguacaugaaagguuuauauaaauuauauauuauuuauauuauauaguuugguaccaaauaccuucucuucuuucauuuucaugauggucuucaucuuuuguauagccuagguguacguugaacuuaggauauuaaguuuaguaauuacugugugccacuaaaccuuuaguuugauaacugcauaaagucaucaugcugaucgauaguugcuuaucauuucucaaagugugguccucaaguaucauuuugggaaauuguuuuuaaaaggcaaauuuggggucuggagagauggcuuagcaguuaggggagaguuagguuccuaguuacccacauugggugacucacagcuacuuauaccuccacuuccaggagguccaaugcccuugcuggccucuguagaacaccauauacacacacacacacgaaaauaaaaauaaaucauauagaccaggcaggguggcacucacacuaucccuguacuuggggacaagggccagcaggucugaauuugaggcuggcuugaucuauauagcaaauuucaggccagucaaaguucauaguaagagccugucucaaaaaaaaaaggcaauaggaaugggauccaacacguuugagcauggcuuccuggagaucccauacaugcaagguugaacacagcugaucggguucaguguuucucagucucuauuggaaucuuaaggaguucuagcugugacaaggcuauuuuuauauugugacacguauaguaccaccaguuccagugugccacuuguuugugcacaccccaaguugugacagucuaaaauguccucagacauuggcacauacucucugauaggcagaaucacucuggguugagaaccacaugugggucuuuacuguuauagugccauuaagaaugucuuuaauuaagcaacaugagguuuuucccuuacuugaucuuccauaaaauugaauguuuuuaucaaaggccauauacauauaaguuaaagggagcuaaaggguacauuuucauucugguaggaacuuuguuuuucaaggcaggguuucucuguagccuuggcuguccuggaacucacuuuauagacaaguuggcuuuggacucgacagagaucugcuugccucugcccccccaaaugcugagauuaagggcgugcaucacuacuuacugucugguccuagaagaaacucuugaucagcauuacaugauggucuugguggaggugauaguuguuccuagcaaauuuucuugacuuuuauccuccuuugaauucuacccuccagggcuuggacugugguacugagagcagcaagaaauaugccgaggcugugggucgagcuaagcagauuguuuggaaugguccuguugggguauuugaaugggaagccuuugccaggggaaccaagucacucauggaugagguggugaaagccacuucuagggguugcaucacuaucauagguaagggcuccugugcuaaacacguggcagaguuuuauguucaggggaaaggcacauggggaaugguuaacauuuucugggucucuugauucugauaggucauagaugugucacucauagggggucuucuugaugggaggaguucauuagcuccauuuugggguugggaaccacaguuaguuuuggugccaaaacauuuuccccucuguucauucaucaggugguggagacacugccacuugcugugccaaauggaacacagaggauaaagucagccaugugagcacugggggcggugccagucuagagcuccuggaagguaagcuuggucucuguguuuuggcuucuuugaaggcagggugaagacugcauucugagaaguggggcaaagaguagagaacuuuaacuuuugggcagugcugucacuagcaaucacauuaacuaggguagcgcaaguaaagccgcgcggugggagggguagguaggaacucauuuuaguugaccugggacccggaaugccauauaacauaacuucugccauauaaccuaauaaagagcugguagauguagcuuagcggaucuuauaguaacgcugucucuguuugugcuuucucaaaaacagguaaaguccuuccugggguggaugcucucagcaauguuuaguauuuucuuuccugccuuugguuccugugcuccuaagucaaccuaguguuuuccacaucuccauuugguguuagcgcaagauucagcuaguggcugagauguggcaccaggaacccuuaaacaguugcacagcaucucagcucgucuuuacugcaucaggauuugucuguguucuucaagaucccauuuaaauuccuuagugacuaaaaccauugugcauuguagagggcgucuauuuauauucugccugagaaaggaagugagcuguaaaggcugagcucucucucugacguauguagccucugguuagcuucgucacucacuguucuugacucagcauggcaaucugaugaaaucccagcuguaagucugcagaaauugaugaucuauuaaacaauaaagauguccacuaaaauggaag

SEQ ID NO: 9697 - RNA, 16602 nt, Mus musculus
cuuccauuuuaguggacaucuuuauuguuuaauagaucaucaauuucugcagacuuacagcugggauuucaucagauugccaugcugagucaagaacagugagugacgaagcuaaccagaggcuacauacgucagagagagagcucagccuuuacagcucacuuccuuucucaggcagaauauaaauagacgcccucuacaaugcacaaugguuuuagucacuaaggaauuuaaaugggaucuugaagaacacagacaaauccugaugcaguaaagacgagcugagaugcugugcaacuguuuaaggguuccuggugccacaucucagccacuagcugaaucuugcgcuaacaccaaauggagauguggaaaacacuagguugacuuaggagcacaggaaccaaaggcaggaaagaaaauacuaaacauugcugagagcauccaccccaggaaggacuuuaccuguuuuugagaaagcacaaacagagacagcguuacuauaagauccgcuaagcuacaucuaccagcucuuuauuagguuauauggcagaaguuauguuauauggcauuccgggucccaggucaacuaaaaugaguuccuaccuaccccucccaccgcgcggcuuuacuugcgcuacccuaguuaaugugauugcuagugacagcacugcccaaaaguuaaaguucucuacucuuugccccacuucucagaaugcagucuucacccugccuucaaagaagccaaaacacagagaccaagcuuaccuuccaggagcucuagacuggcaccgcccccagugcucacauggcugacuuuauccucuguguuccauuuggcacagcaaguggcagugucuccaccaccugaugaaugaacagaggggaaaauguuuuggcaccaaaacuaacugugguucccaaccccaaaauggagcuaaugaacuccucccaucaagaagacccccuaugagugacacaucuaugaccuaucagaaucaagagacccagaaaauguuaaccauuccccaugugccuuuccccugaacauaaaacucugccacguguuuagcacaggagcccuuaccuaugauagugaugcaaccccuagaaguggcuuucaccaccucauccaugagugacuugguuccccuggcaaaggcuucccauucaaauaccccaacaggaccauuccaaacaaucugcuuagcucgacccacagccucggcauauuucuugcugcucucaguaccacaguccaagcccuggaggguagaauucaaaggaggauaaaagucaagaaaauuugcuaggaacaacuaucaccuccaccaagaccaucauguaaugcugaucaagaguuucuucuaggaccagacaguaaguagugaugcacgcccuuaaucucagcauuugggggggcagaggcaagcagaucucugucgaguccaaagccaacuugucuauaaagugaguuccaggacagccaaggcuacagagaaacccugccuugaaaaacaaaguuccuaccagaaugaaaauguacccuuuagcucccuuuaacuuauauguauauggccuuugauaaaaacauucaauuuuauggaagaucaaguaagggaaaaaccucauguugcuuaauuaaagacauucuuaauggcacuauaacaguaaagacccacaugugguucucaacccagagugauucugccuaucagagaguaugugccaaugucugaggacauuuuagacugucacaacuuggggugugcacaaacaaguggcacacuggaacuggugguacuauacgugucacaauauaaaaauagccuugucacagcuagaacuccuuaagauuccaauagagacugagaaacacugaacccgaucagcuguguucaaccuugcauguaugggaucuccaggaagccaugcucaaacguguuggaucccauuccuauugccuuuuuuuuuugagacaggcucuuacuaugaacuuugacuggccugaaauuugcuauauagaucaagccagccucaaauucagaccugcuggcccuuguccccaaguacagggauagugugagugccacccugccuggucuauaugauuuauuuuuauuuucguguguguguguguauaugguguucuacagaggccagcaagggcauuggaccuccuggaaguggagguauaaguagcugugagucacccaauguggguaacuaggaaccuaacucuccccuaacugcuaagccaucucuccagaccccaaauuugccuuuuaaaaacaauuucccaaaaugauacuugaggaccacacuuugagaaaugauaagcaacuaucgaucagcaugaugacuuuaugcaguuaucaaacuaaagguuuaguggcacacaguaauuacuaaacuuaauauccuaaguucaacguacaccuaggcuauacaaaagaugaagaccaucaugaaaaugaaagaagagaagguauuugguaccaaacuauauaauauaaauaauauauaauuuauauaaaccuuucauguacauauuuuucauacauuccuuacaaugaagcucaauuucauuaucuuuuuuguuuuguguuuuuaagacaggguucaugucuuauugcccuggcuguccuuuagauagguggccucaaacucaaaaaucuuccugccucugccuccugaguguugugauuaaaggcgugcaccaccacugcccagccacucugauuaucuauguuuugugaaagcuuuuaauuuuuaucucuuaggaugguuguuauugugggaccgcgcgcaugucauguagaagucaggacaauuuuuggaacuguuuccuuccagugcaggaccgccaggcuugggucgcaagcacuuugacccacugagccgucucaccggccugaaugugugcuuacaauggcuuguagcuauuagcacuggaauccagaccaguucaaaccaugaaaguacauaguaccugucucgaagagaaaagaaaaaaaaaaagaaaguacauaguacucccuguagcacauagugcuaaaacacacacugaaaaagaaucaaguggguuugcccucuuauuaaugaagacagcaacaaugugccagcacugcuuuuaccccagggauuugcccucaggucgguccucacugcaucauuugcaguguugacaguucccauggagacgguuggagggaagaacucagggguagcucauuucuuaacaucuaugagacacacagauggaucuccaaugucacaaaaaaaaucugcuagaugaaugaauggaugaaugaaugaugccaaaaauuucugaucccuuccauaagcgaacagccagcugacucaccauccagccagcagguauaccagaggccacaguagcuuggccagucuuggcauucucaucaaauuugucagcagugacaaagucaacaggcaagguaaucuucacaccauuuuucucagcuuuggacaugagaucuuugacaaucuuggcuccuucuucaucauacagagaugugccaaucuauacaagaaagucaaggagaugaagaucagccccuauacuaagaacggaacugacucauaaaacacacaggaucauaacacacuauaaagcuaugaguuucaaccuuccuaaugcugggacccuuuuauauucuuuucuuggcuacuucauaaccgugauucuguuucugucaugaauuguaguguaaauaugugaugugcagauuaucugauaugcaaccacugugaaagggucaauuuuuaacccacccaggggucacaacccucagcuauaaauacagggacaaaagcaacuucacagauugaauggaaaugucuguaggauucacaucaaguuuacauaaacugcuccuuagcgaaccaugucacagccacuugccauuggcucccuaccuccauguuguugagcaccuuaaggaagguaaaggccauuccaccaccaaugaucaucucauugacuuugucuagcauauuauugaucagcuggaucuugucugcaacuuuagcgcuagaagaaaaagcaagaaucaucaaggacagcacaacugaugaguguagugcuaauacucaaagccacaguaggaaagcaacaaaaguacugccuaaaguuuccauuucuccaacccucucugcguugaucccauguguaaagcccuggguuuauucucagcaccauaaacagaaaagcaaaauuccccuaucuaaacaaccaugcucccauccaaaauucacaaggcccagauugccagauuaguaacuaagggugugaaugaaaauagucuccauagacuccuacuugcauacuuaguccccagcugaacugucuggaaaggaugaggagguguggccuuguuggaaggaaugucacugggagugggcuuuaagguuuccaaauuccauacuaggcccagugugccucccugccuacugccuauagaucaguguucacacuauccuuagcuuuaaguguucagaaaucuuccaacauauccccugugguugaaggaagacugcuguauuucaggcuuauucugaaaccucaauaucaccagcagggggcauucacucccauauuccagaucuucauucagaacaaacccagauagcucaaauguuaacgugaagaagccaaagaccagagucugaugcuuuuaacucauuaaaaaauguucagccgggcagugguggcgcacgccuuuaaucccagcacuugggaggcagagguagguggauuucugaguucgaggccagccuggucuacaaagugaguuccaggacauccagggcuacacagagaaaccaugccuugaaaaaacaaaaacaaaaaaaaaacaacaagguucaaaaaaagaaaauauccaauaaaaaauaaaguagaaaaaaaaagauauuuuuaaaaaaaaaaguuucacagggcuggugggauggcucagagguuaagaacacuggcugcucuuccagaggucaugaguucaauccccagcaaccacaugguagcucacaaccaucuauaggggaccugaugcccucuucaggcaggcagauguauaugcagcaaagcgcucauacauuaaauaaaacuacauuaaaaaaaaaagguucaaaguuuucaggauuuuuuguuuguuuguuuuucgaaacaggguuucucuguauaguccuggcuaaccuggaacucacuuuguagaacaggcuggccucgaacucagaaauccagucucugccucccaagugcugggacuaaaggcgugcgccaccacaccuggcaguuuucaggauuuuaagacaacacaaagcccuauacacaucuugguuucucuaaggagacccugaaacagagcucaugaaguccagggagcaacuauguugugugaaacugacaauccuagagucaauuuuucaugaggaaaugcagaguaugcauuagucauggagggugggggaacaguccauugaagggucaugguucucuaagcagaaagaggcugcugccuaacagcuaugcuaaguaaaaugcagcuuucucguccaagcaguccaaguuccuuguuccucuaccagaugaucagcccugcaucccugaccugaccucuguaaacugucccuuuauuaaacuguccucaguuaccccauguuauaaccacuaccaggccaacacuauuuacaguaugauccaaaaguguucuuucauacccucccaagauagccaggaagggucgcucuggacucuccaaagccuuggcaaaguaguucagcuccuucuucaucaaaaauccaccagccuucuguggcagauucacacccaccauggagcuagggaaaaaaagaaaaauguauucaaaaucuagucaaauuguaccauguccccaccuagaagucaguuccauaccacuaaacugcuuucaucacuaagauacuaagagacugguuucaucccuaaauugcaauaaagccacuuacaucuuacguaacuuuucugacuaauaguuuauaaucaagggcaaaaaaaagcaaugaacugacguggaagauacccaggaaaaggguuggaaagauggcucaggaguuaagaucauuugcuguucuuggagaaccuggauucuaaacccaguccccaaaguacagcucaaaagccucuguaacucgagucccagggaaacaaacgcccucuucuggccucugagggcacugcauauacauggugcagagaaacaugcaggcaaaacacaauaggaaggaaaaacauacuuaguuaauaguuuucaauaggccggagguuaaucacagaauaugaucagccaguugaugagaacauguuuugauaguauguuuccaaagguaagaaaauucuacaaaaggcauccgaaguuggagaagccuguuccugaagcuauacaagacaagcuuuauuuaguacucccaauuuuuuaucuguauuuccacuuugaaacaggauauuuaacaagguucauauagcaccaaguagagagaaguuaaaaauaucucuugguucuuauugucaaccuaggacaaccuagagcucccucgaagaggaacccuccagcccaaaaugcuuuugauuugagugucuaaaucacaaccaaugcaauagaagauuguaaucucuaaaaacagcccagaaucugaaugucucaggugccuaagaucagugcgcucugccuaguacugacaagguucuuuuugguaccuaugggcucggugugcagucccaaaagcaucauugacauagacaucuccuaguuuggacagugaggcucggaaagcaucaauuuuggccggcucagcuuuaaccugcagagagaaguuuaaaaagaaaaaucuaauauagaaaauguugaugacuccacaaaacuccaaaagcauuucagaccaccaagaauccucuugaacaucuucaagacccugacuuaguaggacaguaaguuucacaacuagcaagagggucaaucauuugcucauuucuuauccccucugccucucccggaaaacuauacacacauauauaugcacacacuaaauacauaauaaauuuuucaaaacaaaaauguuugagggaaaauaagaaauugaaagcuuuucauggaaaagaugccauagaaaccaacaaucgugacaauucccauuuuuugaccugacaauggguacaaggaaggcaauguuaauucuaaaaauaacaauguagacacacugaauaacauuccauugaggguggacagaugguccaguggcacuugcugcuccuccacaacacauacuggaccucacaaccagugagccuggcagucucacaacagugccuggcacuuguggcccucuuugugcaccuguacacacauauacauacacaucauaaaaauaaaguugaacugucuuauguuuguguccaguuugaacuuucaggcauucuaagccauuagacucugaauagcaacugacccaacuaagucagauacagagucaguucauugauuccugaauaaacacucugcaucgacuuuccaguugcuccugccauuucuaagcacuagagcuugagucuugaguuucaguuuaaaagggcagcaaauuuuaggucagcauuuaacuaguaguacuguaguagcuagcaagcacagcaaaggaggauagggccaagcucagggccugugcugcuaagaaaagaaacugcuugaaagcaaacacuccagaugccuuaagaaaugucagaggucaaaggagaacugauaccgcagagugucuuguucucacaucauugaagagccaaagagaaaauacuaggaagugccauucgugccccuucuaaccaaaggguaaauccaauaccaugcucaaaaaggcggcuugaacacuuuugguaguugaauucugcugucaggucuaggagccagucuaguggauugccuacaacagccuuucuaggauaauggcaggggaguagauucaaacugugcacaauuaacuacaugauccacaaagucuacaacauuuaccauguggaucuuuguagagcuuacagaucuaauggacuuucaugaacccauaaagcaacagugacuucagcaaaaugacugccuuucugaaacccccuuucuuuagcaaaugaugaugacauaccuacacauguuaaugaaaacauuauauuucauuaaaaaaugccuuuagccaggugugccaggacaugccucuaaucccagcacugcgaagauggaaaagaccaggaguucaaggucauccuaggcuacaucaaauuuaagaccagccugagccacacagcacaggagcuacgugagaacuuaucucaaaccacaccuacccaacucaaaagaaaaggaauuccuuaaaguaaucucacuauugccauuaccuucacucaauacucauaucaguuauccaaucgaggauguuuucaaagguauuucagacaugaacagaaagagaccaucugcacugcuggucacauuccauuccaugacagauuaugcuuugguaauucagaaacaucgugcugugcauuuauacaauuguuuguacccagggcauuguccacuaccacauccauagagcaccccccaucuaugcauuuuuacauguauguuacauguauguuugggccaggugugguggcacaccccucuaauuccagcaguugggaggcagaggcaggcggaucucugaguucgaggccagccuggucuacacagugaguuccaggacagccagggcuacagagaaacccugucucgaaaaaccaaaaaaaaaaaaaaaaaagcuugggaaaaguuuccccuauucuuucaucauggccucaugcaaauugagacccuauggcccaauaauaucaaaaucacagguccuaccuuguuuccagaagcaucuuuucccuucccuucuuccucuacaugaaagcggagguuuuccagcaggaugacagucccagccgcuggguuggcacaggcauucucgacuucugggcccacacaauccuucaagaacagaacaucccugggggaagggggaacaagagaugaagagacuggaguggccugaaagcugagacccaguggcaggcagccugcugacuaccuuacagcucgccagcaccacagcccugucuguacucacuugcccagcagagauuugaguucagcagcaacuggcucuaaggaguacuugucaggcaugggaacaccaucaggccggcccagguggcucauaaggacaacggacuuggcuccauuguccaagcagaauuugaugcuuggaacagcagccuugauccuauaaccaagagaaaacagaaggcagaacaauguuauuccgaggaauuagugggaacuauuugaacucaugacuucacaaaauaaaucucccuuucuccuccaagguuccucaggucuaacaguugcagaauuccgaugaguucagaagacaaacaugauacaaagcugccaccuggccuuacauagucucauuauggaccuguuccucaugcagaaaacaacuuagcaagccugaagcaccugccuggguuagcugguucaggggcuggggacacaccuuaguugguaaagcacuucccuggcaugcacaaagcccugggacuaucaucagcaccacacaaacugcacauggugaugcccaucugugaugccagcacuugggagguagaggagagagagacuccgaaguucaaggucauccucaguaaguaacagcaaauuugaggccagccucggacacaugaggccaugccugcaaacaaauggccccagguuuuaaagugucguccccucagugcucugacaacagcuguucacuguuucuuacauucuguauaagcaagguaauacacaaucgacaccugcucccucgggcugaaacgguagcugcuagguagaagguacccgugugagcagagucauuugguagggacccaaaggaagugaaauuaacauacaaaaagauuucuaugcgagaguuuacuauaccauuggcuaguaauggcugaaauagucuaccucauugcccaacagcagauggagaaaacaagguaccauucaguaacaaaacauaacaucuauacccacauaaaucuuuaaaaaauguuuuaacuuaaaauaaaaagcuaggcuuuguagaauacaccuguaaaccaacacuuggaaggccuaagcaagaagguccgcaggucaagcccagcauaaacugaaacaaugucucagaauaacguucugaaauaaagucuuucuuauaaauuuucucaacagugcuauuauauaaaaauuccguuucugcaggggcacuggagaguacacaguaguuaagaaggauuguagcuauucuagagggcuguucaguuuccagcagccaucaacuggcuuacagccaccauaacuucaccuccaguguauccauccaaugcccucuucuggccuccacaggcaaccacuccccccucccccccccccacacacacacaaauaaaucuuuacaaagaaauucuaccugugcagugguggcacacaccuuugagcccagcacuugggaggcagaggcaggaagauuucugagugaagccaaccuggucuacagagugauuuccaagacagccagggcuacacagagaaacccugucucaauaaaaaaacaaaaaacaaaaaagcaaagaaacuuugcuucuuaagcuaguacccaaauuagaggcacaagcaaaccaaacucccccaccaccaccaacaacaacaaaaauacuuuaucugggcuauuuagaacaaaccccaagacuacaugcaaugcuaaaauuuacugauauuaacaguucucuuaaauagcuuguuucauaagacaauuagcauuuaacuucaauagucuuuuaaaaaauagaaacuccaaauuccuuaauuuuuuuuuaaauaaggacucucuugggauguuuuggcuguugguagcugagggucuuuuccuggggggggagggggccagggaaggucuggaauuuucugcuucuuuuuaugaugcuauugaccccucacuuuuuuuggcucguuguauagccuaggaugaccugaaacuggcuuuguaauaccucaggcuacuuucaacuuaaaacucaugggccuccuaaauccagacucccaggcgcuaggauuaaagggauacaccauuaugucaagcuauauuuggggggggcgggggggacgaccagcagaggagguuguuuguuuuguuuguguggguuuuuuguuuuuugauuuuuugcuuuuuuuuuccuuggaucucucuacagaccuggcuauccuagaacucuuugugcagaccagguuguuuucggucucaagaugagaccucugccucccaagugcugggacuaaaggaauaggcauacccuaccacacccugcuuaggacuguuuuuuaauacaauauuuuuucauaaauuuagaauauuaacucccacacugacagguuaguaaaucaaaaccauggcuucaacugcuguacucccaguguggaaagaaagaaauuuguaguccagauacucaaauauaaccuaagccagguuuaagaggaaucuuaccuuugguuguuuguuaucugguuguucuucauaggaacguugaaguccacccuagaaaagaaaaagguuucaguuucguagccaugaucaauuucuuggucccuaaguauuuuauugaagucguuaaaagacaggguuggcaagauggcucagggcacgggcacuuguuggcaagccugaccaccuaccugaguguuauccccaagacccauggguggaagaaagcaaguuauugucucaacuccacaagggccugagcuuaauucuguuuagugugauggucucuguagcagucugaguggggaacagguaauaaguaacgccccuugauucuaguuaucuugauauugcuucuggcuccuugggauaacauuccccaaagaaaagaaauuuuaaaaaaacaaaaacaaaaaaacacagcaagagaauuuccuucuuucuagagaaugccugauuggaacuugaauaggcaaaacaauacuucaauauuagauaauaguggcuuucaaaaaaaccugagggggggaaaaugagugagaugugccucggcccacugacaauagauaagugggaggcauaugaucaagaaaauacaagcuaauacaaugaagaugcuccuucugaccuaacagaugacugccuuucuuuuuugugcuggugcuggggauugaacccagggaccugagcacgacacccccaguccugcuuuaccauuaggaaccgauucugaacccuuuccuacgggguggugauuuuacuaaguugugucugccaugauuuugagagauuuuucugccauguagcuugccuucauucaucuccugaaugaauacuaagaucaaguauauaccaagacauccacccaagacauuuuucauuauuuuuuucuuaaaucugugaaaugauuauaguaucuggcuaagaguuauaaauguuaaaagguuuagaagugccaccuaguaucacacugguguuaguuauuauaugccauugauuccccaaacuauaacugcuauuugaaagaacgauaauaaaagcauuacuuuugguaccacucacuaaggggcugcaaugaggggucaagacugccacuggucuugauuaugaaacuccaucuuucccauuuucacuggucuuucccgucugcagugaccacaaacccugcaggucacuggcuuccucucuacccugaagaccaaucuaccgcacaaaggagcuugagggacauacuucuugauuccgauuuaaaauuaaaaggcagugugccucugaacaaagaaaugcacucuaagccaggugugguggcgcacaccuuuaaucuugggaggcagaggcagguggauuucugaguucgaggccagccuguucuacaaagugagcuccaggacagccagggcuauacagagaaacccugucucgaaaagaaagauaagaaagaaagaaagaaagaaagaaagaaagaaagaaagaaagaaaaaagaaaugcacucuaguugguuucaggcacuuaaggcacccucuuuaaauauccugagcaggcccuugccagccuuaaagugcagaccacagcagauccaauaucccauuaccaggacugaguucccccucuugcagccuccuagagaagauaauagacaaaaggguuaacugcacaggguggauagugcugcuuccugcacccagaaccuuacaagaaggaaugaaugccuuugggcuaaaauauccaaccaucuguggcuucuauccaagcugugaugacaucagcuuaccgaugaaaacuggauuaguucucacugaccucuugauugccuuugaccuucacucucuccuagacuuacaacucggccuuuagcuucucuccugaagacuccaaagcaggaacaacguuccuuacacaaaucacuuguucacuuggggguggggaacgugguguauacacacacacauauauacauauauacugagcauacauacaucuaaauacguauauacugggaaaaacugaguuucugugcagucuuugcaaucuuuuacaacuccauaauuacuccaaaauaaaacuuuuucaaagcagaauggugguggcuacagcacaccccgcaggaggcagaggcaagaguuccaggccaacuuggugaguuccaggacuucaaaaacacaaagcaaagaaacaaaacaaaaacuuuauauagagaacauuaaauuagaauaucacgucuuuguugaaaucucgagauuccaggcccuguucuacuaaaacuaugggaaggaaccaugcccaccacugccuuguggacugauugcuaaagucugcuaguacgauggugucugcucuccguuuuccucuucccaccagagcuguugcuucgaaagucccaaaagaaaaccagugagguugagggaagaaaacguacaagaaagagaagugccagcaagcaaaggaugacuagggaccuaugggugaaaaggaaaugacaugacaaaaaucagcaggaaauguacucacagagccuuguaaaaucaacuagagugaggcggaaccuguugguguuucuggcuuauuuuaaaguuucuccaaaaggaacuggggugacucagugguagggugcucaggcacaagguggcuaguguuagauuccccaacacaaugaaaacuaauaaaaguuaccaacaacaaaucaacuucccuugccaacuuaaagcaagggacuagucagaaaacaagagcacccuucuacagggcagaaaggaggugagugaacgggcccaggaugcaggaggccccauuucugaagcacugccagcaacuaccacaaaaggcacugaaacaaaaaagguauugagcucacccaggcauggcugccuagacuccucacagaagccuacaaggcaacuccccaugcaagaugcauuaaucuggaaaccaagcaacuucaccacuguggccuaaauaccaaccaaguacaauguauccauauuauacaggacugcaaacucgacagauaaagucuaucccaaccuguuccugagucaggcucaaggagcuaaagagacccaaauccuaguccugccucugcuacauucucuagaccucaauaaccuucacagcgcccuuuuccaucagccaaaggaggccagccagucuuuuccaggcuuaaagguuaaccuggguuaaaugaagcuugauuuggggcaaaagagaacuguugccuccugucucacccucaaccggaguuaauuccuuuaagauaguuucucuguagaaaauagcauaaaaucccaaacugccaucccacaaaagugaccagcacaauggcccacugucuugucuuugagcagcugcaugcaucugaaaaggucagccucaagccaguagugccugucucccucacaggaugaaucuuuuguccuuagaacagaaugaaaaguuagcuagaaccugcccuuuaucuaugauuaggguggcugggauuucugcuccauccugauuauucuaucccauuugggguaacauuaaguguuuugcaugaacauaauacaguggguugguucuggauaucagcccaggaagagaaggccaccuaccaauauuggcuacgauaaaauaagugccuguacagaagccagagaaccucuguucccuuacauguguuaguaucuaaaggaugcccucacuugaacuggcccaaaucuucaaagggaccaggauuacugccaaucagucauccacuuccaaagaaggucaagcaggcagaguagucagucacugcgaccaucaauggcccuuaaaaauucccauccuuggguccuauaguuguuacaugaacaaccaggcccaucaguuauguaucuaaccaucauccuugacuccuggcaaaaaaaaaaaaguauacauuaugaaaggcaaaaaggagaagacgcauacacccuaguaauucuuucagguaagggagaagccaaguuaagucagugaccugggacccacaugugccacgugcgugggagccuuccucaguucugacauccugcuucucuagccaccucucgagugagguuacaggccuccaacucccggcggccacacccugcaugugucacaauccugaugcaaaccccagggccaggaguccaaccgcaagguagggcagcagaggccuguuauauaagccauacagagcuucauccagugggccucacccucccacccacaauucuuuggggagagggaccuccacucgagaggacuuugagcaacaucuuuugggaaagaaaucauuuguaccaggaccaaugaaacgugggcgguuucggauucgucacggaugguccaagaaucuugggggaagggaaacuagcuaaaugaccuuucaaggucccucagcaggggccuagagauuugcaggauaaguacuacguccauucucgcuacaagagaugaaacugcacuucagaaaugggaaaaagauugaguccugagaaucugagcccuuuaucagugggaucaacucccuaaaggacacauuuggucgcuuuuuaagcuagaagcaguuaggacgcagaaaagcaaacucagacacagucuccgccccaaugaggugagaggaacagccuuaaccuccaaacccaggacccccaagacccagcugaaaaauaagugcaacuuaaggugaugggaaaaccgugcuugccacggccagagagaauguggccccgagggcuugagggcagcaguacggaauuaccucaucacgacccgcuuccccuucacguccagcuuguccaaagucagcuuguuggaaagcgacauuuuggcaacaccgugaggucgaaaggcccggagaugaggaagaggagaacagcgcggcagacgugcgcuuuugaagcgugcagaaugccgggccuccggaggaccuucgggcgcccgccccgccccugagcccgccccugagcccgcccccg

SEQ ID NO: 9698 - RNA, 3834 nt, Mus musculus
uuuuguauuucaauucuguuuauugaggagugaaugagacuacugccagacaugccaacaacacuucacauucaagggcuaggagggagagggacagccuccacaccgagucacuacauaagccuucuugcaaagaaccagagcgacaucaagugacagcccugugcuucuggcuugucagcaguuguuugcagcugguuggcugguaaaggcuucuuucuacccccagacucucacuccauuuacagaauaaacacuagguuguuccccagucuguguaacauacaucuguguggaugaacugagcugaaagcugcuuuccuuacauuucugcaggucuaagagaaaaaaggaaucuuuuccucuuuuccuucauguggaucagacacagcaauagaaaaauacucugcugugcuaccaucaggcuuacagggaccuccucugugggucugaugagaucuacagcaguccacccugcacacaggguugcuuuuccugugcacagcuccagaagaacgaccuauacacaacacuacugcucucucuugcuaaaaaacaaaacaaagaaaccuaaacaaaaggguaaacauuuauuuggaguaagucuucugguaggugguaguaaggcccuucaggcagaguucaggagcuucuugauggcuuccugcugcuccagacugagucgagcuaugcauucaguccacaauccuccagaagucuguacuuggcgaacuacauuggccauguguuuggcacaggggucuucauguuuaauggccucaugcauuucuccuucugcaauuauacugaauauuuucgguagauugguauuguuugggcaagaacaauugggugauuacuuucaaucagguugcacagguaacugaaggucuggacagcuucuuuaucuucguguagggggagccaggacauccagugugguaagaccuccuccacauucacacagucgggcuuaaacuucaugaucuuucccacugcugagaugcaguucucgauggcauugacauuuucuuuggucuuagacucugcagccugaauaacucuuacaagcagcgggagugcuucgguacagaaagggcgguaguuaucgcaagcaaacugugccaugacgccuaggccauacaccacagcuugccugacuucugggcuguugucacacaccuccuggagcauuggccuuaagaaauauucugcauacuuaaaugaagcuggacuacaguguucuaugauaccaucgaagaugcacaaucccccauugucugucuggccauggucuuugcagacaaaucagguugacaauuaaugggagcagcuguucaaaccacagcaacaccuuuucuuuguagcuacugaauauugaguguaaaauaucugauacuuuagucaguacauaaacaucauuaucauccucaucuuauagugacucuucaaccuguucgucauagucuucaucuugucuuuuaacgugccgcaacucuugauuuuugaaauguucuucaagcuucaccuucaggauaccuccaagcuucucaaaguguucauuguugaggcaccugucucccauuacuucaauguacuuugugaaggagugcaugaucucugagaggacgucuaagucgggcucugugcugauggccuugaugagagcgucacacaugaagugccacaucugcguaagguacucgggaccccagacucucguacacucgaggagaagaggcauggacucugcugcugccacucagaccccaucauggaaauaaaauuucagcagugggaccaucaguuugacaacuuguucaguguauuccacaaaaaccucccuuuaauuccuuagcauagcaaaccaacaucuggcaagccauugacuuuucuuccaguccuacaguuuuaauaccaaaacuuugcugaucucugagguucacaaauucccaaccgucaucaucacucauauuccccauguccuagguaucuagaagggccacuucaggcuuaauugaagcagucuucaucaggggccccauaaccacgggaagguacugcuggaauucuuucccaaggauuuugcacauccuagcucaugcugagaucauguaagaaaucugagggucgucauauuccauaucauugaagucugucugugucuucaacaauagcugcaucacaucugaagcauccugcaugaauuucuccuucccgacuaccagaccgaugaggcuggugcacucgauggucuuccguugcagcagcuucagcuccuggacuguguucucgacaaugugcuucagugauggcauaaacaagucauaguaggggacaaacuuuuccucugcaguaucugcaacugaugcaauggcugucacaacuuguugcaaaacuaacuuggugccuuucugaaucaucuccuggaucuugagcaccaugauggagugcagguacuucaccaaguuauccaaguacagacuaagcagugacuugggacaaucuucagugaaguuaauaagggcagcuacugcaugggccugcacccgcugguugccuuggucuuccauggucugaagcaaagcugcaaucaccuucucaugaaauuucuuuugaaaaccaggugcaaaaucuguagccaucugacauugcaggcugcauaccggacucucggaugaggauccuggaggaaaagcaagacaaaauuuacaaucucacuuagaguuccuuccaucugcugguggcauccuuugucaauggcagauagggccauuaauccugcaugccuguauuuccaaucaggguuuugaggcauuuacauaauguguuccuugaucaugggcagaacgaguuuuccaccaaguccacaggccauuucgucuaaugcacuuucacuaacaacugcauugcuauugaaaucaucaucuucuagcucaucagcauuugcccaguccucaucuucuucuaggucaaccaucauugccaacaucugaggaauagucugugcgaugauauuggugugcuuucuuaacauagcagcugcagucucugacagugucacaaucacuucaaggacaagcuggcauugcauauuauugagguuagcgucuccacacaacuuuagacuuaacugcagaguugcuucuaagugagggugcaaauacuuuggaacaguaucagcaaucucaacaaggaauuuuaggacagaaucaucauucugguaacaugagucauugacagccuguaagaauccaggcagcaagucugcgaagugaaugaacagagcaccauuaugcucauuggcaaguaugaaggcagcaguagcucuggcagacaguguccugaucaaaauaugugaagggcaguuucccggauuccccuguuuugugagcugacugaaucaaagaggaacuucaaaccuucaggccacugguuguugcuguccucaucuauuaaauuccuggccaauucugcagcaauaucaugauuuuuuuucucaugcuggauuguguuuccaucugaaugaucauuagcaauucacucuugauggaagucuggacaucugauggaagagcuggauagacuucaucaaaugcagaggaaaaaaagaugacuuaggagaacaguggccauuuguccagucuccucagcagcaguuguguuucugauggcuuguaagaggaaugugaucuuggacgggccagggacauucucauagguuuccucccccuguuucuggaccacauugucggggcugagcagguuucucaggagcagguagaacuguugcugcuccgcaccggccaccaccauugcacuaggcuugagagc

SEQ ID NO: 9699 - RNA, 2540 nt, Mus musculus
ggagaagaggcauggacucugcugcugccacucagaccccaucauggaaauaaaauuucagcagugggaccaucaguuugacaacuuguucaguguauuccacaaaaaccucccuuuaauuccuuagcauagcaaaccaacaucuggcaagccauugacuuuucuuccaguccuacaguuuuaauaccaaaacuuugcugaucucugagguucacaaauucccaaccgucaucaucacucauauuccccauguccuagguaucuagaagggccacuucaggcuuaauugaagcagucuucaucaggggccccauaaccacgggaagguacugcuggaauucuuucccaaggauuuugcacauccuagcucaugcugagaucauguaagaaaucugagggucgucauauuccauaucauugaagucugucugugucuucaacaauagcugcaucacaucugaagcauccugcaugaauuucuccuucccgacuaccagaccgaugaggcuggugcacucgauggucuuccguugcagcagcuucagcuccuggacuguguucucgacaaugugcuucagugauggcauaaacaagucauaguaggggacaaacuuuuccucugcaguaucugcaacugaugcaauggcugucacaacuuguugcaaaacuaacuuggugccuuucugaaucaucuccuggaucuugagcaccaugauggagugcagguacuucaccaaguuauccaaguacagacuaagcagugacuugggacaaucuucagugaaguuaauaagggcagcuacugcaugggccugcacccgcugguugccuuggucuuccauggucugaagcaaagcugcaaucaccuucucaugaaauuucuuuugaaaaccaggugcaaaaucuguagccaucugacauugcaggcugcauaccggacucucggaugaggauccuggaggaaaagcaagacaaaauuuacaaucucacuuagaguuccuuccaucugcugguggcauccuuugucaauggcagauagggccauuaauccugcaugccuguauuuccaaucaggguuuugaggcauuuacauaauguguuccuugaucaugggcagaacgaguuuuccaccaaguccacaggccauuucgucuaaugcacuuucacuaacaacugcauugcuauugaaaucaucaucuucuagcucaucagcauuugcccaguccucaucuucuucuaggucaaccaucauugccaacaucugaggaauagucugugcgaugauauuggugugcuuucuuaacauagcagcugcagucucugacagugucacaaucacuucaaggacaagcuggcauugcauauuauugagguuagcgucuccacacaacuuuagacuuaacugcagaguugcuucuaagugagggugcaaauacuuuggaacaguaucagcaaucucaacaaggaauuuuaggacagaaucaucauucugguaacaugagucauugacagccuguaagaauccaggcagcaagucugcgaagugaaugaacagagcaccauuaugcucauuggcaaguaugaaggcagcaguagcucuggcagacaguguccugaucaaaauaugugaagggcaguuucccggauuccccuguuuugugagcugacugaaucaaagaggaacuucaaaccuucaggccacugguuguugcuguccucaucuauuaaauuccuggccaauucugcagcaauaucaugauuuuuuuucucaugcuggauuguguuuccaucugaaugaucauuagcaauucacucuugauggaagucuggacaucugauggaagagcuggauagacuucaucaaaugcagaggaaaaaaagaugacuuaggagaacaguggccauuuguccagucuccucagcagcaguuguguuucugauggcuuguaagaggaaugugaucuuggacgggccagggacauucucauagguuuccucccccuguuucuggaccacauugucggggcugagcagguuucucaggagcagguagaacuguugcugcuccgcaccggccaccaccauugcacuaggcuugagagccaaacguugucucuuuaacuccuuccauggguauuuuguucccauucuaaggaggaaugaauauccacacuuuggucuuccuucuucuugauuuucuguguuuggcaaaauguaucuuggguauuguaaguuucugggcuaauaucuacuuuucagugagcgcauaucaagugacuucuuuugugauuggguuaccacacuaaagaugauaucuuccagauuuagcaauuugcccaagaauuucauaaauucauuguuuuuaauagcugaguaguacucuauuguguaaauguaccacauuuucuguauccauuccucuguugagggacaucuggguucuuuccagcuucuggcuauuauaaauaaggcugcuaugaacauaguggagcauguguucuuauuacauguuggaacuucuucuggguauaugcccaaga

SEQ ID NO: 9700 - RNA, 3660 nt, Mus musculus
acuggagaccuacaacuguaaguagccacuguggcauaaaacugaaggggggucucucugucuuagaacuacuugggucuacucuauugggagaagaauguuguggggagagggggauauuuggagggaagaaaagggagagucagagggaaagacaggagagaagaaacaagagaaccugauugcaacugaaaaacauuccagaaaugauaggcuuugucuccaaaucccugcugagaaccugccagguaaguugcugggagaaguucuaaucagggucaguccaagugaaaagauugcagaaagauaucaagauuuuguuggaguauaauggugaacaagggaacuuuagugucuguuauugaaaauggaggugaugucugggggaucugagaggaaauaguagacaguugggggauucauggauggacagcaaguaggagacuaucguccugucaaaagucuagaaaaaggugggagaaacauugggccuucaaauacuaaagaugggcauguugucaauggcaacacaguuugugggcauggggauauucacaaggugaguagaacaagauugacacagguaaagccaacaggaggcagaagacuuguaaagagagaacuuccuaccauuuuucuggcucugaaccuaaagugauugaaguuccugagaauuugccaagucacauaugcuauuaauaccacagagaguuauucaauuuauauuaggacuggagcauuggauaggucagauuuuacuccugagaccccugaccugugucccugucaggauguccaucaacugugggacacuuccaggggaggacagaaaaggaaacaucaggcaucccaguaagaacuccuuggacucuccauagaggaaguauccaaggaacagauuuccuagucaccuugggagagaaggagcgagaaaagaaucacugaacacuuccaagaaaaaaacaagaagccuucacaaugccagagcugcuacagaagggaacgugagagaaaaugguggagggagcugaggaggagagggaguagaggagaagagaggaaaaaaggagagagaugagagaacaagugggagaggagagaagagauaggugagaguaaaagagagaagugagagauaaaaagagugauccaguccaaugguucaccuaguacauagaguguuggagaagggauacauucugaagaggguuugggguaucaugagcagguucccauacuucuacaaaauguauaaucaucuucaugcuaacugagugcaagacugaaagaaaggaggaagaaaggagaacagggagggaaagccagugaccucccagaauagaguacaagaugaccuaccacaaucagcugcuuccuggguugcaagaagacccuaacacucuggacgcagauccacagcaguggggacagauuaauuuugaaauaaaccuuaggaggucucucaucacagaagguguuagaacaaaugucucuuacaggcuaugguuuuaucagagauggggaaggggcugaggucaaguugaacaggugaaaaucaugguuaaacagagaugcacaggaaugauguuaguggugugaacugugggaaccuggcuaugggaaaaugaaacugcuagugacaggaaggagggauuauucaaacuggaauuuauugacaggaggagacagggcuggaaugaaggcugccaaugacucauguucuuguucucucccacaagcaugggcaguuguccuaauuuagguuuguucuuuggguggagguuggccuucccucacaaggcagagagguacuuucuugcuuacaauggcccuguacuuuguugauuggaaauguccugagagaaacauauagcugaguaacuuuuagaacucaugucuaaaauguccugacugacaacagcaauaauaggaaggaguccuuuggagcaaaaaugagcugauuccuugagaauaagcaggguggccacuagauagagcucuagggcuuucuaagauaaucaggaaauagacaauucuggcauccauguacagaucuugcuuugucuuuguuuaaucuucaaguauucaauuuaucagauguacaauuuuauaccuuuguaauaauauuauagcauauacauaauauucuuugcagacuuguuuauaaugacaaaaauauauuuuaaaacauauccuauaccuacuuguuagugacuauauaauauauggagauaguggagcacuagaaaaugcuuuauuagccuuauuuauaauagcgagaaacuggaaagaacccagaugucccucaacagaagaauggauacagaaaaugugguacauuuacacaauggaguacuacucagcuauuaaaaacaauggauuuaugaaauucuuggacaaauggauguaucugaaggauaucauccuuagugagguaacucaaccacaaaagaagucauuagauaugcacucacugauaaguggguauuagcucagaaacauagaaaacccaagauacaauuugcaaaacacaagaaaaucaagaagagggaagaccaauggguggauacuucauuccuccuuaaaauagggaacaaaguacccaugaaaggaguuacagagacaaaguuuggagcuaagacaaaaggauggacuauccagggacuaccccacccagggaugcaucccauaaucagccaccaaacccagacacuauugcauaugccagaaagauuuugcugaugagacccuguuauggcugucucauaugaggcuaugccagugccuggcaaauagagaaguggaugcucacagucauguauaagauggaacacagggcccccaauggagaagcuagagagagcacucaaggagcugaagggaucugcaacccuauagguggaauaacaacaugaacuaacuauaugaacuccccagagcuuguaucucuagcugcauauguagcagaagauggccuagucggccaucacugggaagagaggccccuugguacugcaaacuuuauaugcccugguacaggggaaugccagggccaagaagcuggaguggguggguaggggagcagggcggagggaggguauagggaacuuucaggauagcauuugaaauguauauacagaaaauauauaauaaaaauauauuaauuuuuaaaaaugcuguauuuucucauuuuucugcaccaaccccuguaucuucaauauguauacacagaauauauauauauauauauauauauauauauauauauauauauauacuucaaauauuuuuauugaagaaaauuaagaaaagcuuuuaaaguaauucaugauuugucaguguucuuuggaugcuuagguaaaaggacuugagauuuuaugauuacuacugaacuuuauugcauuuauuauaucucuuagaaacuuauccucacagaagagugagccauaaccaacccgaugagaagacuguaaagacuggagaauauucaaagaagaaaauaagagaucaccaauuuggugaacacaagacugccucuacauuuagugacacaacuuugcuucugaacaaagccauugacacaucugcuccuccugguacucucuguccuuacacugugaauacugcuccagauacuaacacugauaacaauacuucaga

SEQ ID NO: 9701 - RNA, 6280 nt, Mus musculus
gcgucauaaguaagcccagaccugagcucgcugcugccuguggaagacugggagaggagacacuaagugcugcucaagcaagcgcgauccucuccucuuucaaccugcagcccaagauacugauucgagccgcgccuuaccgcgcagcccgaagauucaccauggugaagaucgccuucaacaccccuacggcggugcaaaaggaggaggcgcggcaagauguagaggcgcucgucagucgcacuguccgagcucaaauccugacuggcaagguaguucccacugggcccaccucugucuucugggguuuggggauggagagaaaagggggaauaugcaggugcagagaguaaacuguuggcugcccugcagcggaguuccaggcaggccaaucugcauugaguugagugggucaccuuuuacucugcuucaacuuauucccucugcauccaugcgauucuaucgcuuaacaccaccuaccccagggaaguuguuggaaggaguuugaagaaauuccugcaugucauuuguucugagaaauggguuauggaauuauccagagaagcaauuauagcuacaggggccgagcagccacacggagugaacaagggcaagagacuuaacuguucuuuauuuuugacauggguaaaguuauaugaaucucugucuuuguaggacugcuuuuguggcgguugaauggaggcaaggggcagccugaacuccaaacuguauguucuggggaaaguguguuucugcacgcgcaugagcgcgcgcgcgcgcgcgugugugucugugcacgcgcgcgcgcacaccacccccccacacacacaauuuuaguuaguguuaaggguuagauaauggagcuauuaaaacauauauugguuuuaauucuugauaaaucacguuuaaaaauaaaauuugagaucuuauuguuuugguuguuauuauuuuuuacuuuuuauuauuuuuuuagcaauaucccucauauagccaugugaagcauauccauguugcuauuuaaacaauucauuuuccaggcacuggagaaguucucucuuccuagguuguucaucuagacaaauuuauauuuccuuuuaaugccaaccauguuuguagugucgauaaacucuuuuuccucaguuaaaucuuaguuugaaaaagugauaauauuuucuucuacuucuguggaaucugcaguacuggagcucgaucugccuuaacuuguccuggugucuuuagagaguuuucucuucuagguucagacuggauauuugaaaagugcuuugagugacaucugaaugcauauaguaaaacauaauuaugcauacaauuuggaaugccaaugugcgcugccgcagaacuuucaucauggaaacuuccgauauuuaacugcaaucaaacuagcuuuuguguaucacacauuuuagaacucaaaaguaacaccccccuugcauuguugagguuuuaauuaaaugacacaaggucaaaaauauguaguugucuuccuacuaacuuuguaaaugaaacacggccagauuugaggggaggucuaaggagaugccaguuguuaaaaauagccacacaguaauccuuuuuuccccucgccaccaaaaacuucaugacuuguagaaagauucaauuaauauguaauacuucugccaguccuguggugugauggggacuaaauaaaaacaaaccuuucacuugauuauauuuuuuguuagguuucagagaagcggcaauagaauccuguccuggcccccuuugucaguaaaacaugacacauuacuuugcgauauauggauuaggucugaucaacagagaaugaacacauuggacugauauuggcaagugauauacaguaacuuuuaaaauacacuucaaaaagaaauuagcuaugauaaucaauucguucaacuacaccgaaucucacaaaguuaaacgaaaacaaaagaaauccuuguuccuccuaaauagggaccucuagugaaaccgagacccucauacuuuagccauacuaaacaauaaacuuccugaauuauuggaaaagagauaugaaauuacaguucaaauuguucuucugucucaauaacaaaaaauuucauugcucagagaauuucaaauuaagcuauuaugugccuuuuagcaagucauuucauauuuccgcaccuaaauuuaauuauacaaaaugucuccugagaucccacaguucuaugacaguaguuuccaaucaaaauuuaaaguucaguuucuguaguguucaguauuauauagacuuuuaaggaaaauaauuaagacauuucaguauguguagaaucuaacugaugaaauaagcuuaaauaaauuuuauuaaaaauaugaaucucaaauuuugaccucuaaauuaaaaaaaaaucuuuauuuugaaaacaaaauuaucaaaugauuuucuacccaugcuuauuccauauuaacaagcauuuuuuuuuaccaaauuuaauauaagggcaguuaaauauccaaguauuauagcaauuucaugaaaaacuccaauggaaggccaacgaaaauaauuguuuaauaucagcuuggguuaucagggcugagauugccugacuucacuaauucuaucgucgagauguaauguggccgaggaguauguugugacaugcaaauuuaaaauggcacgccuugcagcuccaugcccuauaauuaauugcuuccuuuuuguuuuggaucuuucuuuugagaauucaucagaaaauuauugauuucauagaauguuuaaauuacugcuucacagacagcucuuguauguagcauauucucuacauucacaacuaguguuuaaucuaagacuuggaaaauaacauuaguguagucuacagaggaauggauaaugccagcaagcaguauacuuacuaauaaaauuaagaauaguaauuaaucaauuucuaaaaugaaagguaauaacucuuuuccaacuugacaauaaagccaacaaacugaagguuacuaacauucuuuuaacuuaauaaacugauuucaaaacaaauagcuaagagucuauuucuauauucuagaaagccaguguucacaaaaaaaaaaaccuaguuccaaucacuuaaagaacauacuuucuagagacaagcuauacuauaucauaucuauaguuaaaaauacuguugcauccauuaaacauguguuaaagggguaggccuauauuaaguguuuuuaauaaaaauaugucauuauauaaauuaaugauuauuuuaauauaauucuacaaaugaauauuuugaaauaaugcuauauuucuauuuaaguuugaaaaugccaggaggaaggcugggguaggugaagauacucucuauauaugcaucagaaauugucuugggagugggcggguaggggaguggggguggguggguaugggggacuuuugguauagcauuggaaauguaaaugagcuaaauaccuaauaaaaaauggaaagaaaaaaaaauauuuccuauucuauaggcugccaaaaaaaaaaaauaaauaaauaaaaagaaauugucuugaaguaauauuugauuggaaugucuuuguuuauuuuuaaaauaucuugauuuuuaggggugauaaauugcacacaaaagcaagugucuaaaaguuuaauugugguuuguuuucuauuuugcguuuuaaugaauaggagcucagaguugucccgcaggagaaagauggcucaucugggagaugcaugcuuacucuccuaggccucucauucaucuuggcaggacugauuguugguggagccugcauuuacaaguacuucaugcccaagguaauaguucuaauucuuaacacuuugaauuacuaauugccaugcauuuacuuaucggccuaaauaauuauguaaugguaaccagagaaagugaagacuugaacgcuuucaaauuaccauucaaucucugcuauugcuuaggccucacgaugcuaacuauaaugaaguagccucagauugacacaguacaaugaacugacaugaaucuaagaaauaaaugcaagugcguggugaauauuagaaaauuuuuacuuccccauuuuuaucucauagagcaccauuuaccauggugagaugugcuucuuugauucugaggauccugucaauuccauuccuggaggagagccauacuuucugccugugacugaggaggcugauauccgugaggaugacaacauugccaucauugaugugccugugcccaguuucucugauagcgauccggcggcaauuauucacgacuuugagaaggugcauuucucuugcuugcagcuauuuacgaauuuuuuuucccuccaguacuguaaggcaaugaaucuauucauaaaugaacaucuuuucaaagcaaaguccuuucacuauguugugauugcauagaaaguggugaaauuuucaagcuguuuguucaaaagguucuuaguaaaucugcaauauuaauacccaucuuuucccaccuccccaacagggaaugacugcuuaccuggacuugcuuuugggaaacuguuaucugaugccccucaauacuuccauuguuaugacuccaaagaaucugguggaacuuuuuggaaaacuggcaguauguauuuuagagaucaaauuuuucuauaagcauuuccaaauaauuuugcuucguuauucuaaaaaguuaaugaguugggccagacauuccauuuucguugaaacauuuuugaaugaaaagugugugcugugccaaaauagauggaacugaaguauuuuauauuaaguaauguaagccagucagacagacaaguacuuuauguucuccuucauauguaguagcuaaaaauguucaccugaacacagaacacugauuaauagcgguugagaagggaaaguguguaggaggagguggauaaggagagguuggauuugaucaaugcaugcagugugugugugcaaauagcacacugaacuugaaacccauaaacacauguguguauaauaaaaauaguauaguauauaaaacuucuaaaaugaauuccauuuuuaauaaugucuauuuuuaaaagacuauaaguagggauuuaaauacugucuuuaagaaugugucauuuuaaucucucuugauaucauuuauagaguggcaaguauuugccucauacuuaugugguucgugaagaccugguugcuguggaagaaauucgugauguuaguaaccuugguauuuuuauuuaccaacuuugcaacaaccgaaaauccuuccgccuuagacgcagagaccuucugcuggguaggcaauuuauuacuauuggaugagugauagagagugaggggagacugcaucagaauagcauuucucaagcacagcaaacucacaagucacuuuuuuuuuuuaugccuucacagguuucaacaagcgugccauugacaaaugcuggaagauuagacacuuccccaaugaauuuaucguugaaaccaagaucugucaggagugaaaugugacagauaaagaguauccuugauaauaagaagucaggaacuuaccgucugacuuggaaaauugaaauugaugggauacucaugcuauuuacucauacauuuacucuauugcuuauacuggaaaaggaaagggaaaggggggagaaaacuacuaaccacugcaagcgauuguccaauucuacuuuaauugacauugcuugcuguuuucaacaagucaaaugauuaucuuuucucuugaauuuauaggguuuagauuucugaaagcagcaugaaugugucaucuuaccauccugacaauaaagcccauccucugguuuuauuuaaagcaagcucuuuccaacaucacuuggcuagagcaugcuuuaaauuuaaaauauuugaaauuuguuuuugacauuuuuuugugugaaacaugucaaaucucuuaccauucuuugguuuucuucuuuauuauguucaacucuccugauuucagaaguuacauuuuugcauuucuaucaggugcuguguaacgaaucugacugauaugugaacaaucuucaugaggaagcaauuuuuuacucauguaaugauucuuucucacugauaucuguauugugaaauccacagaacuguacaggugcugaaugcuguaaggaguucugguuguaugaauucuacaacccuauaauaaaguuuaccguauucaaucauguuuuauuuucaucacuugacagauccuuaauguggaaauuauugauuuagcuuuuguuaacauuaaucaguuauaaaauuaugaacauaaaucca

SEQ ID NO: 9702 - RNA, 2733 nt, Mus musculus
cauagacagcaggagaaccccuggagguagaaagaacacaggacagaaaggaagaaagcuaaugggggaacugaucacagguaggaggggaaaagggcaguggcagaggaggaggagaagauggagaaugauaagagugaagaacaaaggagagcacaagguauagaggacaugaacagggcugagggaggaggaggaggaggaagaaagaagugcaguaauggcucuugagguuauagggcagaagaaggaaggggugcuagggauuauggaaauggaggaaagcagaguggagucagaaagguuaggagaagaauagagggaguugaggacagaggacuaguggcagaggucagaggaaagcagaaaagaagaaggaggaauaggcaguguuaagaggucagaaggacaagagaaguaguuggaggaagaaaucaaggaagaggugagagaggagaguagaaggcaggcagcuugaagagggcauauugagaaugagaccagagggaagauguaggaaagaagaagauacauguccaagggaacauaacaaugauguaauaauacauuguugucuaauugccuguucaaagaaugaaaucugauguaacaguuugcuuguccuguaacugcugacuaucugaaggcaagaagcugguaucaucuugaaaggcuuugggauugucagauguuggcaaagcguaagauuuugguuaacagccugaaagagacuaauaauagugguggaugcuuaaaacagggacaaggaaguagcuuucagcagguuacuaaugcaaaucuaacaugucauuuaaugaagaaauuuugaaaaaauaucuccuugaaucagggauaauuacugaaauuaaugaugaguucauauauauaauuuugucaucauuaagggaaauagugagacaaguaaacgaucuagauagguuuacucaauaugugcuuggaaaacuugauaaagagauccaugaccuaucuuuuaaacuuaagauuuaacgagaaaauauaauucaguuaacuaaaguuguucacaaaauuccaaauggcauguuaucuauacaaauuuggaaaucaagaaagacuuuuucgaagauaacuacuaaaacacagcaaguauacucaugcacaucauuacccauuaaaaucuuugaaaaaaaccaugcuaauuuaccaauaccacuucuuacaguguccggauaucucaaaaauuacuuggaagauucaaauuguuauugugauuccuuccacucaugcuuauauuauucaaaauguuuuaacaauaacguaucuaugaauaaagggcaaacaagugagaagaaacacauacagaaccaaaauaucaaccaugcuggugauuucaaaaaugugcuacagugucaacucuugaaagaacauaucccuguggaucacauuccagccucugguaaugaggaaucucauucauacuuagaucaauaugaugguggcucuuccuccuauauuuuccaaucaaauagaaacaagugucaaggaagauaugcagcaaacgacuuaccugaugugcaggaccauuucuaccacuguauugggcaugugagcaagucacagccucguguccuuuaugggauugguaagggggguguggugcuuaggcaaggaccaacucuggcucauuacaaauccaauguauuugucaacccacuggcaccagaagcaccaccauuaccaucugauuggcucauccaacuuaucaguucuaaacgaccaucugcucauggaguuguaagcucaagaagaucaagaggaacaucuuccuuacuuguuuuggaaagaacuacaacauuaccaccugcuuccucaaagaguaauccuaacauagaucuaauaaugcuaccugaaguugaguuuacugccacaucagaaucacuugaauauuaugaacuacaaaaacaagguggucuaaauccacagggucugaaucaggagaucgcucuacuuguacauccuucaguaauuccacuaaaaaaucagucaugggauucaauuguggaucuuauugacucuucuuuaguuuugaacacacaauccauaaagucuucuuuuccaaagucaccaagaucuccaucaaaaucaaacucugaacauggaucacuaucaccaaauccaguugcaaauacaucaaggauuucuacuacccaaucaccaagaucuuacaggguaccuuguuguuuuucuucaguaccugccucacagagucccaaaccacaaauaacuuuaaauccauuaccagagcauucagugagucacuuaauaaaacuuauugaggcacagucaaaguuacccaugacacuuucaaaaagacaauuacauccaccacaagcaaaacuaucaaguuucaccuugagugaaguuuccacucuacagucaucguugucuucuaugaaaucaucuauuucaggccagagagcucuaaaaauaaggcaguauacaauagagucagcauaugccaguaucaugcaaaccccuucaagccugccaauaaugaccaaaccaagaaaugaauugauggaagaaaucagaaaaggcauuaaacuucacaaaacucaaccaagaccugaaaaugaggaucuugaaaauggagcagaaaugauccggguucgucguaaagcgaugggguaucauucagaaaaaucggauagcgaaacugaauggauugaauaaacaaagaagccaugaagagua

SEQ ID NO: 9703 - RNA, 1093 nt, Mus musculus
caugucuuuacccaguucaucccuugcuaagccagugguggagagcagcccagaggcccaagguggccugggugcugacaaacaugagagagcugagggagcagaggaagcaaagaaaacccuguggccugcacacccggguuugccuccugcaggcaccacagcaucccugucuggugaggagggccaguccuccaguggggaagugggaacucaggaaugccuggcaucugagccuccucagugggaagaggguaaggcagaggagaaggcaguaguggagucagaggaaaaggcagcaguagagucugaccaggaagagcgucucauuccucucucacagaugaucccauacaucuccuguuuuauuugcaaaggcuacuuaauagaugcggcaaccauuacagaaugucuucauacuuucuguaaaagcugcaucguaaaacauuuugagcacagcaacagauguccaaagugcaacauuauagugcaccaggccaaaccucauaaaaacuugaggauggauccacaauuacaaagcauaguauacaaauuaguggcaggucuagaggaaaaugaaaaaaagcagaggcgugaauuuaauaaagaacauugucugggaccaccagaacccgcugcuguuccacagccaggccauucaagugaagagaacacuaaggaaguuguggaauagugucuuaauuuaugugaacugguaugucuuuaguacuggagucuauggguacuaaugcauacacugaacauguuaagcacugaaaauccacguuuaucugagucucaggaaaugaaaccacuggacagagagaaacauuucucaaaagaacaacaagcuuugcugcagcuugucaaauagucaucacaugcaguggucaguugcugaaggacuuucaaacucaacaaguacaguguaugguagcagauaugaggauacaggaugaggauacaggaugaagaugcaggauagucugcugccuuuuguuaaggucuccucucagagugacuugcuacagcuaucaugaaaggacagaaagugagaaggccucugcagaacugaaucuuaauggagaguucu

SEQ ID NO: 9704 - RNA, 105083 nt, Mus musculus
ugcaaaugagccugagccuuccgggguuuggggcugggauugcagagcuggaagcucauugaaagcagccgcugguggaggcggggcucuggccaguuauccuuccaccuucccccacccuccucauccaaccucuguuuggcccuuagcucgguuccagccguugcugcagcuguuucccagcccuuuucaagacuccagcgaccgaccagaagcccuuguuuccaggauggugauccguguauauauugcaucuucuucuggcucuacggcgguaaggagagugggagcccaccuuuguuguuuuccaacacacuaguccucuucugccccagaaccguuaaauugaagaaguuacacuggaagcuucuccuuagaagacgcaagcaucgcccagaguacccccuucuuuccuuucuuccuuuguugcgucgauuuauuuauuuauuuauuuucucccguggaguuagcuuuguuugccuugagacguuaguguucguuucuaaaggaaaaagaaaacuaccaaguuuaggagauaacugguaaagggacuucacgguuaggugaagucaaguaaaauaaaaaacaaguggcuuucagguuuuuuagagugagacauuuaugaaauaugcucugaguaccgaguucaggggaaguagugcauuucuguaaaggaugagggugcugaugggaagggaagggaagggaagacuucugaguacuggaauuauugugaagccacuggaauggacuuauuuagagagcgugcaggugggguauauaauuuuaaaaauaggcgaaagucaggggcaaugauacaaaugauuuuuuaaaaaaguucuucuccucuuccaccuccuuccccuccuccucuccccuucucuuucuuccuggaauaugaagccauuuaaaaaaaauaauguuguaugagaccuccccccccccacuggaucuuauuuugaguuuuuccuuuccuucgaaagauuuucuuucuaaaacccacucuuucaagacuguugaaaauggaggcaagaacauguggcaacugaguugcuggcucuucauaggauuugguuuucuucuuugauucauuugccaauuguuaacuuagaauaacaguuuuuaccauaucugaggaacauuggguaaacugaggugaaagcuggaaugcauacuccugucacaugaaagagcuucuguuccagcaaccccaggaggaaaaauaaaggcccucaaguggcagaagcagaugugugggcucaggaauuugaauguagaaaacuccucuagcuuuagaguggcagagaucccagguugcuggguuguugucauuuacauuuaguaggauuuggaauagagcugaaggcuauaugaaaucaccagaaccaugaaccuugaacuuugucuuugccaacauguguggguguguuuagacgggcuuucaaaauauaaggaagccuacucuuaaaguuauggagcaaacguuuuguuugaaaaaauagaaauguuuauuauuuccuuuggacccuacuuuagaagcaucuugucuuccauaccuaacauucugauaccucagaguaaaacauggguuaccgaauaucaaucuacuacauuaacugcauuuucaaaacccagcuuaaugccuuugguuaauccuuauuagauugacccucucaagcacuuagguuuuguuguuguuguuguuuugugagguaugcaguuucaacacugguauuuguucuuugcuuucucuaucuucuauuucucucccagaaguaaacucaaggagaaacugcuuuaagaauuucaccaaguaauagagucacaccccccccucuuuguuaagacauaaaaugucuaagugcccaagaaaggauuaagaguuuauuagaugauucaaaugacagauacucauguuguuuugucuuuuguuucuauuguuucuucauggauaauuaaugcacuaauuacauuuuuaugaaaaugccaaaaugaaagauuucuuauuauacucuggcaauuuuuaaaaaauaauccuaaaauaguacaaagaguaucuuaaaggagaacuacuuaauaugaauggggcgguggcuguuuccuugaggaaggaaauuucaguuugcaguaccgaaauuuucuuuaagauagcaaaaaagcauuguccuuuuaacaaaugauuuagaaauuugggggcaaguguucucaugggaucuuaaaaaaaaaaaaccugaaaagauacauacuuguaaguuauuaguugucuaaugagugcuuuaaguguuuggcuuuggcuugauaauauguauguauugaaugauuugccugcauauguauacugugugaauacaaugcccauggagaccagaagaagguguugggucggucccuggagcuagaguuccagaugguuaugagccaccacgcggaugcugggaacugaauccagguccuuugcaagaggaaugagugcucuugacuauuugagccaucucugcagcucugaaucgauuuuccugacuguuaaaaaaaucagcaauauuagguggucaguuguucugugaaucaucuagagcagcaauaauaagcaauauuauuuuuacagcccaagacuucucauauuucucagccugauuuaaaaaaaaaaacacuuaaaauguguucucuucucugcccuaauacacaggagucaugcuuguuccucaagguuaaaaauauaaucaaauagauuagacuuuucaguggauucuauuguuuguuuguuuuccagacaggguuucucuguguauccaugguuguuuuagaacuuacuguagaccuggcuggccuugaacucagagauccaccugccucugccucccaagugaugggauuaaaggugugcauuacuaccacccagaggcacuggauucuccauaguaacucuaguaagaauagcagauaggaaugauuaaguugucucaggcagucucacauauucuugacaauaaugccaugauuauguuucuuucagaaaaggagaugcagauagagagagguuaaguaacuuccccagugccguaaugcuucgacgccagaguuuuaguguagggaaacuugcuuaaguuuagacguguguuuaaaauauauuauaugcugacagugaugcagagcagcuaguaggcaugaagauguaaaugugaacaugacuuuagauguuuagagaaugagaaaguccuguagguugaaacgaauugccuaggcauguccauaaguggggaccauguaguaaggauugaguuuccaguuguucacagaaagugaauucuguguguucauauuuuguuucuuaucacuucuuaguccaacuuaacaucuguucucaauuuuugagauaagcacucauugcccaacuuagacucaaauuuagugauccucuuggugccuuccaaaugugaggacuaccauagauuuguguuaccacaucuggcuuucuauuaccugucuguuuagaauuguuuguguuuacuauugaugugaugucauguaguagcauauguuugaguuuagaucgcaacgccuuguaaauuuauauuuagaagaaaagguauauuaaacucaaugucuacauaacuuaacaaguugcaguaacuuuuaucaacaaacaaacaaacaaacaaacaaaacaacauuguugaaauuaucaaacugaugagagauugggaaaguuuuaguuggcuuaggagaauuuuacccuucuuucuuccagauauauauugauguccucuaugcauucugugggcacuggugcagaaacuugaaggguaugguauauaggagguuucucaggauuucauuuagggaauagcauaugcaaugauuuuucucuuuuuuguuucucuuauaauuacuaaaaacaaagcuaguuuuaggguggauucuaugaugguaaucacaaauaauaaaaacaagggaaugaacugaauacuuuugaucaagucacaacuccugacucacacuauuuucaucauuuggaauuuauauguagagcaggaaggcacuguuuuuuugucaggugguucuuuaguaauuauguuaggugacagaguuccuuguuguucugucuuugcauauauaaauugaacccugguuuaaaacaugcuuuugagcaugucauaacugccaagcuuuguuggaaugguauuauuuaaaguuauucauaaacuaguuagaagaucaaacucagaaacuaccaaaugaauaggcauacuuuuaggaaauuccaagcuguagagaauguugacuuuccagugccaagugcaaagucugaaugaagaaucaguaccuuaguuugguaagcaguacuugaaagcuaauuucccuguaacaguaguaaagccacuggaauaguuuauccuaucuuaaaaaggcuuaagaaacauguuucccauccaaguacuaaucaggccccauccugcuuagcuuccgagaucagaugagaugggauguguucaaaguuguauggccauaaacaggaaccgucucaaugguaguggcucuuaugacuuggaaaugguuaaaacucuaauagcuauucuaccuggcagaauguaauaugauagguaagcgucauaaccucauagaagaaaagggugaugugaauuuauuuuuagcauaaagacucauuauucuguugaagaaaaauaauauccauaacaaccuuucucccagaauacucuguguugaagucuaaacacugucaggcuaaaugcucuaauucuuuguguguauucuuagguguguuuuuuuucuuuuuuugcuuuguuuugcucuuguuuguuuguguuuuguuuuguuuuuuuuccgagauaggguuucucuguguagcucugacuguccuggaacucacuuuguagaccaggcuggccucgaacucagaaaucugccugccucugccucccaagugcugggauuaaaggcuugcaacaccacacccggcuuagguguguuaaaaaaaaaaacaugcauugcacaaucaacuacguaucuuugacuauauauguauauucuuugagaaguuuuuaugugcaugcgauguauuuuguucauauucauucccuuccacuagucuccuuaacuccuccuggaucuucuccccaucacuccaaacuucuugucuuuuuuuuuuucuuuuaauaaaauaaccugucaagucaaauuuguuuugcucuuauacaaauugaugugggccuuccccuggagcuugcauaauaaaccuauuggggaaaacaccuuuaaaggaaauugacucucccucugcuagcgcaccaucaacugucaauagccccucagcuaaagguagggacagaugagcugagcucccauccauguuacacuauugauuggcuugauguugagcugacaacuaugagucuuuaucgaauauguuuugcuuuaacuggauuaucaaggguuaacuuuauauuguguuuuauugguaaaauuaaguagguuacuagggaucuguuugccuucaauucugccuugcuaccuaaguagagcccuuuuaaaaugacaauuuaauuaauucuuccuaucuagaccaagaagagacaaacauacuuguagacaaaaagggcagaucuuuuaugacaaccgcuuuuguuagcaugagagacaaaggugacauuuaacacuuggccagcccagcagaguuuuaaacagaggaguuguuuucuagcccgcugcuuuacauuuugcauauauggcuguggaaagggcuguagacuugcagaaccuauuaaaaauucaaauaaaaguuuaaaaauaccauugcaaauucacacucugcauuuaaaguguucaggacuguugggcuuuuguuguccuuguucuaccuucuccuuagcacagcuacucaacauuugguggcaguaauaguaagaaaccggcauugugagcuccaggccccgugccuaguuuuguuuuguuuuuuuuuuuccguauauuaucccauuuaacucuuaaaguacugugaagggcuguuaguagaucccuuucuguguuugaagagagucuaacugagauucacaagagauauuagguguguauugaucaggaccaaagagcuagaaauggcagagcugggauuauaaagacuacagggcguugccuucagaaccaucagcauuguuauuugugugcccuacacguauagauauugcauagaaauuacaucucuagcacauuaagaugcugauuuuauaauuaccuucggggccaggcuggucuacagagugaguuccaugacuaagggcuacguagagaaauccugucucaaaauaaauaaguaaauaaguaaauaaguaaauaaauaaauaaauaaauaaaauaaccaucucaguaggggguguggaacaguucagugaguaaaaauggcaauguuaucuaugcuaauggccugaguuugaguuggagaaggagaaaaccaacuucugaaaguuguccuccaaacccuccccuugagguacccgcauucauacauacacaucacauaaaugcacaugugcacauccaaugggggggaagaaacuacuugggcgauccucuuauucaguaaguguguucucaucuacaaccuggacuugagaauaaggugggagggagacuagggcaaaagagggaaacuaggcgaagagugaggccagaacuagcauuuccuuuuacaacuuaagaugcaugcaugcauggacacauaggcucuaucagaaucauauuuuaaguuaucuuuacuacuuuuuauaguggcuugugcagcauauugaacuucgaugauuuugauucucuguuuuagaaaacuaucuuuuuuuuuuuucuuuuucucagcauggcuguguaaacugauaaucauagcacucuggaauuugagguacaaauauauuaaguuugaggccagacuaggcuccauggucagacuguaugacaaaaaaagaaauaaauaaaaggaaaaaaacuuaaaaaaaaaaagaaacaaaacauaccauccaaccccuaauuacaggaacaacaaaacccuguauuuuguggcuauacaccagcaugguaaaaaaaggaagguagauuuuuaugagucuaugauuaaauuggaaagcacuauauuuauaauuuauaaagucuggcuuuggauucucgucuuuaaauuauauucuuugguuuagcucuuuuggaaauaacagccuaugacagaguuggguuagagccaaacauuucugcuugggagauuuccaacaaugaaucaagacuaauuaaacuucaguuuuaagcagcagagaauauccaucucagguaacaacuacugugagacaauuuguucuguuuaugucaccgucaccucccauacauacaguuguuucaucguaaguguggcccauuccucaguguuauaauuuuaacaguauguauuuaaucaaaguuguauggcuuaggaaaccaucaucuccaguauaacauuugaaaguugauuuagaaggaagacaugaguggauaauuacuuauuguuuaaaaaaugauaaaguaacuugcuuuaauuucuagcacaaauaauuagucaacuuuagcugacagcacuaugcaaaaggcuggugggacaucuaaguggcgaggugcuuguccagaauggcugaagcauuggguucgaagcacuggggaaaaaaaaaguuuguaaaguaauuuuaagagcugcuuuacugucuuucauggaguacguaaaaauauaccuggcacagcagucacaacuuuauauguaauuugucauguagcaaacuuaguucagagaugacaauucugucccaucacaccaggcccuaccauccacauuuuuauuugaggucacuguguagcacuagcuguccuggaacucacacuauauagaccaggcugguauugaacuccuagagagucaucugccucugccuuucacaggcaccaugauguguggaucccauuauuuauuuuauguauaucagugcucuaucugcauguacaccugugugccagaagagggcaucagauuuaauuuggaaguugaaauugaacaauggauuuuaucuaguacauuuuuguaaauaccauuuguauucauaauuuauauuauauuauuauaugcuuauauggggagcuuauauuuacuguuauauauuauauuguacuguuauauguuuauauuguauggugaauuucagagaagaauguguaucacauugggauuuaaucugacuuuaccaaaaaagaaaagaaacauguacaugagcaccaaacuucauaccccaagagaucguaacauuacucaaaugucagagacucaagugagaagcuugcccugccagcaauauagcauaugucuacuucaaagccaguguuucuacauuuugagaaaacucaaagaaauaugagcuuggcuaugauuuauaccuagauguucaaguagguuuaguauaaaucaauaucuaauacauuuugaaaaucauucauuuuuagagauagauuuuucucucuacuauugggcaggaaguucuugaguuuugcuuuaagauuaauuuaagcaaaaauaauucauaagcauacuacuuauaguauagagaacacaucugaagagcaacuauuggaaaaagucaauacuauugcauguaaaagcaaaaccuaagagauucaugcgaaguaagcuaauuggccuccuuagauuuuucaaacagggauugcucugaaaacagaaguaaacacucuuagaagauuucuuacuaugugaaauaacugggauuaccccgcauuucggaaaagaaucaucauuuucuucauuuccuuuuauuuuauggguguggguguucugccugcaugcaugccuauguagcacaugcacgcaaugcccacagagacuagaaggggacaucggauucucugggaccaggguuagagaugguuguuaguuuuugggugcuggaaaccaaaauuguuccuuuguaagagcaaaaagcauuauauauauaugccuucaugucgguagcucagaguacaagaaaguacauuuauuuuuuaaaaauuauuuuauuagauguuuucuucauuuauauuucaaaugcuauaccccaaauccacuauacccucccuccacccugcuccccuacccacccacucccacuucuuggcccugguguuccccuguacuggggcauauaaacuuugcaagaccauucuuaaccacugacccaucuacaaguguaccacuggacgucauaagauuucuuagaaauauuugaaauuggaaugcuaggcuuucuuguuuguuuuuguuuuauggcacagucuccuuaaguccccaggcuggccuuccuauguaacugaggcugagggugaccuugcacuaauggucauugaaagugcucuuucugauuaugacauaugugucaccaugaauggcuucuuugcgugauucaucuuaugugaaagcauaugauaaaagacagguggcauauuauauaugauaauauuaaauguauuuuucuaaacagucuucucaaguuguagaaauucccuauguuguagucauggcuucaaaccauagaaggaaggucuguuccuguaucuaacagagcagauuuugaggcuaggugaguguuuuuauaucuuagguggauucuauugaucgccuucuguguauuagaacuagauuggagggcccgauuuuagaucuauuuuagaaugaaacaaagagccauuaauaauaauucauuuacuuucucuacuucuuauuauccagaguauaauuagaauggaguaggauucuaaacauuagcagaugcuucaauagauggcaugugcaauucaaaugcaaauaggcuaccaauuggaaauuugugguugguauucagaaauguaauauuagaguugagaagagaugauggcuagaaaguuaaaaaguguaggcgccauuuacaugguuuuauuugaaacuguagaaaagaaggaauuaaagaggaaggaauuacaaaaugagaugaggacugaggauaaggguacaaccuuggugaaggagguuguaaaaggaacagauaaaggaggacgcuucauuaaggaagaagagaggucuagaagcuaggauagaggugagugaugagggagcaugguuuggcagugccauauaagucuugugaaaauugcuaaaaugccauugcauuuaaaaggaggaaauuauuugcgaucuuggacauagcaguuucagugacugugauugcugaaagcaauaauccugagugaaaggcauaaggaauagaauacauauagaagaggggauccgcauugucuaguuuuguacuaguggguugaaaggaaaggcuauccaaaguacauggugaguaaacaggucagcuaggaauauacaaugagaccccuuuucaaguaacaacaggaacaauaauaaauaaauauccuuacuaaguuucauauauauauauauauauauauacauauauauauauguauauauauauauauauauauauagacuaugcagagaguucuuuuauuuuaacucaccagaugugcauuguuuuuguaaggaaagaaacaggaaagucacaguucuuacauaaaguaucggauggcuggacaauuuccacuacgcuuacuugccaaaccaauuaaaaacauggaucuuuagaauauacuaguuugcuggcaggguuuaccgaguguaagcaaaggccuggauuugauccgaaacacugaaauaaaaaaaaacaaaaacaaaaacaaacaaacaaaaaaaaccaacaaaaaagaaccaaacuugugucuguaugaguuguacacuuuaauuuuuuuuuucuaggagauggauuauuuuacccguaagaaaauacaaccaauuuaauguucuuuucaguugaaucauuuaaacuuaguuucaugccuaguacuaauggagccuuuugaagguugccuaguauaguguugugagaucaguaaacugaugcuucugggcugacuuggaaucuuauaaaugaaauucgaagaggguaaagagauaaaagcaaucauuuaggauuccauauuaacaaaaggguuauacucuacauuugagagguuauagagcuuuggcucuaaacuuccacauggaacuaacuugauagcauggauauauggaaaacuauauagacaacucaaaggcacggaugaaggaccuugcaaagugaggacauuuugaauagauuuagcuacaucauauucugccaguucucuguccaugauuuauuuuugcuguggauuuuuuccuuucaugcucuaauucacacauucauucagaaaauguuuaugccauucacuggacuagauuacagaccuuaguucucaaggccaggaaaggaccuggaauaaaugaaaugccucucagacucuugugugcgucagacugagaaaggauguggaugucaugggggggggggggguuaguuacauggucugcaaauaaauaaggagaauauaugaggugcucauaggccgagguacuuuugggauaucucugcugguauauugauaaaaucauacuugaacaguuuuucuaaaaacagugauuuuucuccaggguuuuuuuuuguuuuugcuuguuuuuuuuuuuuuuuuuuuugguauuucccuggaagggugugggaauuaugcucuaaguaaaaugaaauauuucaguuuuuuuuucuguacuugagcaugcaccagaaaauauuucaguuucuuuuuucuguacuugaacaugcaccagaagcaugauugaggucaguucucaaucaaaaugucaaauguagugacaagcugaaagacuuguauuuuuucugcggaauugugucuaucaguuauuuuggaauuccagaggaaaauacuaaauguucuauuauuaucugaccacuccuacccagucuuaucuggauucccuucaccuugggaucagccuggcugggacagucuguauaaauaauuaugcuugauaaaaacuugaggugcauucguuaaguacuuagaaaagccuaacuucccuaagaaagucucauguuucccccucucucuggcuuuucccuugcuuuuuaaaagcuucuaggcuucccaaguuuuugguuggaaguuuaguucagguuuuguacaucaguuugcuuuacuauuuauaccacugcuaaaguggaugaggguuauauccugcgcuagauuuuacaacauggggcuaucaguaugcuggcuuuugccaaccaaccauaugacagagaaaaagcuaaauccugaaauaauuaguauuuuaaguuuccaccagauaauaagacaaauacauaauuuuaauucuuucccuucucaacauauuucuagcucagcuuaauguacugauucaacucugagaaaagaaacaauuguugcauuaucccccagggaguuaguaagucucucaaaccagguguucuguagauggguuuucuauugcaaccacacaugcuccuuucaacacagcauuucaaaugucaguuucuuuuuguaauaguauugcucuugguagacuaaagcaacauuauguagguagaagcaucauagauugaaagcaauuucuucuuuguuauaaagacuccgugaccauaucauagaauguuuguugucuacuggauaaaaaucaguuuauauucucuucuauuuuuauaaccauaaaauugaaagcagaauuuuagaagcauauaucuaggcgaggucauagaaggucauccaacccauccauguaaggacugcuuaggagauggcccagaaaggguuugaucaauuuucucuuaguaaacucuccagagaaggaaacauacacuaucccaugguaauacacuuuaguacuacucuaucuuucuucuuuuccuagacuacaggaguaugguguggaaaucugggugacaagugaaauucagcauacccauucuuuugugggggagggaucagaguuuugaaaucagaaucauaggaaguaaaggacuguguaccauauaaacacucaccuaguauuaauugaacauuuuuuccucaguauccacuaaaauaauaugcaaagccuuuuaaaauuauuuugcaaagagccuguaaguuuuauuuugagaaaguuaaaaauaaaucccaugacuuuuauuucuuuccuucugcuuuucuuuuuccaggaaguacucuggguauugcccaugccugucagucagggcauuauggggugauaagaggacauuaccacuaccacguggugcuuauuucaugaggcuuuugcaaccugcuggauuuacauacauuucaagauagaaauuuaaaccuuuuaaaugugaaggccuuuaaaccucaagcacugggcauaguugaauggcauuacuaaugaagaaaauuauaggacaggacugauuuaaaacccaaugcaaugccuuuaaaagguucaauugcuaggaaaagaaccguuguaaaaauuugaacuaaacuguuucaguuguagagaaaaauaccugccauaggacucugaacuccaggcggugacuuuuuaagguaguuaaaugauacuuugcuagcaaucuuuucuaucaccagugcccuacucaaccaggagcccccagucgagacugagaaaggaaggggcuuagagagugcuuuagaccauguaacgaccauuccuuguggaaauaaaagaccguaagcuugcauccuagggaaugccuagacuuuuuauuuuuaaaugaguaauaauaacuacugugaauuuuauugaaagaaggaaacuuuucaccagcaccacaauaauugcuuaaaauuguuagcugaaaaaaauaugucuuuccucuuuuauauaaaugaaaaauuugccuguguucuuagucauuauagacgugguuucacaagaucuucaaguuacuuguuuuguuuguaaauacgaauauuagcacagaagagaggccuguuacuuguuuccauuguaagugaaucuuucucuugagggaagagucccaaucucccuccauccucucuccuuccuucccuugcuucuauccucccuucuucagccuuccuuccuuuucugcccucuucacucuucugacucuuagcucuguuuuguuuuuaguuuuuguaagaauucacagugugagugguuccaguggcaaucuuagagacagaggcagauggaagggaaugaaaggaaguuugaagccagcccaguuuguauagcugaauuccaguacauacagggcuaccuagcaagucugucuuaaaaaaccaaacauaauuuuuaagauguuaaaagaguacugauuauguuccagagcacucuuuugggaagcuccaaauucaguacccccucgccacccccaguucuugaaugaaggaaaaauaagaaugcacauugauuuguguuucguugaauguguuugauucaaaguuuguguccuaagggaauuauacuuuaggaaaggaaaauggcacuaaaguaauuauauagaaucauaaaagugaagaaggcaaaagaagaaggaagaagggggauagaaggacagagagugaggggaggaaggaaagaaggaaggagggagggagggaggaaaggaggaggagaaggaaggagggagagacaaagauuggaaauccagaaaucaagcuacuaugcugccagugacagugacauuucuaaaucuuuguuuucugguaagggauacuaugcuuuugaaaacuugcuacacguuuuucauuguuagucuaauuucuacguguuuucuuucacaucuucuauuucuccugcauauguuagcuaguauuucaucugcccgguauuaaacaucuucucuugaugaauauuuuuuucaucuacuucaggcacaugugugauuugucuuacuguagacugucuuuaaauuauuuuuuuaaaauuugacuuucuacugaacaugucccaaauauggcaacauuucccccuaagcuauggauggauaagugugcauaugcucacacagaaauaagguaucuggaguuuggggagcacaugcggaccaagacuucuuuuuacaauauggaauuuauugaguaacaaauaugagguucagcaauuuaaguuugucaguuaaucugauuaccuuggcaaucugucuaagguaagcacaggcuauuuuauuagaaacuuaacuucuaauguuaacugccauaucucacagcacacaguacaucagucuauccaucgguuggucugucugucugucugucugucugucuguauuugucuaucucuccacauauauguguuuuacagagugaaaggcaaguuaagccaucuucaaaaaguuucugaaauagucugauggaaaugcaaggcgaaucuuuguuguuaaggaggugcucucaugaaguuugggcuuauaaacuuuuggaguagguagagugagugccuuguuccacuaagauuauuuuagugcccacucuuuucuuuccguuuccuccucuuacuaccauuaccacuuuccccuccuaacuucaugguucacccacugaauccacuuagagcugccugugcaagucuguguucagaaucaaggcugcagcuaaguuguacauugagucauagacacgagcugacugaaaugcccuggauuuauuaaucaauggacacuugcauguucagaagccauaaggguuccuaaacguuucauaucuagugcauucaguuaaguguguucaauugcucacaguuuaacaagcagggugcuagagaaauacuccaucacugaacuauguucccaagcuauggcuuuuuuaacaguuaggcaagaagacaagcugagguauagaguguauacuuaacccaaaaccacauuuggggacaaggcugaggaugcaucacgaauagauauuaaauggcauuguuucuacucauaauugaacugaauuaagauaauugguauuuacuuauuuuauuuuuuacaaaaaguuuacuuugaaccucauuuauaauuccauuauauuuaccaugaaccccaauuuuugcuauaauauaauaaaugaaccauggaucauucuuuguucagauguuuuagucaacacucucuauuuucuaccuugucuucaacucuggaauugggaacacuuaaaaaaaaauaggugugcauggagaaaccaggcagggguguuacagcuucuucuaugauauuccugauuucaagcugacuuuagagccuggcaugauaguccaugacuguaaucccaaagcaugggauguugaggcaggaagauggcuuccaaguucgaggccuguucgggguacaaauugaaacucgaucuaaaggaggaaaaaaaaaagacucaacuucagucuuuucuaaaugaaaugguucaaaugauggccagauggauuauauagaaaauuuagaaaaucuagcucccuucucaaccauauuuauauauauacauauacauguacauacacacacacacauauauauguauauauauaugaaugaaaauguauuucacucaguauccugccagucagaucaucuccaauaccaauuauaguaauauauaaucaaaacuaaggugaucacaguaauuauauuuaauguuuuaaccaaaacuauaugcuauuuuauuuuauauuauugacuugguuuugacucaggugaaggccucaaaaaaaaaaaaaaaagggaugcuagacuuugaccucagugugagaaguaaauuuguuuucaucuguaaaguuucuuuuuagaaaauguguaacauuuuucuuucuuuauucucccucuguguguauaugcauguguguaugcucaugugcggauguacuuguaguugucagaguacaacuugaaagggucaguccuuguccuuucacaauaugggcccaaggaucaaacucaggcugccaauuuuguaucugugcacacugaaccauuucccuguccuggacuuucguuuuacaguuaaaucuuuauccaacuuuuagagaucuauauucaccucagguuucuuuuguauguuuuuuagggaaagaaguagauuuguaaaagccaggaugauuuuugcugcuauaauaguuuccuuuuaaagugauguguggauuuauauugauaaugcuaaaugugagaaagaggacacagcucaugaauguuagccaccacuucauaacacuuccaauugcugagaacuauggacugaaucacagcugaguugauauuugagggaaacauuuucaggauuguuucucucugccauccauucuauccagaauucacuuauuagcaaaaaaauacuuuaaccaucucuagagaacuccauggauuacauauauuuuacacuauaguugcguugugucuaagguguuuuauguuauucauuuuuucuguuauaguucuuccuuauagacuuguaaaguugcugauguuaaucuuaaucucuguuguguuuucagacuaccacacugugcucagucauuggcaaguauauaaugaauauacguguauggaauuugaaugcaugaaugaaugcaugcaugaacaaaguauuuuauuuuaaacagcaauguaggugaaaucauggauuugauaugguaauugcucaguuuucuuuuaccuauuaacauaaauauauucaacugaauaaacaugcucauucacauacuaaaauccccuuaggugcugucauggaaacacugcacuaaaggcacuguuuaauccagacaucugggcauauuaccuuugcguaauugagcuuuuuuucucaccucuguuuuugcaaguggauuuuuguccccuuauuccacaguccuuggucuuauccauuguuaaccugucuucucuaauaaacucuuucucagugcaauaauuaucuuuacucccaaacuccuuuaccauuuuugucagauuccuuuucccuuuauacuaaucaggagaugaauuuugaguuuguucuugucuccccccucccccaucuucuuuauggcuugaggacagcacaaggacagagaacuguuucucuaggguuuugaucuguacucauuuuuuguuccuacuuguuacacaggcuggugcuggcuucaccucccgccucagccugccuggugaggugguguccucauuacuuucccagggcaagggcuaugcuuaaggugaucauggaugaaugaugacauggaggcugacaaagaggucagggucuccuuguugguguccuggaggaucaucuaucuggcuguggaucucauuguucuuugaaucccaggagccuaucagagaccuuauuuccuggcugugauuuccauggcuuaggcuggugguggugauuugaguggcuuuuuaauaaugugagccagguggugguggucgucuugcuccuaauugcugccauuacccacaaauaccaccaucuguuugcuuugccaugguuuccauagaaacugccccccccccauguuaucuugguggaccuccagagugucugaauggaucuuugaguuucgggugaugauaaacucuucugaggccccggcugagaccuuuggucuuggcuacuaagcauaacagaaggauuugggagaagagaagcugagcccagaaaggugagagcuggagucucccccagaaagguaaggaaguaaacaggccuaguaaacaggccuccaggggaggauagagcagaccuuugaaagagaaacuaauccuauugucaguuaaucuucuugugcuaaucgguaaaacuguaaaagugaaacuguaaacacgagauaaguagagauaaguaguuaaacuguuaaacagacugugucagguaucaucccauugcuagcuuggaaaagauguucuuugguauuuguugaugaauuauuuacguuuugugaugauguugcugccuuaauaguuugagcaauguuuguguaaccuuguguggagcuauuguauuugugaaaccugauucuagauggaaagaaucuuacagggaaaauggaccuauagugcacuccauuaaacaucuuauuuaaaguauacaagcuuagagcuguaaauuguuuuguuuuugagauaggguuuuauuuuguaguuuaggcuggccuggaacucacuguggaccccaggauggccucaaacagacaagaagccuguguuaaucucccaaaugcuggaauuacaaggcacaaguaucacuucaucuggcaauuuguagcacugcaaacauuuauuuucuguauucauauucauaauaguuauugagaaaggaaaguuuccccacuguuagauaacccaguuauuaaaaagauuuaaaauuaugccaaaugucuuuugagcccuuacccagugcucuggaauuuuacauucugaugucugaaacgugacauuagaacccuucaaccuaacauaucaucuuucauaucucccugaaguuuuguuuguaugugcauguguguguauguuugugugugagcgugcgcacgugagugugugugcacaaacacaugcacacauguuugcaugcuaaguguggcguaagcauguauaagggcaugcauguaaaggcuggagucagccucagcuuucuacuauuauuuauuuuuugagacagggucucucauugggaucuggggcuuuuuaggauggcuggucagugauccccagggaucugcuugucuccuccugaauuagcaaugggauuauaauccauugugcuuguccuuuuauaucaguccuggcaauugcacuucaucuucaugcuugugcggcaaaauacuuuaccaauugagcuauauucccagaacucaguuuucuggaaacaguauuugauuauuugccugcugauauggugcauguguuuuauauccacuauuauauuauguuauauuauauuggugccuuguucaaauuuauauuccuucagaauuuuauuuggagauuccuaccagagaacugcaguuacuuguauacucaugaccaaagaacaauucuucucugucauggaaggguguccuugaugacaagucugaagaggcaggaggcauguguacgaguggugaaggaggaaggguccaucuuagcuaucagugcagugagaacaguccugacaaugauuggggugccagauguugugaacagauugucuucacagucaagacuuuaauuccugaauguaacuccuaaauguaguuucagucacucucuuaaaaugcuauaaucaccuaugggugauuuaaucucucucucucucucuuuuaaucucucucucucucucucucucucacacacacacacacacacacacacacacacacagaagggcuaugcugaaaacauaaauaaggaaucacacacauugagagagggauacagagaaauauuucauaauauauaaaugcauauuaugacaagugguguuuuuggaguuuuccuuaugacagagaaacuaauggcaguuauauacagaguaaauguuauauuacaguuaaggguuuugccugugcaagaccugcacagguucuagccaaugagaucccaguacugggagggggaaguggacaugaggauuccaccucuacccaaaaaguuaccugcaauugaaagcugcuagaaaaguaguuuuugccauuggcaugccacugaguacguauaucagucacaaucuagggcacgucuugugcccaggaguacuuagccaacacaaaaggaacccaguguauuucugucucauauuucauauuucucauuuuuuccuuuagaauauuuuuauuuauuugacaccuuuauacagguacacaguuuauauuagucauauucaacuuaaguuccccuucuuucuccauuggacccucaccuuuccaucauauauuuccuucccaccuucauuuucuugucuguaaauaauucacugaguucuguuaguacugccugcacuucuauaaguaugauuccacccgccuacauccauacaaacaucccucaaaaaaaaaaagacaaaacaaaaacaaaaacaaaaaaaacccaaaaaacacaaaacaacaacaacaacaaaaacaagcuccuuuuccaagcagcugucaguuaccaauagcucuucagcacugggcagauccucaaugagccuguaccauucaugguugaauguugaucggcuugaccuugugcaggccgucugcagguaaucacaauugcuguuaguccaugagugcuguggucuuuucacacccagaagacagaauuuuagugaauuucuccccaucuucaaguucuuauauuccaaguacucuuaagugauguuuccuuagcuugcuuuuagcugggcuggggaggugauauaaauaacuuauuuggggauaagcucuuaauagaaauuauuccuugcacauuagacaguuauaaaucuuugcagugggugcuguucacugcagaaagaagagguugagaguaggguuuaugaauaucuauacacauaaaauguucagaaggcaguuugauaacuuguucauuaagcagaacaagcgcaguggauuccccuuagggccugugauuuuccuuagccaugggcuucugacuagauuugaagaggaaugaguuccuuccuguggagcagaccucaaagccaaucagaaagcaauucguaauccaggaauacuugugcugguauuauaucaggaaguagccacacaguauauaguagcuugcuauuguaccaugcagauuccauuggauaaaacuauugauaacuuuugucccacaguggccccacacaguacuuucugguacuaugaaagcuacucagcaggcaggguauuuccagaaaaacuccacuugaucucuggauguccuguaaccagaguguguggugucuuuagccgagggauuuuacuaacuaguuuuagaggguaauuaagagcaaugguaauagcuguguuguuuggggagccucuagaacaucuuguguugaaaacuuaagugggggagguuauuccauaccuggcgaugaguuuuucauuuguuaucccauguucucuucugaggaugcaggguccacucauccaaauguagggacauuuguccuuaaauuccugauuuaaaaauacauauuuuguaacuagcauauaaagcagugaguuucuguaaguuucccuaucuccucaguuuuaguuacuauccuuuccuuaguuuucaacaccuacuuuccuaucauauauguuuuacaguucucuacccuuucaugcacccuuuccagccuccugaccucuguguauacauacucuguauuaaaaacauaaaucuaaaucuagaucuaaaaaauuaaaaauuaagaugcacauaugagagaaaauaugguauuuuucuuucuagacuaggcuauuuuacuuaguaauuuuccaguccuauacauuuucccucaacuuuccuaaugucauuuuucuuugcagcugaauaaaauucguugaguguacuguauuuucaccuucuauuuaucaguugauagacauauagaccgaucccauuucuagcuauugugaauggagcaggaauaaacacagaugugcaauuaauuaucuuugcuaugauacggacaccuuguauaugcauaggaccaguauuguugguuuuagauuuuugagaaucucuacacuaguuugcauaguggcuguacccauuuauauucccaccaacaguggauaaguauucccccuuccccacaaccucuccagcguuuguguucauuuguucuugguuuguguauauuuucaaguaaaaauugagaaauauuauuuuacuuuauguguguggguguuuuaccugaaugccuguccaugcaucccauguguaccugguucccacauaggcccgaaaaagguaucagauuuccuggaacuggacaguugugagcugccaugugguugcugggaaucacacccagguccucuggaagagcagccagugcuccuuacugcuaagaugggcuaaagaaagagauagaaauacugaagagaaaaacaaugugaaaugcuguaauuguuaaauaaacaacuccuuggaaacucucaccaacaaaaugggucaaggagaggacagagaagguagccuugaacacacgauggagaaaacgguauugaucaagaugcaaaacuucuagaggaaaacugaguacaugccaaugcccaggcacagguaaggacauacugaguaagacccugauugcucaggaaauaaaaacagcacucaaccaaugggauuucaugaaauuaaaaaguuucuguacaguaaaaaaaagagccaucaauugauuagagaagaagccuauagaauggagaauucuuauaccagcuacccaguugacagaggauuagugacuaguaugugcaaagaacucaaaaaacuaaguaucaaaaaagaagcacuucaagaaaaauuaaauaaauagguaaaugagccaaagaacugaaaggaauccccaaaagaagaaauauaaauggugaauaaauaguuuuuuuaaaguauucaauaucaucagcagucaggaaaacagaaacuaaaaguuuuuccagacuucuucucacucuaacaagaaugauuaucaucaagaaaacaaguagacuagggagauggcuuagcaguaaggagcacuggcugcucuuccagaggaccaguaacaaccuacaacagccauauggcugugggcaagacacucauggcuuaguagauacauccugggaguauacaccgauucagucuuauucuguagcuugcuuuaauaaugccuaccagagacagccagguccuaauauaugaaagcugucugugugucuuauauggaaaaggaaauguugaagguuuuauugaagauuuuaagauaggauauauuuccuggguugucuaugugagccauaaauguaaucagaaguauucuuauaagagggcagagagaaauuuauugacagaggggaaguagauaauauuccucuggaaguucgaggauggagggaugugaugaugggguccuaagguaaggaguguagcucgucccuagagaucagugaagauaaagaaauuggaauuuccaccagggcuguuagaaguacacagcugugucaccgucuugaguuuaucacugucagucuaaugccaaauugcacugagagcuguaaggggauaaaauuugcauugguuuaagucacagggcuaguuugcuagauagaccagagcccacuaguuuaggcaucuuaaguggucugaaaguaacuggagcccucuucugacaauaauguaaauaaccaauaauauuuuuuuuuuaaagaacucugggacuggaaaggcagcucagcaguuaagagugccugcugcuucuguagaggaccagaguuggguucccagcaccuuguaacuccagcuuguuacuucagggccaggggucugaugucugcuucuggacuccacaguuaccugcauacacacacacacacacacacacacacacgaauaauaaaacaucuuaaaaauaaacaugugauuugauuucauaccuacuaccuagcacuaauuuccggagaguagaaaagucaucagauuuuaugaugugagguugcuagucacuagggaaauuuuaguuauaccaugguaggaaggaguauggacagggaggggaaguuuagugguugaguuucaguuccgugauucauauuuuccuuaguuucuacuaacccccaugacuuuaacuugaaaaggagaauacuagcacuuccacgccuauuccacgaaaagguugucauaaguaagugugauuuaaguauuuucauucuuuuuucuuuuuuucuuuuuuuuuuuuuuuguggcucuaaacaauuuuaucuuuaaaaagaaguaaagaaauaaaaagaaccauccccagaacagggaaggcucucagugaauccgccccugccuauaauucucccuggcuccagaaccuucuguggaggccucagcugcucacuggccccucuccuauuccugggauagcagccagcuagcauccuuuccaaccucuugaggaagccugcuccccagaguacucagguguuuaucuuaacuucugcuccagagaaaggaaccaguggaaguacuaggcccacagacccucucccaggcacucuaagcaagcccagauuaauguguccaguguccaccaagaagacagcacaugccaggugccgaaggaacaccaagcucggggacugugaggcgggagcaggcaaggcuguugaugcacguccacacugugcuucacaccacucacugcagccugccaugccacggggaaaacacacuugccaaacuccccugagucccaugccagaagucggcagugaaggagagggccauggguuuagccuguugcuccuagccgaucugcaguucuuggcccaaagccgcugaguccccagaguuaguugcugucuuucuugaugacaaucucuaguccauaacagaggccguaguagcacguucuuguuuuuaaggucuucuaccuguugccgaagcacaucauuguccaggugcaauugaucuaaccccugcagcucuucagacaacuagugauugcuuugcugcagcuccuggauauaaucacaggcuuuggacagcauugcaccuuuacucuggccagacuugaugcucuccagagaagcagucuggggcgauuuggacagcuguauaauucaguuguugaucuugucccagcggcugugccccacuucguuauguugagcucucaguuucucaucucaguuguccugggagcugcugacuucggggaauaagggugcguccugggggcaauugaucgcuggcucccucccugcaauacuucguguggugacaucaucacaaagaauggaccccgugguggugggcgggguugccugccccaguaaugccuuugagcccuggaugguaauaacagcuguuguacucccagaugugguacccucugacccaucucccacuguggugcuggggaaauacguauaaugugucucagcagcugcucccuccgugucaaagcaaucuucacuggugauagcucccuggaucacugccugggugacugaguggcaggguaacgacugaugguggcucaguccucugucuggccauccagcugcccuucagacaccuggaucacccugaacaucacuugacauuggggucggagaaaguggcagcugauuggaugcuggcaauagcuacacuaguugggucagccaccacaccuuucugaaucugcacuguccccucuuggguuucagcuguuuucugcugccccaucaaaucucugugagggggcucauaugaggcacugguuuuuugguuuuuguuuuuggaggacuuccuaucuccugacucaaaggucugagugcuaaaucucaaaucuuggcuguacaucuggaagcauccugagcauuaauaauaugugacaugaaaaucagcauaggauguugugguuuguaugcucaaaaggagagcccagcaaacgcccucaccaagcacagaugcaaaggcagaaauuaaaacaaaaacaaaaacaaacaaagcaaacccccccccccccaagacagauaaaguuuccaaagaauucaggcaccagguccaugagguuuguuccugcagacccaccaacuaguaguaggcacuuggggaccugagcacccaccaggcacuaguucugcugucugcacagugacccugcuggcuuagcuccgcuugcccaugccccagcugcuccucagaggagagaugcgaaaagaagccagggaucaucccaggcuugcagcucucaguuggacaccgcagggggguggggcauguggacuccagggccgggaaggagcuccauuuuaaguauuuucaacaugcuugcuuuuguguuaggcccuugggauuaucaacaagaucgauauaguccuuaaacugagucuacauuccaaaggauaucauagauguugaacaagaaaacacagaaugaaagaaugugguuucaacuuuauaguuucaacuugugauagugccacaaagaacuagggcacugcuuagcuggggauccuaacaagagacacgcuuuaaauaguguggucugggcaagucaugcugcaaaggugauguuuaagccuaguaaggaagaaggaugaacuagcugaacagugugcaguaaaguuaauauuuuggguaaaggaaccacaacugacagcucuaggaaaggaaaugaguuuggcauauuugagaaauaugagcacuaucuuuuauggcuggaacagcuugaagaaauggaauaaaacugauguggaagucagaggagagcucuguagaaccuugaagacauaguggcagauguuagaagcucuaaaacuucccauacauuuaaagcauuguuaguacuccuggccuuucugcuguuuauauaaagcuguguucuuuccuaucuguaauguuugacuccuacugacacuugacacauaagguaaacuaguggauuccuguguuuguacuuugacucugagccaagcuaggggacagcugaguuuccuucacugauacaaauucaaaacuacccuguaauuagucuguccuguuccuccauaugaauuuugacacaggaggauuucaaauuaguuugcugagcgacuucugcuaaaaauaauauguuaauaugaugaaauaagucacucacuaguuaguguucuguguuucuucagggagaaguuaugaaagucauguuggauugucuuggaaauuucucauguguaaauacauucaaacuuuuaguggaagccuaucaacagaauauuuacuagcucuuacucuuucaggaaaauuguuuucuggugaagugaauggaauuuaacuagacucaucugugaaagauggacuugaaauugaagauuuguuugcaaauuuggagucaacaaauacuccuaauuuaguuuaucauuuaaaauaacuggacaacaguguuauugaccaguauacuuuuaaaggagaagauguacauuuucuuuuaauauacuaauauauuuuaaaauguuaguugcuauaguuuuuagaauggaggaacuaaaguaucguuuuggcaaauucuuuucauaugugugaucaguuacauuuggaccuggugaucuaaacaaacuaguaauauauuaugggauuuuuguucugugcuaagaagcaguuauauugcuuuaacaaguuaauccuaugccuagcaguuguucuuuuuaccaaauuacuguuagaugaugauauucaaguucuugaugaacuagucaaaauuuuucugaaaauguucaauuguauuuaaaaaguguaaucugauuauuggacacccaauuggugguagagaaaggaaaguuggcuugguaguauaacaaaauaauacauauuuagaguuaaggaaaaaccagacaguauauaugguccuuuaauuugggguuaaagagguuggguuuuccuuccaguacuagugaaucacucuuggccaucacaccuuauauaaggugugaggcugcacugcugagcuacaccugccucucucugccugccugccucucucccucccuccuucccucccucccucuguccuuccaucugucugucaucccuacauuucauuuugcuaaauuguuccuggaucccuguucucucuuggaagcuuaagcauccuuugauuuuuggauccuucugcuuuagcuucaggcaugagcugccaggaccaccaaaacauauuuugcauaaauuccaaaugucugguuguguucaguucugguuguguuggcuuuauugcuuucauagguuauacuaaucucuuuaaagauaaaugaaggcacaaaaugguuaauaaaggucuuccagaagguucuaguuauaaaaguaguaacuuugaguaaaagauaucaacuauuuagcuucaucugcgaacuagacuuaacugagcgagacucaauuggagaaauugcuuuuauuagauucgcucauaaguaugucuguguggcauuuuacagauugcuaauugauauagguggcccagccuauugcuagcaguaccaccacuaggcagguggaccugggauguauaagcaagugccaugguuuaguuuguguugcucuaacagaauaucacagaacagacaguaugugaaaaacaaauuuauuucccuauauuaaggagauugguaaaggucuuuuguugauucuucaaaaagaaucauaaggaagagaggagagagggaggaggggauuagagacuggaagaggagaaagaagacaccccccaaaaagggcugaacacauccuuuuaugcaucacucacucuucuuauacccacuucugaugcacagaagcagggagcucgugagcuccugaaagucuccuccuuaggacuaucacaaugacagauuucaacaugaauuuggaaaauaauccaaugcugaaaucauaguagagauagcauaaggaagguaaacauuaaacauaucuaucacuguauguuuucugcuucaguuccgguccuugcuucccugcaugacgauguacuguaagcuguaaacagaaauagaucuuuuccuuuccaaguuguuuuuuaucauaauguuuauaacagcaacagaagacaaacuagaagagauauggcagcaaucuucugcagguacugucagguaaaauuaaacaugauuaugcauacaauauuaagcuugauuuuuguuauacaggaaaugcuaaauauuugcauucauccuuauauguguauauuacugucuauauguauguguuacucuccccuguaaaccucaguaaaaugaggauauaauccuuuucuguuaaaauguaaaaucagauaauaugccuagcauauugcuuaaaauaguaauuguucaaugguguuacuugauuuauuauuauuuauuauuaugucuaucugaaaauuuuguacuguuucuacaaucuuuguccagauaugucauaauauacuuacauacauacauacauacauacauguguauauauguauauauguauauacauauauaugauucccucuagaacucaguaaagaaaauauaaguaauauacauacuuaucacagaauuggagcaauuaaacaagguuaggcuugcuguguaguuuguugcccacaguaagcacuaaauagucuuaguggugggugguggugaugaugauggagcaaagguguugcuguuugccuucugagaaagaaugugggccaccuggcaggcuuucagaauaauaagaguuuacuacuuaauuggcacucucccuaagcuggugcucuuaggaacuucagcuuucugccuagccagcccucccuccucgggcugccucuugucucuuguuuuuacuuucuugccaaaggaagcccuuucucccugaaagcaccugugccauggaucagcuuacauuuuggagguccagcuggacauccuacuuaacacuuuuuguauugugaaaugggacccggucuuucauucuguuuuaggcauuugaggucaaauccucaauagauuuaugagccaggauagaauccuucucuugucugacucaccucucucaccucgucauuauggugguucugcuacagcagggcuuuaagauuuuguaacuuuguucuguauuuauuuguacuuuaaaguuuuaauucaacuaucucuacuauguuuucaguauuggauuauuuuccaaauuuguguugaaauuugucauugugauaguacuaagaaggagacuuuuaggagcucacgagcucccugcuucugugcauugguuagaugcuaugagaagagugaaugauguauaaaaggauguguucagccguuuugggguguuuucuucuuucuccucuuccagucucuaaucuccuccucccucccucuucucuuccuuaugauucuuuuugcagaaucaacaaacagccuuuaccagucucuauaauuuagggaaacaaauuuguuuuucauauacugucuguucuguguuauucuuuuuuuaauauuuuuaaagauuuguuuauuuauuauaugugaguacacuguagcugucuucagacacuccagaagagggcaucagauuucguuacggaugguugugagccaccauguggucgcuggaauuugaacucugcaccuucggaagagcagucggcgcucuuaaccacugagccaucucuccagccccuguguuauucuuuuauagcaacacaaacuaaaccaaggcacuugcuuuaagacauuuucaucugauuauugaauuuaaugcccucguaaauguuguauucaagaugacugucucaggacucucacuagagaacauuguauaacccuacaguuguauacugggaucugcuuuuucuuaauuuagaaagucucuuguaguuauugaauuuuuaugacucauuaauugaaagaauaaauacuaauauaaaguugccaucaacuuaguaaauacuucuaaguaaauuuggaguuuauuuaauaucaugcaaauuugaaguaauaugcuuuguguguauacagcuucacaguuuccuuauaauaacucauuccuauauccccacugucuccuccacccuugucccucaccauuaucuauaagucaauucucaugggauagccuccagaguugcuggcauuauagauuagaaaccacugcuacaauaaccacaagguucaauuuguuugaaaugucauaaugauaucuaauguauuauuugcuuacuuaaaaugaaaacaaaaauaauaaagggacaagguaaaaauaauucguacaaguaacacccagacagaacagguugcauuuauguauuuaggaacacacacacacacacacacacacacacacacacagaguaacaaaaaaguaacaaaaugauaaaaagaaagaggccaugaauuugaaagggaacaaguaguggagcacaugggaggauuuggagggagggaggggaaggggagaaugauguaauuauaguauuagaaaauccacuuuaaaaaauaauacagagaaggaaaaauaaguauaucuaaauauggucuaaggaugaugggacuuuggcaaaagacugaagcacagguaggaaaaaggaguaccgaguguagaagacuuccacuuacugaguuccuuucaaguucuaggcaugaagccagacacgcucaaauuucccccucauuuauuccuuacaucgguauggauuuuauacaaaagagaaccaacucucaagagcauuuaggugaccccaggucuuauagacagugaucgcaaagccaggcuccauagcuauaaauuggcauuguugaaguuagcacuugacuggacuuagcuacaguuaaugcugguaaguaaaguauuacuuugaacugauaagccuggaaugugcagagaggagacguuguuugcuuuuguauuuccccauuuggcaggcacaucuucuugccucaguguuuuugaauauccugucgagacaucuguuuuucuucuucuaucacuugaugaauuguuucaucuuccauccacuugacuguuaauauuuaacugcuccuugggcuccuuuugaaagcaguccugagaguugaaugcaagccuucaggcuugcuggacaaguaagugaucuucugcugagcgccagccaccucccccauuugagacaaaaucucacuaugugguccgaccaguuuuauuaaacuuccaauucuucuaccuuggcuuucuaagugcagcugguauuacaggcacaugcuaccacacuuagcaacaguuuuccuguucuuuuuuauuuucuuuuggaguuuuaaguauaauagacuuaaacauaugucuccaacuggaguugugcaccaucauaucugucucuucuuuaguauuuugcaugguuccaaaugaucuauuuaauugugucauaaaaauguauaugguuccuugauuagcuuuucuguauucaaauuacaguuagagaagcagguucccauuacaaauaguugagcaauucagaaacaacuuacuauucucacguaagcacauugauaaacaacguacaaucaaugugguauuauguacaaauauuucuucaagauaaggcuugacaauuuagcucucugucugucuggccuagaccucacuaaguagaccaagcuggccuugaacucaaagaucugucugccucuacuuccaaauucugggauuaagaauaugcacuacuaggcccagcuuccuuuuaaguccuuuagaaauaguuuuuauauuugguguauaacugugcaucauagcauguggagagagagagagagagagagagagagagagagagagagagagagagagagagagaggagagagagagagagagagagagaggagagagagagagagagagagagagagagagagagagagagaagagaaaauauauaucacaguacauguguggaagucaaaggacaacuugcaggagccauuccccucucuuucuacuguauggguuugagaaugagcucaguuauuuaugucuuguggcaauugccuuuacuuugacaucucacugguucaucuuuuccuuucaugacuuuauaaaacauuuaugaacaguucaguguagggguuauuuuuaguauuugggggggguauuuuuugagacauucucuuauuguaucccugguuauccgagaacucacuauauagaccuugcugccuuuaaacuuaaagaucugccugccucugucugaugggauuaaagguggacaccaccacaccuggcuauuuuuaagauuuuuaauaauucucuucuucugguguaauuuugacauuucuguaguaaauauggcuagcagacauaauuguuaauacuguagagguaauuguuaauacugcuuuaccacuuacguuaacagcaaaauguucuuuacggauguuuuaauccuauaccacggauaacuuucuugcuguaaggggaagugugauauugaauaagacuugacuacaggaauuucaaaauccucaggugagccuuugcuaccacuuagugucuuuuguuguuguuguuuugaaaaaucuaucucccuuugaaauaauuaagggucuuuuggauuuaaggcgcauaguaauaugacaaggauuguguguaucuaguuauacuugcuuccugaguauguuuaaauaucaugaaggauuauaaguugggacuuugggcugggucccuuuuuguuacccuuuggauuauucuugaguuauuuuuaacuuaaucuuuuaaguuagaacacagcauaauugggucuauguugucuucaugcauaauaugugaauauguuuauucaucccuccuacucauugccuugccccaaccuaccuggagucuucuugccacucuccuuacugugccucaaauagucauguuuuagcucuugugucaccugugcucuccucccuccucagccugugucccuccuuuaauaucucuuccucccuucucauggucuccauuauaguugcaugagcuagacaugugcauacacacagauuuaaauuuacacccaucacaagugagaaaacaugaagcuuuugcuuuucugcuguucuuauuucauuuaacauaauuguuucuuggucuauccauuuugcugaaaauguuauuguuuuuccucaaugaaugaauaguuccauuguguauauguaacuuuuuuuugccugauaaucuauugaugaaccucuagauugggucaguuuccuacuuauuaugaagagugcaaaaauaaguaugaaugugacacaguuggaucguagugccauaaauucauuccaguaauuauugcugauauuuauuagcugucaaauagucaugaggcauuuagauuuccacacaucauagaauugagcaauucagagcacagucuuuggcuacauggacucaagucuuauuugauaguuccaacuacucuugccugguaguuaauuuuuuuuuuuauccuagagacugucuuuuuauacaggaucuuauaguccucacaagccucaaacucauaguuccagcuggccuugaacuacugaugcaaaagcuucuucuuacugaguguuggaacuauaggcauauaccaccaugccuggcuuagauacucuuucuuuaucaaaugaagaugcuaauaccaaccuuacagagcucuuuugaagacuaaaugguaaugcgauacauuuaccacuguguauucuauauaguagccacucaauaaaugcaagacugcuaucauuauggugcugauaauguuuaacuucagcccagaaaaugaauguauaagcuuguaauuuguggggcauaggccccuaguuccuagccuagccugucucagaaugcaagugcacacugacaaaguuuugagaguguuucuagucaucagaacucggagcuuagguggcacaagaaugugugugcuuugacgggagcugaguuugucugaaaaguugucuuugaaaauugccucaguugaaaaauguuaguaaaguuaguaagaaaugggcaaaaaacuaauguuguaaauuagccucaagauacaauagucacuguuuccuacaugugacuguccacugccaccuagaugacuucuuuaaaaaugaagauuccuaaugcuaguuugacacuuccuggucacauuaaggcaugggaauauguugauauagugaaaacagguugaucugggcucaaaaucuucauuuggccccuugguaucugaucaguggcauuugucuuucucauaugccauaaccuccuuugcuccugcccaccuguccucacauuuccaguguugucaauaacccauauuaauuguauauauguaguuaaguaguuucacagucugcugccacuuguuuuuagcccauugaagaauugucaccaacucugccuuacugaaguaguacauacaauuuucuggcugauaauucauugguuuuccuuuccuuuccuuuccuuuccuuuccuuuccuuuccuuuccuuuccuuuccuuuucuuuuccuucucucucuuucuuucuuucuuucuuucuuucuuucuuucuuucuuucuuucuuuuuuuucgagacaggauuucucuguauagcucuggcuguccuggaauucacuuuguagaccaagcuggccuugaacucagaaaucugccugccucugccuccugagugcugggacuaaaggagugugccaccacgccuggcauuucuuugguuuuucaacuuaccaucuuugguuuugacauagcuucaagcugucucuauuuuguguguguguguguguguguguguguguguguguguguguguauguguguguguguugaguuucuacccugaccaguuaguuauaugaccagcauaaauuuucuuuuauugguguaucuaauuuagaacauuaauagucaacucaggggcacagauuuauuaucguucuauauucauuucuuugugccccauguggacaauguccuguaucuuguucaguaugaaagaacacaugaaauguguguuugagaaaugacccaggagccugcacuagaauuggagcuaagaaacugagcaagccuuuuauuauuaagugaagggaaugaacauuacugagagcaggaacaagaaaagcaauauugaguguucuauaaacauuccauugucucuuacuguguaauacgagaaccaucuguuuuuggaaucuuggaugggucauauuuaaaauuuuauucauaagugacauagagcuauuagguuaggauccaugagaauguaacucacuuuuuuugcauuuuauacaagauauacaucaugaaaaaaaucaauuagucaaauuagucucucacacacgcacacacgugcgcgugcgcgugcacacacacacacacacacacacacacagagaacugagugaggaccugggaaaacuaggccaugucucaaaggguugagaacagccaguacuuguacuggcuuucuaaaggaaggguccauguuuggaauugguauugguuaggggucuguaagacaaaggcaaagacauuguuccaaauaaagugaaggaggaucugugguagugguagaggugguuguguuggugcuggugcugguaguggcauguguagccaacauaaauuaaaaaaaaaaaaaaagaauaguacaaagaagccugcuauguuuucgaacacucagggaaugucuuacaaaaggcagaaugugcaacaaaaagaagacaucuggacaaaacauagcuguugaacucaugaaguuauuguagcuauaguuaucuguacaaggcuugcauaauauugggccuaccaacauuucaucauggauaggccagggacccaguaaacccuaauccucucugagggaauauugacaauuaauguuuccugaggcucagcauaugauuuuuuuuucugugacauaaacacugauaagcugccuagggcccagcaaauagcuucccacccaugcucacagaagcaauucuaauuaaacucaguggauccccugaauacacaaacgccaggaaaguagaagagggacacagaggggcaauaucuugagaaggguuccagcaagaacaggaaagcaggcaauaguauaauggggacaaaagugacaguaaaugcacuucucaauccagacaaaacagcucauucaguauuccauccuccccauuuuuuuucaguguugggaauugaauauagggcagcaugcuugcuagacuaaugguuuaccauugagccaugucccuagcacauggaccccacuuuaguuuugagauaaacuaugcagaccaaucuggccuagagcuuguguugauccuccugcuuuagcuuccugaagguugggauuacugacaugcacucugaugcucagcuccuuguucucuuuaaaaauaaguuauuaguuauagcacgcauuuauuuauaugcaucagccugauucacuuaaggcuacaaaacuuaaagucuuucuuucuggaaucaaauuuucagggugaaauucugcuucuuuauaaguagccauaaaugcauuuugaaaaaaaaaaucagaauuuacuuuaauuuucuuuuuucucagucaacuguauucauaagcaaguaugaagcauguuuuccccagggauucuagauuucuuguuauuagguaugcagugaauguauccaaaauuguccauucucuugguuguauggaagaauaugagagucuuuuuucagggacuagauaugcuaaugaaucagcugagaccagagaccuuugcuuuccagaguagagcauucugagaaaugcauucucaguccugagggaguuguggcuuuccucucuguguaaagucaaaagggaaaaauuacugcaguguacaggcaucuugcuagaaaaggacacagugauuguaacuguucuuugcguggacagauuuauaauauuaccaguaauucuccacacacacggaguaguuacagcaaauauuugugccuuagcuuuugguaaaauugguugcauagggugcuguaagaaagcaggauuuccagguccucgcaaaucaggccuuaauguaaaugcauuucacagugauagaauaugcuucugcaguauucaucuuaacugaguacuuguuauagaugagcucugaauauuuauaaaaucaaaacuaaucaaggacagcccccccaaccaaaccaaagcauuccuuguauuuucauacuaacacacacauaucagagucccugucucauaugcuuuuacuuuucauaaggauuuuguagugaaaaugcucaguuguuuuucuuugacuaaaaaaucuugaauagaaugugacuuauuucagcaagccauuuucugaaugcguggaaugugugucuuuauuugggaaaugaaugcauucagcguaccuucgggggagcggagugcauuucauagcauaccacuagguaaagaguaaaaaaaaaauauuauuugauuaugcuaagcuccuaaucuuaaauuucuuauauagaucuuacaaccuugcuggauuuaacaaacacacucaauuaaagaacuuuccuaggauuuuuuuaugaagcaagaaccuaauacucuucuaaucaucauaaaauaguuugguggaugauuuuaugcaauagcaucuaaaauuuauuuuuaguuucagauguggacuugaaaauaaauuaaucccacagaaauguguuugacagcauguauauuaagugggaguaacuauugaaaaugugauuuuucaagucaacaugaguauuuuuguuuuaauuguauguuucaguuuguuugguuugaauucucuuuucuaccauuuucuagcuguguuguuuuuggcuagagaguuaagugcugugcaaacuguuugcucauuaacuaacaugagcuaugcaaagugcuuaguguaauagcagacauguaaggauuuaggaguauuuuacugaaguaugguaaauugaaauuuuaaauguuuaugaaacagaaauugcauuugcauauuuuacucucccuacagaauauggggguggugguuaguuugcuggauauuauauauaaacauguucugaagaaaaaugaaaauugcuaguuauauuugaagccuuaauuuagguaagaacaguaaaucagggaaccuuaaguuauucuuuuuaauacuuucuguguuuuuauaucaaaauacaaauauuuauaaggaguuucauucauccuacaagguuguugccuuugcucuacuuucuacaaagucaccaaagcaucaguguuaaaagcuugccaaauucuguaaugaauuuuuuuuguuuuuuaagcuucuuuuuaaaaauguuaauuuauuuuuuauacuccauauuccauucccugcccccccaccccccucuaacuucuccacaucccacacuuccgcccugccccacccugucuccacguggauguccccaccccccaccccaccugaccucuaaacucccuggggccuccagucucuugaggauuaggugcauccucucugaaugaacacagacccagaaguccucuaauguauauguguugggggccucauaucagcugguguaugcugucuguuuggugguccagugucugagagaucucagggguccagguuaauuaagacugcuggucuuccugcaugauugcccuuugucuuagcuucuuucagccuucccugauucaaccauaggggccagcugcuucuguccauugguugggugcaaauaucugcacugacucuuucagcugcuuguuggaucuuuuggagggcagucaauuaacaaauguuuaucauauagaccuuuucaaagacccaugcauguugaaggaaauuguauauuugccaagaaacaaagcaaaauaauuuuuaagaaacugaugauuaucagggacuccauauaugucuaugguuaauuauacauaugacacuuuagguauauuucagcaacuuuaguaucaucugaucaccaggugaugccuuagaaugagucacuuccuuauuguacuucuuaaugaaauauauuuuacuguuauuauaaaccuugcacacacagacacacagacacgcacacacacaaauguauauauucauuccaaccucucucuuuuggauauguggguuauuguuggaacauaaacagauuugggguacacuuguggcaauaagguguacacuuuuaaaaagcauaauauaaagugaauauuuuuaauuccugcaauuuuauuuccucuaagguauucaugaucuuauaagugauaaaauaaaaauuaaaaggaaaaguuuuguuuacauaacacuucaguuuuuauacuaggcauuagagucuuucuuuccuauuuauuacgcuuuuuauggugcugggauaugagcccagggccuagagcaugguagacaaagugcucuaccacugugcuacacugcuaacccuguguacuguauguuuaauaagguuuucuuugaccauugccacuuuuuuaaaaaaaaucuugaaugagauuugauuuauuucagcaacucaacacugaaucaggaucaacaugccuaaggcaguuguguuuauagagagaguaaaugguuuucagcuugucuagccuuucaaugaggucaugauucacuuuuguuuuuuggcagacacaaagagauuugguuuagagaguaagaaaaguuaaagguguaagcaucacucacaagaauugaucucacaaauaacccuccuccaccagggacuguuaggugaaugcauugugucuagagguaugaaguucaguuggcuccaugaauuuugaaaguaucuaggauuuauaguuuuuaauugaauuguuauacaaauucacucccacaagguuuuugcuuaagcaggugguagaauuauaggcuuucaucacccaacauagcauuugacucucagaugagcuucaccuuggaaaaccugcaugacaagaaugagacgcuguuuuauagccaaacuauauuguaagugguagguauuggcaacaauauccuuuguugaucccuugcuuucacgcacaucuccuggauugagcuacugaucucaguaugcucuuauacagagaaacagcauugaaacaugcuguuauuaucuccagggcaaaggguaaguuugcuuacugcucauuauaaaagauaacaagucucuuacuuggacuguuugucccccuguaggacuggaaagagguccaaggagacacugauguucucaggaauucuguguuuucuuguagaaccuuaaaaauuauaacaggcuuaccugauagcaagcaggauaaaguuucagacccuucagugguuuugccaguaguaucuauuucuggauaugcuauuuguuuugauaguuguucauauaacuaugucaguaauuacauugcacacaaauuugcaaguaaagaaguaaagugcccagacuucuuugucuuugugugugugugugugugcauagcaauucacuaacguacuaacuuuuuuggacuauuugagucugaucuuguuuaacuaauuaggcaauauguggcagcuauuuucagcuggacaguuuggaacuuguuuuauugaccuaagugugggaguacacucauggugcucucuggaaugucaucuggggcacucuguucagcucaggccucagacuuguccuuuugccuauagcaacugaauuuguuuucauaagaauacaguuuucuggucuauugaaauaaagucuuucaauugucuuuguaaugacagcaccucacaaaucgucaaugagggaugguagaacuauacuguagcuaaaguagucaaaauaguauuugguauuuuguuuuuguuuuacagaaaaguauuuccugcacaaaugaguagcuuuuuaaauaugaagaauaugauaaaagauucaccaccaguuugucuguauuuagcauuuauuuucagagaaaagcccagggagaggagaauuacuuuggacaugcagaguguucuuuuuucuucucugugacaggaacaaacauauuccaaguuggcucuugauuugcugugugguucuggaugaccuuaaaugccugauacucuugccuuuaccuccagugauaggcaaacccacugccaacugauggacaucuucaauccauuuuguuguugcuguuugugcauaacuuggugugugugcaugccugugauuguguguguguguguguguguguguguguuugugugugugucuggaacuagaugaauaauagauaauaguuuccuaacucagccuguacaguauugaagaagcaccagaauaaaaaaauauagauuguuaaacauucaucaauauauguuuuccugugaagauuuuuggacaaguaaaaaaaaaaaguaaaagaaauuacagugucaaauauuugcauaaaguugcuugaacucauuuauccuaaauaagcuuuaccagacaaccauuucuaguugggcagcagcuuuuaaacuauuccauguacaaaaaaaaaaaaucucuguguuaaaagaggucuuuuuuuuugacaggguucuguuauuuauaaugcugaccaugugucauacaaagucagaaagaagugcuugcaaauauuacccaauuaccaaguguauaaagaaauuugaggucucuugcuauuggggccuuugagugaauaguaauuauuauuauuuugggggggggguucgagacaggguuucucuguauagcucuggcugugcuggaacucacucuguagaccaggcuugucuugaacucagaaaucugccugccucugccucccaaaugcugggauuaaaggcaugugccaccacugccuggugaauaguaauuauuaaauacaaauauacugaacuuuaaaaguugaccugacagucagacaggccuggauauucaugaguuauccuaacuuuuccuccugaggcucggaugggauugcuggguguuucagaugaccugguuaauuugcaauuacuaggccacccagugaaggauggauggcuagcaaaauugccuuacagacaagccaaaaccaaacaauaacaaaauuugcauuuggaauuguuauacauuucuaagaauuugaucaugauggccaaagauuauaauuugcauuugaugucauuuauuauuuuuuagagugaguuagcugagacacucuguccugauuugauugaugcaauuaucaauuguucaaaugucuuugaaucuuuucucugucuugccucccuuuuuuucuuacuuucuaccauaauaucaccuuugaaauggaaugacuuaaaauauguuuauuauaucggggcagauuuuguucaugggaaaagcauuuacagggcagaaaaugcacugagacaaauguaaaacgauuuuucuuucccuuugaaaaaaccaaagggcagugauaaauuuucuuucaauggaaaauaauuaagaacugcauuucugagaacuugcauguggcucuguauggguauuauugguauucauauuauucacagaaugguuuggggaacuuuuugagguuaagacaaugacuuucuaacucuuuauuauuucacaauauuuucuguuaccucuucuucucacucaugaacauugguggaauuuuacugugaacacaaguaacaaauuucacugguagguuuugaggauucaaguuuagguugacuuaggaauuuguucuacugcuccacacuuguuuaugcggggaguggcaguucuuuuccuuuuggaggaaauugccacauaauguagccaauuuaagaaaauaucgcaauuuuaaaaugugucuggauauuuuuuuuuaccuggugauuaacuuugaggcuuaagaauuguuuuguuuaacaaaaguauuguuugacaauguuuaacuuccggucagcuuucucauagacuguuauauucuaacuuccuuauggacaguuguuuaaacaauuuaacuucugaucuuuguacuuaggaguuuugcugcaauaguauaaauacuuuaaucuuucaacacuuuauaaagagaauuugguuuccaaguggcccuuuaaacuuuuacugggcuuuuauuucucagagcccagugauguaaggaaagucacuagacuuugugacugcucagacauuuucccagcaugucacauaucauuugccuuauaguggcuuccuagcaacugcauagauuucuuuuuaacaucuuaaauccuccuguguaguuuuuuuuauauugauacuaauagcauccucugaaaaguuucauuggguuaugcauauaaaccuuacuauauuugauuccaaagcuugauucuuugucuacacacuuccguucucauaaaaccccagaaggacguuuucuguauugugacuuuguuuccuuuuuuaaaaauuagauauuuucuucauuuaaauuucaaauacuaucccgaaaguccccuauacccuccccaagcccuguuguccaacccaccuacucccgcuuccuggcucuggcauuccccuguauugugacuuuuaagccauggcaucauucauuaugcuuaguacuuugagggcagagauucucuuuauuucuuaauauucuuuauuuuauacacacacauacacgaucuuacuuucauucgcuuauuaauuccuuuaccauauauuuauaaaacaccugcaguggauacuaaguaacaugaugagcaaaauaggcaagguuuuagccauaugagaaccuauaauuuacagucacgacuguuuucuagcagguaaugcaauaggcuucucuuaucugugauuuucugugcaaaauuucugagagguagguauuauuauuauuauuaucaacagauaaugaguuugagacucacaggguuaaucagcuugcucagccauacacaauagguagaaguucucugaguuuccaagccaaaucuguuugguccuguauugguuuucugugcuguagagcagauuauuguaauuuuauccauuuaaaucaacauccauuuauuauaguacagugccuauaggacagaaguccuggcauaguucagcuguauucuugauaaaacugcagucaagauguacugacuugugagugggaggguacacuaaggcagaaucuacuuucaugcuauguggugguugacagaauuccucgagacuauaggauuuguuugcuucuuuguaaacaaaguagacucaugugugagucucguagagagccucaucucccacaacauaacaaugacauccuaucaacguugccauauucucuugaauauaaacaagaaguccuaccaccccuaaguaagucucuggugggguuucugaggaaggaacaccuuagaguguuugugccaaagauucaguggugcacagccuuaccuuuauaauaugcuaccacuagaaaggccuucauauauaugauguauuuuacuuaugaagcaaucuguuuaaguucuugcuagucuuuuaagaauauaccuuuuuuuuuuuugcuuuucacaguuggaaucacaaaaauauauaauuuucuugauuuuccuccccauguuguaaauauuuucccuuguugcuacauaaucauacagcacgugcuugcuuucacugugcaugcaauauucuuucaaguaauuacuucacaaacauuuaggcaagucugaauggguaaauaugcagacaauuuucaaaucuccacugucaaaaggaaacaaauaacaaacucaccagaauauaucacacacaauuucuucaggcacaucauuuagcucucuuuuguuuauuuacuuaaagcaucuggacuugaaauuacaagauuaagaacuaugaauguuuccauggcuauuaccacacacuggaaaaaaaaguuucugaguuuacuugacuuugucugaauuaacagccuucagcacaagcaacauacuugaucauacuaauuaggaacacuaugcucacugaaaaugaagaugaugucucugugugcucuuuaauucucauguuuggcaggggaagaguaaggguuauuauggucucuuuauggcucugcaacagcucucagaaucugguucuacccuguaauugaaaggacccucuuaggauuuagucuuaacgaguuauuccauaucuggauuuuuuuccccuggccacacuaagguguuucuguaguaggacagagauaguuuucugagucauuugggaacucuauuugcgucuuucagaggagguagaaugaaugaauuuacuuauucacauacaccauuuugauguuauaugcauacccccuggccacacauuucauaauagccugucaauagaagaagauggccagcuuaugcgacacacugcaguguggcuaauauuugucauuuaguuaacacuagcaagcuuauugcuuuucuuaugauuuaggaacugauagaguugaugguuacagccuucuuuuuuaaaaaaggcaucuugugugccgcagauuuuagcuaccauauuugguucucguaugccugcccugugacuucacaucagccuguuugaggauuuguguuuuugcuuauccuuauauggaaaggcugccuggugacugugucugaccggaauuagaagcccuguagcauuagcaggaagugguuuuaggacacaguuuccuuacugcuggaauuuguuaugcaaagagaaagauggguugggaacauuuuguugcucauaauguuucuucuaaacauccaaguuccuuuuauucuacucuaacgcuauucucuuaaagaggauucaaaucuauccagaaaaccauuguacugacuucuuaauggcagugauuaaggcaggagugugggggcugagaugaacagauuuauuuucaaaaaucuuagcaugacaccagucugacauuuuugaauggaagauccauaauguuagaauagcacauguaccaguuauugagcucugauaauuucugcuaacagugugaagugguuuucuuuaaggauacuccuaaaguuuugagaguagccuagggugccuguuaacccuauuuuccuugaagagccauuuccuguagccugguguacuggcacuuuuguggaagcaugucauaacgcucuuuguuuuacacuugcauuuguccauguacaugaaauguacaggcaguauaauucacaugacagccauuuccuguauaaaucuguaaucacaagccacuaacacugugcucuaaaaugcuuaaguugugccaugguggugcaugucugucaugcuagcauucaggaugcugaagcaagaguuuauaaguugaaggucauuguggaccauguagugagacccuaguucaaaaaaaaaauguuguaagggauaggaauguaauucagugauagaauacuugcuugugguauaugaggccuugagcuugauugcaaaacaagagcaacagcaacaaaaaaucuuaaagggauggggaaaauguugcaauuacauuacauucucaaaaauaaacaaaaaugauacuaaaaaaauaaucuccagguuuucuugcugcuacuuuagaccaggcuuugaaauggagacugauacacaaaauuauuaugagccacaucugcgcucaagagagcuucaguaagucaacagaugaucuaauuagcaggaggcaucaagcauggcaguaccuuauuuguuauucuguauacuucguuuuuuaauggugauuuuuacucuggcagagauuggacaaauaaguaauuuggaacaaguucccuaauccaucugagcauuaguuucuuuuucagagugucuggaaugaaaauaauagcagcugcuucagaagauuauugugagacuaaaauaaaauaaacauguaaagagcuuaucacagugccugguucauaggaaacgcuuuauaaauaauaauuaucacauuauauuuuacaacgagaucacacaugguguaaugcaaaagggaccugaugcauauagcuuauugcuaaccaauucagcauaucuauucuuuuuccuuauuauucuagcacuaauucaucuacuugccugcagcagaauuauuccagacuuugauuaagggcugguuagauguaaucauuaaaaaucauggacuaguuuagaauuuauauuuuauaauuauaauuuucaaauuccuucagaucauaauaauuguuauuuuuaaugucuagaaucauugaggccuagauuguauugaagaguuacauuuuuaaugaacugguaaccccauaacauuaccagauagagucaaauauugaaccuuuucuacugguagagaauccugauuuggaaguggcuguuucagaugucuugguuuuuguuuguuuguuuguuguuuuuuucuuuguuguuguuuuuucuuugaaugcuguggaaauuuguucauuugugcacauacucauuuggaaaauaagaugaaaccauacuuuguuacacagaauucacaauuaacaagaacacauaaaaauauugccuuggaaauagugucucucacuaugcugcccaggucucagguccuaggcucaugugauugucauccucucacaaggaccuggaaauagauguguagccacugugccagggaguauuacuucuuaaaagauuuugucaguguuauauagauugcuuucuauaucauuuguuugauucuuuaaugugugugugugugugugugugugugugugugugaaugccagaggauaacuugugaagguugauuuucucucuccacugugugaagauagccagcucagauugucugguuuggcugcaggugucuacccaaugagccauauuauuggacuaaaaauuucuuaaagaaaacaaacauagaagguaaaacgaaagaaggcaggcaaauguagugaaauaauguaagauuugcuauuaaaagauaucugaauuugaauuuuagucucgucauauauugguuuugugacuuugaguacauuucauuaaucacuaugagucuugguagucuaauccauaacaugaaaaucaagauaccugcccuacaggauauuuugaauaggaaguggacaugaagcaauaacuguaauguuaguuaacuaacuuucucuucauugccauccaucuacagugauaacuaauagugguauaaauaagaagccaaaucuguuuccagcaguuuacguauuuauuuuuuuccuuaucuaugugcaugggucuuuugacugcaucuguaugugcacaaugugacugcuugguaucugugggaucuagaagaagguguuggaucuccacauggaacuggaguuacuugugacugagucacuauguuuguguuuguguuugccugugugugaaugcagugcugggaaguaaacuugggaccucuguaagagcagcaagugcucuuaacugcugagccaguucucuaacaacuccuagucuucuuaaaauagcugcaauuagaaaucugguaaauugggaaauaauagcagugaacucuuucugauagcccaaaguuucucucuaauuuagguaagcucacagcuugcuugcauuuaauuaaucuaucuaucuaucuaucuaucuaucuaucuaucuaucuaucuaucuauuuuuaccuagacaagcagucucccuguuauggaauauguuaacuuuuagguacuuuauagaacucugaugauguauauaaagguacaaacuuuucaucagcuuugcuuuaggauucacaaguguuauuuuggaaauugugaggauggaggaaagucuguaugcaaacauugauuauuuccguuacuccugugcacaagaaguuuugcuagaaggauguaugugggccuaaaugaaauguaguuuaaguacuaaucacucuaauaugauacuucacguuuaguccaaggauuuuucaaaaagauauguuuuccaaauaaaaauugaauuaugacuucuggcgcucugucuaauguuuagcuaugagacucugguucuguucccaucaguugcuggauuaaguuucucuggucuuucugaagacaguuaugcuaggcucuggucccagaauacucuacaggcagggcaaacuguauauaggucgaagguucuguggccucugcagggacgacgaauuguaggucaaagguugugcaguuagguuggugucccaaucccuccucuugaggccuugccugguuacagaauauggccaguucaggugcucccuauuacuaggagaguuuccuaggguuacucucguagauucuauagaguuucuauagauucuauagaguuucuaccucacccuggaauaccgcccccccuccagucauuucuccugguguuuucucccucucccaaaccugaucauuccuguuuccaacaccaccugcccccagaucacccugaaaagcuauucuguuuccccuuccuagggagauccuuguacccugucuucagcccuccucauuacuuugccucuuuggaucuguggacaguagcgugauugucuuuugcuuuacaacugauauccacuuagaagugagucagggacaccaugagaucauggggcacugaaucaauugacuaggauucaggggaacucucagacaucaggaauccuguagggauuugaccuagguucucugcauauauguuauggcugaguagcucaguguucuuuuagguagcuuaacaguaggagcagggucugugccugacucuuuggccuacuugugggaaccuuuaccuccuacuggauugccuuguccagccuugaugugaugguaugugcccagucuuauuguggcuuguaaugcuguguuugguugauuucccuggagggcuugcucuuuucugagggaagguagagggcacuagaucugggggagagacuggagggcagggggaggaaggggaaacugguguggauguaauauauaagaaaaaauauauuguauuaugagaaagccacaguauuuguccccaaagauggauguauauuacuuuucagcaaucucucacauauugcuguuucucaaauuucccagaaucucuaacuaagauguacugucagauuuucacuaugaaguuggaauuuuacugacucccaaacacauaguguagaaagggaaaauuauuuacuucuaaauacacagugugaagaaggaaaauguagugaagaaaccuaacucauacuccacuuaccaaguaauccagguuaauguuaucuuagugaguuaggucccuaucagggguucucugguaugauaggaugagaaaguuauuuauauuuuauacucuugucccccaaauucauaaucccagucuaaucauaagagaaaaacuagauaagucuggcuggagaagcauuaccauauaucugaccaguacacuucaaaauugccaaaaucacagagaaaggggaucugaguaacucacacagcaaaagaaacuaaggagacaugaugacuaaguaucucgaggggaacagaaaaugacauuaaaggaagaagcggugaaaugcuaauaguuugggguuuaauugauaguguugcacugauguaggcuucuuaauggcagguguacgucuuugagguaagaugucaauaauaggugaacaggguaacauauauggaaacuguauuuuuaugaauuuaagauaauuccguaaguaacuuugguuuaaauuaaaaacccaaaacaaauaguuugauuguccuaaacuuaaagcaaaaauauaguagguaauuaaguacuuaauacuaacuuuguuaccagaucuaugcacaucugcuacauauguguguguaugcucuuugguuggugguucagucucugagagccccaaggguccauguugguugacucuuuuggucuuccuguggaguucccauccccuuuggggcugcaaucuuucuuccaacucuucuguaagagucccaaagcuccauccacuauuuggcuaugggucucugcaucugucucagucagcuaauaggaggagccucucagaggacagccuugauagucuccugucugcaagcauaaaaaauuaucaauaauagugucggaauggugguugcucaugggaugggucucuauucccuaucccuacuuuucuuguagacagaauaaauuugggguggaaaguuuugugggugggaugaagcuuuguuuuuugcaucggaaccuucuaaagaagaaacuguguuaaucuuuuuuaaaaaagaaacucaacccuugacauacagauaaaguuacuaguaaauaucucugauuguacauacugauaucaggcaaggacacuguauugagucagcacaguguuuucaacauaaagaacauccgauaaggcaggagaugccucaaagggcuguuuauuuuagauggccucugaucuuugucuauacaaacacgauggugauagucugcuaagacugaauauaauuguuauuguugaaauucuagguucuggaaaguaagacauuuauaucuacucauaacuguaaauagucuaagcauuuacaaauuacuugauacauuucauguugacugaacuccccuacucugugacauagguugaaagucacugacuugagacuucccucauguauauuagcauacuagaugcuuauacauacugccucagugauguuuuccaaauuuucuguuuagagaggaaaguuuaauuguguauaccaaugaagaaauaguaauauuagaaaaauuaauguugugguacauuuuauuggauuauaauugaucuuuuugaaaggacuuuuaguauugaauccaaauagguagcagaaauuccuguuuuuacuggaguugugaguuguauuauuuaaagugaauuauguagcccuaaccacaaguaaucuggaugaaaauauaaccccugugccugcacacagugguagaggagggaaguaugaauuuaaaguugccugcugcugaguuccuuuuucacauuuuugauugccauuguguggacuacgucuuuauaauauauuuuacuuuguuuuguuuuaaauguuucugccacauguauccuuugaguaugacuccauuuaaaaagauuuuuuucuuucauauuuucuauauaguucagauauguuaugaagaggcuuuaaccuuaauuacaugaacauagguaugugaaaccauguacucagauaaaugcauuucauaggaagguccuaggaaguauuaacuucacuacuucugaagcucucugaccuugauuugauaaggauaacaguauguaaucuacuaauaaucuaaugagguagcaccgacaugugaaagguguccuaauucggcauauuaugagcuaaugagaaauacagauuauauuacaaacuuaguauacagacaggcuuagcucuuuuacaguauagauuuuggucugaaccauaaaauggagucauugcuacugauuaugaugcuugaauuaaccauacuuuauagacuuuguaaugugcaugagcuagaauuauaucaguaucauuagauauugagccuuuagugcaaaaaggagaguuagauaaaaagggccuucaggcucuucacuugugagacaucaucaaaacaguaacgaggggaaaauguaucuuuugcacugcagauuuaaucugugucuaaauucauguuugcugguuuuuaagcacugauuuuguuaaauuuuaaaaauaaaaaccuuuuguuuaggagcucugauuuaaauuucuaucacuagaauugaaugguaaauuauuuggaccuccaguaaaaagcuucuuagauuaaagaaagcuugguuauuuuuguuuauuuuugagauuguaauugacaucucuucuuucccuguucucccucuaaacacacccgugcccagccuccucuacucuccuucaaaaucauggccucuuuuuccaucaguuguuauugcaugccuguauguauuugaauaaacauauauuccuaaauaaaaccuguugaguccaaacaaagaagaaagagaaaacaaucagugcucuuugcuuaucaguauuaucccugcccccuucucuuggcuccuagauuaagaagaaacagcaagaugugcuuuguuucuuagaagccaacaaaauaggauuugaagaaaaagauauugcagcuaaugaagagaaucggaaguggaugagagaaaauguaccugaagacagucgaccauccacaggguaccccuugccaccucagauuuucaaugaaugccaguaccgugggguaaggaagcaacuucaauucuuguuuuuuuuuuuuuuuuuuuuuuuaaauagauugucucaaaggaacuuaaccuuucaucuucaccuccaggccuagucauuucuucuguacaguuauuugcccucugcaugcgccauaggcagcuacauaguauuuuguucucuaggaucaacauucaaaugaauaagcaaaacaugcuuguauuucuucauuuuggguccaaccacaucaaaacagguaacuaugccugauuguuagcuaucaucuggacucucccuuuccuggcuccuggaauguaguuuuaccacugggagauccucugccguggggcuuccucuuugaugagaguccuguucuccccucuuucucaauccagcuauuguuuucgagacagcaaagacuggccucagauuccgauguugcugaauauuuugcuuaacauauucucuagguucauccaugucacagauaacagaauuuuauuuuaaaggcugaauaguguuuuacuauauacacauacagaauuuuccuuuuuccuucauccauugccggacgcaaacugauuucauauauugccuguugugacuaguguugcaguaauaucugauuguagcaaucucuuugacagacugauuucauucuuucuuugcuuucuuuaaaaccaggguucucuauaaacagacuaauuuggccuuaaacucaggcaauucuuuugccuccaccaugagugcuaggacuaccaguguaagaccuauacccauaaugaccucauuuccuuuguauaugugcuacaaagggagauugcuggcucaugggauguugcugcugcugcuuccucuucuuccucuucuuuuccuucuccuccccucccccuccuucuacuuucuccuucuccuuucucccuucucccuucuccuccuccuucucuuccuccuccuccucucuuuugguuuuucgaggcagguuuucucuguauagcccugguuguccuggaacucacuuuguacaccaggcuguccuugaucugccugccucugccucccaagugcuaggauuaaaggcuggccuacuacugacaagccuccuccuccuccuccuccuccuccuccuccuccuccuucuucuuuuacuucuuuuaagacagggucucuguauuuagaccugacugucucagagcuugcuauauagaucaggcuggcuuaagguaguucuuuuuuuaaugguuugggaagccucuauauuucauuuuccauaauaguuguacuaauuuacauucauacacaauagugcggaaaguuuuacuuccucuacaucuuuuucaauacucauuccauuuuuguccuuuugaaaaaccacauuuuugcaugguuaaagguaucuuccugugguuuuauuuuauaacuccucaauaauucauuaugauagacauuuuucauaagccuauuugucuuuguacaucuucguuugaggcaggucucauuaggauauuucaguccauuguuuaguuggguuaacuugaauuuguauauuuuaguuuuugucauuuucccuuaaaaugucauuacauuuuguaaguuuaacguuuaaaauuuuaguguaugguagcggcucuuuuugguauguauuuuucucugaauuuuaacacaugcauuggauugugaaacuagugcuacaauaaaaauucagagucuucucucaaacucucaugauauuccuuuauaaguguaugcuauuccuauucccaguccauggccaacacuaaucuuaccaucaucaguauaauuuuguccuuuugauaaggucauauaaauggauucauacagugugcagucuucggaugcugccuucuuucagugaauugcauguguuugagaucuguuuguuuucuguuuaaauacuuuuuuccccucauauaguuggguggcgguauaucauuauaaauugguagacauuuucauuguuucuaaaucugagccauuguaauuauaaguguuuucuguauuuguuucuugauuuuuguauaacaauaauucucauugcucaggcauaaaucccagagauguauuuacugcuuaacacagugauuguauuuuuaauuuguagagaauauggaaugcuucugaauugccuguguuauuuugcauagguuccugguacucagucuuucuuuucagcuccugauauugucaaaaguuuugugucuguuugcuuuuucguauguuacugcauauuucguucaguauuguauauacaauagacaaaggcuagagcccugagcuacuucucagaccuauuguuggccuuuuaaaccaauccuaaauagcuugguauuuugguagcuucuguucauuauaauguuuuuauguaaugaucaaaauuaugauauuaacacauuuuuguccuuauuugacauccuucuauucucucuaaguaucuguuuagucaguaucacuuuuuuuuguauuuacaaauuauaaucuuuauuuccuuaugcuuuauuuuuacauuguuuccuauugauauauuuauuauauauuuauggguuauaaauacaugcccuuccuuggagcuaauaauugauuuuaaucuuucaauuucaguaucacuuuuaauuuuguuuuauuacuauuaucucaugauuuuuaagcauuuuagaaaugaauucuucgcuacuuacacguuuuggaauucuuuucuuccaugcuguaggucaucuuuugauucucuuaacauugacuuucuuaaagcaaaaugguuuaaguucagacuauaaggaaugugagggaaagacaguauuuuuuugucuauuuuauuuuauuuuauuuuauuuuucuuauuguuuuauuuacugucuccuuuccuuauacauaucuagaaaucacacuguaaucaaggccacauacagaaaauagacauuuaacuauguuugcuguugauuacaaguuacaauuguagacaaguccacuuguuacuuuuguuauaggcuuaguggcuuaggguggcagcaauguuaaguugaaccaaauugagacaugucaggauucucuuguauacucaggguuaaagcuuucuuugcucauguuucaagaacgcuguacucucuuugcaaacacaguauagccccacuguucuucuggccuuaaguagcuaauauugguuucaggcugaggaaaucacuauuaaauucaguaagggaagagaacuaugacuaauuggaaugagccucucacuaaaaagaagcaaucuacugcugagaaaugcuugcuuugagugguggaggaagauguaagcaucuguaacuccuuuugaugugcaauaaaccauuuggcauuuucaacuuaccuucuaguacacauuaaauaguauccaaaugccauuucucucuuccuccaucauuuucucuucauauuuauuuuguugugauuuuucccaacaauauaacaguuuccccuccccaaacuccucccauaacuucuccauuuccucaccuacccaauucucuaccuuuucuugcucuuuauuguuagaaaaccuuuaagacagucaaguaaaaugcaauaugaugaaagcaaacaaaccaucaaaggacaaaacagacaaggaaaaauacagucaaaaagaaagcacaaaaacacauauauagcuucagauguacacacacucacacacauggaaaucucauaaaaacacaaaaccagaagcaauuacaaaauaaauuuacugauauuuuuggagguuuaauuaaauuuauuuauuuauuuauuuauuuucuaauaaugcuuuguuuguguuuuuuuuuuaaaucucacucucuuuauuuuaaauuaagaugaauacaaaccaacugagauuuugcaagcuggugauaaaaacauuuuccaauggcauaccaaccauuucugcuuggagcugcuuaacaggguuuuugauuuuguuuuugagauaguguuuuccuguggagcauagucuggccuggaacuagugauccuucuccuucagcccccaagguucguauuauacauguguagucucagaaacccgccugucuguaugucuguuuacuacuccuuccagaauuucagccuuuuggaacuaaggcuccaaggagacaucugauccugucagccagucaagucauuaugagcacaucucucucuauuggggugcacacugcuaauuuuucuugucuucuuuucacaaaggauuacgaugccuucuuugaagcccgagaaaauaaugcaguuuaugccuuuuuaggcuugacagcaccaccugguucaaagguaugauuccucuguuuccuucauuacugaccaucuuauugcugauggguuuuuuaaucaacaaaaaucaugccugaguggggcagugguggcacacgccuuuaaucccagcacuugggaugcagaggcaggcagauuucugaauuugaggccagccugaucuacagagugaguuccaggacagccagggcuacacagagaaacccugucccccaaaaaagucauaucuguuaauauucagaguaagucuagagcaguguuugugguaauauacuuaaccccuaauggcguagacaacugugcauaguauacuuagugaaguacacuuagagaagugaacuucucuaucaagcuuccugaggcaggagauauaucgguauucagucucaaaggugugauugccagcuuuaaaacuccagaugucaugcucaauucuacauggcuaucaaguaucuuaguucaugaucaucuccuuagcagcagcuauuagcuucugugagccuaaaugauauagucagcuauucaagaauaauaagaaccuucgaguuacaaaacuggucauuaaauugcuagcuaacuuugguauuuuauuucuugccaagacaaauuaauuuuucaagugacaguguucccaagggagcccaaauaaagaaggaaaguaaaaaugaaauuacuuguccagugagaugccucaaagcuagggacuuucacuagaccuuagccuuuuccauuuggucuuucuuguaucagaucacuuaaucaaaauagguuuuuccaguagcacucaucuguguuccaaucuugaguagauuuuaugaucagcaauuuauucaagcucuaauuccuucuucaaucuugagaaccuauaauaccaucuacauuuucaccagacaggcuuuguaaauauguuuguuucacucucaaguucugcuuccuugccaaacauuccuuucccauggauaaauguuauauuuuaggauuuauaaaaacugaaucaagccagaagaacauuuuuuuucuugguguuguuuaaauaguuuguaaggcccaaguuaagccagugaguuuaaugcagaucagagagugcaaaagaaaggacagucuauuucuuguggcugacgacuuuguccccuucaauuaaaauuaagauucauucauucaccaaaugucuaucaguugccaagcacugagaucaaugguggagcaagcauaacauaugauauaauucuuauauucugaucauaaccuagugaguauauaugugcagaagguuauauaaguauguguauagguaauuauaauuuaagacauucuaugguuaauuuuaggacugucauaaauaaaggacauagggauugagggcaguaaucuuuauuucuuauugaagagauuggagaagcuuuuauuagaaggguauuauuugaucugcucaaaauuucaagauauuuaaaugauacuaaguaauuuuugacaggacaacaaagaaaagcacugcauaggugcauauagcuauacaugaugaucucauaucaagaggacagaaugcaguguaacuuuggaauugaggcuauuaaacaaagggcugcuagaagguuuaagauuagcuagguacuuuggggccagguuaugguucuguauuagguaccuucaccuuuuuucuguuagguacccaaaagucaccauggaaaaccugggaaagcaacggugugauuuuuguuuguuuguuucuuucuuuggucgcuguuggacuguauagcuugagcuggucuggaacucacuauguagaucagucuggccucaaauuuauauugacccaccauccucugcaagggauuaaaggugugcaccaccauacucugcacaugggaugauuauuucaguaguuuaagauaugguuuaauuuaauuucaucuacguauuuuccauuccuucccuucuccuugcuggcuuccugugugucaggaucucauucuuuuuuuuuuuaaauauuuuuauuagguauuuuccucauuuacauuuccaaugcuaucccaaaagucccugcccugaacugaucagagcagcuugacuuccccugugauggggucugucacccugcaaagaaaauuugucuuaagaaacuaaauuugguaggugugugcagugugggcauuagaagaaggacgugguauaguaacacuuauacuuugggaugcuuuuaaguucacaaaaacaaucaagggggccuuaagugaaauaguuuuaagaaagugaaugauggaguuagaagucaaaugagccaagucacauuguaaguguugacaauuaacaaggugcuuggguaaaagcaugguuaagauuauaauccauaaucucaaaccauuggggaaaugguaaauauuucaaaaagagugucaauuaaguugauucaucauugaacuucauggauaaacuaugagucauauauaauuuaaauauguuuuauguauaugucuaaugucuauaauauuggaaacaaauauccagcaauaaaaccuaccaaaaauguuguuccauuccauaagcucauguugccauuugaaaaauuacaucauggcuuccucuuauacagucucacuucucagaguuaugucaacuguggucuggaaauauuaauuaagaauuguagaacaacugauuuauguguuuuugucacucugguuaguaugaugaaauuacuccccaucucaguccaucccaugcugucuugccaaacuuauccaguuuguuuguaccaccugcucaauaggcaagagagagggaguggggacuacauucacaugaauuucauuauagucuuuugucauaauacacuguuauuaguuauuuuugcuaguuacaaacaaucuuauuuucugaguuaaacuauuuauauaagaaaaaucuagucuaauuagcauguuuaugguuguugauaagagggaacuguauagcuuguggaaaaauauuuaaaaaaugaguuauagauuuauauuuacuggauaauucucuaauuauauuuagaaccugugcauggggcaaaaaggaagccuggaaggaguaauaggcaauaggaauggccuucucucauuccuuaauuuuucaaaccacuaguaguguauacccuuuaaaauuauugaaaaccgauguacuagaaagauugcuaccuaaaagaacugcucagcaaauauuuccauaaaguacauucuuguagaggaugaaucugcucuauuauccccuuguggccccagcauacucaaaagggauaguacucauuuuuugcuucucucauuucagaaaguccuuuuuagcacuggcccuuguuuguagugaaagugaugauuuuaagauaggaaacaauaaaguaguuuauacuuugacggaaauauaaauccaguggcauuugucuucagggagaaaaugauuuggcaagaaaaaccacuugcaguaaacuuuucauaugguagaguuauguuaugaaagauguuuuuggccaucuaguuugaaucauuauauguggaaaguggccuuggacacuguuucagcugugguaugugaaacaauccuauuuaaauugaaaauaaucuauucaagagauuaauaacgaagauuaauauuacccaacuaugaacuugguuucagucaaaaacaggagaggaggaaaaucagaaagaguucgugccuguaauggggucacccacugagucgcacacuguauacaccccccucucaucuuuuuauccuuaugugcucuuuaugagcuaaaugccuggaaugaaauucuauagaaaaaauuaagacuuaauuuacuuugucuaagaauacauaauugacuggcacagcuaaggucugaauccugaauuaauuaauucaaaacuuaugcaggcacagggugaaguucauaugauaccauuuuuuaaaaaaaaauaauuaaaucucuucuuguuguuauuuuucuauguauguauauaugcauguauguguauaaugugcauguacaugggcaugcauguguauauggaggcccaggaacaacuauugcuacuucaaugaauauauuuuaugcaucuuguuauuuuaauauuuuuuuguuguucaguguauauacaauuuguguguguguguguguguguguguguguguguguguguguguguguauugggagggagcauuagugccacaauguauguguguagguaaaaguuucaagauuugaacucaggucaucaggcuagcauccuggacagcaggcaccuuugccuuuugagcugucucacugguccuacguucuauuuuauuccuaaaauuaaauaugaacuugcucuguagaugaggcuggccuugaauucagacacauccaccugccucugcccuucucucucaguauugggacugaagguggagcuuucccuuuuguuuuagaugccucuguuagcaaucucuuucauuaggaaaaauggagugugacucuggggagaguacuggucacuggaaauagauguguauuuaugugaaaaaacacuugauacgagcuucugcacauuauuauauacaugcuuccccgguugcauaugcuaguugcucuuucauagauguguuaugguuugguuuucugccaaguuuuuaaaagcauuuuguacuuauuuuggcaauuuauacaugcauggaguggauucugaucauauucaccccauuaccuugucuccuucucccugaccacuucuuuccauauagucccugguuaguuccgaaccuuuguguaugaccuauugaauuuaaaaaggguugcugauaugucagggagccguuuaucagagccauauaccacugaaggaaauuuacuuucuaucuccuagcaacuauuaacugcaaccaguaacuguuaacugcaaccuuuaccuguuaauugccaauagcuucuuaagaaugggcagugucucagaagccccuucauuauuccaugagacucagggccccaucuucuguagguaaccucaaugugaguucaugaaaugaguguaaagguuaugcugugcccaaagacagcauucuauaacauacccauccccuggcucuuuuuuuuccacucccuuuucccaaagugcccuuccagacuuggagagguugguacagaugucccauucacgacugagcauccaacaguuacuuuuccuaguacuuugauuaguuaucaacugcuguugacagcgaaaagaaaugucucugaccaaguuuuuaagcaguacuauauggucauauguugaaucguuuagaaggcagugugaugcaacaugaucauuuagcaaaacaaguaccugugaccucccugcacaggggcuuuuuaccaggcuuauagaaccagauaugaauuuccucuuguggagcaggcuucaaguccaaucagaaaauaguugcuaacuccuauaaaagucacaugaucacuuucccaggggccuaucuuuccugugaguugguugugugguauacaggauccacagcuaaguaagaaugugauucugauccucucccagcagccuacauaaaacacuuucuggcaugauaaaagaaagcuucugcuaauuauuuuaaagccuuuuuuguuaaaucauggaaguaauugcuauauaauuacuuguuaaauaaucuuagucacuugagauaguuuauuuuaaccaaaaugcacaagaguauuuaccuuaugauauuuaaauguaaguuuuguuuguuuguuuguuuuauuccaggaagccgaagcccaggcaaaucagcaagcaugaauguucugaguucuuccuucagcaucuugaaaaauaaugaaaucuccauugcuuuuauagaaauccuugcuucaaaagaaauaggcuuacauguugaaauaauagauuagagauuaguugauauucucgcaugcaaacaagcauaaugaaaaugugaacauggugguaagaaaugagagaugaaguuaaaacuuuaaguagauaucuuagaguagcauuguuaucugccaaggcauuucuguucuguaaggauuuuacaaaaaaucaauaugcuccuucuuuuaaauuucuguguagcuuaagguucucaucauuucaacuuuaaggaacugaaaggagcgagagaggagagagagagagagagagagagagagagagagagagagagagagagagaagagagaagagagagagacucuuauucccacaaugccucauuaucuuuagugaacaugaauauuuucaugugauguuacuguuguugaaauguauuuacagguuauguucauauguuagucauuguaauuuccuaugcugauugugacauucuccuucuuuuaucaaagaaacauguaugccccgaaccacaaguuuuccaggcuucuagauguaaccuuucauugcacagccagugaucaaaauagcuggcuucccgucagacacacguugagugcauuuaacugauaaauuccuugcuuauacaugcaguuauagucauguuucuaaguugcuugccucaguacaauguggguauauaagucauggagaaaagauugcaguucacuuuaaauuggcccuuccuugcaaagaacacagacuuuuaauuaacuguuauauaguaucuugcccuucauuguuuaagauauauuuucuuuugguguuugcugaacgaaguaguaguggcucuugucuccugcuuuaacacuguuggugaucgugaaugauacuguccuuaauagguaagcuuuuaguuucacuuuagguagacugugucaacacauccguccaaguagaaagaaucacuaagcacacauugauuuuuugagaaaguacaaguaucaaagaaaagcaacaacguuugaaguaguuugaagauaagcaagacccaaagcauucaaccagaagauguugauauuguaccuuuuucccauacuugauuuuuauaaagaaacacacaucuuuuacuucaaauuacuauuaucaucauaccugcucuuuccuagacuguacuuggcaaaaauucaauauguaauggagccauagcuuaguuuacugaaacucaaacgugaauugaugcuuuaacauaaaugguuuuaaaauuugcgcuacucaacucuaaauguuauacaguaauuuugaugaauaauuuuuguuuauagguguuuaaaaaggagaaaaaccaaaaugaaccaaaccaaccaaaacaacaauaaaaaacaauuugaaggcaacuuuuagugaccuaaacuuugaaguaugaauuggagucaaaacuauuccauuucuucuuccuuuuuuuuuuuuaauuguuuuggggaucucuauggaagacaauacuuuaaauuaauuuuggagugcaaaauacuuuuagccaauguuuucccucaucauugcuaaaugcuacagguaauaccugcaguauuauauguggacaauguaacuuucucuguuuugcauuggaggauguuuaugucugugggauaauacccugaagucuguagauuuaaaguacaaguuugaauugagucuucuccaauugaagccugucauuuugucaacugagaaacauuccugauagaugaaaggaaaggaaauaaaagucuaagaauuaaaugaguuuugaagaaacuuccacaguauaugcuugggagugaauuucuuguugcuuugcauaauauguuuggcauauuuguguuucuaaaugagacuugguaauuuguaaauuucacauuuaagagcugauuugcccuuuagaaauuuuguucuuuagaaagaguuccacuuucaaaaacacuguaaauuguuaauuguacugcuaaauguggacacuucauugggacccuaaguauaugugaauagggaauuuugaaacaaagauuacuuuuacugggaaagacugaguacagggaguuuuggugaaaucagacuucacuccuuaaguaaaaagaacaacaaaauguaaaacucacaugaauuuuuguuaagcaguuguugguguuuaaaauuacaaaguacaacauuaauccuuuucuauggaacacugauucuuuucaucugaugaauuucaauaaaacugauuaagugauucauguuugauuacuuuuaauuuucuggucuucugucucucuuccucaauucuuguuucugaauauuaccagucaucccguuguaacuaauuuucauuuuaaauuaauuguaauuuuaacauuucuuuagaaagaguaaccauucuugggguuggggagaugacaguuuaagagcacuuaaggcucuucccaagaaaccagguucugcuugcagcacacacaugguggcucacaacuguuaauguaaugauuauuuugcuaugauguuuuuuaauauguucauugagguauuuuauauaccuuaaaauuuaccuauuuaaaaugcaagaccccauggauuuuaugcaaucaucagcacagugugaaacacuucagcauggaacagacuuccuuccuuguuaguucuuacuccaucagccauaugcaaccaguaauuuacuuuuaaucuuuauggaauuaacaguucugcaaagugucacaugaauggaaucaugaaguauuugacuuuugguuagagauuucuucaguuaccaugcuuuugaauuucaucucugccacaucuuguaaucuauugaugaauagagcaucuauucuuuuauauugugaaaauaauauuuuauuauguggguagaaucacauuuuguuuuauucaucauuugcuauauauuuucuacaaaucuacuuuucuuuaucaugcauaaugcuacuaugaaugcugauguauuuuuuuguuugaacaccuguuuugaauuauuuugcauauuuguagguaugguucauguggcaauucuguuuaaaaauuugaguaacuaccacauguuuucaaauuggcuucacuauuuuacaccaccucucgcaggguacuaaugugauaaauucucuacaucuggggaaauguuuguuauucuuauauuuuuuauagccauuguaggagcuauuuuauggcaucucaguagaguuguaguuuuacauuccuuugguggaacauuuucuuauguuauggcuguuuguguagcuuuuuuggaaaaauauuuuuccaguucucuguuuaguauugauaucuuuauuacuaaauuauaauaauuucuucuauaauaagauuacuuuucuauuauuguaggcaugaucugaaauguuauuuuuccauuccauggguuuuauuuucgaacauaggugucugauguucaaguuuuuaggcuugacaaagucaauuuucaaauauugaucauuuauuucuuuuuacuuuuguuaucuuaacuaagagggacaauccuaaaccaaggucaugguaauauaauuccuacacuuucauugaauauuuuuaacagccaugcuuuacuuauguuugugaacauauuuugaauuauuuuugugugugauggagaguagggaucuaagaucauuuuauuuugaaugaggauuuuguccaagagccauuugcuaaaaauaccuuuuugucccuuuaaaaauuuuuguuuauuccuucccacaguuucacuucuacauuuuuuacuuucaugguguauauccccuaaauaauuuaugacuauguaaaauccaucauuuacagaugaaagaaaacaaacaugugaauauuugccguucugagaauauauauauauauauacacacacacacuuuucuauaugcauucacccauugauggacacauuacugguucaguaacagcucuugugaguagugcugcaguaaacaacaaaaagcaauaucccuguggucuguuaacucaggauucuucuuuguaugcuaaggaaugguauaacuaagucauauaguacuuuuuuuuaagguuuuuaagguuauuuuuauaaaacuagaaacaguuuuguuaaggauuucagaguacauuuuucagacuucuagaguggaauagaagcauuuggggacugacagauugucauaaugaacacugaaccccaaagcuccacccagcacaucuccauuauacaaaaugagccaaccagcuaccccuuugcuuuggcagcagcuacuuccuauggaaggaaggguguaaguucaucaaaaaugagauacuaucuuaagacuauaacuucaacauucaagaaaauaagcuguguuuagaugaccuaugauuacagagaauagcauaaaccaucugaaaaaaaugcaaccaagucauuuucaaaauaagggaaauaauauauuuuguuaaggauuuccaguaguuaaaaaucucaggaaggucagcuacagaauguguucacauucucagagcuuaauacuaaaauuucacaauucacuuccaaaagaaaauccuugauguaaauuacaugaacagcagaaacuauagucuuucuuccaaguacaauacaauuaauauacccugucaaaaauguuccuuccccaaaaugaacaguaauuagccugagguauuuuaaauguggcucucagugauugaaaacuuaauaccacccucccuguaauagccucauuaccacuuuugaguuuauuacaguguggucacuugaaauaucugaagcaggggagcuaacuaaaaaauaccaaaacccuuuaaucucuugaaauuauacauuaauuucauuaauuccuacuagaacaggagcuacaugcuccugaauauuacacucauaguauagaaagccaguauuuuugagccauuuugaagacugagaaacuaugugagauuuaccccaauaugucuuaacagagcugugaggugguugucucaccaguaccacccagucuuaguucuauacaguaagcagcguggcucauggcacuccucaucccuucagcaaggaggacuagaauaaacaaaaaagucaagaaagcauucaguucuaacaaagggaauuucacuuuaauguuaaaaagcuaucuauagcacaucacuuuuauuaaagcacauucauauucucuccuccaaaguuguucaguauagaaaacuaggcaucucugaauucaaacuaacacucugcaauagccucaaucaguacaaacugaggcagcaucuagcgagagcuaaaauugugugccauuuauuuuacucucuaaaacaaaaguuagcugaauaacagaaaaaccccaaauagguuuaaauuguguauauucaucuuuuccaggaaagcaaagaguaggccauaucacaaagaaaguaauuaauggaagcuaauuuucaaaguacauuaaauacauuagcuuccgaagagagccuagggcuugcucaccuuacugugauaauaagcuugaguugacuuuuguuauaucaucuaaaaaauaaaaauaccuuaauaaucucauuuauuguuugaucuuacuggaaauucuuaaucacaauuuuccacaaaugaugaccugucuugauguuagucaccacauccaucuaacaacauaaugggaagcacaacugaugccggcagacugcaaccuuuucuacuuuggcucuuuaggaaagaaacaacuacuuuucuuuguucaacaaucaaguauguucaacaguugauuuuucauaauuguauuccaauaguuacaugauaaaaauaauccagaauaaccaaacugcaacaauaagugaacauguauuaaagaggacuuacgcauucaacauaucuaauagagcuauacuugggacgcuauguauaacaaauuggucuuugaauagaaauauguaacaguggaggauaagaaacuggggauagccaccagaaagucccagacgccaggaaagcaagagacucccaggacccaacagggaugacuuuagccaaaauaugcaacaaagggaagaacaauauagagaccaccuccagagagccacccacccaucucaaaauuuuuaaccccagaaauguuccuguccaaaggaaagacagggacaaaaaauggaacagagacuuaaggaaaggucauccauucuuuuucucaucuuaagucuuugccuuuucuuucagcuccucugaaauuucaucuuccucaucuaauuuccauucacauucuccuguagguuagaguuaggguuaugguuaggguuaggguuaggguuaaggguuaagguuaaggguuaggguuaaggguuagaguuaggguuauauuuuuguuguuauuugcuauuauuuuuugcgugaaagagaacaugaagucaugcugcccuacauguguagaggucacaggacaaucugaaggaauuuccucuccccaccagguggauccugggaauuugacuuaggucaucagauuuggccacauuugucuuucugugucuuacaccucuuuugcccgaguuagagucuuucccaguuugguugcuuuucuuuugcuaugauaaagucacacgacaaaaacaacuuaaaucauuuauuugggcauacauuuccagagggcuauaauuuauaugacgacuaugucaugauagauaguaguugggaguggaaaacaaagaguucacaucuucaauuauacacaaagcagagagcaaccugcaauagagauaauaaggcuaugaacucuuuuuuuuuaaaagauauuuucuucauuuacauuucaaauucuauccugaaagucccugauacccuacccacgcccugcuccccaacccacccacucccacuuccuggcccuggcauuccccuguauuggggcauaugaucuccucaagagcaagggccucuccucccauugauggccaacuagacugucuucugcuacauauacaacuagagacacugcucuggggguuacugguuaguucauaguguugucccuccuauaggguugcagaccccuuuagcuccuuggguacuuucucuagcuccuuuauuagaggcccuauguuccacccaauagaugacugugagcauccauuuuuguauuugccaggcacaggcauagccuuauaagagauagcaauaucaggguccuaucagcaaaaucuuucuggcauaugcaauagugucuggauuuggugguuguuuaugggauggaucccuggguggggcagucucuggaugcuucuuuccuucucagcuccuaacuuugucucuguaacuacuuccauggguauuuuguuccccauucuaagaaggaaugaaguauccagacuuuggucuuccuucuucuugaguuucauguguuuugcaaauuguaucuuggguagucuaacauucuggguuaauauccacuuaucagugaguacauaucauguguguucuuuugugauuggguuaccucagucaggaugauauccuccagaucaauccauuugccuaagaauuucauaaauucauuguuuuuaauugcugaguaguacuccauuuuguaaauguacaacauuuucuguauccauuccucuguugagggacaucuagguucuuuacagcuucuggcuauuauaaauaagguugguaugaacauaguggaguaugugugcuuauuauaaguuggaacaucuucuggguauaaguccaggagagcuauugcuggaucuucugguaguacuauguccaauuuucuuuuguuguuuuuguuuuguuuuguuuuuauuuuuaguugcauuucuuuucuuuuuuuaauuuuuuauuagguauuuauuucauuuacauuuccaaugcuaucccaaaaguccccuacaugcucccccucccacuccccccccacucccacuucuuggcccuggcguucaccuguacugaggcagauaaaguuugcauguccaaugggccucacuuuccacgaauggcugaguaggccaucuucugauacauaugcagcuagagacaugagcuccgagguacugguuaguucauuauguugcaccuacaggguugcagaucacuuuagcuccauggauacuuucucuagcuccuccaaaggggggcccggugauccauccaauagcugacugugagcauccacuucuguguuugcuaggcccuggcacagucucacaagagacagcuauaucugggucuuuucagcaaaaucuugcuaguguaugaaauggugucagcgauuggaagcugauuaugggauggauccccggauauggcagucucuauauguccacacuuuggucuuccuucuucuugaguuucauguguuuagcaaauuguaucuuauaucuuguguauucuaaguuucucggcuaauauccauuuauuagugaguacauauugugugaguucuuuugugauuggguuaucucacucaggaugaugccauccagguccauccauuugucuaggaauuucauaaauucauucuuuuuaauagcugaguaguacuccauuguggaaauguaccacauuuucuguaucuaguccucuguuuaggggcaucuggguucuuuccagcuucuggcuauuauaaauaaggcuguuaugaacauaguggagcauguguccuucuuaccaguuggaacaucuucuggauauaugccgaggagagguauugcgggaucccuccaguaguacuauguucauuuuucugaggcacuacaagacugauuuccagagugguucuaccagcuuguaaucccaucaacaauggagggguguuccucuuuuccacauccucaccagaaucugcugucaccugaauuuuugaccuuagccauucugacuggugugagguagaaucucaggguuguuuugauuugcauuucccugaugauuaaggauguugaacauuuuuuucaggugcuucucagccauucuguauuccucaggugagaauucuuuguuuagcuauguacuccauuuuuuuaauaggguuauuuaauuuucuggaguccaucuuccugaguuauauauauauuuauauuggauauuaguccacuaucugauuuaggauugguaaagauccuuucccaaucuguuggugaccuuucugucuuauugacagugucuuuugccuuacaaaagcuuugcaauuuugugaggucugguuuguugauucuccaucuuauagcacaaaauauuacuguucuguucaggaucuuuuccucugugccuauaucuucgaggcuuucccccauuuucucuucuaaaaguuucagugucucugguuuuauguggaguuccuugauccacuuagauuugagcuuaguacaaggagauaagaauggaucaaauagaauucuucugcaugauaaccgccaguugugccagaaccauuuguugaaaaugucuuuuuuucuuuggaugguuuuaucucccuugucaaggaucaagugaccauagauguguggguucauuucugggucuucaauucuauuccauugaucuaccuguuuguugcuguaccaguaccaugcaguuuuuaucacaauugcucuguaauacagcuuugggucaggcauggugauucccccagagguccuugagaagaguuuuugcucuccuagguuuuuuguuauuccagaugaauuugcaaauugcccuuucuaacucagugaaggaaugaauuugaauuuugauggggauugcauugaauguguagauugcuuucagcaagauagccauuuugacuauguuaauccugccaauccaagaguaugggagaucuuuccaucuucugagaucuuuuucuaauucuuucuucagagacuugauuucuuaacauacagaucuuucaauuccauaguuagagucaucccaaguuuuuuuuauauuaguugugacuauuuggaagaguguuguuucccugguuucuuuuucagccuguuuauucuuuguguagagaauggccacugauuuguuugaguuaauuuuauauccagauacuucacugaaguuguuuaucagguuuaggaguucucugguggaauuuuuaggaucacuuauauaagugauauaaguguguguguauauauauauauauauauauauauauauauacauauauauauauguauguauauauauauauuaaaauaucaccugcaaauagugcuauuuuaauuuuuccuuuccaauuuguaucuccuugaucuacuuuuguugucuaauugcucuggcuaggacuucgaguacuauauucaauagguagggacaaagugggcaaucuugucuagucccugauuuuagugggauugcuucaaguuucucucuauuuaguuugaaguuggcuacugguuguauauugcuuugauuauguuuggguaugggccuugaauuccugauuuuuuuccaagacuuuuaucaugaauguguguuggauuuuaucaaaugcuuuccuagcaucuaaugagaugaccauguaguuuuugucuuugaguuaguuuauauaguagauuauguugauggauuucuguauaugaaaucaucccugcaucccuggaaugaagccuacuugaucaugauggaugauccuuuggauguguucuuggauucuguuagugagaauuuuauugaguguuuuuacaucaauauuaauaaaggaaauugguaugaaguucucuuucuuucuugggucuuuauguggcauauguaucagagaaauuguggcuucauggaaugaauuggguagaguaccuucuguuucuauuuuguggaauaguugaggagaauuggaauuaguucuucuuugaaggucugauagaacucugcauuaaacccaucugguccugggcuuuuuuuaguugggagacuauuaaugacuacuucuauuuuuuuguuuuuuaggggauauugaacgguuuauaucauuaaucugauccugauuuaacuuugguaccugguaucugucuaggaauuuguccauuucauccaggcuuuccaguuuucuugaguauagcccuucuuaguaggaucugaugauguuuugaauuuccucguguucuuuuguuaagucuccauuuuuauuuugauuuuguuaauuaggauauugucccugugcccuuuaguuagucuggcuaaggguuuaucuaucuuguugauuuucucaaagaaccagcuucugguuuggcugauucuuugaauaguucuuauuguuuccauuugguugauuugauuauagccugaguuugauuauuuccuguugucuacuccucuuugguguauuuuuuuccuuuuguucuucagcuuuuagguguacugucaagaugcucguguaugcucucuccagauuauuuuuggcagcacucagaguuaugaguuuucuacuuagugcuguuuucauugugucccauaaguuuagguauguuguggcuucauuuucauuaaacucuaaaaagucuuuaauuucuuucuuuauuucuuccuugaccaagguaucauugaguagaguguuguucaguuuccaaaugaauguuggcuuucuguuauuuaugcuguuauugaagauuauucuuaguccguggugaugugauaggaugcauggccaaauuucaauauuuuuguaucuguugaggccuguuuugugaccgauuauauggucaauuuuugaugagguaccaugaggugcugagaagaagguauauccuuuuguuuuaggauaaaauuuucuguagguaucuguuaaauccauuuguuucauaacuucuguuagcguccaugugucucuguuuaguuucuguuuccaggaccuguucauugaugagagugauguuuugaagucucccacuauuauuguaugaguugcaaugugugcuuugagcuuuacuaaauuuucuguaaugaaugugucugcccuugcauuuggagcauauauauucagaacugagaguuccucuuggaggauuuuaccuuuguugaguaugaagugccccuccuugucuuuuuugauaacuuggguuggaagucgauuuuauucaauauuaaaauggcuacuccagcuuguuucuugggaccauuugcuuagaaaauuguuuccuacccuuacacucuaagguagugucugucuuuuucccugagguggguuuccuguaagcaguaaaauguuggguccuguuuguguagccagucuguuagucuaugucuuuuuuuggggaauugaguccauugauguuaagagauaauaaggaaaaguaauuguuucuuccuuuuauuuuuguuguuagaguugggauucuguucuugcggcugucuucuuuuaguuuuguugaagaauuacuuucuugcuguuucuagggcguaauuucugaccuuguguuaguguuuucccuuuauuauccuuugaagggcuggauucauggaaagauacugugugaauuugguuuugucauggaauacuuugguuucaccaucuaugguaauuuagaguuuugcuagguauaguagccugggcuggcauuuguguucuguuagugucuguauaacaucuguccuggaucuucuggcuuucauaaacucuggugagaaaucugguguaauuaucauaggucugccuuuauauguuacuugaccuuuuucccuuacugcuuuuaauauucuaucuuuauuucgugcauuuguuguucugauuauugugugucgggaagaauuuccuuucugguccagucuauuuggaguucuauaaucuucuuguauuuucauggguaucuguuucuuuagguuuuggaaauuuucuucuauaauuuuguugaagucauuuacuggcccuuuaaguugaaagucuucauucucaucuacuccuauuauuuguagguuuggucuccucauuguguucuggauuuccuggauguuuugaguuaggaucuuugugcauuuugcauuuucuuugauuguuguuuccauguucucuauggaaucuucugcaucugagauucucucuuccaucucuugcauucuguugcugaugcuugcaucuauggucccugauaucuuuucuaugguuucuaucuccugaauuguuaccguuugguuuucuuuauuguuucuauuuccauuuuuagaucuuggaugguuuuguucaauuccaucuccuguuugguuauguuuuccuguaauucuuuaagggauuuuuguguuucuucuuuaaugacuucuaccuguuuagcaguguuuuucuguaauucuuuaaugaacuuuugugcuuccucuuuauggccuucuaccuguuuaacuguguuuuccuguguuucuuuaagugagucauuaauguccuucuuaaaauccucuauuaacaucaugagauaugauuuuuaaaucugaaucuugcuuuuuggguguguuggaguauacaagacucauugugguaggagugcuggguucugaugauggugaguggucuugguuucuguuaguaagauucuuacauuugccuuuggcuaucugauaaucucuaguauuagauguucuagcugucucuaucuggaacuuguugcuccuguaauucuguuagcuucugucagcacuccugggaguccaacucucuccugagucucaguggucagaguacucucugcaggcaagugccagacaucuagagcucagcucugccucuugccugaagaugaaggcccguaauugacccuguuccagaugcuaugucacuucugccaccugcaugcucuccugugcagacuggucuuuugggacccuguauaaaagauggcauucucaccugguucuuuguucagagccuucccuggaggccaccucuccucugguaggaaaagugugcagaggucugggucucagcccugccuccuggcugaagaugaaggccugaagggaacccugucccagaagcuauguugcuucugcuguccucucacucuccuguugcagacugcuaauucucccuuuuuaccauuaauuccuuagaauugagcucaagucauuagacuuggcagcaaguuucuuuaccuucugagugaucguacaagcccaaucauaggauuuuugucuuuuuucugauguauaauauuuacugacuuauguauggugaauaaccuuaucaucucucugauaaaucccucuucauauuugagauuggauuggguauaauuuuggugaacauuaaaaauuuuucauuauuuauuuuaugugaauugcuuguuuguguauauauauaaucuaugcagcaugugagugccuucugaucuuggagucaaggaaaaggugucauaguccuggaguuccagacaguuggguaucaccaugugugcugggaauugaaacuggguccucugcaaguauucuuaacaacugacucaucuuuccagucccauggcaaacauaaaaucuguguucauuaaggauaucaacauguaaucuucuuuuuccuuucuuguguucuuguaugauuuuaguuucagaaugaugaugaccuuauugaaugaacuuggaagaugauagacaagcaguuuuuaauugaacuaacucugguguuuuauuuauuguaauuuagucuugguaagguuucugagucagggaauuugccauguauuucuaguuuguucagccucuugauaaguauuugcacauaauaauuuguuguggguugagaauggugucccacgucuguuuggggcucgggcugcugggugagguaggaugcagacaauucgauuguacacacccucauguugcugcaggguaggcaucaggcuguaagaaaccucaggaccccacuuaggggguggggagcuaaagucugaggucgcaguggaacugcugggacuggcucagggucccuggccugcacagaggccagggacaguagauucuaacucuugggcaccucagacaccacugagugcucuggaagagcugagaacagaguagcaggggcccacagggcuaguucuggccuggggccaaagggagaaagacaggaagagagagcuccagcugguuacuguggggaggagagucauuggcuugguuuguggcuugcuuggggaagaccauggcuaagaaugcagagaggccuccggcauaaaguuaguuguguggcucuuuagagggagaccuguuucauugcuccagcauaguggauaccaaugagaaagaggcacucagugguuuuaaggcauuuaauguagaaaggcagagagagggaaaagaguagagaaguagaagccaggccauggccacguggagagaggggagaagggaauggagagagaggggggcaagagggcaacaguaagcaaagcaggaggaagaguguaagagagcaagggaguaagagagugcagaaggagcaagcagcuccuuuuguaguggacugcaccuaccuggcuguugccagguaacuguggggaggagcauacguggcuguugccagguaacuguagaguuggaaaccagacagccuaugugacugaaggucauagacuuauggagcuggggcuuuuuuguuaggagccuagugcuugggagcauguggcaaacuuccuuugucccuugcagauuaaucugaugggucucugggguuuaaaccuagcucgaccagaaaacagacaggcugccuuucacgaucccaccauuugugauaguccuuaguuuuuccaugguggcagcugcaauacugcacuuuuaaaccugauguuauuagagaugucuccccuuuucuuagccuaagauuuugucuacaauucuuaauauuuuuuaaacaacaacuuguuuugggauguuuuagucuuuuauuuaugcucuaaucuuaauuauauucuaucuacuaauuuuuauaacuggcacaauguucuuuuuccaauuguuugauaaacaguaauaauucauguguuugaacuauccuuacucugugaaauguaagcauugauugcaccaaacuuucuuuucaguuccccuuuuccuguaucuccuaauugauuuuucaaauuucacuuuacuguaguuuuuuuuuuuuaauuuucuuguugacguucucaauauuaguuuucaacacacucuacaauccacuagcuguccaaauguagauuguuugauuuacacacauuuuuguugucuccaaacuauccaagcaaaugguuucuggcuuuaguuuuauuacacagaagucagaggaaguauuuauagagguuuuaaaaaaaaguauguugucacuuagcuuguggcugagaaaauauucugcucaagaagaaaaaaauaguguguauuuggcagugcucaguaggauaugcaguauauguauauguuaggggcuuugaguauaguuuaacuccaguuugcuaggguaguaucugaaugaucuuuccauuaauaaaaggggaauuuuaaagucaacaauuguuacuauguugcacuauacauuuucuuuaacauugauauuugcuuuauauauucaugugcugugauauugaguucaaaacauaauuauucuugcuggguugccucaguuacuauuacuuuucaccuauuucugauuuuuacugcuuuucauuuaaaucuauuuuaugugcuacuucugugaccauucuggcuguuuauagauuuuaguccacguauguucuuagagaugagguguacaaaacauagaccuugguggagucacucugugcuuguuggagagucaaaucacgcacuuugguaugagacuugauagagaaguuauugcugaaucuauaauucuaguuuugcuuuuguuuauuuugcuuauaaucuuucuuuauaauugauugacucaauugucauauuuguuucuugcuuaucacuuugguuuguuucuuacuaauuuuugcuuuaagguuaccauguggcuuacaaacauucuuuuauuguaagaagcuacuuuauaaagaacaacccaaaaucugcuaguaauaaaacucuaacauuuucccacauauuuugaauuguacauuuuuucuauaugggcuaacucuuaauguaguuaucacauuaauauagcuuuuauuuuauuuauuuuauuuuauuuuauuuuauuuuauuuuauuuuauuuguuuuccuuacuuugaaagguaaagggagcuuauguaccauaucuacaacauuagagcauucugaaugugaauuugauuccuucagaugucuucaucuuacuaaugaacauguuuuucaguuuacaaaaacucuuuguuuuuuaccauuuuuuauuagguauuuagcucauuuacauuuccaaugcuauaccaaaagucccccauacccacccacccccacuccccuacccacccacugccccuuuuuggcccuggcguuccccuguacuggggcauauaaaguuugcaaguccaaugggccucucuuugcagugauggccgacuaggccaucuuuugauacauaugcagcuagagacaagagcuccgggguacugcuuaguucguauuguuguuccaccuauaggguugcaguucccuuuaguuccuugggugcuuucucuaguuccuccauuggggguccugugguccauucaauagcugacugugagcauccacuucuguguuugcuaggccccggcauagucucacaagagacagcuauaucuggguccuuucagcaaucucuugcuaguguaugcaauggugucagcauuugaaagcugaucaugggauggaucucuggauauggcaaucacuagaugguccauccuuucaucacacuuccaaauuuugucucuguaauuccuuccauggguguuuugauuccuauucuaagaaggggcaaagugugcacacuuuggucuucguucucuugaguuucauguguuuaacaaauuauaucuuauaucuuggguauccuaaguuucugggcuaauauccacuuaucagugaguacauauugugagaguuccuuugugauuggguuaccucacgcaggaugaugcccuccagguccauccauuuggcuaggaauuucauaaauucauucuuuuuaauacacgaguaguacuccauuguguaaauguaccacauuuucuguauccauuccucuguugaggggcaucuggguucuuuccagcuucuggcuauuauaaauaaggcugcuaugaacauaguggagcauguguccuucuuaccaguugggacaucuucuggauauaugcccagaagagguauugcuggaucuuccgguaguacuauguccaauuuucugaggaaccgccagacugauuuccagagugguuguacaagcuugcaaucccacaaacaauggaggaguguuccucuuucuccacauccucgccagcaucuacugucaccugaauuuuucaucuuagccauucugacuggugugagguggaaucucaggguuguuuugauuugcauuucccugaugauuaaggauguugaacauuuuuucaggugcuucucugccauucgguauucaucgggugagaaaucuuuguucaguucugagccccauuuuuuaaugggguuauuugauuuuauggagucuaccuucuugaguucuuuauauauauuggauauuagucccuuauccgauuugggauagguaaagauccuuucccaaucuguugguggucuuuuugucuuauugacggugucuuuugccuugcagaagcuuugcaauuuuaugaggucucauguaucgauucucgaucuuacagcacaagccauugcuguucuauucaggaauuuuuccccuguacccauaucuuccaggcuuuucccuacuuucuccuuuguaaguuucagugucucugguuuuauguggagauccuuaauccacuuagauuugaccuuaguacaaggagauaguacuggaucaauuugaaaucuucuacaugauaacagccaguugugccagcaccauuuguugaaaaugcugucuuuuuuccacuggaugguuuuagcucccuugucaaagaucaagugaccauauguguguggguucaucucugggucuucaauucuguuccauuggucuacuugucugucacuauaccaguaccaugcaguuuuuaucacaauugcucuguaguacagcuuuaggucaggcauggugauuccaccagagguucuuuuauccuugagaagaguuuuugcuauccuagguuuuuuguuauuccagaugaaucugcugauuguccuuucuaauuuguugaagaauugaguuggaauuuugauggggauuguauugaaucuguagauugcuuuuggaaagauagccauuuuuacuauauugauccugccgauccaugagcaugggagaucuuuccaucuucugagaucuucuuuaauuucuuucuucagagacuugaaguucuuaucauacagaucuuucacuuccuuaguuagagucaugccuaggcuuuuuauauuauuuguggcuauugagaaggguguuguuucccuaauuucuuucucagccuguuuguccuuuguguagagaaaggccauugacuuguuugaguuaauuuuauauccagcuacuucacugaagcuguuuaucaggcuuaggaguucucugguggaauuuuuagggucacguauauauacuaucauaucaucugcaaaaagugauaauuugacuucuuucuuuccaauuuguauccucuugaucuccuuuuguugucuaauugcucuggcuaggacuucaaguacaauguugaauagguagggagagaguggacagccuugucuagucccugauuuuagugggauugcuucaagcuucucaccauuuacuuugauguuugcuacugguuugcuguagauugcuuuuaucauguuuagguaugggccuugaauuccugaucuuuccaagacuuuuaucaugaauggguguuggauuuugucaaaugcuuucucagcaucuaaagagaugaucaugugguuuuugucuuugaguuuguuuauauacuggauuacguugauagauuucuguauacugaaccaucccugcaucccugggaugaaaccuacuuggucaggauggaugauuguuuugauguguucuuggauucgguuagcaagaacuuuauugaggauuuuugcaucaauauucauaagggauauuggucugaaguucucuaucuuugugggguccuuuugugguuuagguaucagaguaauuguggcuucauagaaugaguuggguagaguaccuucuguuucuauuuuguggaauaguuugugaagaacugggauuagaucuucuuugaaggucugauagaacucugcacuaaacccaucugguccucggcuuuuuuugguugggagacuauuaaugacugcuucuauuucuuugggggauaucgggcuguuuauaucauuaaccugaucuuaauucaacuuugguaccugguaucugucuagaaacuucuccauuucauccagguucuccaguuuuguugaguauagccuuuuguagaaggaucugaugguguuuuggauuucuucgggaucuguuguuaugucugccuuuucauuucugauuuuguuaauuagaaugcuuucccugugcccucuagugagucugacuaaggguuugucuaucuuguugauuuucucaaagaaacagcuccucgauugguugauucucugaauaguucuucuuguuuccacuugguugauuucgccccugaguuugauuauuuccugccaucuacuccucuugggugaauuuacuuccuuuuguucuagagcuuuuagcuuuuguguugucaagcugcuaauguaugcucucucuaguuucuuuuuggaggcacucagagcuaugaguuuuccucuuagaaaugcuuucauugugucccauaaguuuggguaugaaguggcuucauuuucauugaacucuaagaaguccuuaauuucuuucuuuauuccuuccuugcccaagguaucauugagaagaguguuguucaguuuccaugugaauguuggcuuucuauuauuuauuuuguuauugaagaucagccuuagugcauggugaucugauaggaugccugggacaauuucaauauuuuugaaucuguugaggccuguuuugugaccuauuauguggucaauuuuggagaagguaccaugaggugccgagaagaagguauauucuuuuguuuuaggauaaaauguucucuagauauauguuagauccauuuguuucauaacuucuguuaguuucacugugucccuguuuaguuucuguuucuaugaucuguccauuggugaaagugguguguugaagucucccacuauuauuguguguggugcaaugugugcuuugagauuuacuaaaguuucuuuaaugaauguggcugcccuuguauuuggagcauagauauucagaauugauaguuccucuuggaggauuuuaccuuugaugagaaugaagugccccuccuugucuuuuuugauuauuuuggguuggaagucagucuuaucagauauuaggauggcuacuccaucuuguuucuucauaccauuugcuuggaaaauuauuuuucagccuuucauucugagguagugucuaucuuuuucucugagaugauuuuccuguaagcagcaaaauguugggucuuguuuauguagccaguuuguuagucuaugucuuuuuuauuggggacaauauuaagagauauuaaggaaaaguaauuguugcuuccuguuauuuuuguuguuaaaguuggcauucuguucuugugguugucuucuuuuagguuuguugagggauugccuucuuguuuuuucuagggcguuguuccaguucuuguauugguuuuuuucuguuauuauccuuugaagggcuggauucguggagagauaaugugugaauuugguuuugucguggaauacuuugguuucuccaucuaugguaauugagaguuuggcuggguauaguagccugggcuggaauuuguguucucuuaguuucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuaguucauuugauguucugauaauuaugugucgggaggaauuucuuuucugguccagucuauuugaaguucuguaggcuucuuguauguucaugggcaucucuuucuuuagauuugggaaguuuucuucaauaauuuuguugaagauguuugcuggugcuuugaguugaaaaucuucauucucauccacuccucuuauccguagguuugaucuucucauuguguccuggauuuccuggauguuuugaguuaggauaauuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucuccaguguugccucacuuugaguuuucuuuauugugucuacuucccuuuuuaggucuaguaugguuuuguucauuuccaucaccuguuuggauguuuuuuccucuuuuucuguaaggacuucuaccuguuugauuguguuuuccuguuuuucuuuaaggacuuguaacucuuuagcaguguucuccuguauuucuuuaagugaguuauuaaaguccuucuugauguccucuaccaucaucaugagauaugcuuuuaaaccugggucuaaguuuucggguguguuggggugcccuggacugggugaagugggagugcuggguucugaugaugguuaguggucuuguuuccuguuaguaagguuccuauguuuaccuuucgccaucugguaaucucuggaguuaguuguuauaguugacucuguuuagagauuguucuucuggugauuuuguuaccaucuaucagcagaccugggagacagauucucuccucugaguuucagugcucagagcacucucugcuggcaagcucucuuacagggaaggugcacagauaucuguguuuggaccuccuccuggccgaagaagaaggcccaaaacaggaccuuucucagaagcuguguugcuuuggcaggucagcuucuguggugcagacucucaccugugcagacuaauuuccuaaguuccucggagucccggaaccaagauggagccccgcugcuccugaggcugaugccuucugagccagguggacaccuaucaucugguccggacgguggccggcugucuguggcccgcaaagggugcugccucagcggcucugugccuccgccuguccuagaagcuguccgguucuguggugcaccuucuuaccuguucagacuaauuuccuaaguucgguggagucccggaaccaagauggcacccgcugcuccugaggcugaggccuacaaaaccucuuuuugcaggguagagacaagaaguuagggcauggacuucaugguguggcuaacuuccuuuacccagccucuguguaaaaguucauaaaagauucucaguacuugagagugcccuguccuagucuacucauuuucccaaccaugagaggaccuuggaaauagucuguauccagcuucugaaauuguguccucauccaaaacucuaguguguagauucuuucucuauuuuaagagaucacaguuaaaggaugcaauaguuucccgugaauuuggaaaaaaaaaaaaccugccacaaauagcagacauugcuuucagagcucugaaggccagaaguuuaaaaguacugugcccccaccaaagucacaggaaaaggagauucuuugcgugcuuucagcuucuguugguauagcagucaguucagucugccucuuuuauccuucucucuuucucucuguuuugucuucuguuucgugcuuauaaagauguuuggaaaucaauguuaggauucccuugguucauuacauuaucuuaaauaucaaaauccuaauuuacauuugcaaaaaacccuuuauucaaauaaagcaacuuccuaaaucucagaaauuaugggauguguguguguguguguguguguacauguguagugugugugugcacgcacacacaggcguguauauacacauauacggggggugucaccuuuagauuuuuuacuggauagucucuucucaguggaucucuguuagguuguugcaucuguaaaacuaguagaauguuuaugcuacccagauuaagaaucuuauccacuaaguaagcaaaaugagaauccucauuuuucuugguuuguguaugaaaccugagagaauaaaucuuaaagagaaaggacuuauuuguacaugguauccauuuuuuucuaagggagaaacugauuuuuuuuuaacuauggccgcaauaccacucuaauuacugguugcuagggucacaauuauuucccaucguucauuucuugaacuucaagaugguuuuuauaccucccuguucacagacagcaguuuagagccuuguugggaguggccaaaucuuagauuuaaaaaaaggaaauagaacacuggcccauaacuuguaaugaucaucacaaccauaaaccauagccuuugugacaaaccauucaugaaucugaaccacagucucuguagcaaucagucucagacuuucaacacuucaucaucacuauuagccucccgaaguguugaccucaaguagagaaaaucaguuaucacacaggauugccuauuuuuaguuauccugcuuccagaaucuuauagcugucaauuggcacauaccugauaucuuuaguuuauaaaacuucccauucuuuagccugccuuuaaaagucucugcaaaauaccagugaugaugccuaacuucuaacaaguccugaauaaucaggcuuucauuguucucauugggugguauucaauuaguuucucuggaggcaugggaaaauuugaaauguugcaucacuguaaaggaggaauggggcucugugugacuaacaucaguuucaucacccuagacacacagacacuauggcuauguagcaauauuucaaugaaagguugcuaggcaucucucgaaagacuuuugaaauaacaugcagacauccuuucuguccuuuuuaccuuuaaaagcagcuaucuuucaagauugccaaucuucuaacuuccuggaauuuuugccuaaaagaacgcucaaguuagaauggagagauggcuuagcuguuaagagcacuugcuacucuuuuggaugacuggaguccaggucuuaucaccuacauggcagcucacuaccaucuuuaacuucagucccaggggacugaaugaucgaucucuuuuggcuucugggggcaaugcccaugcaugguacacagaugcacaugcaggcaaaaugcucguauacauaaaaaaaaaagaugaaucuuuuuaaagggcuugaacuguagaacauuuuaugguugcagacuucugacucacugcugcuuucucaucgucuuacugguuguaguuuuuuuuuuuuuuuuuuuuugcaacuugcuauuuuguagcuuaguuuccucaugcauagaucaugaaauugagaugguuaaaugaagcugccaugcguaacacuuuagaaggaugcccaacacauguuguauaagaaauguuguuuauuaacugauguaauuuuuagaucuuucacagcagaaagucugauucuuugguguucacaaucuuuccauuccuucuuccacaauuuuuccagacccuugagcauaugacuuguauugagcugggcacugcauggucagcuguugucuguacuuugacuaguaucuauggcuuucuauaauggucucuaucugaugaagaaagaaauguuuuugauaauuggugggagcuacacuuauaaucuaugguuauaaggguaauauuuacaaagcuguuaggaauuacugguucucacaagcccccaccucuaaaugaagaacuaaagacaauuaauaacugcugagagaggaagaaucagacuuucucagagaugaguucccuaaauaguuauccaauacuaaguaagucauuucuacacaaacauuugcauaccagcaacacuaacuaaauggagccaagcagguuguauucacauguauguauacaggcaaucauaauaauauuuugaaaaagaaauuucucagaggaagcuaucaaggcaaguaggacuacuuggcaauuacugucaguaaaaccauuguaucuugugaauuuguuauuauucaacaaaaugucacauuguagaaagacaugaaaaaguguuggcagauauuauuuucaagggagucuauaauuguaagccuguuauuuguguucugagagaaguacauauuagguuauaccugaaacugaaaggaaaaugaagcugcauucugguagggagaaaucaccaagacugucaugagaacucacaccugaaagaucaauaaauaauucauugucaccagauggcaggauauaugaccugaaagugugggaaaauggcaagaaaaugcaaaacugaugcauuuaggaagcuacaaagaacagaguagagaucucaagggaaagguacuuaaaacgugggagaaaaugaucuauaacuauucguuuccaaaaauguguauggaauuucuauuugaccuauauuucugagauauuacuaugcuuuagcaucaccagaagcaucuuaacuaaauucuuagaucuuuauuucaacauaaaaaaugcaagaauggauuuagcaacugaauauucaguaacacucuagauaauuuuagggaauaugacuuuuccacaucauauaauuucaaacuuucuguuucagauuguuaaauuuaaauaaacauaccuuuuacaaaagucuacagagugauuucuguauuuaauuucaugaaacauugcaaucauuagguauguaaaccuauguuaaauauagugacagacauuuaaaaagaagcuaacugaaaauuguacuagaagacuauuuaugaccauacuuacuagugaauuuuuaaaaguuucauguugguggaugcuaguacauuuuuuuucuuguaagguauucaugguuagaguugaaaagaugacguagaaguuaagagugguuucuugccuuuuagagggcacaauuuucauucccagagcccaugcuggccagcugugagaugccuguaacuauagggaaccugacacccucuccugauuuauguaggcucccacauguguguguuagcacagcccuccaccuaguacacaugcacacacacacacacucacacacacacacacaggaacagacacacacacacacagggagaaagagagagagagacagaaacagagacagagacagagagauaauaaaagcaaaauuuuagaauguuuacaguuuaagaaauaauuuuaacuaaccauuggaacaguaggagcccauuaguuuugauagcuacuuuaauggagugguucuuuuauggcuacgaucaaauggugaauuuaucuuuuaucauaaauguucacuuacucaaucuucaggaacuucagaauuuccuuguucuccuuggcaucauggaaauauaugaaauucuaaaacuaaaaguauaguuaaccaauucugaccauucucaauuacuagcuaaauuuaagcauggagugcuaauuauuuugcugagaauuuuacaaaccucugguaacuaagaugaauaauuuucucagauuaccaguuauucuauauuauaauacccaaguaucccucaccacgaagugacaaucuuuuuuaggauuaaaugcucauuuucuuguugucggaaacacaaguuagucuguugaugaguaaaccugacuuuaauacuccauaccuuaggggcuggggagauggcucagggguuaaaagcauccacugaccuuccagaggucaugaguuaaauucccagcaaccacauggugguucacaaccauuuguaauuggaucugaugcccucuucugguuugucagugacaguguacucauauacauaaaauaaauaaauaaauacuccacacauugauuuuuuuuuaacccacauauaugacuuuaagguacgaaauacaauuaagaagaacaguuaugcuuacaccacaauauucuuguucauugacuaucugagguggauuagccuugggagaggcaaccuuaauacacauuucuuccagcacuuuggugcugacagcuauguucauuaacucauacuuaauuuuguaagugucuacaacucucguagcuucacucugucugugucuuaccuagauagaaaaaagagauggcaaguuauucaauuuaccguaauacuuuuauguauucuauuauuaccuauucauuaaguuaugaaagaggaacagccauuauugguggcaggcauuggugaaaaacuaugcaauuuuguuguuagacuacacauauguauauauuauauguaguuuauauaucauauguauuaugauauaugacacauauauauuaugcaaacguauaauuuaaaaauuuuggaacugaacagaaccacaauuuuuuucaaaaaguuguguggcaaucuaagaaauauauauguuuguacaaucaugcauaaaaaaauuagaaagauggccaaagugaacaauuccaaggcauuagaccuugcuuugaaaagcaaacaaccuguauguauauauauauacaauauauuauauauauguauaugagggaaacaauaauaagacauuaaucagaaauauauauauauauacauauauauauauauauaugagggaaagcaauaauaagacauuaaucauaaaauagaaugaaagauuaaauacuucaugaaauuaagauauaaaaaaugaaugauuaauuuguguugugcucuugaacugucaaauuuguaucuuauauuaacagacuauaucuaguguuuaacugucuuuuaaaacacacaaugguucaaguacaauuguaucagcuugguuuuuaaacuuauuuuauaacugaaaauugaauaacuauaagaaauaauaguaaaauugagguuucuuuguuuucaugugauaaucuugaguaauuuugucaaacaacacuuuugauacuagaaugugauaacaauuugacaagccccauccccaacuuauugaagugggauuucuguaaaaugcaugccaguaagauuuuuguuugauguucaaaagauguaacccaguuauacuucaaaaaugcuugucugcaugcaaaggacagcagagaaauuucuaaaauuccaaaauucaguguuucuaccuucucauuaaguuuuuaaaauugcacaauauguuucaugagacuugagucaucuuugcauaguauuuuucuaaagcuuuccagacaaacccauuaagagaacaguuacauagaucagugauauucaguuugugauucacagacuggcagccucaucaucacucccgccucaauucgacaguaguagaaaugcugaggguaguacccggaaagaucuguucuagcaucccugcccaaugacuauuaugcaacaguuggagugccaaagaucagcaguuuaguguugcauucuuugugguucuuaguugaaaucguuccuuguuuuaggcuguuaugcccaauagcauauaagucacauguuuguuugcugauauuuuaaaacuagagaaauauguuauaauuuacuuucuuuaaaaccacuucuuauuuuuaugcaaaauacuaaucuaauugaccagguuuuauauaaaaacaaucuccuuuuccuaggcugaggucaaaucgcauucuucccuucaucuauagugugugauguguagcaaggaugugaugacugcuuggcagccauuuauuuguugucgugaaaguggaacucugaaguguaaaaauucuaguccuucagucuuugaguacagugcaugauggcuuuuaaagacagcaugauaaaaauauauguaacauaccaacauuuaugauuacauuuuguaaugacacuuugaauacuuuauguuaaauguacacaguaaaauuaaucucacuuuuuucuauuuuaaaugacuaguaauaaauuuuaaauuacucagguagcucucauuaugcuucuauagggcagugcuguucuguaauacuuacuagauauugcucaaaauacuuaaucauuucguguaagaaauaugugaucuaugaaaauauaacaacuuauuagaaauaaaguuggcccuuucaugaauuguuuggucuucucuggggauuugagcuauaugcauacuguguuuguuuguuuguuucucucccauccuaaauggaguucacuauuucuuguacacuugaaauauggacaaaaauauuggauuccuuaagguaguuaaguucaaaauaccagaaacuucuaauaucaguaaauucuuagagcacaagaggaguaagggaguuaacagccauuuugguagguccuugcaaaucccgcuuccacccaagaugauaaaauaaaguagaauaaaaaaauauuuagaaaggcagaaaaggcgugauaaucuuaacaaaaucuugaaguccccaacuaugguauuuuuacucuaacccccuccuguugccuuccuccaacugagacacuuccuacucaucucccuggagacugucaugcuggcauaguaaauuauaauauuacucauuguuuuccgucugcaguugcucuucaaauguauuggguccaacaauuuacugcugucuuccggucagcuuucuuucugguuaccagcuuucugaagucugaacauggagccaagcuaaacuuugcuuucucucugaggguugcuaagggccugcacucaggauuggcuaaggagcaagugcuccuuugugacgcaggcugguguccauucugagaaaaacuggugccuggugaccagagggcaggaagccccacccaccugcccucaaaggaagagagauugugcucccuagaguaauacccacuagcuaacaccucucuuuuuugcccaucugccaaguucuggggucgaaacaggaaaaacuaacacacucuacauuucugcucuuuccccuucuguuuagaaagggaggacagcuacauauuuugcuggccauuccugccuccccuggcacagagagaggaagaaaauccauuaaaaauacaguguggcuugugaagaaaagagacaaauaaacccgaguugccuuaguuuguaaggucaguacaaacagauccaggcaggauaugaccaacauagcaacauuuccccaagucuugacacaggaaaguucucuuuuccucucucccacugggcucccuuguugaaacgugcuuugcagugugcccuuuccuucuugaggucaagcuugcaaugugggcagugugagccucuguagcuccugaugcuuccucuucuccccucacuccgcccucuacucgcuguguaaaaugucugcuucuucuuccuuauauucauaguucacuuuuuaguguacauuuucuagcuacaacuuuuuuaagauuaaaaaaauauuuuaauuaauauaucuguaccugcauaagaugauguauguacuaaucauguuaucugugccugucugaagguaggaguacaggcccaagaggccuggaguuauaggcaaccaguugggagccaccugacauuaacguugggauuugaacucuggucaucuugaagaccaguacacacuguuaaacagggaucuguccagacacaaguauaaguuauugcuauauuuguacauugaggaggaguuugccaaaagugggucuauaauggaaguuaaguucuucuuuauaguauccuaauuauuuucaaugacacaauacuguauguauugcauggcucuacccacuaauaagaauggauuuguggcugaagaugcagcucacuugguagagugcucaccuaguguuuuggaaguccuggauucaugccuagcaccacguauaguagggguagugguacauaacuguaaugccagcacccaaaagaaauggaaucaggaagaucagaagauuuagggcacaugcauagcgaguuacugcuagccugggauacaugaggcaugagucuugaaggagaaauagagggggaggagaaggaggagggagagggggaagggaggggagggaggagaggaaaagagagagagagagagagagagagagagagagagagagagagagagaaagaaagagagagagagagagacugugcaaaugaauuuggugaaauugcagucuuguuuaauguuaaagugaggaugauaguguguggcuucauuguagguugcucauuaaaacaguaugaugaguaauagcuguuagacucugcguauugcuaggaaucacaucauuagguaagacaguauuugucuucauggagcugagaauucauaagauaaaaucaaaccaacuaugugcauucaggcaggaauccuggaaugacagagauuaacaaacuugaggcauguuuaauaaugggaaaauaugugaauaaaguauuuuuuauuucuuguggguuuuuucauugauuauuuuauuuauuuacauuucaaauuuugucucccuucucggucuccucuccauaaaccucccuaucccauccccacucccuuugccucugagaggguacuccuccucucacccauccacucgcuccucuucgcuggggucacaagucucuacaggaccaagggccuucccucccauugaugccauauaauggagucuuaugcuacauauguaacaggagccauggaccuacacauguguacucuuugguuggugguuuagucccugggagcucugagggauccgguuaguugauauuguuguucuuccuaugggguugcaauucccuucagcuccuucaguccuuccccuaacuaacucuuccauugggguccugugucucaguucaaugguugucugugaguaucuguaucuguuuuagucaggcucuggcagagcaucccagaagaaagcuauaucaggcuccugucagcaaguacuucuugguaucagcaauagugucaggguuugguguaggaagauggguuggaucccaagguaguggagucucuggauggccuuuccuucagugucuggugcauuuuuuucccuggguuuccuuuagaaaggaacagagaauaaagcauuuuaaaggagaagagaaagucaagaaugccacauuugagauagcaucaggaaaagccaguaauguguaggcugaaaauguguuuaacaacgauauuuaccugagaugaaaacaguauaagugcguauuuauuggaaugaauaucagggacacaggugaugaguucacugcagagaucacagggcaugggaauauuugugaaucuuauagcagcugagagggaaguucuaggucugaucucaagggguguuaguacaagugcuauuaugagauacagagguggguuuccuacugucucuuuaguaguagauuuuacagaauaaaaucaguuuuugagacuugccauuuugguucaguuaccacaggucgguaaaaguuaggcucuacauguuugcauaaaacaucaugagucacugauacugagcuccagguagauggcagagguauuaaaacaugacugcugacuuuuuugucuuugcuauuaaguaagcugguuauuggagauuuaggagcacauaaaaaauuaaaaaauggaaauugggguaaaugcaugaaaucacauaugguuugauauuggauuuugauuuuuaauacuuccaaggcuuuuuacuauuguaaaaaaugcagguaauuauagcuugaagauuugcugugaugguuaaauaaaaaaacuuacuugugguauuuuauuuugagguacacaauuauauacuguauauauucuuauuaauauauggguaagcagaaggcuuugaagacuuuagguuuguaugaaaggaagaacaacuaguaugacaaacguguauauggaggcaagguuagaaucagcuauuauaauccaaguauggaaagggaaugcuaguuuugaaaggcagacauuuuaaggacaggguguuguugguacaacuuggagcacugaaauguagugaugaaggaaaacuacauggaauauaaccaaugaugaaaucuaagauaggagggauuugaaauuucuauuuucuuuuaauauucuuuugugguaguauugauaaaauauauuuuauagguuuuuuuauuaccuucuagugaaauguugacauauuucuucaauucacuggauacucuuauaauacaauacuucuuuuuuuuuguuuuuuaccuuuuuuuagugcagaauucuuuuuuaauuuuauaacauuuuuauuagauauuuucuuuacauacauuucaaaugcuaucccggaaguccccuauacccuccccucgcccugcuccccuacccacccacucccacuucuuggcccuggcauucuccuguacuggggcauauaaaguuugcaauaccaaggggccucucuucucaguaauggccgacuaggccaucuucugcuacauaugcagcuagagacacgagcucuggggguacugguuaguucauauuguuguuccaccuauaagguugcggacccugucagcuccuuggguacuuucucuagcuccuccauugggggcccuguguuccaucuuauagaugacugugagcauccacuucuguauuugccaggcacuggcauagccucacaagagacagcuauaucaggguccguucagcaaaaucuugcuggcauauacaguacuucuaagaggagaauuauuauuauuauuauuauuauuauuauuauuauuauuacuauuauuacuauuauuguuguuguuguuguuguuuuguuuuucgagacaggguuucucuguaugguccuggcuauccuggaacuuacucuguagaacaggcagaccucgaacucagaaauccaccugccucugccucccaagugcugagauuaaaggcgugugccaccacgcccggcgagaauuauuuuaacugccuagaaggaguccuucauuuugucccgagcuuggggagcuaucuggacaugauggcuugucauaccuuaauaguagugauuuccaacaucuccuuacacuucucugaaauugaacaauccuaacuucuuucugugucugguuuuucucauaaggaaaaacaguaucucuuucuuggaauuuuaggaagaucaaauugcucugugugagauauucugaauaguguuugacacauguaauacacuauacauaauugaugguggaaucaaacuguguauauucucuuacagaauacauacuuuacacauauacauaacauacguugcagugccuaaggacauggacucuuaguccaacugucugcucaaacaucuacuucuauuaguuacuaguauugugacuguaaaaaacauacauuccuuuucuuuuccuuuguuuucucuguaaaaugaauaaucguguguuucuuaaauaaucuacaugacaauuuauaaugcuugucauauagccaaauguguuguugacacaugccuauaaucucagcucuugggaggcagaggcaggaagauugucaugagguuaaggccauucuagucuccauaacauauucuaggucaaccagugcuacauugugagacugaguuguaaacagaaaauaaaauaaaggaauaacaaauucacuaucauaaaaucauuagaaauguuccauuuguucagagaccaucguggaagagggcaugaaaagauuauaaaaucuaaaagucaggaaguagcagaggaaaacaguauccucuggacaggacaugaccacugcacacaugaacucacagcagcugugaguaccuguguaagaccuguacagugucaagcuagucaaguuuugaacguggagggcagaguggcuaauaaccucacaccccauaacugaagaucuauugacagucaguggcuucugagaaggagagaaagguguaauccuugaaagaauuaauaaaauauguuuaaauaaauguuuaauuuaguauuucauuucauaaauguaugaauuaguaaauauuuuuaaaggaagguuuucauauuuccugucaugggcguaucaaaauuuauucaaucaguuucuuuuuugaugcugauuuaguuuguuuaaaauuacuccuuuuuacagaagauguugaggcucuuccaccucuguccuacuuaaaagugaaaauaacccugugucugucucugucucuauguauauuaagaacucuacuacuguuaacauuuucccacccauuuucauugggaacuugaagaaacacuuucaagauccucuuuugguacauggucauuaccguaccucacaugugaccagcccacaucauuuuccuauuagguuugcaguccugggguaauaacggaaagcagaaccaauuuacgugauuaaagcugucauccuuuguaagauguaagcagacgcugagaagcaaaccagacagaaaggucuuucugaguuuggacuguuggcaucucagaggagcaaaucuuuagguauccugaucuuuggaaaacguaagucuaaacucuuaguuuuauuuguguuucauuuucuucucaaauucuuucaaauaauaacauagauagguuucauguaaacauauguaauauauaacauagacuuaugagacgaaaucuuuaucuugaaugagggcaacugaccuuuuucauucuuauagaguugauguuuaauuuugcuauguaagaggcagguuuugccaguuagcccaggcugaccuugaauuuaagauacuuuugccucagccugcugaguucugggauugcaggugugaagcauuaugccugacuuuuuacauagauuuuacagugaaauuagaaacucuuaggcuuguauuaauaaaugauguaaaagcaugaaauagcaaauaaggaagggagcuuuguguccaaaagaagaaaaaggaaaaaauuaaaaauaauggagaaggaaaaagcagagaccuacauuauaggaaaaauauagauagcuaugauuauaguuuaguucagaaauuuuccauagguauaaguuuuauuuuaagugcccuuuuagacaguaaaaggcaaggcauuuuuauuaauuucuaaauaaauacuaaaaaaacccagcucaauauaauguuaaacaucucucugauuuugcaguuuuuaaacauuugcauggaugcuaugcaauauucucacaauaguucaaugaaaauggaagggguauuauuauaauuuaacuguugagaaaauugagagccagaaauaaguaaauucuucaggguuaaacagugauaaaaaggaaucaaagaauuucuaguuuuauccuuugccucuuaagcaacaguucuucccuagaacaugguucaugucagagaaaaaaauauuacauugcuuaauuaguuauuuuauauuuuaggaguacaguucacucauauuuuauaacuugucuaagaaaaugcuuggagaagccuuccuaacuaaauuccucuacaaagaacagagacaugcaaaacuuuacaaaccacuaagauguaagaagacaucaaaugacaaaaaggaaaauugggaaaauaagcuuuuagauacaccggacaauucacuuuccccuuuaaagacuggaagccaagagaaaguuauagaaggaaguguaacugaacaagacaaugauucaucucaaaucaaaucuauggaugagcuaccuguugcaaaaugcaaauguacaccucuuccaggaaauguaucuguugcauugcccauuccaaagaggggacaggaggaaacacaacuggauuuauaucgaucuuggucauguacaaguauuugccagaauuauccugaccuacagauaggaggugaccacauuagaaacauguaugauucugguugcuuuguggaacacacauaugaugauguuuguaaugguccucuuuuacuuucaguggauauaccauugggccacucuccuaaaauggagccucuagagaaaacgucuaccucaaaauuauucaauggugaugaaauucgagaaaaaagcaugcuauuacauaagcaaccccucucuaauucuaugcuuaauaauuauauugaaagaaagguggaugaacucuacaaacaguuuuuggaagaaaaucuuaccaggugccucucuauaaccaaccucaugacuucuagcauacugaugaauaaugucaaucaaauuagccuucaaaucucucaggagcagaacauagaggcauccaaagcccgagaagcccuucuccacucuuuagcacuaugcaaucuucguaauguuucccacagaaacaguacugaauuaaguacuccuaacuuacaaauaucaaaccaagcuagucgggaauuuguaugacaucuauaaugguaaucaccuaaagacugucuaugucaaauaagaaacuacaguaacaauugcguucucgugcuuuuuaggucucauaaaguuuccuuuguggugguguuaauuuugugaaauuauuuugguucaucugaauucuuguaggauauaaguacaauaaauaugauuaaugaccauuuauguuuuauuucuguuuugacaccuuuaguaguuuucacauaugcucugucuguacauauugucacuaagauuuguuaaccacaaaagcaguacaaggaaggaacuguauuaaaacaauuuuagaggcauaugaucgguguuugaauaaccuuccucuuauuuaugguacacaaaaccauuuacacugacaaauagaauacccugggagaauuuguuuugcauguguauauucuauuuuuguguguagauucgaagagccuauagcaaaauaauacaauuuaucugacauuuguaagagacguugguggaaagauuaaggaaaauggagaauuuaguugguuccauuugaauuaaacuucauuuuauuuuaaacucuacuggcacaaggauuaacacuuuuauauuacuguguuauuccuuguuguuuuuaaaucugagaggaaggaaggugcacagguugaguacugaaguauauagcaaacugucaacuacuucugagauucucuuggcaauguuuuacacuauucagauucucuacaaucaagaucuugacauaagauaaaagaaaauguguaaaauuugaaacugaaacuaaauuaacuaauucuccuuuuaaaauguuauauucuauugccaaauuggaaacaaaaucucauggcuaacagcucacauuucuccuaugaauagugaaaugaucauuacacauuauugcuuguaaauagauugcuaugggcuucuguuauaaacuuccuuuuaauguguaauauguuaauaacuuuauguauuaauaaucuccucaaauaagugcuuuguuccuuauuaaauucuacagaaugaaccagcucaaugucuucauagcuagugauuuuuaaaucaaauauuuucauccaguccuguagcuugaacuccuuagaauaccuugcuuuucucuccuucacuacuagucaucaucugccauauuuguccaaucaauuucaaucauucagauauuugauucugaaaagacaaugggcaacaauuuuggaaaacugaguuacuguuauguauagacugaaaauacuguguauauuggcuauuguuuugucugauuuuaauauuucaaugcagauuauucacacgaaauauauuugauuuaaguuuguacuuuuaaaaauugaaugaaauauauguagacagcauucuuguggguaauuuucuuaggcacaguaauguguauuaauauuuauuuauguugcaaauauacccaaaguguugagauuauauaguacuauauaaaacuauaauguuuagcuaauaucauauuuuugcuaaugucaaauuuaauacugcauuuauagcuucagauuaaaaaauuccacuuuccuaugcuuacuuucccauuucaucaaaauaccuauuauaugcugauagucacaugauuaacauggccuaaaauuaauacaauaaauaaagaugcuauaauuugugugaugcuuuauugugaccucauaccggcuuacuucuguauuugaauaaaauauucauauauaaaugu

SEQ ID NO: 9705 - RNA, 1821 nt, Mus musculus
cauguccacgaaagagaaugcuaacuuaccagcugccugacuuaacagauucaagaacaaggggaaggacaguacagaaaugugucgcuguggaauagaaguuaauguggaacccaggaaagcuaaaaaugaugagcagaugcugaaaaggagaaauuucagcuccuuuccugaugaugauacuuuucugcuacaggaaaaccagaacaaccaggguacuguaaauuggucuguugaggacacuguuaaaggcauaaacaguaacaauuuggaaagccagcuccaaacuacucaagcugcucagaaauugcuuucuagagagaaacagccuccuauagacaacaucauccgggcugguuugaucccaauauuuauguccuucuugggcaaaacugguuguaguccuauuaaguuugagucugcuugggcacucaccaacauugcuucuggaacaucugaacagaccaaugccgugguggauggagguccuaugccagcauuuauuucucucuuggcaucucuucaugcucacaucagcgagcaagcuguuugggcucuuggaaccauugcagguaauauuucagcuuuccaaaacuuaguuaucaaacauggugcgauugacccauuguugacauuucuugcaguuccugaucugccauccuugacaugugguuacuuacauaaucuuaccuggacacuuucaaaccuuugucaaaacaagaacccugcauuuuccuuagaggcuguugagcagauucuuccuacuuuaguucgacuccugcaccacaaugauccagaaguacuagcagauuccugcugggccauuuccuaccugacugaugguccaaaugagcucauugagaugguugugaagaaaggaguuguuccccaacuugugaagcuucuaggagcuacugaacugcccacugugacucccacacuaagaagagccauagguuauauugucacuggaacagaugaacagacucagaaagugauagaugcaggagcacuugcaguccccaaaacaaacauucagaaggaggccacauggacaaugucgaacauuacagcuggacgccaggaccagauacagcaaguugugaaucacagccuagucccccuucuuauugguguccucucuaaggccgacuuuaagacacagaaggaggccgcgugagcuauaaccaacucuaccagcgguaggacuguugagcagauuguguaucuuguucauugugggauaauagaaccuuugaugaacuucuugagugcaaaagauaccaagauuauuuagguuauucuugaugccauuucaaauaucuuucaggcugcagagaaacuaggugagacagaaaagcucagaauaaugauugaagaguguagaggcuuggauaaaauugaagcacuaccgagccaugaaaaugagucuguauauagggcuucauugaacuuaauugagaaguacuucucaguggaggaagaucaaacuguggugccagaaacucccucugaaggcuucguucaggauggagcucccgggacauuuaacuucuaauguccagccaaggcacaaaguuguuagcuaugugcugugcuauucuguguucucauagauuugucuuacucucucuacuaagcacucuuuuuaaauguuguuuguuauuguagcacuuuuuacaaaagaaacgauacuugaacaguuauaaacuguacauacucuaugaagcuguccuccgaauuuauuucuauguggaauuucguacccugucauguccuguaaauaaagauuaaaguuccauucuuucaaaaaaaaaauag

SEQ ID NO: 9706 - RNA, 931 nt, Mus musculus
aaaguaaagcaccucuuuuuauuaugaccauuauauguugaaauuacauugcauaucucuugguccacucucgagccagucuauuguacucucuuaaauccuugcgguagaccuuugcaauuucagggaccagagggucaucuggguuuggaucacauaauagagagcagauagagagaagaaguuuggaaauugugagugcaggugaccacauagaauucaagauaucuagacagauacuuccauuuuugcuaauguuuggaugguaaacucggguuaugaacguaacuuuggggggcuugaagggguaauuguucggaaaguggacggacaggaaaaaaaccccucccugguaggggcugucuucaggccccauuaugguugcuugccaaugaaacauauuuucugccacuggcccugcagaacagugagccgggggaucuugagagauggcaacuaacuccuucuggauucgcuuaagagccauagcccccaaaguagauugauccaucuucaccgaguauggcagcugguagauggaucuguugcgccuaggguauagagauaagauaaagacagaugauuaugcugaaggagacaaagucauguuauuaaagcacaauucggagauggauggaggagagagagagagacagagagagaggagagagagagagagagggagagagaaagagagacagagacagagagacagagagagagcgagagagcuguaccaguagagcuacaaggacucccuccugucgcuuccggccaagagcuaaagaauccgcuuagguugcuggaaugcugugaugccuggaggacaaacaauugcuuggaaacaccucugucuggacaggcugauaucucuagcucucagacagcuugccacuagcagugcuucaguacagugccccuucagugaaua

SEQ ID NO: 9707 - RNA, 501 nt, Mus musculus
auagauuuuaguuuuuuuuuuuuucccaaaaggagcucuggcaaaguuuuauuaaaggaaaacuuucuuguuuacuucucaccagucuguucuggcaugcuucuaauaauaucagaaucaccugggucaaugauagccagagugcauacucuguaguauuuuccacacgcugugcccaguucaauauuauugccacuguagugauggaccccaguuuuagccaacauggcauaguauucuauuucagauuuccucaaagcuggacaguuguuggcaaggauaaccaacuucgcuuugccuugucugaucaucuucagagucuguuuguagcccagcacguacuucccacuuuucauaaaaaguuggagccuagaguugaucgacuccagagacuuuuucgucuucuuugcggccaccaucuuccugccuuaggugcgggacaacccccaaccaacaccagccgccaagauggccggggagcgagaaagguagauuuuaguu

SEQ ID NO: 9708 - RNA, 501 nt, Mus musculus
aacuaaaaucuaccuuucucgcuccccggccaucuuggcggcugguguugguuggggguugucccgcaccuaaggcaggaagaugguggccgcaaagaagacgaaaaagucucuggagucgaucaacucuaggcuccaacuuuuuaugaaaagugggaaguacgugcugggcuacaaacagacucugaagaugaucagacaaggcaaagcgaaguugguuauccuugccaacaacuguccagcuuugaggaaaucugaaauagaauacuaugccauguuggcuaaaacugggguccaucacuacaguggcaauaauauugaacugggcacagcguguggaaaauacuacagaguaugcacucuggcuaucauugacccaggugauucugauauuauuagaagcaugccagaacagacuggugagaaguaaacaagaaaguuuuccuuuaauaaaacuuugccagagcuccuuuugggaaaaaaaaaaaaacuaaaaucuau

SEQ ID NO: 9709 - RNA, 1203 nt, Mus musculus
ggggggugcagcggaacuuuauugaugguauucaagagaguagggagggcucccuaggccccuccuguuauuauggggaucugggauggaaauugugagggagauguucaguguugggggcugaguugggacagggacuccucagcaaccgagggccucucucuugcucucaguguccuugcuggggugggugguccaggguuucuuacuccuuggaggacauguaggccaugagguccaccacccuguugcuguagccauauucauugucauaccaggaaaugagcuugacaaaguugucauugagagcaaugccaacccuggcaucgaagguggaagagugggaguugcuguugaagucgcaggagacaaccugguccucaguguagcccaggaugcccuucagugggcccuuagaugccugcuuuaccacauucuugaugucaucauacuuggcagguuucuccaggcggcaagucagauccaugauggacacauuggggguaggaacacagaaggccaugccagugagcuucccguucagcucugggaugaccuugcccacagccuuggcagcaccaguggaugcagggaugauguucugggcagccccaugaccaucacgccacagcuuuccagaggggccauccacagacuucuggguggcagugaaggcauggaccguggucaugagcccuuucacaaugccaaaguugucauggaugaccuuggccaggggaguuaagcaguugguggugcaggaugcauugcugacaaucuugagugaguugucauauuucucacacccaucacaaacaugggggcauuggcagaagggguggagauaaugacccuuuuggcuccacccuucaagugugccccggccuucuccaugguagugaagacaccaguagacuccacgauauacucagcacuggcaucaccccauuugauauuagcggggucucgcuccuggaagauggugaugggcuucccguugaugacaagcuucccauucucggccuugacugugccauugaauuugccguggguggagucauacuggaacauguagaccauguaguugaggucaaugaaggggucguugauggcaacaaucuccacuuugccaugcggagagcaggcagcagcucuggugaccaggcgcccaauauggccaaauccauucacaccgaccuucac

SEQ ID NO: 9710 - RNA, 498 nt, Mus musculus
ccaaagaguguggcuagcaagaugaacaaagaugcacagaugagagcagcaauuaaccaaaaguuaauagaaacuggagaaaaagaacgccucaaagaguugcugagagcuaaauuaauugagugcagcuggaaggaucagcuaaaggaacaugguaaagagguaauuaaagaaaaaggacuagaacauguuacuguugaugacuugguggcugaaaucacuucaaaaggcagagcccugguaccugacaguguaaagaaggaacuccuacaaagaauaagaacauuccuugcucagcaugccagccuuuaagggugaauuagaauguguuggucuguggauucauuucugaaacuaaaacuugccauaguuagaaauugauuugcccaaauaaaguccuucuuuauaugaugguauacaguuuucaguaauguauacauuguauugauuuuuuccuuaaauguaugauuuuaauaaauaucucaugaauaaguuucu

SEQ ID NO: 9711 - RNA, 1291 nt, Mus musculus
cuuuuuugggggggugcagugaacuuuauugaugguauucaagagaguagggaggacucccuaggccccuccuguuauuaugggggucugggauggaaauugugagggagaugcucaguguugggggccgaguugggauagggacuccucagcaaccaagggccucucucuugaucaguguccuugcuggggugggugguccaggguuucuuacuccuuggaggccauguaggccaugagguccaccacccuguugauguagccguauucauugucauaccaggaaaugagcuugacaaaguugucauugagagcaaugccagccccugcaucaaagguggaagagugggaguugcuguugaagucacaggagacaaccugguccucaguguagcccaagaugcccuucagugggcccucagauaccugcuucaccaccuucuugaugucaccauacuuggcagguuucuccaggcggcacgucagauccacgacagacacauuggggguaggaacacagaaggccaugccagugagcuucccguucagcucugggaugaccuugcccacagccuuggcaguaccaguggaugcagggaugauguucugggcagccccacgaccaucaugccacagcuuuccagaggggccauccaaagucuucuggguggcagugauggcauggaccauggucaugagcccuuccacaaugccaaaguugucauggaugaccuuggccaggguggcuaagcaguugguggugcaggaugcauugcugaaaaucuuaagugaguugucauauuucucgugguucacacccaucacaaacaugggggcaucggcagaagaggcagagaugaugacccuuuuggcuccacucuucaagugggccccagccuucuccaugguggugaagacaccaguagacuccaccacauacucagcaccgucaucaccccauuugauguuggcggggucucgcuccuggaagauggugaugggcuucccauugaugacaagccucccauucucggccuugacugugccguugaauuugccguggguggagucauacuggaacauguagaccauguaguugaggucaaugaaggggucauugauggcaacaaucuccacuuugccauguggagagcagauggcagcccuggugaccaggugaccaauacggccaaauccguucacaccgaccuucaccauuuugucuacaggaugaggcuggcacugcacaagaagaugcggcugucucuggaacagagaagagcagagagcc

SEQ ID NO: 9712 - RNA, 2864 nt, Mus musculus
guuuuuuuuuuuuuuuuguuuuuuguuuuuuuuuuuuguuuuuguuuuuuuuuucccggccagaauuuuauuuuauugcaauauguuaacaaucuaacaaggaaaaaauaccccacacaaaacaaaacacaacccuuaggacugugcuguccagucugccuguaguaaaugguucaguuuccaugagacacaccugcacacuuugguaaaguuacaaaagaaacaaaaccuaccaaggaaaacaucuuccucaguacaggcuguaacuacaaaagaaauucaucgaggaaacccauuuaucucgcuuuaaaaaauaaaaauaaaaaaagcccauaauacagaaacccucagaauucuuuugcugaguuaaaaaugagauggaacugauaacacaucucugccuuccaugacacccagucagugcacucucugaaaaccaggcuuccacgguggacauccagugcucaguggugaggagugaagaaguggccagcccaagccacaugcagcuucagcccugcugcuccccuggccugaggccacagccaacucccucugcaaucgugucagcgaauggcgcgggccagggcaucuaugaaggucugaggggcagcugcaggggccaccccuggaaugaagcacacagauagcugccaggaagacaugucugggcuuuucaaagauggguguagaugguuucuagggagcugguguggggagaacuccuaccagcaugacaugaggccugguaugaaacucaacgguuucuaaacccaucucaaaaaaaaacaaaaacaaaaacaaaaacaaaaacauuuuuuuccuucucuuggacaauaaaucacaggcuuuguuauagaaaggggguggagggaugaaaaacagaaguccaacugguagccagaacaugggauuccuauagaugccugguuaacuggugaccagaucagaagaguugccacaggcagacgugaaggauaacaccuucaagcuaaacacacuaugaaguuggaaccaugagcccucugccugggucuuggcaucaccggccgcugccauagccagggaagagcugguugagaauggucugcaagggcugguucacccggguuggggagcugugguccagcucauagccacaggcugggcagcugaacaccugggcccguaaggaccuguccagacaguccuuacagacguugugcugacacacggugguuacuggccggaacaccagcuccuggcagcagaugcacuggaaagccucuuucaccuugcucaggaagaucugguacggcccauccugaagugaaguuagcacaucaucccacagcuuggcguugcccuuguccucuuugaugagguuagccugcugcucugagaguguguauggcuccagcuugcuauucuuagaggcacgggggcuggagaggguuggcccuguggauuucuguuugcuuuugccugucuuggaagaugagggucccugcuccaaggccuuggccgggcgcuuccugcucuucuccuuguuagccaaggccuccaaguagccuucaggguacugcauagugagccccagcugucgagugcgguccuugcccuuucggguccagggcucaggcucugugucaucucgucgaaggagauaaugccacaugaggaagccagauuucccucucucuggccaguacuucaccaccuuguagaugccaucauagcgguugcccucugcgggagcguacuugcuguguuucccgcccuucauguuccggaccacacacacuggcuucccuuggcgccagucuucagccuccgcaccuuucucauugauuggggaguggcaauugagugccagagcccuauuguuauuagugagcuucuggucagaggacuggccugcuguacgcuuguugccagagaggucucggccaccacucccuguguaugugaaguaauugccauuguccacaucauucucauagccaccagccaggaccaaugaguaggcaccgucguugcuccggccauggaugccugccacaugaggccgaugcacaccggacucacugaccuggacucugaagugccacauggugcccacagggacaccagggaugggcccaaagugguuggcgggcacaaugguacacucuguggugcggcccacacaugccaugcccuuaccccagucccgcugggaggaggaaguggcugaugccaucuuugccuucuucuuguucuccuucagcuccccugcuuguaccaccucacuugagucagugcggcagcuggggcaguaccacuccggcucaggggggacagaggugagcgguggcuucaggcaguacagguggaaggccaugucacagucaucacacaacagcuguuucucaggagccucgcgcccaccacacacguggcaggcacacuuucgacaugguuuguuuucaucauccuugcagaaccggcaggaugggccacucuucccuguguuccggagggcaggaggggguugcgaggggcuagcgaucaaaggccuccucucauuagggagcucaaucaucaagacuucauccacaaacaugauccgacaguuguugagcugagagucauucaagagccugauguugcugucauaccugguuuguaauagaaagauuuauguguuuguagcucaaucuuguucuggacaauagaaauaacuuuuuuuuaaauucucauuuuuuccaggauaacaauuguucaacuaaaauuaauuacccauaaaauuaugagccuccaucuaauuugaaagauuuacuuaacuaaaaaagacaaaccuaugaaccuuuccaagauauuuauuuuugcaaugcugguucaug

SEQ ID NO: 9713 - RNA, 2206 nt, Mus musculus
gaaagacuuuaauaacucacuuaaagaaauacaggagaacgcugcuaaagaauuacaaguccuuaaagaaaaacaggaaaacacaaccaaacagguagaaguccuuaaagaaaaaaaagaaaacacauccaaacaggugauggaaaugaacaaaaccauacuagaccuaaaaagggaaguagacacaaugaagaaaacgcaaagugaagcaacucuggagauagaaacccuaggaaagaaaucuggaaccauagaugcaagcaucagcaacagaauacaagagauggaagagagaaucucaggugcagaagguucaauagagaacaucggcacaacaaucaaagaaaauacaaaaugcaaaaggauccuaacucaaaacguccaggaaauacaggacacaaugagaagaccaaaccaacggauaauaggaguugaugagaaugaaauuuucaacuuaaagggccagcaaauaucuucaacaaaauaauagaagaaaacuucccaaacauaaagaaagagaugcacaugaucauacaagaagccuacagaacuccaaauagacuggaccagaaaaggaauuccucccaacacauaauaaucagaacaacaaaugcacuaaauaaagauagaauauuaaaagcaguaagggagaaaggucaaguaaaauauaaaggcaggccuaucagaauuacaccagacuuuucaccagagacuaugaaagccagaagaggcuggacagauguuauacagacacuaagagaacacaaaugccagcccaggcuacuauacccgccagaagagccuggacagauguuauacagacacuaagagaacacaaaugccagcccaggcuacuauacccgaccaaacucucaauuaccauagauggagaaaccaaaguauuccacgacaaaaccaaauucacacaauaucuuuccacgaauccagcgcuucaaaggauaauaacagaauaguagcucagacauagaaauacugcaggguguggagaacaucauaaaacggagucauacuuuuucgaugaagaagcccaaaaccaucgccagggaacaaagaaaguucagagcuccugaccugcaaggcaugcugcaagugcugcaagaggucgcagaggcucaacgcuacuggguucaggugacccugguucaaaacaaccauccaaacauugccauuacugacgacaaaagacaaguacgauaugaagaccaccaagcaaguaaucuuauacccgggugugaaaacucucaugaaggcguccugggacauccagcuauccaaucuggaaaacauuacugggaaguagaugugucuagaaaaggugcuuggguucugggguuaagugauggaagcuaccucuucuguccaauauuucauucaaaugcugaaagaaaucguuuauuuuguagggggauuaagaaugauucacauuaucaaccaaaauauggcuucuggguuauagggcuguggaaaaagucugaguauaaugcuuuugaggaguguccuuucacaggcaagcccagugucuugucccugucucugauggucccgcccugucguguugguguuuuccuugacuaugcagcuggcacucucucauuuuacaauauuuccaacaaugggacucuuaucuacagauucuguacagcuuccuuuccugauaggguuuuuccauauuuuaaucccacgggaaguucagagccgaugacaauuugcuggccagacucuuaacauuugccuguuuacuugcaaggucucuggcucugauauguauaucauaugccugagcucaucauaccauuuucucucucuuuuuuuuccugacucuagucuuucugugugaaugucuuucauugguaaaaaaggauauauucauuucucuaggucagauucuucucaguuucuuucaguuuuguuuuguuuuagaugagaauaauaaaucacuucccauuuagucaaggaaaagugccugagugcucacuguguaagauaacacugcugcaaaguucucuuauucuucgcgccagagguggaagccaaggccuugugcauggugaggaggugcuccaccacugagcuaauuaccucagcucugucaggucucuauaacuucauccugcccaucaaugaaagaagauuaaagaaaguucuucaacaacuuguccauucauucugaaaauuauagauagga

SEQ ID NO: 9714 - RNA, 1594 nt, Mus musculus
aggaaucgggccccuuccccuccuucauaacugcgugaccaguuuggacaacauguaaaaucagaagugcacuugaacuuuuauguuuauuaugguccugaucguauuagagauucagccuggcuuucaaaacaggauauuauuuugacuacuuacaauauuuuaacucaugauuaaggaacuaaagaugauaguccauugcauagcaucaagugguucagggugauccuggaugaagaccaugcuauuugaaauucaaacgcucagcagacaaaagcuguacuugaguuagaggcagaaagaagauggguauugacagguacuccgauccagaauucuuuaaaggacuuguggucucuucugucguucuuaaaacuuaagccauuuauugauagagaguggugguauaggaucauacagcauccugucacuacaggagaugagggcggacuuaggcguuuacaguccuuaauaaaaaauaucacgcuuagaagaacaaagacaagcaaaauuaaagggaaaccuguuuuggaguugccagaaaggaaaguauuuauuccgcacauuacucugucagaagaagagagaaagauuuaucagucuguuaaaaaugaagguaaagcugcuauuggaggguauuuuacugaagggacuguccuugcacacuaugcagaugucuugggucuucugcuuagauugcggcagauuuguugccauaccuaucuucuuacaaacggaaugucuucaaguggccccuccagaagugacaugccugaagagcugagaaagauguuaauagagaagaugaagauaauucugagcucugguucagaugaggaaugugcaaucugccuggauuccuuaacauuuccugugauaacccauugugcacacaugcucuguaaaccuuguaucugucaggucauccagagugagcagcuaccugcagaguguccuuugugcagaaaugagauauauggagauaaucuauuaaaauguccuccagaagaauuggcaugugacagugacaaagaguccaguauggaauggacauccagcucaaagauuaaugcucuaaugcaugcuuugauugaauuauggacaaaggaacccaacauaaaaaguuuaguuguuucucaguuuaccacauacuugucuuuaauagaaacgccucuuaaagccucaggauuuguauuuacuccuuuagaugguuccauggcucaaaagaaaagaguugaaucaauucagcguuuucaaaacacagaagcaggaucuaccauuauaaugcuacuguccuuaaaagcagguggaguuugcuugaaucucugugcagcuucgugaauguucuuaauggauccggccuggaauccugcugcagaagaucagugcuuugaccggugccaucgacuucuccagaagcaagagaugaucaucacaaaauuaauugugaaggacucuguggaagaaaauauguugaaaauacagaacacgaagugagaccuugcagcuggagccuuuggcaccaagaaaacagacgccaaugaaaugaaacaagugaaaaucaacgaaaucagaacuuuaauagacuuauaau

SEQ ID NO: 9715 - RNA, 2889 nt, Mus musculus
ggaacgaauuuaaccagagggcugucaacaagggaggggcugcccauccuaacccaggagacgguucugaguccgguacugcgucacuggacugcagcaggucucggcgcagguccauugcggccugacaagccucguagcuaaggcuccaggcugcuuccccugcugcgguuuccugcgcgccaccucugugaccccgcccccaucgcgccacugccacagcugcugcaguccguguugccacuggaucccggccgccgccgcugcagucuccgccgccugaccuucuccggccuucgccccugcugccaccgccccccaccgccgccgccacuggagcauccgugaguccuuuucuguccgucucugggugcacgaucucugcuguugucaccaccuuaaauagguguacggggcuaacaguauggcagaagcggauccuaaaauggucacagaaccuggugcccaugggguugcugaagaggcgauggcuagcacagcuugugauucuggggaugaaucugacagcaauagcucuagcaguaccaauaguugcagcagcagcggcagcagcagcagcggcagcagcaguagcagcagcagcaguagcagcagcagcagcagcagcagcaguagcaguagcgguagcaguggcagcagcagcaauggcagucauuugaaccgaaagaagaggguaccugagccuuccagaagggcccagcgacgucccuccgggaaacuuuucuuggauaagcugccccaagccguaagaaaucgggugcaggcacucagaaauauucagaaugagugugacaagguagacaccuuguucuuaagggcaauucaugaucuugaaagaaaguaugcugaacucaauaagccucuauaugauaagcguuuucagaucauaaaugcagaauaugagccuacagaggaagaaugugaauggaauucagaagaagaguucaguggugaugaagaaaugcaggaugacacaccuaaugaaaugccacccuuagagggugaggaggaagaagaaagcuguaaugaaaaagcugaagugaaggaagaaggaacacauguuccagaagaaguuccugaggcaaaaguugaagaagaggaggcucccaaagaaacuccugaggugaaaacugaagaaaaagacauuccaaaagaaggugcugaagaaaaagcugaagaacaggaauccucuaaagaaauuccugagguaaaaggugaagaaaaagcagacucuacggauuguauagauauagcuccugaagaaaaagaagacgucaaagaaguuacccaggcaaauacagaaaauaaggaucaaccuacagaagaauuuacaccaagggcuccagcaagagaggcucaaaaaagggucccugagacaaggccugaagaaggagucaauauuaaaagggcucgaaagggaaaaccuaagaaagaagauccuaaagguauuccugacuacuggcugacuguuuuaaagaauguugauaagcuugggccuaugauucaaaagugugaugaacccauuuugaaguucuuaucugaugugagccugaaguucucaaacccuggccagccuauugguuacacuuuugaauuucauuuccuaccuaacccauacuucagaaaugagcuccugaugaagacauacauaauaaggucaaaaccagaucacuacgacccguucuucgcguggggaugggaaauugaagaguguaaaggcugcaaaauagacuggagacgaggaaaagauguuacggugacaaccacccggagucgcccugguauuacaggggaaauugaaguccagccaagagugguuccuaaugcauccuucuucaauuucuucaguccuccugagauuccuuugauugggaagcuggaaccaagagaagaugcuauccuugaugaggacuuugagauuggucaaauuuugcaugauaaugucaucuugaagucaaucuauuacuucacaggagaaaucaaugaucccuacuaccaugacuucagggauuauggaaauaggaaguacuacaaguagaaagggcaagcugaaaaaucuuucaagaauccuuaaaaguuaagcaagcagaagugaaauaagagucaucuaaacuucuaaaauagaaaacuugccccauaaccugaacaguauuacuccuuauagucugguguuuucauuuuuuccugguaauguccuaaaaagugucuuaagcuucuguuuauucuaucuugccuguuguauuguaauauucuucaaaauauguaaacugcuguuaauuuccaaagcauguuuuguuuggugcuacaguguugguuuugugaagucaguuuuugucauguugcuauuagauuguaccugugaaaauugucagauuuauuagagaaauccuugccugaauaagcaacauuuuaaaugccaauauacguguguuuucucuuucuuuuuuuacagcccagaagacuaaagacuuaaaucugcuugcacuagaugugccuucauuacuuugccauagaaauguaguaauaauaacaacugaaacacucuauugugaaauguaguugcuugaaaaaaaaagaugagaauauauuuaaaaaugucaggaucaaguagauuuuuguggguuuguuuaugugauuuauuggucuguuagcaaaaguauuguuuaccacuaagguguuaaauaugguauaguauuuuaaaauuuuucuuuguuguauauuguguaauugaaaacuaaagaaaccguauuuucuuuguaauguguucuacauugccuuuuaaaaauuauuucaucauuugauacauuaucauguucuuuuauuguaccuggaguaaauaucaaauaaacugccaugcuauaaagacuu

SEQ ID NO: 9716 - RNA, 497 nt, Mus musculus
cuuuuuuuuuuuaaugagccaaaauuuauuuauuucuugcacuugaaguauuccucgaugacauccuuggccugagauucuuugccauaguccuuaaccacuacacaacugcaaccaaccaccuuccgugguuugcccucacgaucgauuuuacagaggccuacccauuccccuaauuucuuguuguaucaaccuuuaucagguugauuugaugcucagcacaaagugccuccaccagcuugacauacaagcucgcauacaucacaguuggaugcgagcacacacagaugggcuugacgcuugucuaaggcuuuggcagcuucgcguaugccacaugcuaggccaucguggaugagggcggucuucagcaccucuuguagagcagucuugacguccaucacaccuccagcugcugugccuuccucggccauggcggugaaucacgggugaugccgaaucuugaacuuacccgagcuuccgccucugcgcaaguugga

SEQ ID NO: 9717 - RNA, 509 nt, Mus musculus
cuuuuuuuuuuuuaaugagccaaaauuuauuuauuucuugcacuugaaguauuccucgaugacauccuuggccugagauucuuugccauaguccuuaaccacuacacaacugcaaccaaccaccuuccgugguuugcccucacgaucgauuuuacagaggccuacccauuccccuaauuucuuguuguaucaaccuuuaucagguugauuugaugcucagcacaaagugccuccaccagcuugacauacaagcucgcauacaucacaguuggaugcgagcacacacagaugggcuugacgcuugucuaaggcuuuggcagcuucgcguaugccacaugcuaggccaucguggaugagggcggucuucagcaccucuuguagagcagucuugacguccauuacaccuccagcugcugugccuuccucggccauggcggugaaucacgggugaugccgaaucuugaacuuacccgagcuuccgccucugcgcaaguuggaggaggcaggga

SEQ ID NO: 9718 - RNA, 1720 nt, Mus musculus
auuuaaugcagaucuaagcuuuauugaauuaauaggcauuauacagagaaugcaagucauuauugguccagcgcaaauacagguguuuauuccgaggugaaaugacagcacaaauugacagcuuuacugcuacuggaacuauuuauuaaagaaauaguugcuugcuauggacaaaaucucccucaauacccauucaauacagucuuugcuuuuaccucucacuucagcugagggauucacaauaucuaaaggaagcuuguaaagaacccuucuguaucagagguaguuuugugccuacauuaugcaugauagaagacauuugaacaaaggcuucauaaaaaagggcagaagagacacacuagagcagaguugagauccgugaauuguuucagcuaauugguuacaguggugaaaauaucaaccaaaauuuagaauagccauuuugucuauuuaguaacaaagcaugcaguagccugugcagacaauagcuuuuaauaacaaccuuaaaucuggcuugagcaccaaggaugcauuuuaaaaaguauaaaguacauuuauaugcaaugacuacuguaguggcugaauuaugcuccucccucccaaaaagacauguucauuugugugcuaauccucagaaucugugauauuaccuuauucuguucagcagguaugugaaguuguaauuaaauuuaggcucugaaaaucaggauguuauaauagauaauccggacgggucaucaaaauuaucuucauaagagagaaguagagguagauuauauauacagaggggaagcugucaaaacaacagaguaguaagaugaagccacaauccaaggaauaaugacaaucacaugagaagaugcaaggaguggauuuuucucuagaguuugcagaggagugcucucuugccaauaucaugguuuuggaguuguggcuauaaaaacaccacagaaccagaaaucuacuauuuuaucccucugugucugugggaauauguuacaguaaccauaggaaugugauauaaauuuuaguaugaggugggguacugcuaugacaaauaccuacagaugugaaaguggcuuuggaauuugaugcuggguagaggaugguacaauuguugauaguaaacuuaauagagacacuauagauugccugagccaaaccccugauggaaauguggauguuaaaggcauuucuggugagggcacaagaggaaaugaauacuguagugggaacugcaagaaagauuguuguuauauagcagcaaaaccaaaccaaacaacuuaucugaauugucuccuacaguuuuauggaaagcuaaucuugaccuuguaagggacaaaguugaggaacuuggcaggcccuguuguagguauagcucguucauuuuugcuggggaaaagaagucuuaggagaauggggaggagaagagacgauacuagaacauaugagacaugccagugaaaugggauauacuagggggaccauagcaguggguagugguagaggcgagggcacauaagguggggagaaggaccaucaucaucaucaccaucaccaucaccaucaucaucaucaucaaugacaacaacaaggcaugaaaaaugccacaaugaaacucauuauuuuuguacuaaguuuuuuaaaagagcccgauaggaggaagugaagaaagaaccauuauaucaagaaggaauuagcacuugauuugguaaauuuu

SEQ ID NO: 9719 - RNA, 7364 nt, Mus musculus
cgucuccuguuuccgguucuucucaguugcagauacucgugaguuuucggcaguuuccguggaaacucggaaacucucgcgccuggcaagcucgagccgaucgcccggugcauaggcgcagggucuccggguagucauggcguccccaucucggaggcugcagacuaagccggucauuacuuguuugaaaagcguucucuugaucuacacuuucaucuuuugggugagacacgggaacggcuggggaacucucgcuuagguggugggugugacugggagcagagaaccucgggucuggagugggaugagcuuugggcggcagugguuccagagaccccagccuuggccacgaguuggccuaggccacaguggcgggguccccgagaugggagcuggggugggcggcacugcguuggcguuggggucuugaugugagaugacugguugaaguaggacccagaugucucaggagaucgaggucggagcgggagaugaagaaagggguuaaggccccuagagcacacgaggugucccugaaccuuuccuuugaggggucuuuugcauaauaauaucucucuuuucacugcuucauaagaggggaguuuuucacagguaaguauggugugaaucuauuccugccagccucucuccuuggguuuucuuuuguguaccaucccuuuguauccuauguccaucccaaaauuggggaugggggauucgagaaguuucuggaauucagaaacgccuuuaacccuucccucucuacaagaugguuuucuuucucggacuggauuaaauugcuugaggaaauuuucauuucuagacauguaugccgcagggaauguauuuuacacaacgaaacagauggauucaugcaguuuugagaugauaccuaguacacaacccgccuuuuuuuuuucuuuuuugcagaacccuuuucuccuaccucuuccauauuuaccccaucccauccccccauauccuagccacugugcuguggcaacugggcuguuaaucaauucucacaagcauugugucuuagaugccuccugaguuugugaucaaggacucaagcuuguacggugccugauuguuucuuucucugguuucucacauagaucacugguguuauccuucuugccguuggcauuuggggcaaggugagccuggaaaauuauuuuucccucuuaaaugagaaggccaccaaugugccuuuugugcucauuggcacaggcacugucauuauucucuugggcaccuuugguuguuucgcuaccugucgagccuccgccuggaugcugaaacuggugaguaaguccuugauuucuuuagaaugcucuugguuuuccuggaagauucuuauauguucuauaaugucuuuguuucuuggaauuggccguagcuguuuuuuccauuccuuauggaaaaaaaaauacccaaaaaaaaaaaaaaaaaaaaaaaacaaaaaaaaccaaacuaccagucccucugcuagcuuccauauuuaauuagagcuuuggauacugccuucccugcccuuuucaauaaaaauguguucaauugauugcucagaacuccagccaccucccucuuuuccucugugauauaugagucuuuuggucugagucuuguuuguacuaacuugaacuuuuaaaaaccuuuucaucccacaguacgcgauguuucugacacucauuuuuuuggucgaacuaguugccgccauuguuggauuuguuuucagacaugagguaagccugacuuagacaaucauacuauguuaaaacuuuguccuuuugucuuagauaaauaauuccauaaguggcccaguuugauaagcuuucaauauguuuaaaaccauuugaaacuguauuucuuuuuuuuucauuuuuuauuagguauuuucuuuauuuacauuuuaaauguuauccccuuuccuggccccccucccggaaaaucccuauuccuucccccucccccugcucaccaacccacccacucucauuccuggcucuggcauuccccuacacuggggcauagaaccuucacaggaccaagggccucuccucccauugaugucugacaaggccauccucugcuacauaugcagcuggagccauggguuccaccauguguauucuuugcuuggugguuuagucccugggagcucugggaguacugguuaguucauauuguuguuccuccuauggggcugcaaacccuuugaagcuguauuucaagcuaagcuuucaaccugcagcugacaagagaggcuuucuaguaaaaauuggcaggaugauaaucacuagaagaaaaugauaaccaaaaucacaauaauuuguaguuguaauuugguguagaagcaccuauuaaaguggaguuuuagagcuuuacuaauaggaaaguaaaauacaaaguuuaaggcagaaaauuaauaccuuccugugggucccauuuugaaaagacauaauuaaugcaaaucaucaaaggcuuaauauucauauauuaaaaucaaguaaagacagcgcuguugagaagccguuuaucaaguagggaagguguauucaaguacuauuugaauuguuagugcagguucauucuguaggcguccagcuuguacauggaggaagauuuaggcugagggguggaaaggcagugcauagaggccuuugaauagguacaugcaccuugagcuuguaggucuuauauuguaauauuuuccuugauaggccuuucagccaaaacuauauuccuuaguaguuaucgucagaccauuggacuuaauuacaacauaucaaagauaggauuggccagacaugagaauuucuuaguugauauagaaacccaaaguauuuucuagaauauuuguuuacuggcauuuuguuuuuuuucggauccagauuaagaacagcuuuaaaaguaacuaugaaaacgcucugaaggaguacaacuccacaggagacuauagaagugaagcuguagacaagauccaaaguacgguaagugguuagagcugggguguuuucauuccuuaucgccuccaaggaaaggauggagcuaggcugcuggguguguuccacuuguauggaaaggcggugugagauaccagcacauuuccuuguucucuuccuuuccacugacgucauagacaaauacuguuagggccaacuaagacagggccguaaaggccgucuaaaacccaugcuuauuguuagaaucaagugccagucucuugaauaaaucaagaagagagaucgccgaguauaguacauauuguuuugggcacauauuacaauagaagaugguguuaggcuaaaugguugccagcgaaccagucauauaaaccaaugcuuuuuacauuucuuucucaguugcauuguugcggugucaccaauuacggagauuggaaagguacgaacuauuacucagaaacaggauuucccaagagcugcuguaaacuggagggcuguuauccacagagagaugcagauaaagucaacgaagagguaaggguccuuuuaggacuuuuuauuugacaguauuugaggguuucauggaauccaaaaugaacucaauuuuuacuccaugaauguacauacucugaagcacguagggaagccgguacuucauuuccuauaguuagcaaguccagugcaugauccaaaagauggaaccagccaucugaggacaggugagacaggcuagguuucaguaacgugguaagcaaaggcgaugaucguagcucaagaccaucuucuguggacagcugaaugaucaaaauaguucuuaacaggaagaaaaucacagcuuucuugacuugugcuuaaugucuuuuuuuccucuccuguuaggguuguuucauaaagguaaugacaacuauagagucagaaaugggagucguugcuggaauuucuuuuggaguugcuugcuuucagguagguuuucuuuguucuuugggaaaugucuuauucuuauauguauaagagaaguuguuguuuuguuuuguuuuggguguggaacucaggauguagaccaggcuguccuagaacucaagaagaucugaagaucuaccugccucugucacucaagugaugcuauuaaagauauaugccaccaugugguuucccuuuggagacaugcugaagguuuugcuucaggagacuggauagugaagacaauguaagagaggucuuagguuucacaaagcagucaauaacuuaucacaggaucgguuuucuuauggugaagucuugggacuucuugggacuuaacguuggauguauguuacugauuuuguuuaucauugacucauuucuuucuuuaaguggaggauuuccugaauccugcauuuuacaagacaacaaauaacuguaaauuuagcuagguggugguagcacacgccauuaauccaagcacuccagaggccaacacaggcagaucucugaguucaagcucagccuggucuaucaagcaagucccaauacagccaggacugcauaggaaaccuugucuugaaaaucaaaaaauaaaaaacaaaacaaacaaaaaaaccaaaaaaaccaaaaaccaaaaacaacaaaacaaaacaaaaaccaaaccaaaccaaacaaaaagccccucuaaauuuuaauucacauugucauagaaaucaugcuuugaaucuauaaaagaccaagaauucaauccuagcauauauacauacaugugugugugugucuugaacuaacagccuuauaaauagauguaagcccucuaccacugagccacaucccaaacccaguacguauuuucugaaagcaguuaacugugggaagacauaauacccucauaguugaucaaaacaugaauugauaggacuauuuacucggugaucagucaagguucuauaacuuuauuagagucucccuuucuuggacggcaacugccugguaaccaccaggcaguuuauagaucauacaagccucuauuucuuuugugccuuuuauuuuguaauuuuauagauugaauuucuucuugagcugugcugaucacuacagcaugacaaguuugguauugugauuuggaaugaauuuuuaaagcuuuuuuuuuuucuuuacucauucagcauuauagaaguaagaccaaugcaaggcugguccuaauauauuuaucaaggugcaugucuuaccaucuaaaucugcaccaaugcaacagccaugggccuccuucauucuaauuauuagacaaaauuaaaaccccagucguuuuaacuagauuuaaguccucacacgaggcuaaagucuguuguauugaacaucacaggugcauccaaaaaagugacuuguccccaucaguuaggauuuuccuugauaaaaugcuuauucuagacaauaccaucauuuucuuuuugguagcugagggcuucucuaaaucccaggacuuuugaauuuuccuuacuguccuuugugaaguuccgggucacuguuaggaacggggcuuuuuagaaucauugaaugugaccucggcacugcagaagcagcuaauguaaucaggacaauucaaggaaggaaauuacuggugaauuacaaauacaaugagaaugcauccauauccugagcucuucaaccuugaaagaucugcaaguuuguguguguaaauguguaaucuuuguucguauuuucucucuagcuaauuggaaucuuucuugccuacugccugucucgugccauaacgaauaaccaguaugagauaguauaaucacuacacacgggcucauaucuccucaguuuuaaggugcguucauuuugguucuuaaugcuguuuauauugauauuuaugugauauuaauauuuacauauuaauuaugaauuaacuuucccaaggcuuucuccaguagcuuauuuaaaucuuuuugguguggaagcacuguuuaggcaggucagguuucuaucugcaaggcuggccugaaaguauguauguagcuuaucugugguuacuuuuucaaacauuugggcaaugaaagagcuuuucuggauuuaagaguucacuuccacuucucaaccuaaaggucauaaggagucuccuuucucauggauguugaccuagagggaagagaaauaaagagucuaacuuugaccuuuauguccuuuaaguuaugaaguguuaaggaaaauauguccugcucuugacuguuguuaauguuuccccuagaccuuaauggucauucauacagccuuagugccuaauaguguugcuuucuagguaaaaaguuaauuuuuuuguagacuaagauuucaaugaguuaaaguuaaccuggccuaaauaaaaaaccagaugugggggaccauuguuacuggcugaauuaaucuccaggguaccuggaauauuugaacuggggcaugaccugggagcauuggggggguggggggggggcugcacuagcaggaauagaccagaaugcagacaaaugccgaugaugaaauuagacaacaacuaaauuaacuauguuuucuuuaauuuuuggacaccaagguuaccuuugugaguuauaacagcgccuggauggagacugacaucugcuuagccugaaaagcuacaccaguaggcugauucaaucaagauacuuguguauuguauucuguguccacuuucuguccuauucuuacaccccuguaucucugaaacacuggaagugcuaguaaauuguaaaugaaauaauacccuguuucccuuggauuugauuucucaguguaggaauugugagaagugcugugaacuugccauuucccuaacagugucacugguggaacuuuaaccccuaugaauuugucguugauguagugugauagaaaauuggucuccuugagugggccuuguacuagucaagauugucuggcuugauuauauaauauccaaaaaaaggaaaacauuuccuuagccucugcugguaggcagaguugcauuguauaauuucaucccagcuggucaucagauggugcccaucaauggcguuccugcauggugguaccagucucaggcuuugggugcaaaggacagagacuaagagccaccacuuguauucugugauacaucagcuuucagcacacaauguaugugcuuuuaucaccaaacuaaggcauucauacggauucuacuuuauuauuugaaagguuauaauuacuuuaauggcaucagaacucuuguauuuuccuuaugaauuuacuggaacuuacuugauuaacuuuagcuagcuauuccucaccaagcaaaucauacuuaauaccaacugucagcauuuugguuaauuuuaauaguauucauuuuguuuuguauccuugauuaauaaauauaaauccuuuacacaauaaauacugcauuuccucuaaaag

SEQ ID NO: 9720 - RNA, 2509 nt, Mus musculus
caagcucuucuguagcugcuggacaucuagguaggauguagaauagguacuacaguaacugacuaacgcucuacauuaauauuggaauguggucagccuacaaguacuaacuacuguuagagggcagggaugugggagggagaacauucugggauggggggggacuuugagaacaggaaauagcuuucauuuucaaaggguugguggggaacaggaaaccagccuuguucagaggauaaucuuauuggcuuaguguggaguagaccauucauguugguaaggcaguggggaaugagggcuuaauagagcuuggggguuggggauuggagugccacagaagagaucugacuuaaaagagagcucuuguuucugaugccuccugacaugcgccaagaaaaccauuucaacuuaaucuugaaaguuaaaggaauuugauaggaaagagauacaaaucucccugcuaaauguugaacguaacaaaguagccaaauauuuaaggaaaauauuuucuuccauuuuuuuuuuuuggcaucaaguguuuguugcccaaaauguggagaaaauaaccgauugaauuagagaaagaaagaucagaugcucugccucaccccuugaaggcagugucacuaccugggugauuggacugugggagcgaaggcaaaaggaaaacugaacuguccacccuaagagcaaggaggaacugguggcagcagacccuucagggacucuacagagcccccauuugugauucagaguccaagcagcaacacucuuggcuccaucugagucaagauagguguuuguuuuuauauuagucaugucucacugcaaagagggccccaugucugaggccagaaagagagguaugcugggcuuagucuuaggcaagguacuagggcucuuugagccugguuuuccaucuguaaacugaggaggguaguggaucugagcucauaauaggacuuuugugauguaggugcgagguaagagguaucaagggcuuagcagcaguggcugguacauggugcucagcauugcagucagcaguaauacuugaaagaaggaacucaucugauggcccagagaagcauaugugaaguugcuuuagaugggauuagcuguccucuugguuggguuugggauccagaccccagccuacauuuuaacugaauugaacuguuggauuuguuggcacgucaggggacaagcuggcccagcaaggcaggagugguacaagguguuguggccauaggaacauuaauuuccaugugggcuuucaguuuaguuuggcacuggcuguccugcaaacaaagcaguguugugaguggcagaggaagggagagaaggaacauuaacacauucuuggaaauaagaugugccuuuuaguuuuagcuguucuuucuuucuuucuuucuuucuuucuuucuuucuuucuuucuuucuuucuuucuucagccacacaaaaauuacuuuccucuuaggcuuacaaugaaaaugauuucaaagucauggaacaaaucuaaacuucagaagaaaacuuucuauuuaggaugacaaggaguuagcaagacuucccuugcucguuguuguuuuuaauacaggaauccucagauagggucaguuagcuucagaaggaagcuuugcauauuuuuaaagcuuccuuccuccagcugccugacugcagcuaugguaaauguauucuaaaagcugaaugucuguuuccugaugacuuuaccucaaaguauuuacgggaguauguuguccccagagcaaaaauaugcacacacacagagagaugagagagagggaaagagagacccuccaguuuccgaaaagcuuuguauuguaccuuuguacuuuugggauaaaauuuaguauaaagccugggaaugaaauaacucauuuuccaaauguuauuuucuuggacugcagaugugugguuggauguuauaggaacugguccuaggucaauauuuaaaccacaggaaagcucugcaugaucaagucaauggaacuuucuuguccucugcuucuguaguagcauauuuuucgagcaaacuuucaaguagaaaaaaaauggggaaucuccuuaucuuucaugaauacauaaccuggcuguaaagucuguauugaauacgagguagauauugccuuccaaccuuguagcaauaccacacacuuaaccaucucugcuucacuucauuaauucauuuguauuuauguacauuuuacauacuuauugugaaucugauuagaagaagaaaauauccuuaugcuguucucaugagaaguaaagaucguauucaaguggagggcaaucugauuuuugcuuuuauucuuuucuuuuagggcacuagggaccugggaggcuggaccuuccaacauugcgggcagugauagacaacuuacgaugaaguaaaaaagacucgggggagaagguuaggugggaaacaggaaagauuccauagagaagcaacaacaauaccaaaaagccaccaccaacaaaaag

SEQ ID NO: 9721 - RNA, 24044 nt, Mus musculus
cacuccacccagagcuugaaaccagugacagucacacuuccccucuucugcagcagacagcacuagcuccucuaauccucuugcuucccccucccccaaccauuucuuggggaauaacaaauauagcuuuggggauaauauagcuuuaagacgacuuuuggcaaauguaaauguccuaacaucugggcaguguuaccagaaucccggaggcccugacagaccaggagccacugguucuaggaauguuaaaguacaagggcuuuuucccacccccgacugacugaugagaggagcagagagcaaagaaaaagaagagagaugaacgagaccacaaaaaucauaaaauaaaaagcagguaaguacacugcaccuaauuccucaaacugaacuucacagcuguggagaggucaaaagacucgggacuuagaugauagagcuggagguggggggaagaagauugguuuuuuguuguuuuuuuuuuuuuaaaugaaauuggaucauauacuguuuucauuugugcuggccacagaugcauguuccugcucuuuucaaagcuuccaguagaacgauagcucccuccggugagucaaauuuuuucagccugagcuuggggaggaggugggcaggagagaggucauagguucaaaaagaguaugggggcugacacaggaaaaccuuuauuccacugcaaaggcguugguuugaggcuggauauggaagaagggucagcaaugagcucauuucccuggcucuuuuuaaaaucucuuucuguugccacuuggugcuuuagucaaucuauuuccucuaucuccaucagaguuucuccuuaugaucacaucuauacuacagcuuucuacuuucuuaacccccauuccuuucucucucucucucucucucugucucucucucucucucucucucucucucucucucucucucuguguguguguguguguguguguguguguguguguccuaauuuauagauacucuagaucuagaaucaagaaguaaugacuuggaaagugacuuuuugauuuuauacgauguaccuuuaaggacucugccaucagauuggguuuuguuuuuuucuguuguuuuguuuguuuguuuguuuguuuguuuguuuuuaauguuuccaugucugagauugauccccccccucugagcauggcguugcaugggaaacaaugaugaaugaaugcuugcugaaagauccaguggcuauuguacauugaugggcagugaguuguaacaaugcuacuuaagguguccaguagcauuacagaauucucucaucucaucucauugcugugaagauuucccccagaaaggaaaaugaaauagcaauaggaacuuggccauacucuccuugugggcucauuagguggguccucuuuaaccucucugccuuccuccuagcucagcaggacaaagcuagagggguaggcuggacuuaaaagcuagaaauaacugucaaagcaccaagccucaaaacccagagcuaagaagagagcagagcuauaguuccugcuugcaaggcuggagaagccaaacacccugucuugucuaauaugaaauuaguaauaauaaugucaaaacacugauuuuucccucugugguaggcaauaauguacauacuauuuuucuuguuguauagguaaaguacagagaaguuaccuaauuugcugauuugucacagcauauccagaucugccuuacucuagcgcugaaggucuuaggccauauaugucaaugcuucuccagcuucgugguuaagaaauacugaguggacacaaucccuaaguagcagccuuuggauucccacauucccuccuaguucugugugauuuuguuaguauuuuucuggucuuggaacuucagugccccucccugugacuuggaccaugcaauauuugcacuugauggccccagaguacacugaagauuagcuccuaauacccuucucuuccugcugggagaaagggggaccauaaauccaaaaagucuuauuaugcuuugaagcaggaaagguuuaugguccagauaacacggacuggaauugaugaauguucaaaucuucuuccucacagaugucauaugccugcuuccucucacuuuugggaguucauagcugguucugcucugaaagucauuccccuuuauccugguacuucuggccacauagcccuagucuugucuucugaagcuucccugucgacgaugaugaccaguccacugacucagagaggugcucucucacugcugcuccuccuaaugcccgcagugacaccaacaugguacgcagguaaguucugggaacuguuguccguuccuucuagggagaucaagaccaguaggaagacuuagaagagggaagagcgagaugacaaugagagaguccuaacuuaggcccacagaaaaacugauggguggcaaugaacaugaucaaauauuagaaggggcugccaaucagggccugugaggcaucauccuagcaguagcuacuuggcaauaggcuguaacacacaagugaaagaggacagcguggccuuugagggaugcuuccuaguuucuuucuugcuuuuuuuuuucaguuggccuuuucacuuagcuuccugacaaggaguggggacuuuagguuugacuguguaguugguugguuuguuacaugcuugcuuucuacacaugggauugaauuuaagaaucucacaaauccuacccaagcucucugcugcuaaacucuauccacaguccacugaaaccucuuuagaaguugcauuuuuuaauaaaccaaaucuuuauuaauauuaauucuuuccugagucaaauauccuuguggagacuacaaaauaggacucagaccauguaucucuuuugggaaaaaaaaaaaaaaagaagggagacauacagucuacugagagggaacaagaauucaccagacuuccccuucuuucucucuuccucccaggguuuaucuacaggauuuguauagccgcuuuuuuggccagcgggggucaaucacaauacagauuacauucuuugauuuaggaauccccuaggaucccuccucuggcuugauccuuauuucaaaaagaauguagcucucuggauucuugaauguuucacgccucacccccugggagacagggugagcugacaagaguggacuaaggaagagaggcggguagaaugcaaugggggugggggacaaggaaaggauaccgaaccaccauacagagguuuuuugauuggguugcaguggcacuucaagugcuaaaaauauucuguggccugcagugucugcccuccuaacaacuggagagaguaggggaaugagacagucccaacggaugggguuaggaaaauauccagagaugaguaaauaacaaacggcaaccaccacagccgcagucauugcagcuaaaauuuuccacauacccccggcuccugguagaggccuuuggcagcagcucuguuugccuggaacagcugcauccagcuuucagacaaguaugugagcuucuuccccucuuuggcuuaaccuggcuuuguaggggguaaagcacaagggcugacauucagccgaagaaauucaaauuaagcccuuggcagagcuuacacuguuugggguuaaaagagcucaaggcuucuggagauaaauaugcagcuguucuccccaaacacucccuggcuucaauucaacuacaguggaccaaaaucuacccaaagaccacagaacuuaacggaguggagauuguagguucaaaccccaguuuugaacaccuguaugaaacucauuaaagccagagauguuuuucagacaaggcauuaaaagcuucaugugagguucucucucccucucucucucucucucucucucucucucucucucucucucucucucucucucugaaggcuguuugcaaaucuggcacuccccaguucuacaucaauuacccccagucugcuccggaggaacccaggcugcuaaggucucugacagcccugagagccuucuuagaaggcugcacuaugggagauauuuugaguuuucaugauucuccucuucaaugcuagcuccuggcuggguuuguguccauuugcccauucuuuccuuuccucauucaacaauuaagugucaaauaucgccuauaccucaaggacuguuugguucuuugccuuuguucucaaaugagaauggcacaaagaugcacaaaaaaaaugcacaaaaaaauggcuaaguauggacucugggcaagugagaaaauguguccaggaagaaugaacagagagugggaaaauguuagggaguauacaaggagcugaguggguuaaaaauguguacuggaauaucugcauauuucagggacucacacugucuuugucaucagaaggcaggcauuaguguggcucuuaacaucaucuucaauuaucaaauaucuuuccaaccauauagccaccaagggcugggcuuaaagggucccacuuggcuguggaauuugaaggaacccaguaccagaccacacaguaaaacaaccacugauugaugcaaaggaacugagaauuguugcucaggaaaauggaaugagacagaggcugaguccuucuuuccuauaccccaccucagaaucccaacaugugcauaaaauauucaaaaguaggcaacuaggcgacaugggaaaguuuaagugguuauguagcccaagcccauuccugguacaaaagaaaccuagcacugguuucgcuaccucugcacucugguggagacuauaauuaugugauugagucuuccccucagauuucccacauccccuguaauucuggaaugguauaaaauacaugguggucuauggucuccuuaccccaccccuugccacaagggaagaaaaugcuagauugcaugacagauuuugacucuaucccuucugaacauagucaaaacacugccuuuauuaccauuugaauuuuacuaucaaacgggccugggcugggaggucuacucugcaauguaucaucuaggaggccuugggcaacuccuucuauuccucugagucagcuucugugucuuuauguaggagagcauuaauguuguguacucaguugagaugguauggcaacauaaugagcuagcauaugcucuacagauuaagagcuaaauugucauugucauuacuuuauccagaccuaggccugugacacccuucuuucucuuuuggugaacagcuguuuguucccugaugagcauuucuucacaagcuagcucugcaauuagaauggggagacccaguacuuuaaggaaccaagcacaucugguccccuguuuacaaaagcugugagggauugagacuaacaacuaaacugaaacagcugacagagauuccaugcugcacaaacaaaccucccauguggguaugagaagaggggaccuacggaggaaugaagggaagccagagaaacuggaaggugaaaagagcaaaacugaagagaaaaagggaaacccuuuccuuuuggaaugagggcaaaccaaggaggacaugauuccuaaggcaaaccugcaauuugauucaucuccauguuuacugaguuggacuaacaccaccaucacuaccuaccuguccugcccacgucucugucucucugucucucucucucugucucugucucugucuguguguguguguguguguguguccgugucugugucuuucucugucucugugucucugucucucucccugucccucccucccucucuuuauugcaggagacccugugccucugcccaagaaaaggccacaagcuugcguucuggauguuuacauaggucaaagggcuccagcuuuaaagcccagcccugcccuguaagcaugccuucuccaggaaccggagaguuaucuucagacugcaacuaggcuggcugcccucuuccugcacaugcaugagagcucaggggcauuaaagaaggucucccggaaacuuugcuauggaaagaacgaaauuguuucccaauuaguucauacucaugaccgauuuccugcgucugcuggaacacacuguuuagucucccagacagccgcagaccugccaccacaagggacuggaccacuuaacugaauggaagaagauaggcugggaauguuuucuaguucagcugcucacugcucaagcuguuccugacaggaaggagaggaaauuagccauugcacuacacgggugaggcccuaggaucaaucagcacugaggaggaaaaaacaaaaacaaaaacaaacaaacaaaaccuuacuccgacuucucuuuuuacuccaagccagaauaaggugcuuaugaaggcauucuaguuuccccuuugcccuuuaagccauccgccugucuuggcgugccucccuacaauuacagucaggugcuuaaugugcccuguaggcuagugagaacuugaaauacuguuuuccugugaaaacugugugcaaugucugucgcuggagaagacacuuuggugcuauuguuuccucagagcuggggacaacgguccaucuccagugcuuggcuacucacuaaggcugugcgugugagcuucagccagggaauugggugguuuauagucaagauuggcugaauugaucagugguuaaggaguucaauuauuuuuuguuuugcgagucuuccaguacgacccgugaacacccaccacaugucacccuucugagguugcucucuguguacauccuaugaucgggaucacccacagucguucugcagcuuuacaaauuacuugacagcucuaucaugaagugucagauccuaugggaaagacaaggaugggaguaccgggaagugcuugagugagaaaugaauauacaucuauauuuucuuccucauucuaggcucagguuacucuccagaugaaagcuacaaugaaguauaugcagaagagguccccgcugcccgugcccgugcccuggacuacagaggugauucucauuuuuucugaagcucagcuaggaugcuuucuggccuaggaucuggaccuucccagaaacauccucgcucauguuuagcucauaugugucagacuugagcucagagaaucaucaggaucuaugauuuuucuuugccacuguuuugauuuugcuuuuguuugcuuuuaggcaugcgaucuggcacugagcccgagcccucuuguucuguucauuccuuucuugagacagggucucacuauguaucccuggacagcuuugaacucaagaucuuucugccucagacuccucagggcuggcauuacaggugugcaccuccacacccagcagguguacuaagcuuucuaauuacaaauuuaguuacugaauugcugugugguuuuaccuccccagcccguaggagucauuaaauauagacuggguaucugcuuuaugccucucaccguguaggguaagccugugggaaauacacgggauacauacaacaggggauugcccccucgaggagcuugcauucuguugguugugaagugagaauaaaauuaacacauguaaagcgaauacaugugaaacugugugucagccacaaaugaacuaggagcauaagaauucaggcaagaggucauuugugaaagaugacauccaggauaggccucgaaaacagggagauugugaugaacuggaaaagguuauagacauuugacaaagcagauugccaaagagaucaaaaguauaccaaauuuacuacacuaagaggcuaagaagaaaucccacugacuugaagggauggaauauggguggauuaggagagaagagacuugaauauaaagagugaaguaggaaagguuccgugacuuagugguccuuccaaggagagucagaaagaaugcugaauaguauuuccugaauugauagcaaguuaccucaggugaugucuaaaaugacuuuaauuuaugauucucucugcccaugcuuuccuggacacacagaagaguuuauguguuaugcuaugagcucuaaagagugaucaugugauuuuuccacagggcggcgacaauguaaaagauauuucagaacacuaaguuaguuuguuuagaaaaauaaaagguagaagaaggagagccugaguugaggagaugcuccaggaaucaguuacagcaauguuauggagagauauuugagucugggggguaaauaaauguagaguaaagauggaccccagaggggcuagauguguagcccaauaacagagugaauuuauggaguguagaaggcucuccuguguuugagucccagcgccacaauaaaaggauguauuccacagauguuguaaagcaggugauaagauugagugcacuaaugccuggaagaauccauucugaauacuaaggcaaacuguaaaaaacauuucagaaagacaaacuuaaagaaguaugcuaggagccagagagauggcucaacugguaaaagagcuugcugccaaggcugacaacgugagcucaauccccaccaccacaugagauaaggacacagagacgcagcacacucgugagcacaagcacgucugcguguacacacacacacacacacacacacacacuaauuuggaagguuguugggcagauaguuuaaagagaaaguugugugaauacccggcuuaacugacagggcuuucugaagagaaaaaucaaugucaagcuuuggaagacauugcuagauauguguagaagagaaagauaaaucauugaagaagaauuaguggucaguguagaagaagacugucuauuggggauauuacaaaagcuacagauuaaaaaauacagaaauccagaaaguauaugagaucaacuacaucaaguauugcaaaaaggucaaaccuaaggauaggaaauauuuuaguugcggaggugguaaauaaauggugaucuuugagaaagcaguuucaguagagaaaugauccaaacaugggguuguucuaucuuucaagcuauucuuucuuaacuucuuuuuacugauaauggugcacaacuacuaccucugacucuagguucccuacagacuguuuccccauccacccacauauuuccaguugacacaccacaucuugaaaaugauaguucucucuugaucuccaaaucauauggccuugggcgucagucugccugaucucucaagcagcaguaagcacacccuuuucuuccugguucuccuuccucagaugccauaguaauuucucuauucugaccacaguugaagccaagauaggaaaugauguguggguagugaucauagagagaagaaggcugggaucugaauuuuggggaucccugacauagcuccagagcucccggacugcaucucuaacacugcuagaaacccaguuagagaugucuaagagagaauuuuugucuuaucugaucaaaaguucuaccauaaccugacuguccuacuucuacuuucugguaauccuaccaccacccucuuagugacucagaccuccaaguacccuaaugugacuucuaauaacccccagcauguuuaauuaacccccuuuccuccuuauuucuuacuagucauucaccaagaccuaucauuucuuuaauacaugggcuuuagaauuauuauuauuucauacauggacaaagacuauuguuuccuaauuagauucccaggcucaaguuucugcauuccccuaauguagugaccuaguaaaaccauuuuaaaccagagucuggcccuggguccuagucugaccacuuuuuaaaccauuuccccacaugaaaucugucuuuuagcuagggugguauacuguuuuuuccccccaaaauugauuuagugcacaccagucccaguccuucccucaccagcccauccuuuuuucuucuaguuaauguauccauuuguuuggagggagggugucacagcauauguguggaugucagaagacaacuugucaugaaguugcuucucuucugcuaccacguggguccuguggaucaaccccagguugucaggcuuguguacaaauacauuuacccccucagccaucuugcuggcccucauuauucuacucuguaccucuucugaaauggauguucauuuuguuugcugagacaacucacucgucugaccuucauuauagacuguuucgugcugggagcagaaugauuauuuaacaaaaggcauaaugcauaucacucccaccgaagcauaugaaaagcaggcagugacaguuagccuccugggaacccaaaaaugaaagaaucagauacuaaaaaaaccaaauguaaaagguauuucuuuaugugguguugugaauugaacucagggccucguacaaauguucuaccacccagccauaccuccagucccagaaguacuuuugaagggucuggcaucccccauuauuagcccuuaccugccucacugguuauuuuuaaaugaucaaaaaucccuuuaaaaaccuauaugccacacaauaguauuugccuuggugucgagugucuuuggaacuuggucuccagcccuaaaacaaacuaaacaagguuaucaaugaugcauggaaaggaguggccaggaaaaguacaaccagagguccuggccucccuuguaaucccuguugugccuugugaccauuuucucugcaacuguaccauuuaaaaucuuccugcaguuuagagcugauaucuccaagcggaaguacuggaaauagaugccacaguguauugaugcuugaagacaggugaaacgguggcuccaagccagacacugauuuagagaacaccauucuggagagcaggcauuucauguauggaaucccguuugcuucucaccgcagccucauggggcugcuuuauuaucucccauuuuacagcccagacaacuaagcucaguggaggcuuacaauggacagaagcuaaugaggcagaaugggcauugaaaaugaggucugucugaccacagagccaugugcaucccauaucuuucauuaaaaauggaauuaauuguuuuuuuaagguaaaaagaagagaaaacugucuacauaguuugguauuguccucacaaaccuucugccauucucuuaucaggaaaccuuccuggagucagaaaucuuagucuggagaugcagucuuagccugccugguggcuaagcagcugccccauagcuucucucaguccugagcaaacuaguaacugacugggcuaccuuggguuuaccacagacaaggccuuuuccuugucuugucagacuuucuuguccuuauaugccccccccccaaaaagcccuucugcuuuguuaaccccggacaagugauuaucaugugucacucauaauacuaaguguucuauaaauguuacuccguuuaaauaaagugcacacuugcuauguugugauaugcaaagauuucggaaacauauuauuaacuucaaaaauaguaguuagaacugcaccuauaagucaguaauagagcauuuacccagcaugcagaagguccuggguuugaucccaagaaccacaaaauguaaagcaauggugggaacagugaacacaauauguuugcauaugugucaaaaaaaugaaaaguaagacacuaugcaaggguuugcauuguaucuauaaacaaauugcuaccaugggccuuuuggaaagggaauaaugagcacaggcauaugagaaggaccaagaggagacauuuuacuauauagcuaacugcauuuuggauucacgaaacauguggauggauuaauagauucuuuaaaauggcagcuacaguggcagguuuuauacuuaggauaacccauuuuuagaauagacaaaguuagguuccaccuugccucugccccugccccugacccuuacuucccaagcaacucugggaaaaaucacuucaucuauaaggaugaagacugcauaccucacagggcuacugggagaacuauaugagaugggcaugaaaauggaagaacgacucauaaacucaggacucaauaugaucacaugucccaucagacauuucaccaggcagcauuuagccauagucuuaguuucaguugcaguguuguucagccaguuaugacucucuugaacuguauugucacuucuuuuguauuucuucaucuuagccacaucaauggcauggaaaguauggucuggcauaugccucacugacuugcccauaaccuaucuaucaucaucccuguucuaccagucugguggcccuacccagaaaggaaaucaggucauccuggaauaacuuguucuugaguuccccugccagcucacaggccucaccuuggaauguucuagaacacugugcucgucaucccaucagugguaacaggcuauacuaccuagagacuaccuucucccuuauuugaaaacugaguuuguggcuuugucccuuuccugucuucuaacauucuguccuuaugucacaauucuucugggcuagcaauuuaaaaaaaucauacaaguauauauuguauguuggacaaaucccuuccuaucucuguacccuccuauuucucaccccucacugcuucuguugguccucuuuguuccccuuagauaguuccacuuguaccugcaugccauaauucucuacaucuguauaaagucuaggaaccacaaauaugaaaaaaaaaaugugauauuugucuuucugagaccaggccagcaagcuugaacuuguugacaguagcuggacuucuaucacuuucuuuguauucugagcuuuguaucucuagcuuccauucuuguuuccucucccaguuucaaucugauuuguauuuuccuugacagaaugugggagacaaaaaagagcagacaugcuuuugagaucccaggcucccguguaagucuuugugauauguguuguggcuuuguaauuagcagcucugaacaaauggagcacuuaagcaacauuauguaacucggagaugguaucuccagauggcaaccccaccacugccacugacguaaacuaauaguggaagcccaaagcaucguacugguuagagaauaguuuuugcucugucaucuaucuuuauucuccagaugcaugagaacagaggcccuagccuuccauuguuccuuaaccuccuggugugaugugcuuuugauaaaaguuccccauauccuugucccuaugauuugaaaaucaaauaaacuuauaugguccuuuuugccuuccaaauucaugcuguguggguaaacuugggcaggccaccauccaauuguuucuuuguguccuucuaaacucugaaccauauggaaugagguguacugguacaccuguaaucccagcacucaggagauuagagcagggaaucaugaguuugaggccagcguggacuguauagcagacucuaucucaaaauauaaacgagaacauagaaccaguggaagagucaguuauuuuguuaccaguaaggcaucuuuaugaaagaaccacccuaaaaacuuguguguucaguacugaacagggaguagacuuucauuccucagcagucugcuuugaggucacaauccuguucucucucuaauguacaucuuccagguuuuuaaaauuugcauacagcagaaugcccugucugcuguauuguucuaugaguuuugaccaauacacagaguaagauaacuaccaccagagaacaaaaacaguuuuaucuccucagaaacgugugccaugcugucacguugcaguucuccucugucuuuaccucugauguggagcuguauucuaugccuaugguauugccuguguguuugucauauaauggagucuuguuucuuuagcuucccaaaauacacuuagaagucaucuguguugucaccugcacauuauucuuauacaucuuuauaaagagauaaacccauuagcuaugcuguucacacacaaaaccaauuuuugacaauuacgaauagagauauuucaagcauuaagguguaagacugugugugaacucaggucuuuauuuucauugaguaaacaccuugaaaugaaguuguggggucaacuuucuuaacaaagaaaguauauaacuucuggauaaacuacuauuuuccagugugccauuguuuuucuauuuuccaaagaaauuuguaguucugauuucucuccaucuccuuuagcacuuucuauuaucauuccauacauuagacauccuaagggguuuauuaaugauauugcccugagguuuaacuuugcauuucuuuagugacuaauggugcagaacaucuuuucauauguuuacuaaucauucauauauccucuuuaauaacauaucucucugggucuuuuguccacaucuuuacuauugaguuuugaaaauucuuucuauauucuguauucuauucacuagccuuuuguuguggaugugauaugugguuugcaaauauuuucucccaguuuuugcauuuuccuugaacuuguucauagagcaaaauuuuuacccuugaaaagguccaguuuguugauuuucuuuaauaauuuaugcguuuaguaucacuucuaaaacuucuuugcuuaucuuugaaucccagagauuuucuaauuuuuccauaagcacuguuccuuuuguuuucaauguaaaucuaacgucaauuuugaugagaauuugaguaaguugugggauuuagguucuaguucucuuccuccccugccuccuuuuuuugcaccugaaacuccaauuucucuagugucauuuguuuugaaaagcugucuuuucuccauuaaauugguuuugaaccuuuguccaaaaucauguugaccuacguaagccuguuucugggaucucucuucuauuccaaugaguucucuuucuuccccuuugacacaaccacacuguuuugcuguuguuguugauguuguuguuuuuuuuuuuaaguuguguuuccauuacaacauuucuaccuucccuuuccauauaccccuccucgcuguccuacaaauguauggccucuuuaucuaccaauuguuauugugugcauauuugcauuuauauguauacacacaugugugcaugcaugcacacguauuugaguccauauaauguuacuuggaugcauguuuucaggacugaccauuaaggcacuggacaacagcucaauaguguacucuucccugagaagggcaaccucuccuacucccagcuucacugaguugcuuauaguuacuauuuguguaaaguuuauuacuguacuucuagcuuacuuuucuucugcuacuacagucccccgaugguguuacacauugaauauccaggauggagaagccacaugcuacucaccaaggggaggaaauuaucacaguagccuaggcacacguugugagcucuccugugaccggggcuuucgauugauuggacggaagucagugcaauguuugccaagccggcguuggucuggaacugccuacugcaggcguaaguugcaugugagcauauacagauauguguaugagagagaaguuagccugcuggccaugaaagguauauaccugggaguuuuaugcugugaaaguugguaacuuuccauaggccuucaacagagccuuuucucuuccugacauugugguuucuuuugcucuguauguggugguuacuguccaaguaauguggauauuuaagucacagccagccacucugacucaaagaacccagaaaugugugugggcaaacaagacuuggccaugaggaacuaacugaucuaggccugggccacuuccuggagguuccaaggauguguuccagacuccuucacacuuguggucaagugucauuaauuuuccuaacuuuagaggucuugccaguagagcugaugagacauaugcuagucuucauuuucuuuuuaaaguaaaaagaauccacaauagcaugauaugggaauacauauacacacauagcuugaauucuaucucacuucaucucccaagccccuacuuuuuauucaaacucuucagcuuuuuggcagcaagaggcuuuccauauguggucagcaaauaccauuuaaaggaccucuaugugcacaggaugcugauggaacucagucagcucauccuuuagguugcuaauaggcuaaggggauagaaacuuaaaggugugcacaugcauguugcacaccuguguccauaugugcugagaauucagagauucaugagcuugguggaaaaaaaaaagcuaugaaggagagaagaagguggauggccaaaaaaggagcuacuaccaugacccuuuaggcccuaauaaguaaguagcuuuaggacuuaaaccucaacauuuccaaagugaauuugaauugaagugauaaaaaaagauauaaagcuaugaauuauaagcauaaaaguagucaauagcauagagauguucccauuuccaugagguggcugguacaguugaguccugucuuuagcuugggccuuccucgugauugaaucuacuuuuuuucacugucccauaauacugaguaaauggauucaucugaagagaccuagcuuucuccuugacucugguuucaaaggggucauuuugggguguguguguguguguguuuuuacauaacaaaugcagggagaaagaaaagccaucaucucagcaucaagcuucauuuagucaagaaaaaaaaaaugaacagagccuauguaaaauuuuucuuaaaacuucuaacauucaaacucuauguaagacugagacaagcuacagaaauguguguggcuuacuucucucaaauaucaguuagccaaaacaagacuaaugauaggcucacaauuauauacuaacagucuugaaagcacacauguucugcuuuuauuaaaugucaccauguccuccagacaguggccugacucaaguggaccaaaagccacaguccaagugugccuuguggcauccaagugagccuuagcuuaacaguguaugcagccaaggaacuuugaacacgcuuuaagggcauauaacaguugaagaaggcccagcaucuaaggaacaagaagcaaaaauuaaccauugcugaggcuucccuuaaauuguccugugcgauaaauguaguuuauuguuuaaaaagaaaaacaguaagacucagagaaaugaggcaaugucucuaagucagagagcaagaggugaagguaggaugcaaaccgaggucuuauuuucauaaugaugcacucagacaacugauuuacuuuuuuagaccccacacuccaucccacucagauuguucuuuuacuuuguaauaugaaauuauaaaaggacaauuugagggaaagggcagacuggaugagauuucuauauucucuguugaauauaaaucccccccccacacacacagacacacugugguagacacucaugaacccccuccagagaguccuauagggugcuaaacuugcuguuugguucucucuuagagauaaggugccacacacugccauucaucacuaguggcaccuauacgugcaccaauggaaugcugcuugacucccguugugacuauagcuguucuaguggcuaccaccuagaaggagaucgcagccgcaucugcauggaagaugggcgauggaguggaggcgagccuguauguguagguaaaugcugguagcuccaguuauucuguuacaaaaggugaucuggcauuauguucacagaagauguggaauuauaaucacagaauuauuuuucucuaugacaauacagaguaggcauagccaggcuccuuuccccucuuucuuagauaaaggugaacuuuuguucuuuuaccuacccaguggugugaaauauugcuuccacaagggaaggcaggggaucuauaaauccacauuuauuuuuuuacaucaccagacauagauccacccaagauccguuguccucacucucgugagaaaauggcagagccagagaaacuaacugcucgaguauacugggacccacccuuagugaaagauucugcugaugguaccaucaccaggugagcuugagucaugcacgccucuuguguccccaguagauucucccaguuccccagugcaguucuguuguucacuucuucccucugaguguucaggcacugauauacacuaggcagugaacgauagagcaaaguucugaaagggugggucagcaggauccugguccagcagugaagguauucuuggaggauuucaguguuacagcucuuuuagacaacauugaaugaaacagcucucuuagacaguauucaaaggaacaguuuguauucuuuauuuggggugaacaagaaccauauaaaccuugaaaaguggaaaaggguucuucuuagggugaaggcuuauuggcugaggcuuaagguucugggauaccucauuugcauggagacacaauccaggaaguugaaccuguaacuucaccaaggauuaagugacauuucgcagguagagugugggggcugggcuccccagauuagguagagaagaggaaacccugcugggaaagugaguucucuauuuugcauggaacugaggggagcuaucuagacaugauagacuaugaccuuuaaauagcaggaucucccaguaaccuacugugcucacgugaccagagaauccaggcugagccuguagaaaagaugugccucagaucucaauucuaacucucuuucccuuaguuguugaguaacuccuucacccugucucaugcagggugacacuucgggguccagagccugguucucacuucccugaaggagaacaugugauucguuauacugccuaugaccgagccuacaaccgggccagcugcaaauucauuguaaaaguacaaggucagaagaaaagagagagagaaaaaaaaagacucuucauuguauacacuguucaaauuccugcucugcccugaccuucagaaacccacgacaguucuuuccucuuuuuuauauuggggaaaagccaacuucaucaaacagauguuuuaagaaaaccuacacuacauuggcauaaaauuguucuaggaaccuugauucuccaacaagccuuuaucauccuucuaaaucuagauacaauucauaaauagucuacauccauuucucuucuuaguacucaaacugaucaaauuuaaucaguucuugcugcaucuaucuacugaaacgauaacauugguggccugcuggcccccuuccucucugcuccugguuauauaguuucacuuugguuuuuuuuuuugucauuuuaaaaaaauucauguuuauaacuagacauuugaaaaaaauaaccagguagaguagcacaugccuguaugccuguaauuccagcaggugaggcagaaagagaaaagcaagcugaagguuagccuagucuaaguagcaggaugcuaucucaaaauuaaaauuaaagcaacacauaaauagaauaauuuauuacauccaucuuccagggcucauuguuguaacaucuuaguauuuuuccuucuagucuuuucucuauauauacuuacaauguauaauuuaagcucacucuuccuacuuuuuauuaaaucacaaguaauagccccauguucuuugauacugcuuccagaaauauuuuuaaguacaacauaauaauucugcucuaaaucuguauuaugauugguuuaacccauuucucgaucauggacucaucuaacuuauacacuauuaaaaguaagucugaccaaguaugguggcacauaccuguaagauuagcacuugggaagcuaaggcagacagugaguuuggagccucuuggacucccagagaauccuucucagccugugcuauauugauugugagaucagaucucaaaagaaagaaagucauucugcacguuggucauauuuacacugguuaucuauaaaagucuacaaacauagaugacaauauucuuuuauacauuuacagucaucugaugacuaugcaugacucuguguguguguguguguguguguguguguguguguguguguguaugugugugugugugucuauaaagacuaggaaccuggguuugcaugucaaaauuaauuccuuagugaagaaaaguguaucuccugccuacugaaaacacagaaaaucuuuucauucggaucgucucaagucuuuuguccuagaaagccuggaguagacccuuuagcccuuccugacuaugagagauaacauaaucuuuaacuugaccuucuuccugguagugagacgcugucccauucugaagccaccacagcacggcuaccucaccugcagcucagcgggggacaacuauggugccaucugugaauaccacugugauggugguuaugaacgccaggggaccccaucccgagucugccagucaagucgacaguggucaggaacaccaccugucuguacucgugagugaaacuaggaaaggagugacuaggcuuguggcucaggggcacucugaaagaacuccuuccaucgucuagggggucagauaucaaugcaugugguaugagucuggagauucugagaugggucuauuuuaagggccaacauucccccaaagaauacuuauacuucaaaaagaagaguauaaaauauucagguuuccuucuggaauucaccucagggaagggagggcaaggauauacaagacuggaaugcuuucaggggugaagaagggcauauuccaacuuaccaucugcuucuguccuagcuaugaagauuaaugucaauguuaacucggcugcuggccuccuggaucaguucuaugagaaacagcgacuccucauagucucugcuccugaucccuccaaucgguacuacaaaaugcaaaucucuaugcugcaggugcgaccuaauggcuuaguaaaaaguuuacucuguguaacacaaagccuaccuacauagaccuacuauuuuuguggauagcauuugauucauuuuaccauuauguauauuggucacauuuuaaaaugucuuugcggagaaguuaguaaguaugguauguauggaaaagucaguaaguauggcaugguagauuuaucucgcaaggaacuggguguaggcugggaauggaauguagagaggcuuguaaaauagcugucaucaaauguaaauauuaagaauaaccuacauguguguuuccaaggaauuucacuuguauaauaagugccggguaaguaccacauaaugacuggcaugcuuuuacacauauacaacuaauucuuacaacaacuccuaugauguaugugcuauuuuuugccccacugaagacuugagggaacugaaacagauucagugacuuggccaagaucacuagcuaauaagugguagaguugggacugaacccaagcuaucucacuccaggucggugcugucuauuacuaucaguaccuaagcgccaugauaucacaaaggaaagcaaggaaguugcauggugaauuuaccugauaaauggaacagauaggaagguagguaaaagacugauuuuaaaaaaaaggccagacuagguggcuaucaagaaguguuucucuuuucuauuccauguuguacaauauguuucagacaguuaaguagaaucaaggaaacacuuuugugaagccaguacuucaggaaugagagggaagagguuauacagaccucauaguacugugaucacuugauuacgagauugugugaucauugcagaaacccuuccuuucccauguugccuuaauggaaucacaggguaggggguuauccaaguagccuaagaauguaaauacaaaaggcuauuuuauuuaauggucucucucucucucucucucucucucucucucucucucucucucccagcaauccaccuguggacucgaccugcggcaugugaccauuauugagcuggugggacagccaccucaggagguggggcgcauccgggagcaacaacuaucagcaggcaucauugaggagcucaggugcaggcugcggggcugcagggcagcgaugggcaagaugcugauauaggacaauagcaaccaagagcagggcugagccaguacaugugaauuagugucuuggaggcauuucuuguguugaacucuuauagcuaaaucacgacagugauucucaguucuaaaggaacuaaacagagucuuaaaauacacauaaccagguucuaccucaaaguccagaucugggcuuucauaaaggcaccucaggugacuuugaagagccacaacugagagagacacaaaggauuccacgccagacuagaaucgcuaggaagcuuugcaucucauugccuaugacuuccucuguuuacuuccagucuccaaaggagaaaaaggcaucuuuggugacugaaaucugaaccauaucuaucugccccucaugaaagagaagguuauagguaacaggugguagaaguugacuucucucauuaucuaucuauuaucagccuuacaguuccucaaaguaugcucagguccaauaaaggcaucaguguucucugagaaauaauaccuaccucuaggauucaauuucaguggggacaggaacaauucagggcagucaaaaaagacuaggaaauacugaggacagagacuugcagcuacgaauggaagaguuuagcacaauuugcuaaucaaccuuagagcuccuagguuuaaugugcaugcaaaucauagguucuccaauuacaugucucccggagcugcuccaugcaggcugcaugcacugugcaauauucuugcuucaaguggaaaacacagugaagaaauaacaggcuaggguuaggagggaaagcuagacacaaaaggcuaccaggauuaggaaugcagcagaaaauaagcaaaaaggauuugagauggggguggcagggguggaacaaggaggggcacagcuauaaaagaacagagggacuuggaccuaggacucacuccucucugaacugcucugucuaggcaauuccagcgccucacucguuccuacuucaacaugguguuaauugacaagcaggguauugaccgggaacgcuauauggaaccugucaccccugaggaaaucuucacauucaucgaugacuaccugcugagcaaugaggagcuggcacggagaguggagcagagggaccuaugcgagugaccuugagucaggguguggcugaagcaccuguccuagggagcuuaaacuaaggaggaaaugucguguccucccccccccacacacacacacacacacuguugggagcagcccucgggugggggugagguuugccaaaucuaggacaguuccaggcagcauuuuagggcagaauauucauuucccuaagcaagucuccacuucggguagcacuggaggagccuaugaaacugaggacaugcccuggguggugaguuguagaccgaaggccuucuucaccugccuggagccucucucucuagacucuucccaaagccuuucagauaaguaaauaccaaauucauuccuuuacgguguuguaaaugguuccucuacccuacaauaacagcagggggcagcauugcaacagacaaacaagacacuuugaccaaguauaaauagauuucccucacaguuaguuaugugaggaacaggagagaggagacuaggaucuacaaaacauucuugaagcugcucgucauccucuaggaugcuggccuuaaaaacaauguugcuugagccauuucuucaucaagaguuagaaaaacauuuucuccagggggaguuugggaagcaacgucuagccauagcuggcuguucccuccuagaugcuccaacuagcuuguaggcaagaacuucuaauaacugagguguuuaguacccuggugacagcucuuccuuagaggauucugcagucugugaacaacauuaccucuaagaauuagggagauggcuccguuggugaagugcuugcuaucaagcacugagacccgagugauucccagaacccauguaaaauagccagaugugguggugugcacuuggaaucccagcagagagguagacauaaacagaucuguggggaucacugcuuagcaagccaagucuaaugaugaguaccaggucauguaagaaacacuaucucaaaaaccaugguaaauggcauaaaaaaaaaaaaacaaaaa

SEQ ID NO: 9722 - RNA, 27805 nt, Mus musculus
cuguugccccucccccggggccgagccgccuggcgggaacgaccgcggugaggcgcgcggccgggcuccgcggcggcgcuucggggccaggugcuuccggcucccaccggacggaggcgggcugggccguggucucgcucggccgcggaagugugcuuuagcgcaccggaagccaccucgggggugagccauggcggguuugccagugagagacccugcgguggaucguucccugcgcuccgucuucggugagaggauuuuccgaggcgccucggcucggggagggacguccccugcggucccccgucuggagcggagcggguguccccggcgggcgggcucgcugcuguccuuuggcacugcagcccggcggacucguggacacacacgaucccccgcccccgccaucuccccggcuccggcuccggcuccacgguaccggagguuuugccgcaguguggcucagggagccagccucgagccggugucuucucuugcgguuucuuuuccccccuucaugauucucaguuauuuuuuaggagaaaaggugcguggaaacagagugucccuguuccgugcugcuucuccuaccccaaaauacagauuuuuauucugaauccaucgacccccauagccacuucccgcccucucauaaacguguuauguggcuugcuuuuuuuuacuugguuccauccaaccauagugguagcggccaccuggcaucuugagauggguugugaaugaaugaaugaaugaaugaaugauuaaaugauuaaagcgcagggcgauuucagaggagcgcaacuaagcaauucuuaggguuuaaaugaguuauuucuaagauacgugcauugcuuuuaaagcacguuugggggcaguagaauugcuucgaauucaaggccagccuagguuaccucacaagaccagccagagcuacauaacaagauucuuucucagaacaaaaaaauaacaagaaauaagcacuguuugaaagagacacgacaaaacggucucgucaucgugagggucuuaauuaagcacaggauaauuuuuaagcauccugugcuguauucacggcuuuuccuccauacguguguguguguguguguguguguguguguguguguguguauacaugaaaauaaggagacaauccccccacuguuaagggcuuugaggaaauaucaguguuuaaagauuuuacuuccagcacaguuagggacaaauaaaccuuuuauuugucauaucacuacgagaacuguuugaaagguaccuuuuuaaauguacucucuggcucauuucccuuguuauaagaucugaaaagagacaguggucgaggggggguuuggagaacgcuguucagucaguuauugccuauguguugaugcagauagaaagccuacuguucacuugcucgcucaagagcucaguuacugccccaaaauuuuaauacguugucucuucuuuagugggaaacaucccuuaugaagcuacugaagaacaacugaaggacauuuucucugagguugggccuguuguuaguuucaggugagauccucuuucaggagucuucauugugagagucuucaaaagcacaaauuuuggggguacaugcacaugcucgauacuucauauccagucuugccugaaagauuucuuucauuaaaaauguuuccgagccaagaaagcagucagagugggcuaaauaagacuauggcaguguuagcaggaagccugugugaguuccuaauacuugguuuuggucugcagauugguauacgauagggagacaggaaaaccaaagggcuauggcuucugcgaguaccaagaccaagagacagcacuuagugccaugcggaacuugaaugggcgugaauucagcgggagagcacuucgaguggauaaugcugccagugaaaagaacaaggaggaacugaagagugaguauaaggcccagccaugugcaucacaugagaguaaagaugggcgaguggaagcuuugcauuuuccgugauauuuuagaaggugcugagguaaugagcggaaugaauagcuucuuagaccugaggcaccugaaugagggguugacuauguuuaagaaacuuggcuguagugaucuuucuguuccuuaggaguuaauuuccaguguaagggacaugcagaucuacuaagccaucaguuauuucucuguguugcuagacuaguaacugguggggaauccucaagacauuuccacaaauacucuguugaaaugauagccuuugucgguuucagugcuuuucuucuggagugacuuauggaagaaguaaaugaugauauuaccaucacugucguagcuuuccacuaagaacagaagguagacccucacuuuccuucgcagaaagauuuuugaguggcucagcuccaaagaguuccaaguuauugguuggugcuuccagcagcccuaggaaauagauacuugaaaugacuuggguuguuacuugaccauccugacuuucuucuacuuucuuccuaaucaggccuuggcacuggugcaccugucauagagucaccuuauggagaaagcaucagcccugaggaugccccugaauccauuagcaaagcaguugccagucuuccaccagaacagauguuugaguugaugaaacaaaugaaggugggaggaggcauucgaguaucaacgaaaucauucgcaucagauuuucaaggaguuaauggauauaauucccugagcuuaaauaguugauacuguaggcaccauuucuuccacauuuuguacacuggguauuuuuauacauaaguggaccugcccaaaacagcuguuucugugucuucuguagguguuaaauuguagcguuuucccugagugauauuauuucaguauuacaaauaccuccucuucuugcugcugcugcugcuguuccuccucuuccucuucuucuucuucuuccuccuccuccuccuucuuucuugccuaaacugugcauucaaugucagaacagugcuaaaucaccagcauggugugaugugcuuguagucacacggcuugggaugcugaggcagaagggucacggugaauuaaaaaacagaaugggaagcaugagacacugucucacaaagcaacucaguaguaauucagaggggaugagauuuguagcauugaaccugaaggugaauuuucuuaucuucucagcucuguguccagaauaguccccaggaagcacgaaacauguugcuucagaauccacagcuggcuuaugcuuuguugcaagcacagguagugaugagaauuguggauccugagauugcgcuggugagugccucugguucuuguauagaacuagcaggguuaucuuugggauaggaacugccugauuggcuuguuaaacagacagcucauagaucuaucuuuucacuuuuuagaaaauucugcaucgccagacaaauaucccaacgcugauuucaggcaacccucagccaguucauguugcugggccuggcucaggacccaauguuucaaugaaccagcagaauccgcaggccccucaggcucaaucuuugguagggcuuuauuuugcacauuuuuuuuaucugucuuaaaauguuauuuucuuuccaggaaauuauugagagaagaaacagcaggaaucggagaugguaauuaaauuuucaggcauaaaagcaauuuccagauugcacagcacaugcuaccugaaagaauguagauucaguuccaagauaacaaaacagauccuugcuguaaacccuuuucuaauaagcuaauuuuugcagguguguuucucuaucacuguggugauuacuuccauaucuuauaugaaaucucauuuaguccucauagcagcaaaaugaggcaggcacucuuacugucuccauccucagcaguuacaaaggaaaaagcaacauguucaaaagcaugaguguaaugcugcagaccuacaaaacagaugcaucuaaaggugacauaugcagaagguacuucuaaauaaaaaaguacuuggucaugcucagagaugccgauugcucuaugauaagagcaaauauuggaaacguaggaaguguucaucaauggaaaauggagaaaauuuggaauaccuaucuaauggaaaacucuaaacaguuaagcaaacuacauguaugucaguagaaaugacuuuuagaaaccuaaugcuauacaacauuaaaguaggcuagaauaugugguaucaacacagauaacuuauaacacugugcagaaaguaaaacugcggaaacauuuuccauauggauguggauaucagcauaaauucucaaccuguuaagugaaauguaaaacuaguacaauauauaaugauaaaugcauuuuaaagauuuguuuuauuuuguguguaccuguugcaugccucacacugggcuugcagugugaggaugccagaaaagaaugucagauuuccugaaguuggaguuagaaaccauuuugguuccauguggaugcugggaacugaacccaagcccucugcaagagaagcagguguuuuucuaaacauugaggcaucucuccaguccaaaauauaaacauuuuaaacauguguaagaauucugaauagucauuuaaaaaguagaaaaaauauguuguaacugaagaaagccacacagauuguguuuauaucucuauuuuucagaacaaaaagccuauaaauuaguuuuuaaaaaaacccuaguaaacagaaaaaccuaucaaaaugaguagugggcauaaacugcucacaaaacugaaaauaaagcauccaaccucaauuggauaaacagauaugagcuaaaguaagccccauuuuuuaccucuuagaugggaagaaguaaauaauguggauuaauccaaugaaugguuuagggcaaggauuaguaaaccuucucuuaagaaauuuagauaauuaguguauuuggcuuuauaagccauaugaccucuguaacaugccacaauauguaaaaugugauuguauucuaguaaaaccuuacuuauaaagccacugagagaaacaggcaugguaguacaugccuauaaucucagcacuuagaagguaaaggcaggcagaucagaggucagggucauccuuggcuaccuagcaaaauugaaagcaguauaggcuauuugagacacugccuucgaaaacaggaaggcuggggccuacaaaauaguugagaaaguaaaggugcuugcuaucaaaccugacaaccugaguucaauccugggacccacguuguggaaggagagaauguauuacugcaaauuguccucaagugugccauuaguauacaaacauacacuagaaggauggcuagauggauggcucaguagauaacaguacuuggugccaagccugacaaacugaguucuaucuccaggagccacauagugggaaaaggaaacuuuauacaaguuguccucugagcuaugacuuccacaugcaugcugcuauguacaugcaaacacagcuugggaagggucucacuauauagcucuggauguccuggaucuuacuuuguaggccaggcagcccuuuuuacucagaggucuaccuaucugcuuccugagugcugggauuaaaggcaugugccacuuaugcuuaacuugaaaaaaacauuaacugguuacgaguuuagccaauuugguagugcuuaccuuuaauccuagcacuugaggggcaggggcaguuggauuucugaguuugaggccaaccuguucuaugcagaguucuaggacagccaggguuauauagaaagacccugugucagaaaauaaacaaccaaaagaagagaauuuagccaaugagcaauagucaucagcuccuguccuaaauaaguauuuuauagaaauggaaaauuaagacugaaaaugcaccugaucaaaaagcagaguaaguggcaaaccuuggaugugaacuuagucuaaucucauaaccuguuuuaaccacucccuggacaauuuccccuuuucucuuuuaguuuuguuuacaguaaacacaucugauuuuuaaaaauacucaaacaacuuguaguuguuauauuuuuaguuuuuguuguaaaccucuaaauugaaccuaggaggaaaauagugaugcacauagacagguuacacacuaaagcuucaaauguccacuggcggucuugaaaugugucugcagaaagcagggugcugcuacauuucacuucuccccucccaucaccacucacagugaggagguugggcgugagcaugugaaccaaucaugauuccuuuagauucaugcucuuuuggaccuucuaugucgcaguguacacagacggcagacaugcagaaagaguaggguccuacugaacuuagacucuaaacugauuugcuguuaaugcauuucauuguugggggacuguuuugauucuuuacaauucuuuacauuccaaagacaugcauaguucucuagggaaugccccaugaaaaaauuuuguucccuuucucucaggcaauuuaauuuaucauuaaaaaguucacuguugcacccaacaaaguuacacccaaggacagaaguuauuaaaacuugaacaaaugaaaauguuuuuucaucuuaaaaauauagaguacuagcaaaucuuuuggaagucucagucccuuuuguguccuggguauaaggcuuuuuuuuucucuuucucacccuuuauuuauucaguuuauaucccaguuacaacccccucucucuuccagucccgccucaccccguuccuucccccuggguaccaacccacccuggcacaucaagucacuauaagacauucuaaacuuaugguuaugcaccaauuagugaggucaagaauggguuauuugcugccuugccacauggacaaggcaugcuuaaccgucucuauauuaugcauauguucugucuugacugcacucacauaaacaggcucaagauacuacaauuugcuucuguggaauucaggaugugugauaaaacuaauguuacaauuaccaauauuaagagaaacuucaggcuauagacuaagugguuugagucucuacagagacaggcucauacuuguuuuucucuuggucaggguggaaugcaugucaauggcgcaccuccuaugaugcaagcuucuaugccagguggaguuccagccccagugcagauggcagcugcuguaggaggaccuggcccugguuccuuagccccugcagguaacuuggaauuagaguccuuacuauuuuguuaacuuugccgagguuuuacaguaguaacugcugaagugcagccaauuauuuagcaauaggaucuugguauaagaugaauguauagcuauagcaugcauucuaggcugaggaaacuagaugauuucuucuuguguauuguuuuuaagacaagguauugcucuguaccugggacuggacuggccucacacaugcaaucccccuaugugagguauccaagugcugggauuagaggcauaugccaccagucuuaacugaauaagcuuuuacgugcgagaaguaugcugcucacacacuuggaugucuuaacaguggcaaacugccauagacauuccuaaaaagcucuucucuguuucuguacuuccauugucaugaaauacuaacauacagguuauuggucaguaccuucucuggacauguugaauaacuuugaccucgugaauaaaaaacagcuguauaugcacauauucaggaacuaaugggaucaacaaguuccacaauuuagaaaaagccauacauuuuuuggcugcagaauacauuccccuacuccagaugaccauaggacccuuaaaaagaagacuacaugcuuagccauugguuaaauuuaacaaaauuugaggcaguggagauuuuuacagaucacauugucugauuuuaaaaaaauaaaauuagaaauaaguaauucacaggugaaugggaagaaaucuugccuuggaaaauuaaggaacauacuauagauagcuauuuaaagaggaaacaaaaauuauaaauuguauaaauuaaaacaacaaauacuuacauuucauacaaacaaguaugagaaauaauaaagguagugccuaaagaaacaaaaugaauauucuuaaauacacauauaauuuaaaaaggaauuccauauuaguucuaaguuaauuagaaaaauaauaaaccacaauacaccuaaaagaggaaauuaauguagaugagggguguagcucaguguuaaagcacuuguuuacaugugcaaaaagccccauguucagccccuaguacuggacacaaaaauauuguuaucaaaacaacauccuaccaaaaagagaaccaaaagacaaaaauugagcauaccauaaaauuuaacuaacuuucaaggaauguuuuggaauuuauaguauuuauauuugugaauucauuaaaacgucaugggguguccuacagagcucuuugaaaauugguaagaagagggaaaacaaccucuagagcagugcaggaagaaacuaauuucagagcuucacagcaaagcaaagccagauggccaacacagcagccucauuauaguaacaguaaaaugcuacuuccacuccucagugccaaguuucaaagaagaggacaauauuuguaaagaaauuuguacaugggcuggugagauggcucaguggguaagaucacagacugcucuuccgaagguucugaguucaauucccagcagccacaugguggcucacaaccaccugugaugagaucagaugcccucuuuugguguaugugaggacagcuacaguguacuuauuuauaguaauaaauaaaucuuuaaaaaaauguacuuuuacaucacuaguagaaauaggaagguuuucagccuuucaagaaaguggaauaaaaugaaagauuuauacguucugaccaccaguuccacuacuggggauuuagucaguacaaguuaaagguauuaugugacgauuucuuuauguggggaauuaugcucaugccuucugcugccuuuuccucagauccuaagccuuuguuuuguguugaugauuggucugcauuuaguggaauggaaugauuuagccagaagaagcuuugaaaucuuuuagcaguuguuuccgacuuuaaucuguguuagaaucaccugacgggccuguaaaauucagauugaaaguuucugcugccaaacuuaauuuaacgagucugagguucagaaccuuuaaauguucaggcuuugcaucuuucuguuguuguuauugauacugauguggcuugccuugcuggggaccgcuuucugaggacuacuguuuggaacaacguacucauuuuacagauaagaaagccaggaguauacaguuuauugagucucuugcucagaaucacagguauauaauacuguauauaauaaacugggguagcauccaguucuuugguuauuuauaacuuuagugccuagcauguucaaugagauagggacgaugugaucuguccuuuguauuuuaaggaaguauuaaugaacuacacccaaaucugcuuaccuuuugccccugugcagcagcauaucuaguuccuuugaggaaaagagaauuauugcuauguggaagggaccagacaaggauuuguggugugugauucuuuuuuauauaguagucaucauaccccaucugguuaguguagaccauaaguucucaacuccguuaaaucuagcauacccuuuuuguaacagguauuuugcaguagcuuuacuuuccugaaauguaaugcacagaugauucaacuuuuauaacaugacuacaaaagauuaguauaacgcccuaauuuuaauacauaauaaaaguaaaagaaaaucaacuuauuaaaaauuaauauguaaauguccagguaugguuagaacgcuaaguguaauagguguuugcaacuguccugugaguguaaaaacuaaaaauguagacagcuacagugauguuugcuuugguaauugaaacaccacaaggacuguugaugugguuuuccuaaauagugaaaaaucauaugaaaauucuuaaaacaaaucgcagucuccauaauuuacucaguaauuguauuucuggaaaagucagugaauauauacuaaaauagugcauauaacuucuguuuuuacaaaugaaacagacucggacucuagguugagauggcaacagacagcuuuuccuuuguaugaauguucaaugagacauuugaaaguuuuaucagacacaaaaucagccuugauuugggggaauuguauuauaguuuguagggcaccuaguaucacugacaccaucuuguucagugucaucuaugcccccaaagguuuugucauaacuaaauaauauacccauacauguauaaaauauccuaugaguaauacugccuuccacaagaagagccuuguagguaagagguguuauuuucuuuuauuaaagggcuuucugccacaguuuuggugauugugaugaaauacuccuucugaacucaccacuugucacugaagugugacauauacugacaggcuuuaucuucugcucauugcauuguucaaugguaguccucaccuuccaucacaguuuugucuuuguggggaaaagggaugacauuuguaaacucagccacuguuguuuuuucuacaggcccaauuuauguuuuuucccugccguuuauuuucuaggaguuaugcaagcccaaguuggaaugcaaggagcuggaccagugcccauggaacgaggacaagguaaauauuaauauagacuagacauggaaauguuucauaucugcacugucuagugugucagccacugaucacaguugcaauuuaaagauuaaguuaauuaaaauuaaguucauauuaaucauaaaagccuaaaacucugauuuccugggcacaaugauuauuacauuccaggugcccaguagccacaugugcuaaugaagaccacacuggacauugcagauguagaauguuucuauagucaccaaacuucuauugguccagacuuugcauaggagagccagcauacugauacgugaugaggcaaaugcauacuuuguuucaugauagucuaacaguuccacaggcauggucucucucaaucugugacuagcuauuuacuguguaagaaauuuaaauaaugagcauuuaguacaugaucaggucuguagaugacaagauguaaaucccauagcaaacugggaagaaagcagaggucuaucgaucauaguuguaaaguuucuccuguucugugguaaaaaaaaaacaauucuguauauaacagcagcagcccucccagaaucuuugcauucuuuccuccgguuauuguagcuugaaggaagaaaguacauuaguuccauuagaaaaugaaagacgauggaaggaaagggaccuggagauguacuauauauacucagucacuuccguuuucauagacagcccuuuggguuagguggcagugccuuaguuuuacagguaaagacauggaagcacaggaauuuuaaguuucucaguaggaugagguaaguauguacucacuucugaguauuggcagcuggaucuggugcucuucuuuuuaacuuaaagagugaaaucuccauagccaauaaucugccuccuuccuaucauucuauugccacuguuaauuucagaauuaauuuuuaaaauaaucuuguuauucauuaagugccuguguugggaucaaauugcuuuggacagaccaaaggggcuuaauauuuuucuucucagcugauucccuauaagaggaaacccauuucaaaagcacauaauaagauacaagcccaagauugguacauagggauuggugauugaaaugacaagucuaaacacaugagaugaaugacaagacaaacguguagcauaccucuuaucuucccuuuaaagucgcucauguuucugugcugcugcauacccccaucucacuauugucagacuagugcauggcgugucuaccucaggaucuuuguuaguagugaggagggcuuggacuuccauuaaucucuuccucuucccaggccaucagucuuaucagugaaccuuucagcuguuuaauacauacuucuacaagagaucucucuuccuacuuuagcuuagucccaucuuucugguaagaauuuacaaaagcaauuggcuuggauuuugaaaguauuucaaggaccuuuugaagcaaagacagagugagaugaauuuuaaaaaaauaauuuccuucagugccuagcagaggaaacaauguuuucauuugugaccagauuuguuuuccuucgccuggaauccuuguuggguuuguguguuuguaauggugacagauguuugagacagaacuugucccuuucccaucuccuucaguauugguuauaccuugucaacucauuagucuuugucaugguuuuuauaacuguagacugguuguaggagacuguuucuuucagagugauaaauacuuuuuuuccucaucugaaguucagcugcauuuuuccauuugauaguuuugauagaaaauuuuagaccuuaaaauaggacagauuaguauugcgucacuucuguuaugguugucugugauaaaucucacaugucacauucagugcaauuuguuuuguguuuugcuuuugaaaacauauuuuacuguuuucuuuuuaaaaaaaaauaaugguacaagaagagauuaggcaaaaugcuauaguaacaaaaagacuucaaaauuguugguuauucuugcgcaaguuaaccagccuauagguuucccuuaaagauaucugaggcuguugagauggcucacugguuuagaauacuggcugcucuuuuggagguccugacuuaauucucagcaaccacaugguggcucacaaccaucuauagagggaucugaugccgucuucugaccuguagguguacaugcagacagaacacaccuacauuuuuaaaaaaauuaaaaaauaaacaaaaauuuuaaaaagauuuuacaaagaaagaugucuagucaauguggagcuguucuggauaagagaaaggccuauuauaguuuagggaguuuuguagucuaggacaaaguaauugaacucuuggcuucuuacugacauguaaauuucuuaaucuccugucuccguguguguguguguguguguguguguguguguguguguguguguguguguguguguguguguguuuacguguguucaagcuauuuuaaguaucugcuauuucuccuuuugaacuuacugcucaccuaggaaccuuacagcacucgcccgugggacccgccgggccugcaucaauugagcgaguucaagguacccauuguaucugcggguucccuuuugcuugugguguucagggugggacguugaggggaaaagagcugcuuggcagugauccucacguucagaaccccaaaaggguaauaauguucuggggauuuuuuugguuuuuguuguuauuuuuguguuuuuuuuccucuugaggccacaagccuaagauugaccucuucacacagggcagagaacauggaugauaugggcaucuguccgaggcucuacucccucccuacuggugucaggaggcuuggauggaauugcagucuguaaggagacggcagguucuugcagagccaugacaguguucauaugccaagccccuaccucucuuuugugacucugguccuuaaacuaagauugguuagaaaaaaaaccaggaaguuucuugagauaacagugcuaguucuugacaggugcuccccaguuugcucuuuauguauaauuccauccauaccucugacaugguacagauucugccuacacccugcuucuguucuugagcugcaagaggauucugcuguggugagguuucacccacucuaagguguuugaauuacauugucagugguauaagagucauuucuuguucucuaaugugucuuucacagcaguaacuccccauuuguuucccugucagugccaaugcaagaccccagagcagcuaugcagcggggagccuugccuaccaacgucccaacuccucguggucuuuuaggugaugcucccaaugacccgcggggaggcacuuuaaugacuguaacuggagacguagaaccuagguaaguacuggcauagaaggaaacaacuugaaaaguugggaauucuccuuaccuuggaagcaacgucuuucuggaacaguuggaccuguuugccuucuucaaaagauaaaaaaaguauuuguagccacuguccaagacuaaggcuuuuuucuauaguguaauuauacauauaguuaagguaacuuugagccaaccaugacuacucuauauucagaaauugaaguuucuagucauacauaccuaaacaaggaaaacuuggaguaauggcaguacuaauaacgauaguuguugauguuggugaggauuugggcagauagagcucuuuccuauguaccuaacacagaucaucucauuaaaucugccuuaggcuagcaguguaacaccagugguagagcacuugucuaauaugcccaaggcccuaaguucaaucuacagccccacaaaguuagaaauggguauuaguaauccuguuuuacagguuaagaaauuaggcaucuagagguuaagucagugacccagaucaaagagcuaguaaaugaugagaccuggauuucaguauccagucugaauccagacccugcauugcuaagcacuauacuguauacucauugcauacacaauaacuauccauuaauucuucccuaacauugauugcccuggucaaaaagguucuagaaugcacaaauuuauguucaauagcuuuccuuuuaucuuaguuucuuguuaacauuuauuugcugauguuuguaucaguucucucucuguuggauguuugcuuacugaucuggcugaaauuucaaugucuguauauucugcuuuaaaauaugucauuuuucuccuaucucuagagcuuaccugggaccaccaccaccaccucaucagggcccacccaugcaccauguuccuggucaugaaggucguggaccgccuccacaugacaugagaggaggaccccuagcugagccgagaccuuuaauggcagaaccaagaggacccaugcuagaucagaggggcccaccucuggaugccagagguaaggggaaacugcaucacaaugccaaaugguagcuguggaucgaugaaguacuuaggucucuuuagcucuuauaugggacagaugucuuaacaagagucuccuacaaaucugauaaacuagaaagaagacagucuuauagaugaaggaagaugugacuagacguuaguaacuacacacagguuugcuugcaacuuucuagguggaagagauccccgaggauuagaugcacgggggauggaggccagagccauggaagcaagaggacuagaugccagaggacuggaagcccgugccauggaggcccgugccauggaggcccgugccauggaagcccgugccauggaagcccgugccauggaggcucgugccauggaggccagaggcauggacaccagaggcccaguaccuggaccuagaggaccuaugccuaguggaauccaaggucccaauccaaugaacaugggggcaguuguuccccagggauccagacagguaaugcuuguagcauauacauaaaaucuuaauguauucaagaauugguuacuaagccugauuuuguuuuaauuuuuguaagugauuuugguuugucuccccagugcagaguaaucucugagcucuacauuuucagguuuuucuaaaugaaauagcccccaaaacugaaaccuacagguucaugugagaagacaauacaaacaggccucagugacgccccuacccccagcccguccccugcgucucucaggccaguugaaaaccucuaccaggugauuccaaugugugacccugauuacagcauuugagcagcugcauauuggguguuuacguuacguucauaacaggagcaaaaucccaguuaugaaguagcaaugaaaauuuguggguggguccccacaaccugaggaaauauauuaaaggguugcagcauuaggaagguugagaaccacugauuaagaucaucucagggugacagaaaccuauguagauuucuugucaucacaacaucuaaaugaacagugacauagaaaaggcagucugcauuuauucuggagcugcaguuugucucuucuuugucucugucaguugguuugcuccaguugugccuaugggaugcuuuguaguagucauuuccucauuuaucaucucuaguugguugggggcauagaauauauguaucuuugcaagguucuauauguugaugccuucaucuuuucauuucuuuauuccuauuuucauguguuucuguuucuuccauuguauuggggguggggaggaaaaacauaucaaagcuagaaugcaacauguccagcauccaguucucucauuuuagagguuuagaagcugaaggucagaacgucaggugacuuggccagauucacuuaacaaaaaaaaugacagagcaagaaauacagcuugcuuuucuauuaugcaacucucuuauuauauuugcauguuauguauguauauagauguuugccugguccuuuuuaauuugagauaaaaaugugacuuuuucuugguauauauagaauaaaaauguauuuucuguuguauuucaaguuuugcuuuuuaaaaaauguuuguggguuuugauuuuuguugcacccucuauguucaauagccucaaaauacacauuuuuuguauauccuuucuguacauacuuccugaacaccaagcaguacuagggguaucauacuguaaauagcaaagucucaccauucugcuuacgugauucugcacaccacucuaugggaaaagacauugaaaaugguggccggugucuuguucuuuuauuuauugcuuuuuuaugcuaggguuuuggcuugauuuuuauaaugccaagacucaaaccuagagccucacagaugauaaauaaucuacuacugagcuauaaccccagcccaauauaguuuguauuaaaagucuauaaaaccaaguagauccaagguagagaauaauaagaacuuaauauuuauaguuuugguauuuuucaaaauuaauauauucacuuacaaauaaauauauaaauaaauacauauaaucuuuuauaaaagcuguauguuaggaaucucacuuccuccuguauaccucucauuugugauagauaauugcuucuauuagauuauuuuuucagacugaguuucuuuauguuguuggcugaccuggauuucauuauauauauugggcuggccuugaacgcaccaagaucugccugucucuggaguguuuggagauaaggcauacuccacaucuggcuuaucugauagauauuuuaaguauaucuucuacuuuuauccuauuuaugauuuuuggcuuuuaaaaaaaaaccuucauauggccuucauuuaucacuuuaaaucagacuuuaaacuucauucaaugcauuucgaagcuuguagcuuguuacauaauuugucuuacaaagaaagaugcauuugacagugaaagugcuauaacaauuuacucugagacaaaaacauaagcuaggacugucuuaggcuaaccaagguauauggccagucuugcugguaaugccuagaacagguacuccugggaacuuaacuaccuaguguuagguaauuauuucauacuagugucucagauugguacuaaucaguaauaguaaauucccaagugacuacucagagguaguucagaugcauaacagaucaauugacacaaaucucugaacuaaguauuaguauagguggaauaguggugauauuucuacaguauaaggauguaccacugcucaugugcccagugucuugggaaaaagcugaugcaugugaguauuucagguaucuuaguuacuguucuguugcugugaagagacacuauaacaaugacaacucuuauaaaacauuucacuaaaggcuugcuuacaguuucagaaguuaguccauuaucaccauagcagcagacauagcaggcaugaugcuacuggagaaguagguaagagcuauauccugaucugaaggcagagaaggagauacugggcuuaucaugggcuuuugaaaucucaaaguccacccccacacccccaccucuggugacaaacuuccuccaacaagcccagacuucauaaucuagaauaauacuauucccuggugacugagcauucaaauauaugagucuauagggaccauucauauucagaccaucacauuucacucccuggcccccauaggcuuguagcuauaucacgauacaaaacaaugcacucaauccaacuucaaaaguccuccuagucuauaauagucucaacacuguuccaaaguucaaagucucuucugaggcucauagcauucucuuaauuguaaacccuguaaaaucaaaaagcugaucacagacuuccaacauaaaauggcacagaauauacauuaccauuccaaaaaggaggaaagggaacauagcaaggaaacacuagaucaaagcaagaccuaaaaccagcagggcaaacuccaaacucuguauuuccaugucugaugucaaagugcuccagaucuccaaccuuucagcucuguugaauugcauuuuagcacuucucucuuuugggcuagauccgcucccucuuagcagcucuucuuggcagauauccuacaacucuggcaucuacaacaucuucgggucuccacugaaauugucuucaccuucacauuuucaugcaauggacucuaugccuccauacaggaacacccuugacacaugccgggccucagcagccuuccuuagcuuuggagggauauuagacaacuccuuuuuuguaucacugacucuaagccagagccacuuguggcagaaacugccaaguucaacugccuggugaagcuggaauuagacuccuuuguucacuuacauuugcaucagauuucuucuugaugguucccauuacugcuuaugccuuucuuuaauuccuuuucacaaguugaaacuuggcuaggcaggaucuuagccugaacuuaccaauccauuuauuccauuuagcaucaggcuuuucuuuaaacuuuuuaucuccuugaguacuggacuuaccuccauuauacuuccugaugcuauuuuugcucuuaaacuauacacuuuuuuccuugcucagcuugcuccuuuucauuauagauaugcauaagaguggccacuaauaacuacaugacacagucaauauuugacagucucaaaaucucuaccaaggccauucauccaaaacuguucaauuuagccuaaggcagauuugucuuagucaggguuucuauuccugcacaaacaucaugaccaagaagcaaguuggggaggaaaggguuuauuugguuuacacuuccauacugcuguucaucaccaaggaagucaggacuggaacucaagcaggucaggaagcaggagcugaugcagaggccauggagggauguacuaagagcuacagccugguccacaagcagaaagggagaugcugcucuuagcauaggcuuuuaaaaccucagaguccauccucagugacacacuuccuccaacaugccacacuuaauccuuucacauaguaucauucccuggugaccaagcauucaaauauccaaaccugugggggccauucuuauucaaaccaccacaucagguaaaagaacaauucuacaagaaguugcuugaacuaucuuagugggaaaacgauguauaugcugccuauuuucuuaaggaaaaugaaaacaauuuaaaucaucuuugauuguucacacucaccauggaaauagauuucauuauugucuguuauuauaugucagaguacucuccuguggguaucagcucccuuuauuaauggauugucaccugauucuucacaguguugccacaucaucuaguucuaacauguguuuuucuccauucuuucuauacuuugcugcuuguaaucugaggaaguaggugaaaagauuuuuaaaaauuuuguuugcaaaaaauaucuaaauucuggguaagagccugagugugagcaucauguuaaguguugagccuaacuaacaguuauaguagaugaauagaggcauuuucuuugaguuccaguuucuuccaaagguuggacucacuaccuaucuuaaaugccaacaaacaugcuauaguuggaugguguucuuuuacucgaguaauauuuuuucugcauuaagcaugaagcaauuguugucucuauagaaaaaaaaacagaaaaagaaaagaaaauaaaugucuggagagguagcucuguaguuaacagcacuuacuauuguacaaaaccuggguuugguucucagcacccacaugguggaucauaaccaucuauaaguccaguuccagaggauccaacacccuugucuagccuacauggaaacuaggcaugcagguggugcacuggcaaaaaaaaaaacuaauaaaaaugaauuuuuaaaaaaauauuacaccacuguuguguguucugagcacuuaaaaugauauucagggguuuggguuuguagguuuuuuuguuuuuuguuuguuuguuuguuuuuuaaggaaucucuaaaaagcaaauguugggcuaauaacauuuuuuccccagagaccuuccuaucuccuuucugccuuuccgacacugaccgucucugguuuaugggauagaauucuuugagaauagcuauuauuguaugauugagcuagagauaggccauggucuugugaaugcagcuucgccaguagagcaauauacaguuguuuaaaaucucuuagcuuuacuuauguuuccucugagcauuaauuucuccaguguucauaguuuucccugugcuuauugggcuaaguuuguuaauuugaugccccuuuccuguacuguguauuacuuguuaaugauguugggccuguuauaagcaaguaugugucuacuaguggaucuguggcuaaacacugccuucggcuggucuuuaaaucauucucuuuuuacucuugugucaagauuguucauuguauugagauuccuugaaugucaggaauucuguaugcucuuuccuuucuuuguacacauagguaccagucaugcagggagcaggcaugcaaggagcaagcaugcaagguggaagccagccugguggcuuuaguccuggacagagccaagucacaccccaggaucaugagaagguaagcaacacuauccgacugccucccugcacaccaaucuagucuuuuugaucuuuucgcaguuaccgugaagauccugggucuucaaaaucccuuuggaggugauguuuacucuaacuugguacucuuuaaugaauuuggcugagcauuuuggggaccugcuccuaaaguuuuuaagugaauauaacuggcaacuuauuuuauauuucagacucaucuaaaaauggcagauuuuuucugugcaagccaacugaccugaaaauccaagcuccuuucuguccccuccucuaccauuucuacccaauccguacagaaacaauagcagauugaccacaaguauaucuuucucuugcuagacuuggcuguuguugggagcuugugucugguggaaaggcuuaaaguugugaaagagggaaacucaaacuaggacucaaaacuuaagaguucccaaggcucgcaaauaccaucuuaaucuguaggaacuuugaguuccugagcugucuguuugcaucauguaaucuuagauauuuucauuuauucuuguguucuucauugugcuuuucuuaccagauuuucucuuucuuuuggccugcaguuuguuuuugugugugagaguaugcaauauccucccuuuucccauuuugcuucauaucccaugacaguagccuuuuggacagaagcuggugauguuuuuguuucauuugguuuucuggcucguccuggaaacucacaacucuccucuccucugcgcaggcugcuuugauuaugcagguccuucagcucacugcagaccagaucgccaugcugccuccugagcaaagacagaguauccuaaucuuaaaggaacagauacagaaauccacuggggcaccuugaaaggugagcggacggaauggcacccgggcaggacuaggugcuucuguauuugaagugauagcuucagccuuugacaacauuauguuccugagacccucagacuucauuagguucgcuuuacccuucaguagucaguaccccuggagauaggauaagccuauagaacauuugcucaguuguugaauuacuuacaaucuuuucagccuuauguaauagugaaaguauuaugucgguuuccuaaaaucagugacacaggaaugcagaaaguuaaaggaagggccagugagacagcuuagcaggugaaagugccaaaucucuugccaguucugaugaaaugaguuuggcccacagaaguuacaugguagaaacgagaaccgacucuucucaaucguccucugacacacagcucaugugcacccaaauauaauaaauacauguaacugaaagaaaaggaagaaagagggguugauaaaggugaaaggccugcucccugaauucucucucauaccccaauagaacucagcccuuguaaugaacauuugauggcucacuguuacaagccauuucauuucaaguuuagcuugugucauucuauaaccaguuguuuuccuccugaccuuuccuucaaaauagaggaaauacaaagcauuucaauaaaauguacucuuuaggcuucuaauauuuguucuguaauaauuuuguguaugugugagacugggucacuuauaacccagaccagccuugaucucacuauguagcuagugaugaccauaaacuugugaucuuccugauuccacuuuccgaguggugaugacaggcguacagugccacacucugcauuugagaucaaaccugggauccaugcguuugaggcauauucuauaccagcugagcuacaucucggcccuuguagcauuuugaugguucacuauuacaagccauuuaaaguaguaguugucccugucaccaucaguuucuaaagauuuauuucauguaugugaguacacuguagcugucuucagacacccagaagagggcaucagaucccauuacagaugguugugagccaccaugugguugcugggaauugaacucaggaccucuggaagagcagucagugcucuuacccgaugagccaucuguccagcccaaguuucuuuacaucauaaagaugacuguauacuaucauuauuuuucuuguucaucagucagguaaggaggauccaagugcacuugccaaauauauguaaucaugugaccaaacuugcuguguaaauauuguugugauuuuuaaaguauuucccagcaucuuuuuauauuguaaacaaugcuguucucugaaagcaauuuuaaauguauauugucccaguacuuguuguaaugucuuuuuggaacuuuuacuuaccuacaugucuuaaaauucccacgcacauguuaccauguaacagugaacucauuuaugauaauuggcggucuuacuaacuaugcuauaguucauacuuguaccuuuaaagcuuccaaacugcaaauaugcauguuauuuuacugagacuuuaaaugccugaacuauaauuggaucauaaaugguuagcuaacuagacauuuaguauauccuauuuuaccuuuuccccauauaucccaaacauuucauuuucuucauuaaaauauggauuauaauauucauagcaauuuacuuuuuuaaaauuaugucaaagaaggcauucuuugcaguacaagaaaauuacugguuuuagaaaguucuucauuguauacucucaauuaucucucauuugccuugcaaacugaccuuggggcaagauuuuacuuuuuuuucauuuuaaccucuugaaaugauuauaguuucauaggacauugggaaacuaauacaaagggccucguguuccuucucacagugauuccaucuuacacuuuuguuuuguaguauaaggccaggcagguguccuugguauauuacugugaacuagacugcagacaguauucaguuuuuacaacugugagggugguaauuuaucccaguggauguacaaacacaacugugauuuuaugugagccaacccucucuuggcauuuaugaacacuggcugaagcaguggcuuuucauccuaaacugacuugacuccuuuuuaucaucccagacaggguaaguuaccacuaugagagauaaguaguucuugaacuagagagauggcucgguuccuaaagugcuugggcauuuacccaguguacgcacuugaggaguacuugagcacccaaguucaaagccuagaaccaacaugaaaaguuggguguggugacacauucugguaaucuuggagggggagguggagacaggaacaucuuuggcacuuacugaccagcccgccuaaaccuaaucaguaagcccuagaccccaaugaaacagccagucucaaaaacccagguggauggucuuccuaaggaucauuaucacuugacguugacuuggaccucuggcuucugcccucauauauacaugcacacauaugagagagguaauuuugaaguaggggaaguuuaccuaucuaugguauauuugucaauuucauguuauggcaacuuuagaaagugguauagcacugucauuccauggguagagaucagagaugcuucuacacaucccguaaugauaccuaggcuaccucccucacuccuuacaagugagcacuuuguuugaauauguccauauaaugcuaagguugagaaacccugcugcaaaggaugauggggaaacaugacaagagucaggcaauggcuauuugaugguuggcacauccucucuucccuuagucccuuuuuguucuuggggggaugggggggguucuccugguguuuagaaaagagagguccacuaauagcuuucucccaaauuugucuuacagguucucaaaauagcuggcaacaaaucuggaaauguaauuccauaacauuuuugaaauuuugaaaacauaaugacgucugcauccgaaccuccccggaugaggcagauggcgccagguggaggucuuacaucgccauugcuccaaaggaaagcaguuuauucuguugucguaguguguauauuuucugugacauuaaauaaacuuugaacacaaguuuaacauacuacaaauugauauacauaauccuuuugcuuuuaagaagcuaacagcaaggauguaagcuuaacugugauuucuaacugcagcaucauucuuuaaucuuacauugccauagcucuauucuuacuuuagcauaagcauuuauucuucuuaaugauacuugagaauuucucagaaacaauguuuucaggaacuuugauuuuuguugaauuugcuuucaguaaaguaauaacacuuuaccccgugaaaacuuucuagagucucagagcuuucugggaggaaaacaaaaaagcacgugguuagaacuaaaaaugaucagaaggccaacaagggaagagcguaccacaacaguguguuugcuuccagaaaugccaguuauccaaguguguuguuuggucaguagcaggugugaacauacauaggacaaaggcugucguggcacugguuugcaaaagauugucguaaagcucuccugucuagguagcccgcuuuacaaguuuaaaaaggcacugguuuuccacauggucaaauuuaauaaagaaaaccaagugaacaaaauauauuccaaucuuucagaaaaucacaaagcuuucagcccugucaucuuaacuaaauccauuccaagaacuucaaacagaaaacccuaaaacuuugacauuuucaagucuuuaaagaggaccaaguauagagcaccggacggcaaacugcccguuaugguugccugcuucuuuccaaguccgaccaacuuggaaggcaauuagugccauuagccugugcuaaccugcagguugccuugccuuuuguucucccacaguggcauuaaggaggaacuugguuucucuccaccaguuugaccucaagacauuugaagaguugccuuaauaauuauuaaguuuacuagcacuaauuguaagcuuauuuguauucccagaucccuacccucugcauuaggauuaugggcaggugaauuaaaaucacuacuuaaggcauaaaaagcauaguaguacauugcuuauaugccaagaaaaagaaagcaaagauauuaaaauugaaggauuuuucuccauauauuuuuaaugaaaauuugcuggaucugucauauuauaaccugucaagaaaaguauaaaacaacaagcacuccugccugccuauuccacucaugcccaguucaaccccgauggauguuaauuaugcaugcacuucuuugucauuacccucugugccuccugcagaagcaguccuugcuguguugguuuuggcagcugucuugacuuaaaagcaccaauguauuuagaugcagagaccaagagcaaaguauuucuaguuaggaacuuggguuuuacacaaccaguuccaaaucaagauaagugaagcugaagugauuugggaaacaguugucuaguagaaaccauguccuggaaagccagcacauuuucccgaagccucaguaaacuuaauuugcuuagcaggcauucaggugacuaaguugacaagagcaguggcaucccaauucaucacuauggaaacacucaucagugguugguugguuuguuugcuguuauuuuuuacuguuguaauaauacaguuagcuaccccacguucaugaucugccuuuauuauguucaaaacuaaugacugaaaaauaaucccacaaauccuucaggcuguaaguuccuagauaauugaaaacaaaaauguguucacuuuugguuaauuaaugguacaaauuagauggucuagugcuaacucuauagauucauucugcuaaauguaugaggucaacugccugaguacagugaaguguggaguuuuuucucccugaagagccugcaccuuuuuguguaauucaccauaacuaacaucccagagccagcgugcuuauuguccugguugauaggaaaaaucaacauuuuuguaggaaaaagagugacauuuaguggaugauuccugauugaguaagaccuggaaaauagccaaaauuauaacuuuuuucuuuuuauaauacauucauuaacaaacuccuuuaacaacaacaaaaagcauaaaagagcuucaguucaauuaucucaugauguacgucaggccuuuccaguuauuccaaacaauacaaagugacaauauaguuggcuucuaacuauaguacaaauuugauuacaguuaauauacuuaagauauuacuaggaaauuguucaauaagcaaaaaggaaagucaauuauuuugacaaaguaacguguaaauuguuggucacacuggauuaacucauguaacaauguacuuagugggugauaugggagugggaagcuuggucguucuauguuguuuauuuaugauuguuguucugucguggauucaauaaauauuuuaaaagucacccuacuuagaaaucuuuugugagggacaagugggagggaagauuaucaagcaagacaccugauguuaaauugugcaagugucagccagcaaaauucagcuaaaggcagguucccaggauuuacagcccccccccccccaauaaaaaccaauucaug

SEQ ID NO: 9723 - RNA, 27805 nt, Mus musculus
caugaauugguuuuuauugggggggggggggcuguaaauccugggaaccugccuuuagcugaauuuugcuggcugacacuugcacaauuuaacaucaggugucuugcuugauaaucuucccucccacuugucccucacaaaagauuucuaaguagggugacuuuuaaaauauuuauugaauccacgacagaacaacaaucauaaauaaacaacauagaacgaccaagcuucccacucccauaucacccacuaaguacauuguuacaugaguuaauccagugugaccaacaauuuacacguuacuuugucaaaauaauugacuuuccuuuuugcuuauugaacaauuuccuaguaauaucuuaaguauauuaacuguaaucaaauuuguacuauaguuagaagccaacuauauugucacuuuguauuguuuggaauaacuggaaaggccugacguacaucaugagauaauugaacugaagcucuuuuaugcuuuuuguuguuguuaaaggaguuuguuaaugaauguauuauaaaaagaaaaaaguuauaauuuuggcuauuuuccaggucuuacucaaucaggaaucauccacuaaaugucacucuuuuuccuacaaaaauguugauuuuuccuaucaaccaggacaauaagcacgcuggcucugggauguuaguuauggugaauuacacaaaaaggugcaggcucuucagggagaaaaaacuccacacuucacuguacucaggcaguugaccucauacauuuagcagaaugaaucuauagaguuagcacuagaccaucuaauuuguaccauuaauuaaccaaaagugaacacauuuuuguuuucaauuaucuaggaacuuacagccugaaggauuugugggauuauuuuucagucauuaguuuugaacauaauaaaggcagaucaugaacgugggguagcuaacuguauuauuacaacaguaaaaaauaacagcaaacaaaccaaccaaccacugaugaguguuuccauagugaugaauugggaugccacugcucuugucaacuuagucaccugaaugccugcuaagcaaauuaaguuuacugaggcuucgggaaaaugugcuggcuuuccaggacaugguuucuacuagacaacuguuucccaaaucacuucagcuucacuuaucuugauuuggaacugguuguguaaaacccaaguuccuaacuagaaauacuuugcucuuggucucugcaucuaaauacauuggugcuuuuaagucaagacagcugccaaaaccaacacagcaaggacugcuucugcaggaggcacagaggguaaugacaaagaagugcaugcauaauuaacauccaucgggguugaacugggcaugaguggaauaggcaggcaggagugcuuguuguuuuauacuuuucuugacagguuauaauaugacagauccagcaaauuuucauuaaaaauauauggagaaaaauccuucaauuuuaauaucuuugcuuucuuuuucuuggcauauaagcaauguacuacuaugcuuuuuaugccuuaaguagugauuuuaauucaccugcccauaauccuaaugcagaggguagggaucugggaauacaaauaagcuuacaauuagugcuaguaaacuuaauaauuauuaaggcaacucuucaaaugucuugaggucaaacugguggagagaaaccaaguuccuccuuaaugccacugugggagaacaaaaggcaaggcaaccugcagguuagcacaggcuaauggcacuaauugccuuccaaguuggucggacuuggaaagaagcaggcaaccauaacgggcaguuugccguccggugcucuauacuugguccucuuuaaagacuugaaaaugucaaaguuuuaggguuuucuguuugaaguucuuggaauggauuuaguuaagaugacagggcugaaagcuuugugauuuucugaaagauuggaauauauuuuguucacuugguuuucuuuauuaaauuugaccauguggaaaaccagugccuuuuuaaacuuguaaagcgggcuaccuagacaggagagcuuuacgacaaucuuuugcaaaccagugccacgacagccuuuguccuauguauguucacaccugcuacugaccaaacaacacacuuggauaacuggcauuucuggaagcaaacacacuguugugguacgcucuucccuuguuggccuucugaucauuuuuaguucuaaccacgugcuuuuuuguuuuccucccagaaagcucugagacucuagaaaguuuucacgggguaaaguguuauuacuuuacugaaagcaaauucaacaaaaaucaaaguuccugaaaacauuguuucugagaaauucucaaguaucauuaagaagaauaaaugcuuaugcuaaaguaagaauagagcuauggcaauguaagauuaaagaaugaugcugcaguuagaaaucacaguuaagcuuacauccuugcuguuagcuucuuaaaagcaaaaggauuauguauaucaauuuguaguauguuaaacuuguguucaaaguuuauuuaaugucacagaaaauauacacacuacgacaacagaauaaacugcuuuccuuuggagcaauggcgauguaagaccuccaccuggcgccaucugccucauccggggagguucggaugcagacgucauuauguuuucaaaauuucaaaaauguuauggaauuacauuuccagauuuguugccagcuauuuugagaaccuguaagacaaauuugggagaaagcuauuaguggaccucucuuuucuaaacaccaggagaaccccccccauccccccaagaacaaaaagggacuaagggaagagaggaugugccaaccaucaaauagccauugccugacucuugucauguuuccccaucauccuuugcagcaggguuucucaaccuuagcauuauauggacauauucaaacaaagugcucacuuguaaggagugagggagguagccuagguaucauuacgggauguguagaagcaucucugaucucuacccauggaaugacagugcuauaccacuuucuaaaguugccauaacaugaaauugacaaauauaccauagauagguaaacuuccccuacuucaaaauuaccucucucauaugugugcauguauauaugagggcagaagccagagguccaagucaacgucaagugauaaugauccuuaggaagaccauccaccuggguuuuugagacuggcuguuucauuggggucuagggcuuacugauuagguuuaggcgggcuggucaguaagugccaaagauguuccugucuccaccucccccuccaagauuaccagaaugugucaccacacccaacuuuucauguugguucuaggcuuugaacuugggugcucaaguacuccucaagugcguacacuggguaaaugcccaagcacuuuaggaaccgagccaucucucuaguucaagaacuacuuaucucucauagugguaacuuacccugucugggaugauaaaaaggagucaagucaguuuaggaugaaaagccacugcuucagccaguguucauaaaugccaagagaggguuggcucacauaaaaucacaguuguguuuguacauccacugggauaaauuaccacccucacaguuguaaaaacugaauacugucugcagucuaguucacaguaauauaccaaggacaccugccuggccuuauacuacaaaacaaaaguguaagauggaaucacugugagaaggaacacgaggcccuuuguauuaguuucccaauguccuaugaaacuauaaucauuucaagagguuaaaaugaaaaaaaaguaaaaucuugccccaaggucaguuugcaaggcaaaugagagauaauugagaguauacaaugaagaacuuucuaaaaccaguaauuuucuuguacugcaaagaaugccuucuuugacauaauuuuaaaaaaguaaauugcuaugaauauuauaauccauauuuuaaugaagaaaaugaaauguuugggauauauggggaaaagguaaaauaggauauacuaaaugucuaguuagcuaaccauuuaugauccaauuauaguucaggcauuuaaagucucaguaaaauaacaugcauauuugcaguuuggaagcuuuaaagguacaaguaugaacuauagcauaguuaguaagaccgccaauuaucauaaaugaguucacuguuacaugguaacaugugcgugggaauuuuaagacauguagguaaguaaaaguuccaaaaagacauuacaacaaguacugggacaauauacauuuaaaauugcuuucagagaacagcauuguuuacaauauaaaaagaugcugggaaauacuuuaaaaaucacaacaauauuuacacagcaaguuuggucacaugauuacauauauuuggcaagugcacuuggauccuccuuaccugacugaugaacaagaaaaauaaugauaguauacagucaucuuuaugauguaaagaaacuugggcuggacagauggcucaucggguaagagcacugacugcucuuccagagguccugaguucaauucccagcaaccacaugguggcucacaaccaucuguaaugggaucugaugcccucuucugggugucugaagacagcuacaguguacucacauacaugaaauaaaucuuuagaaacugauggugacagggacaacuacuacuuuaaauggcuuguaauagugaaccaucaaaaugcuacaagggccgagauguagcucagcugguauagaauaugccucaaacgcauggaucccagguuugaucucaaaugcagaguguggcacuguacgccugucaucaccacucggaaaguggaaucaggaagaucacaaguuuauggucaucacuagcuacauagugagaucaaggcuggucuggguuauaagugacccagucucacacauacacaaaauuauuacagaacaaauauuagaagccuaaagaguacauuuuauugaaaugcuuuguauuuccucuauuuugaaggaaaggucaggaggaaaacaacugguuauagaaugacacaagcuaaacuugaaaugaaauggcuuguaacagugagccaucaaauguucauuacaagggcugaguucuauugggguaugagagagaauucagggagcaggccuuucaccuuuaucaaccccucuuucuuccuuuucuuucaguuacauguauuuauuauauuugggugcacaugagcugugugucagaggacgauugagaagagucgguucucguuucuaccauguaacuucugugggccaaacucauuucaucagaacuggcaagagauuuggcacuuucaccugcuaagcugucucacuggcccuuccuuuaacuuucugcauuccugugucacugauuuuaggaaaccgacauaauacuuucacuauuacauaaggcugaaaagauuguaaguaauucaacaacugagcaaauguucuauaggcuuauccuaucuccagggguacugacuacugaaggguaaagcgaaccuaaugaagucugagggucucaggaacauaauguugucaaaggcugaagcuaucacuucaaauacagaagcaccuaguccugcccgggugccauuccguccgcucaccuuucaaggugccccaguggauuucuguaucuguuccuuuaagauuaggauacucugucuuugcucaggaggcagcauggcgaucuggucugcagugagcugaaggaccugcauaaucaaagcagccugcgcagaggagaggagaguugugaguuuccaggacgagccagaaaaccaaaugaaacaaaaacaucaccagcuucuguccaaaaggcuacugucaugggauaugaagcaaaaugggaaaagggaggauauugcauacucucacacacaaaaacaaacugcaggccaaaagaaagagaaaaucugguaagaaaagcacaaugaagaacacaagaauaaaugaaaauaucuaagauuacaugaugcaaacagacagcucaggaacucaaaguuccuacagauuaagaugguauuugcgagccuugggaacucuuaaguuuugaguccuaguuugaguuucccucuuucacaacuuuaagccuuuccaccagacacaagcucccaacaacagccaagucuagcaagagaaagauauacuuguggucaaucugcuauuguuucuguacggauuggguagaaaugguagaggaggggacagaaaggagcuuggauuuucaggucaguuggcuugcacagaaaaaaucugccauuuuuagaugagucugaaauauaaaauaaguugccaguuauauucacuuaaaaacuuuaggagcagguccccaaaaugcucagccaaauucauuaaagaguaccaaguuagaguaaacaucaccuccaaagggauuuugaagacccaggaucuucacgguaacugcgaaaagaucaaaaagacuagauuggugugcagggaggcagucggauaguguugcuuaccuucucaugauccuggggugugacuuggcucuguccaggacuaaagccaccaggcuggcuuccaccuugcaugcuugcuccuugcaugccugcucccugcaugacugguaccuauguguacaaagaaaggaaagagcauacagaauuccugacauucaaggaaucucaauacaaugaacaaucuugacacaagaguaaaaagagaaugauuuaaagaccagccgaaggcaguguuuagccacagauccacuaguagacacauacuugcuuauaacaggcccaacaucauuaacaaguaauacacaguacaggaaaggggcaucaaauuaacaaacuuagcccaauaagcacagggaaaacuaugaacacuggagaaauuaaugcucagaggaaacauaaguaaagcuaagagauuuuaaacaacuguauauugcucuacuggcgaagcugcauucacaagaccauggccuaucucuagcucaaucauacaauaauagcuauucucaaagaauucuaucccauaaaccagagacggucagugucggaaaggcagaaaggagauaggaaggucucuggggaaaaaauguuauuagcccaacauuugcuuuuuagagauuccuuaaaaaacaaacaaacaaacaaaaaacaaaaaaaccuacaaacccaaaccccugaauaucauuuuaagugcucagaacacacaacagugguguaauauuuuuuuaaaaauucauuuuuauuaguuuuuuuuuuugccagugcaccaccugcaugccuaguuuccauguaggcuagacaaggguguuggauccucuggaacuggacuuauagaugguuaugauccaccaugugggugcugagaaccaaacccagguuuuguacaauaguaagugcuguuaacuacagagcuaccucuccagacauuuauuuucuuuucuuuuucuguuuuuuuuucuauagagacaacaauugcuucaugcuuaaugcagaaaaaauauuacucgaguaaaagaacaccauccaacuauagcauguuuguuggcauuuaagauagguagugaguccaaccuuuggaagaaacuggaacucaaagaaaaugccucuauucaucuacuauaacuguuaguuaggcucaacacuuaacaugaugcucacacucaggcucuuacccagaauuuagauauuuuuugcaaacaaaauuuuuaaaaaucuuuucaccuacuuccucagauuacaagcagcaaaguauagaaagaauggagaaaaacacauguuagaacuagaugauguggcaacacugugaagaaucaggugacaauccauuaauaaagggagcugauacccacaggagaguacucugacauauaauaacagacaauaaugaaaucuauuuccauggugagugugaacaaucaaagaugauuuaaauuguuuucauuuuccuuaagaaaauaggcagcauauacaucguuuucccacuaagauaguucaagcaacuucuuguagaauuguucuuuuaccugauguggugguuugaauaagaauggcccccacagguuuggauauuugaaugcuuggucaccagggaaugauacuaugugaaaggauuaaguguggcauguuggaggaagugugucacugaggauggacucugagguuuuaaaagccuaugcuaagagcagcaucucccuuucugcuuguggaccaggcuguagcucuuaguacaucccuccauggccucugcaucagcuccugcuuccugaccugcuugaguuccaguccugacuuccuuggugaugaacagcaguauggaaguguaaaccaaauaaacccuuuccuccccaacuugcuucuuggucaugauguuugugcaggaauagaaacccugacuaagacaaaucugccuuaggcuaaauugaacaguuuuggaugaauggccuugguagagauuuugagacugucaaauauugacugugucauguaguuauuaguggccacucuuaugcauaucuauaaugaaaaggagcaagcugagcaaggaaaaaaguguauaguuuaagagcaaaaauagcaucaggaaguauaauggagguaaguccaguacucaaggagauaaaaaguuuaaagaaaagccugaugcuaaauggaauaaauggauugguaaguucaggcuaagauccugccuagccaaguuucaacuugugaaaaggaauuaaagaaaggcauaagcaguaaugggaaccaucaagaagaaaucugaugcaaauguaagugaacaaaggagucuaauuccagcuucaccaggcaguugaacuuggcaguuucugccacaaguggcucuggcuuagagucagugauacaaaaaaggaguugucuaauaucccuccaaagcuaaggaaggcugcugaggcccggcaugugucaaggguguuccuguauggaggcauagaguccauugcaugaaaaugugaaggugaagacaauuucaguggagacccgaagauguuguagaugccagaguuguaggauaucugccaagaagagcugcuaagagggagcggaucuagcccaaaagagagaagugcuaaaaugcaauucaacagagcugaaagguuggagaucuggagcacuuugacaucagacauggaaauacagaguuuggaguuugcccugcugguuuuaggucuugcuuugaucuaguguuuccuugcuauguucccuuuccuccuuuuuggaaugguaauguauauucugugccauuuuauguuggaagucugugaucagcuuuuugauuuuacaggguuuacaauuaagagaaugcuaugagccucagaagagacuuugaacuuuggaacaguguugagacuauuauagacuaggaggacuuuugaaguuggauugagugcauuguuuuguaucgugauauagcuacaagccuaugggggccagggagugaaaugugauggucugaauaugaauggucccuauagacucauauauuugaaugcucagucaccagggaauaguauuauucuagauuaugaagucugggcuuguuggaggaaguuugucaccagagguggggguguggggguggacuuugagauuucaaaagcccaugauaagcccaguaucuccuucucugccuucagaucaggauauagcucuuaccuacuucuccaguagcaucaugccugcuaugucugcugcuauggugauaauggacuaacuucugaaacuguaagcaagccuuuagugaaauguuuuauaagaguugucauuguuauagugucucuucacagcaacagaacaguaacuaagauaccugaaauacucacaugcaucagcuuuuucccaagacacugggcacaugagcagugguacauccuuauacuguagaaauaucaccacuauuccaccuauacuaauacuuaguucagagauuugugucaauugaucuguuaugcaucugaacuaccucugaguagucacuugggaauuuacuauuacugauuaguaccaaucugagacacuaguaugaaauaauuaccuaacacuagguaguuaaguucccaggaguaccuguucuaggcauuaccagcaagacuggccauauaccuugguuagccuaagacaguccuagcuuauguuuuugucucagaguaaauuguuauagcacuuucacugucaaaugcaucuuucuuuguaagacaaauuauguaacaagcuacaagcuucgaaaugcauugaaugaaguuuaaagucugauuuaaagugauaaaugaaggccauaugaagguuuuuuuuuaaaagccaaaaaucauaaauaggauaaaaguagaagauauacuuaaaauaucuaucagauaagccagauguggaguaugccuuaucuccaaacacuccagagacaggcagaucuuggugcguucaaggccagcccaauauauauaaugaaauccaggucagccaacaacauaaagaaacucagucugaaaaaauaaucuaauagaagcaauuaucuaucacaaaugagagguauacaggaggaagugagauuccuaacauacagcuuuuauaaaagauuauauguauuuauuuauauauuuauuuguaagugaauauauuaauuuugaaaaauaccaaaacuauaaauauuaaguucuuauuauucucuaccuuggaucuacuugguuuuauagacuuuuaauacaaacuauauugggcugggguuauagcucaguaguagauuauuuaucaucugugaggcucuagguuugagucuuggcauuauaaaaaucaagccaaaacccuagcauaaaaaagcaauaaauaaaagaacaagacaccggccaccauuuucaaugucuuuucccauagaguggugugcagaaucacguaagcagaauggugagacuuugcuauuuacaguaugauaccccuaguacugcuugguguucaggaaguauguacagaaaggauauacaaaaaauguguauuuugaggcuauugaacauagagggugcaacaaaaaucaaaacccacaaacauuuuuuaaaaagcaaaacuugaaauacaacagaaaauacauuuuuauucuauauauaccaagaaaaagucacauuuuuaucucaaauuaaaaaggaccaggcaaacaucuauauacauacauaacaugcaaauauaauaagagaguugcauaauagaaaagcaagcuguauuucuugcucugucauuuuuuuuguuaagugaaucuggccaagucaccugacguucugaccuucagcuucuaaaccucuaaaaugagagaacuggaugcuggacauguugcauucuagcuuugauauguuuuuccuccccacccccaauacaauggaagaaacagaaacacaugaaaauaggaauaaagaaaugaaaagaugaaggcaucaacauauagaaccuugcaaagauacauauauucuaugcccccaaccaacuagagaugauaaaugaggaaaugacuacuacaaagcaucccauaggcacaacuggagcaaaccaacugacagagacaaagaagagacaaacugcagcuccagaauaaaugcagacugccuuuucuaugucacuguucauuuagauguugugaugacaagaaaucuacauagguuucugucacccugagaugaucuuaaucagugguucucaaccuuccuaaugcugcaacccuuuaauauauuuccucagguuguggggacccacccacaaauuuucauugcuacuucauaacugggauuuugcuccuguuaugaacguaacguaaacacccaauaugcagcugcucaaaugcuguaaucagggucacacauuggaaucaccugguagagguuuucaacuggccugagagacgcaggggacgggcuggggguaggggcgucacugaggccuguuuguauugucuucucacaugaaccuguagguuucaguuuugggggcuauuucauuuagaaaaaccugaaaauguagagcucagagauuacucugcacuggggagacaaaccaaaaucacuuacaaaaauuaaaacaaaaucaggcuuaguaaccaauucuugaauacauuaagauuuuauguauaugcuacaagcauuaccugucuggaucccuggggaacaacugcccccauguucauuggauugggaccuuggauuccacuaggcauagguccucuagguccagguacugggccucugguguccaugccucuggccuccauggcacgagccuccauggcacgggcuuccauggcacgggcuuccauggcacgggccuccauggcacgggccuccauggcacgggcuuccaguccucuggcaucuaguccucuugcuuccauggcucuggccuccaucccccgugcaucuaauccucggggaucucuuccaccuagaaaguugcaagcaaaccuguguguaguuacuaacgucuagucacaucuuccuucaucuauaagacugucuucuuucuaguuuaucagauuuguaggagacucuuguuaagacaucugucccauauaagagcuaaagagaccuaaguacuucaucgauccacagcuaccauuuggcauugugaugcaguuuccccuuaccucuggcauccagaggugggccccucugaucuagcauggguccucuugguucugccauuaaaggucucggcucagcuagggguccuccucucaugucauguggaggcgguccacgaccuucaugaccaggaacauggugcaugggugggcccugaugaggugguggugguggucccagguaagcucuagagauaggagaaaaaugacauauuuuaaagcagaauauacagacauugaaauuucagccagaucaguaagcaaacauccaacagagagagaacugauacaaacaucagcaaauaaauguuaacaagaaacuaagauaaaaggaaagcuauugaacauaaauuugugcauucuagaaccuuuuugaccagggcaaucaauguuagggaagaauuaauggauaguuauuguguaugcaaugaguauacaguauagugcuuagcaaugcagggucuggauucagacuggauacugaaauccaggucucaucauuuacuagcucuuugaucugggucacugacuuaaccucuagaugccuaauuucuuaaccuguaaaacaggauuacuaauacccauuucuaacuuuguggggcuguagauugaacuuagggccuugggcauauuagacaagugcucuaccacugguguuacacugcuagccuaaggcagauuuaaugagaugaucuguguuagguacauaggaaagagcucuaucugcccaaauccucaccaacaucaacaacuaucguuauuaguacugccauuacuccaaguuuuccuuguuuagguauguaugacuagaaacuucaauuucugaauauagaguagucaugguuggcucaaaguuaccuuaacuauauguauaauuacacuauagaaaaaagccuuagucuuggacaguggcuacaaauacuuuuuuuaucuuuugaagaaggcaaacagguccaacuguuccagaaagacguugcuuccaagguaaggagaauucccaacuuuucaaguuguuuccuucuaugccaguacuuaccuagguucuacgucuccaguuacagucauuaaagugccuccccgcgggucauugggagcaucaccuaaaagaccacgaggaguugggacguugguaggcaaggcuccccgcugcauagcugcucuggggucuugcauuggcacugacagggaaacaaauggggaguuacugcugugaaagacacauuagagaacaagaaaugacucuuauaccacugacaauguaauucaaacaccuuagagugggugaaaccucaccacagcagaauccucuugcagcucaagaacagaagcaggguguaggcagaaucuguaccaugucagagguauggauggaauuauacauaaagagcaaacuggggagcaccugucaagaacuagcacuguuaucucaagaaacuuccugguuuuuuuucuaaccaaucuuaguuuaaggaccagagucacaaaagagagguaggggcuuggcauaugaacacugucauggcucugcaagaaccugccgucuccuuacagacugcaauuccauccaagccuccugacaccaguagggagggaguagagccucggacagaugcccauaucauccauguucucugcccugugugaagaggucaaucuuaggcuuguggccucaagaggaaaaaaaacacaaaaauaacaacaaaaaccaaaaaaauccccagaacauuauuacccuuuugggguucugaacgugaggaucacugccaagcagcucuuuuccccucaacgucccacccugaacaccacaagcaaaagggaacccgcagauacaauggguaccuugaacucgcucaauugaugcaggcccggcgggucccacgggcgagugcuguaagguuccuaggugagcaguaaguucaaaaggagaaauagcagauacuuaaaauagcuugaacacacguaaacacacacacacacacacacacacacacacacacacacacacacacacacacacacacacacacggagacaggagauuaagaaauuuacaugucaguaagaagccaagaguucaauuacuuuguccuagacuacaaaacucccuaaacuauaauaggccuuucucuuauccagaacagcuccacauugacuagacaucuuucuuuguaaaaucuuuuuaaaauuuuuguuuauuuuuuaauuuuuuuaaaaauguagguguguucugucugcauguacaccuacaggucagaagacggcaucagaucccucuauagaugguugugagccaccaugugguugcugagaauuaagucaggaccuccaaaagagcagccaguauucuaaaccagugagccaucucaacagccucagauaucuuuaagggaaaccuauaggcugguuaacuugcgcaagaauaaccaacaauuuugaagucuuuuuguuacuauagcauuuugccuaaucucuucuuguaccauuauuuuuuuuuaaaaagaaaacaguaaaauauguuuucaaaagcaaaacacaaaacaaauugcacugaaugugacaugugagauuuaucacagacaaccauaacagaagugacgcaauacuaaucuguccuauuuuaaggucuaaaauuuucuaucaaaacuaucaaauggaaaaaugcagcugaacuucagaugaggaaaaaaaguauuuaucacucugaaagaaacagucuccuacaaccagucuacaguuauaaaaaccaugacaaagacuaaugaguugacaagguauaaccaauacugaaggagaugggaaagggacaaguucugucucaaacaucugucaccauuacaaacacacaaacccaacaaggauuccaggcgaaggaaaacaaaucuggucacaaaugaaaacauuguuuccucugcuaggcacugaaggaaauuauuuuuuuaaaauucaucucacucugucuuugcuucaaaagguccuugaaauacuuucaaaauccaagccaauugcuuuuguaaauucuuaccagaaagaugggacuaagcuaaaguaggaagagagaucucuuguagaaguauguauuaaacagcugaaagguucacugauaagacugauggccugggaagaggaagagauuaauggaaguccaagcccuccucacuacuaacaaagauccugagguagacacgccaugcacuagucugacaauagugagauggggguaugcagcagcacagaaacaugagcgacuuuaaagggaagauaagagguaugcuacacguuugucuugucauucaucucauguguuuagacuugucauuucaaucaccaaucccuauguaccaaucuugggcuuguaucuuauuaugugcuuuugaaauggguuuccucuuauagggaaucagcugagaagaaaaauauuaagccccuuuggucuguccaaagcaauuugaucccaacacaggcacuuaaugaauaacaagauuauuuuaaaaauuaauucugaaauuaacaguggcaauagaaugauaggaaggaggcagauuauuggcuauggagauuucacucuuuaaguuaaaaagaagagcaccagauccagcugccaauacucagaagugaguacauacuuaccucauccuacugagaaacuuaaaauuccugugcuuccaugucuuuaccuguaaaacuaaggcacugccaccuaacccaaagggcugucuaugaaaacggaagugacugaguauauauaguacaucuccaggucccuuuccuuccaucgucuuucauuuucuaauggaacuaauguacuuucuuccuucaagcuacaauaaccggaggaaagaaugcaaagauucugggagggcugcugcuguuauauacagaauuguuuuuuuuuuaccacagaacaggagaaacuuuacaacuaugaucgauagaccucugcuuucuucccaguuugcuaugggauuuacaucuugucaucuacagaccugaucauguacuaaaugcucauuauuuaaauuucuuacacaguaaauagcuagucacagauugagagagaccaugccuguggaacuguuagacuaucaugaaacaaaguaugcauuugccucaucacguaucaguaugcuggcucuccuaugcaaagucuggaccaauagaaguuuggugacuauagaaacauucuacaucugcaauguccaguguggucuucauuagcacauguggcuacugggcaccuggaauguaauaaucauugugcccaggaaaucagaguuuuaggcuuuuaugauuaauaugaacuuaauuuuaauuaacuuaaucuuuaaauugcaacugugaucaguggcugacacacuagacagugcagauaugaaacauuuccaugucuagucuauauuaauauuuaccuuguccucguuccaugggcacugguccagcuccuugcauuccaacuugggcuugcauaacuccuagaaaauaaacggcagggaaaaaacauaaauugggccuguagaaaaaacaacaguggcugaguuuacaaaugucaucccuuuuccccacaaagacaaaacugugauggaaggugaggacuaccauugaacaaugcaaugagcagaagauaaagccugucaguauaugucacacuucagugacaaguggugaguucagaaggaguauuucaucacaaucaccaaaacuguggcagaaagcccuuuaauaaaagaaaauaacaccucuuaccuacaaggcucuucuuguggaaggcaguauuacucauaggauauuuuauacauguauggguauauuauuuaguuaugacaaaaccuuugggggcauagaugacacugaacaagauggugucagugauacuaggugcccuacaaacuauaauacaauucccccaaaucaaggcugauuuugugucugauaaaacuuucaaaugucucauugaacauucauacaaaggaaaagcugucuguugccaucucaaccuagaguccgagucuguuucauuuguaaaaacagaaguuauaugcacuauuuuaguauauauucacugacuuuuccagaaauacaauuacugaguaaauuauggagacugcgauuuguuuuaagaauuuucauaugauuuuucacuauuuaggaaaaccacaucaacaguccuugugguguuucaauuaccaaagcaaacaucacuguagcugucuacauuuuuaguuuuuacacucacaggacaguugcaaacaccuauuacacuuagcguucuaaccauaccuggacauuuacauauuaauuuuuaauaaguugauuuucuuuuacuuuuauuauguauuaaaauuagggcguuauacuaaucuuuuguagucauguuauaaaaguugaaucaucugugcauuacauuucaggaaaguaaagcuacugcaaaauaccuguuacaaaaaggguaugcuagauuuaacggaguugagaacuuauggucuacacuaaccagaugggguaugaugacuacuauauaaaaaagaaucacacaccacaaauccuugucuggucccuuccacauagcaauaauucucuuuuccucaaaggaacuagauaugcugcugcacaggggcaaaagguaagcagauuuggguguaguucauuaauacuuccuuaaaauacaaaggacagaucacaucgucccuaucucauugaacaugcuaggcacuaaaguuauaaauaaccaaagaacuggaugcuaccccaguuuauuauauacaguauuauauaccugugauucugagcaagagacucaauaaacuguauacuccuggcuuucuuaucuguaaaaugaguacguuguuccaaacaguaguccucagaaagcgguccccagcaaggcaagccacaucaguaucaauaacaacaacagaaagaugcaaagccugaacauuuaaagguucugaaccucagacucguuaaauuaaguuuggcagcagaaacuuucaaucugaauuuuacaggcccgucaggugauucuaacacagauuaaagucggaaacaacugcuaaaagauuucaaagcuucuucuggcuaaaucauuccauuccacuaaaugcagaccaaucaucaacacaaaacaaaggcuuaggaucugaggaaaaggcagcagaaggcaugagcauaauuccccacauaaagaaaucgucacauaauaccuuuaacuuguacugacuaaauccccaguaguggaacugguggucagaacguauaaaucuuucauuuuauuccacuuucuugaaaggcugaaaaccuuccuauuucuacuagugauguaaaaguacauuuuuuuaaagauuuauuuauuacuauaaauaaguacacuguagcuguccucacauacaccaaaagagggcaucugaucucaucacaggugguugugagccaccauguggcugcugggaauugaacucagaaccuucggaagagcagucugugaucuuacccacugagccaucucaccagcccauguacaaauuucuuuacaaauauuguccucuucuuugaaacuuggcacugaggaguggaaguagcauuuuacuguuacuauaaugaggcugcuguguuggccaucuggcuuugcuuugcugugaagcucugaaauuaguuucuuccugcacugcucuagagguuguuuucccucuucuuaccaauuuucaaagagcucuguaggacaccccaugacguuuuaaugaauucacaaauauaaauacuauaaauuccaaaacauuccuugaaaguuaguuaaauuuuaugguaugcucaauuuuugucuuuugguucucuuuuugguaggauguuguuuugauaacaauauuuuuguguccaguacuaggggcugaacauggggcuuuuugcacauguaaacaagugcuuuaacacugagcuacaccccucaucuacauuaauuuccucuuuuagguguauugugguuuauuauuuuucuaauuaacuuagaacuaauauggaauuccuuuuuaaauuauauguguauuuaagaauauucauuuuguuucuuuaggcacuaccuuuauuauuucucauacuuguuuguaugaaauguaaguauuuguuguuuuaauuuauacaauuuauaauuuuuguuuccucuuuaaauagcuaucuauaguauguuccuuaauuuuccaaggcaagauuucuucccauucaccugugaauuacuuauuucuaauuuuauuuuuuuaaaaucagacaaugugaucuguaaaaaucuccacugccucaaauuuuguuaaauuuaaccaauggcuaagcauguagucuucuuuuuaaggguccuauggucaucuggaguaggggaauguauucugcagccaaaaaauguauggcuuuuucuaaauuguggaacuuguugaucccauuaguuccugaauaugugcauauacagcuguuuuuuauucacgaggucaaaguuauucaacauguccagagaagguacugaccaauaaccuguauguuaguauuucaugacaauggaaguacagaaacagagaagagcuuuuuaggaaugucuauggcaguuugccacuguuaagacauccaagugugugagcagcauacuucucgcacguaaaagcuuauucaguuaagacugguggcauaugccucuaaucccagcacuuggauaccucacauagggggauugcaugugugaggccaguccagucccagguacagagcaauaccuugucuuaaaaacaauacacaagaagaaaucaucuaguuuccucagccuagaaugcaugcuauagcuauacauucaucuuauaccaagauccuauugcuaaauaauuggcugcacuucagcaguuacuacuguaaaaccucggcaaaguuaacaaaauaguaaggacucuaauuccaaguuaccugcaggggcuaaggaaccagggccagguccuccuacagcagcugccaucugcacuggggcuggaacuccaccuggcauagaagcuugcaucauaggaggugcgccauugacaugcauuccacccugaccaagagaaaaacaaguaugagccugucucuguagagacucaaaccacuuagucuauagccugaaguuucucuuaauauugguaauuguaacauuaguuuuaucacacauccugaauuccacagaagcaaauuguaguaucuugagccuguuuaugugagugcagucaagacagaacauaugcauaauauagagacgguuaagcaugccuuguccauguggcaaggcagcaaauaacccauucuugaccucacuaauuggugcauaaccauaaguuuagaaugucuuauagugacuugaugugccaggguggguugguacccagggggaaggaacggggugaggcgggacuggaagagagaggggguuguaacugggauauaaacugaauaaauaaagggugagaaagagaaaaaaaaagccuuauacccaggacacaaaagggacugagacuuccaaaagauuugcuaguacucuauauuuuuaagaugaaaaaacauuuucauuuguucaaguuuuaauaacuucuguccuuggguguaacuuuguugggugcaacagugaacuuuuuaaugauaaauuaaauugccugagagaaagggaacaaaauuuuuucauggggcauucccuagagaacuaugcaugucuuuggaauguaaagaauuguaaagaaucaaaacagucccccaacaaugaaaugcauuaacagcaaaucaguuuagagucuaaguucaguaggacccuacucuuucugcaugucugccgucuguguacacugcgacauagaagguccaaaagagcaugaaucuaaaggaaucaugauugguucacaugcucacgcccaaccuccucacugugaguggugaugggaggggagaagugaaauguagcagcacccugcuuucugcagacacauuucaagaccgccaguggacauuugaagcuuuaguguguaaccugucuaugugcaucacuauuuuccuccuagguucaauuuagagguuuacaacaaaaacuaaaaauauaacaacuacaaguuguuugaguauuuuuaaaaaucagauguguuuacuguaaacaaaacuaaaagagaaaaggggaaauuguccagggagugguuaaaacagguuaugagauuagacuaaguucacauccaagguuugccacuuacucugcuuuuugaucaggugcauuuucagucuuaauuuuccauuucuauaaaauacuuauuuaggacaggagcugaugacuauugcucauuggcuaaauucucuucuuuugguuguuuauuuucugacacagggucuuucuauauaacccuggcuguccuagaacucugcauagaacagguuggccucaaacucagaaauccaacugccccugccccucaagugcuaggauuaaagguaagcacuaccaaauuggcuaaacucguaaccaguuaauguuuuuuucaaguuaagcauaaguggcacaugccuuuaaucccagcacucaggaagcagauagguagaccucugaguaaaaagggcugccuggccuacaaaguaagauccaggacauccagagcuauauagugagacccuucccaagcuguguuugcauguacauagcagcaugcauguggaagucauagcucagaggacaacuuguauaaaguuuccuuuucccacuauguggcuccuggagauagaacucaguuugucaggcuuggcaccaaguacuguuaucuacugagccauccaucuagccauccuucuaguguauguuuguauacuaauggcacacuugaggacaauuugcaguaauacauucucuccuuccacaacgugggucccaggauugaacucagguugucagguuugauagcaagcaccuuuacuuucucaacuauuuuguaggccccagccuuccuguuuucgaaggcagugucucaaauagccuauacugcuuucaauuuugcuagguagccaaggaugacccugaccucugaucugccugccuuuaccuucuaagugcugagauuauaggcauguacuaccaugccuguuucucucaguggcuuuauaaguaagguuuuacuagaauacaaucacauuuuacauauuguggcauguuacagaggucauauggcuuauaaagccaaauacacuaauuaucuaaauuucuuaagagaagguuuacuaauccuugcccuaaaccauucauuggauuaauccacauuauuuacuucuucccaucuaagagguaaaaaauggggcuuacuuuagcucauaucuguuuauccaauugagguuggaugcuuuauuuucaguuuugugagcaguuuaugcccacuacucauuuugauagguuuuucuguuuacuaggguuuuuuuaaaaacuaauuuauaggcuuuuuguucugaaaaauagagauauaaacacaaucuguguggcuuucuucaguuacaacauauuuuuucuacuuuuuaaaugacuauucagaauucuuacacauguuuaaaauguuuauauuuuggacuggagagaugccucaauguuuagaaaaacaccugcuucucuugcagagggcuuggguucaguucccagcauccacauggaaccaaaaugguuucuaacuccaacuucaggaaaucugacauucuuuucuggcauccucacacugcaagcccagugugaggcaugcaacagguacacacaaaauaaaacaaaucuuuaaaaugcauuuaucauuauauauuguacuaguuuuacauuucacuuaacagguugagaauuuaugcugauauccacauccauauggaaaauguuuccgcaguuuuacuuucugcacaguguuauaaguuaucuguguugauaccacauauucuagccuacuuuaauguuguauagcauuagguuucuaaaagucauuucuacugacauacauguaguuugcuuaacuguuuagaguuuuccauuagauagguauuccaaauuuucuccauuuuccauugaugaacacuuccuacguuuccaauauuugcucuuaucauagagcaaucggcaucucugagcaugaccaaguacuuuuuuauuuagaaguaccuucugcauaugucaccuuuagaugcaucuguuuuguaggucugcagcauuacacucaugcuuuugaacauguugcuuuuuccuuuguaacugcugaggauggagacaguaagagugccugccucauuuugcugcuaugaggacuaaaugagauuucauauaagauauggaaguaaucaccacagugauagagaaacacaccugcaaaaauuagcuuauuagaaaaggguuuacagcaaggaucuguuuuguuaucuuggaacugaaucuacauucuuucagguagcaugugcugugcaaucuggaaauugcuuuuaugccugaaaauuuaauuaccaucuccgauuccugcuguuucuucucucaauaauuuccuggaaagaaaauaacauuuuaagacagauaaaaaaaaugugcaaaauaaagcccuaccaaagauugagccugaggggccugcggauucugcugguucauugaaacauuggguccugagccaggcccagcaacaugaacuggcugaggguugccugaaaucagcguugggauauuugucuggcgaugcagaauuuucuaaaaagugaaaagauagaucuaugagcugucuguuuaacaagccaaucaggcaguuccuaucccaaagauaacccugcuaguucuauacaagaaccagaggcacucaccagcgcaaucucaggauccacaauucucaucacuaccugugcuugcaacaaagcauaagccagcuguggauucugaagcaacauguuucgugcuuccuggggacuauucuggacacagagcugagaagauaagaaaauucaccuucagguucaaugcuacaaaucucauccccucugaauuacuacugaguugcuuugugagacagugucucaugcuucccauucuguuuuuuaauucaccgugacccuucugccucagcaucccaagccgugugacuacaagcacaucacaccaugcuggugauuuagcacuguucugacauugaaugcacaguuuaggcaagaaagaaggaggaggaggaggaagaagaagaagaagaggaagaggaggaacagcagcagcagcagcaagaagaggagguauuuguaauacugaaauaauaucacucagggaaaacgcuacaauuuaacaccuacagaagacacagaaacagcuguuuugggcagguccacuuauguauaaaaauacccaguguacaaaauguggaagaaauggugccuacaguaucaacuauuuaagcucagggaauuauauccauuaacuccuugaaaaucugaugcgaaugauuucguugauacucgaaugccuccucccaccuucauuuguuucaucaacucaaacaucuguucugguggaagacuggcaacugcuuugcuaauggauucaggggcauccucagggcugaugcuuucuccauaaggugacucuaugacaggugcaccagugccaaggccugauuaggaagaaaguagaagaaagucaggauggucaaguaacaacccaagucauuucaaguaucuauuuccuagggcugcuggaagcaccaaccaauaacuuggaacucuuuggagcugagccacucaaaaaucuuucugcgaaggaaagugagggucuaccuucuguucuuaguggaaagcuacgacagugaugguaauaucaucauuuacuucuuccauaagucacuccagaagaaaagcacugaaaccgacaaaggcuaucauuucaacagaguauuuguggaaaugucuugaggauuccccaccaguuacuagucuagcaacacagagaaauaacugauggcuuaguagaucugcaugucccuuacacuggaaauuaacuccuaaggaacagaaagaucacuacagccaaguuucuuaaacauagucaaccccucauucaggugccucaggucuaagaagcuauucauuccgcucauuaccucagcaccuucuaaaauaucacggaaaaugcaaagcuuccacucgcccaucuuuacucucaugugaugcacauggcugggccuuauacucacucuucaguuccuccuuguucuuuucacuggcagcauuauccacucgaagugcucucccgcugaauucacgcccauucaaguuccgcauggcacuaagugcugucucuuggucuugguacucgcagaagccauagcccuuugguuuuccugucucccuaucguauaccaaucugcagaccaaaaccaaguauuaggaacucacacaggcuuccugcuaacacugccauagucuuauuuagcccacucugacugcuuucuuggcucggaaacauuuuuaaugaaagaaaucuuucaggcaagacuggauaugaaguaucgagcaugugcauguacccccaaaauuugugcuuuugaagacucucacaaugaagacuccugaaagaggaucucaccugaaacuaacaacaggcccaaccucagagaaaauguccuucaguuguucuucaguagcuucauaagggauguuucccacuaaagaagagacaacguauuaaaauuuuggggcaguaacugagcucuugagcgagcaagugaacaguaggcuuucuaucugcaucaacacauaggcaauaacugacugaacagcguucuccaaacccccccucgaccacugucucuuuucagaucuuauaacaagggaaaugagccagagaguacauuuaaaaagguaccuuucaaacaguucucguagugauaugacaaauaaaagguuuauuugucccuaacugugcuggaaguaaaaucuuuaaacacugauauuuccucaaagcccuuaacaguggggggauugucuccuuauuuucauguauacacacacacacacacacacacacacacacacacacacacguauggaggaaaagccgugaauacagcacaggaugcuuaaaaauuauccugugcuuaauuaagacccucacgaugacgagaccguuuugucgugucucuuucaaacagugcuuauuucuuguuauuuuuuuguucugagaaagaaucuuguuauguagcucuggcuggucuugugagguaaccuaggcuggccuugaauucgaagcaauucuacugcccccaaacgugcuuuaaaagcaaugcacguaucuuagaaauaacucauuuaaacccuaagaauugcuuaguugcgcuccucugaaaucgcccugcgcuuuaaucauuuaaucauucauucauucauucauucauucacaacccaucucaagaugccagguggccgcuaccacuaugguuggauggaaccaaguaaaaaaaagcaagccacauaacacguuuaugagagggcgggaaguggcuaugggggucgauggauucagaauaaaaaucuguauuuugggguaggagaagcagcacggaacagggacacucuguuuccacgcaccuuuucuccuaaaaaauaacugagaaucaugaaggggggaaaagaaaccgcaagagaagacaccggcucgaggcuggcucccugagccacacugcggcaaaaccuccgguaccguggagccggagccggagccggggagauggcgggggcgggggaucguguguguccacgaguccgccgggcugcagugccaaaggacagcagcgagcccgcccgccggggacacccgcuccgcuccagacgggggaccgcaggggacgucccuccccgagccgaggcgccucggaaaauccucucaccgaagacggagcgcagggaacgauccaccgcagggucucucacuggcaaacccgccauggcucacccccgagguggcuuccggugcgcuaaagcacacuuccgcggccgagcgagaccacggcccagcccgccuccguccggugggagccggaagcaccuggccccgaagcgccgccgcggagcccggccgcgcgccucaccgcggucguucccgccaggcggcucggccccgggggaggggcaacag

SEQ ID NO: 9724 - RNA, 4625 nt, Mus musculus
ucuucgucacaacauugaucuugcgagcuuuuauuucagugaccaaaagaaugcaguuaauggaaucgaugucuaccaucaggcaugcaccucuaccugaaacaguuguuaguucugaacuggccuaagucgcgguuucuuuaggcacaucugugaauguuuugcaucuggauauacauaguaaguuaacuucuucucguggcugucugguaauaagaauaguacucaugagcuagauucuuuuaugacuaaagcccuuuggauucucaggcuuccucuucuaccuugagaccauauuuucaauuugcgaguuaaguaagucacaguauaggggagagacaaccuaagaaguuggauugcaggaacacuccauaggacuuuuuuucagcuccaggucagacaugaaagaaagcucacaguuaaacagugccaggaucuuuccccacugccaauuugacugacacaaagaucucccuaaaaaaaucagaaaugaacccauacaaaucaagauuuacccuauguggucccacuaucaaauucuagaaagcaguccaccuaucaaaauuauuuuauaaagcaguaaagggaccuugagaaagcagucccauauacaguuauaugcaucucacacuuucauuuaucugucaauuauugucacaugguuagcuuuaaaaacacaaccaaauacacaugacucucaacucccauacauaaaaauuggucuuuguucauucucaggugacaagaugucccaagacgauaaagaaaauugggaguuuaaucccccccauagccauuucuucaaccaccucaucagcagcucuucaauucuugaacuacuuuuccaaagagguaaugcugagaucagucagaaaggcuuucugagaagacggguuuggacuucugggucuguuccagucgauuuaagaugaacuggcuuguaucaaugaagcguucaacgcaguucacaaaacaggccucagcccgacuguccaacuuaggcccaggcuuauccaugcacuucuccuguucagaacaagaaacagagucaccaaggguccuucgcuuauagaaauaauucugccuaaaucaucugauggguuaaugcauuuggaccuguuuucucucaccuguggcaucuaguuuaaaacuguauguuucuguauguguauguguguaaggggggggggggagagaaagaaagagagauguaacuagaaagaagacuaugauagaaagaagugaaaggaaagcaagaaauacaugugcuaaaacaacacauacaccaugaugaagcccaugguuuguuuguuuuuuaugcugaccaaaaaaauuaauauaaaaauuuucacauuuggcaccuuaccacuuguuaagcaauuagacauaggcuuacauuccaaagcaaggcaauggaauacacaccauuaucgguccucgucugauuaugcgggaacucuggcagaguuugcucaugggggccagaaaaugccauaccuuacaugaaagagaaaagcagcaaaaaugcacaagaaauaaccuuuuuauagcacuugggaggcaaaagcagguggaucugacugaguucaagaccaguccggaccacagacaaacccugucucgaugcccuccccccacaaaaaaaaaaaacaccuuuuuucuagauuaggcuguaacucuacacacaacaaugcugacauuaaaugccuuuaaaugaacuguuaaagaaaaugauuacgagauaaaucaguuaggugccccaacucaaacaaagaaaaucuacauacuaaccuucaguaagucguuuauuuaaagugguguugacugucuuuagagacaaggucucacuauguaggguuagacagccuggaaauugugaucccuuugucuugcuuccaacaguucccaguucggggacugauuacccuacucaacacaccaaagguucuugaaucuccucaggagaaaugaaaagcuaauguucucugaggaaggcucuguauuucagcuuuuaaaaaaaugcgcugggcgugguggcgcacgccuuuaaucccagcacucgggaggcagaggcagguggauuucugaguucaaggccagccuggucuacagagugaguuccaggacagccagggccacacagagaaacccugucucgaaaaaccaaaauaaauaaauaaauaaauacuaaaaaaaaaugcuucaacaauuuccuacauguauaugaucuacuuugagcauauucaccguuauauucucaaguccuguccuuuccuucuccccaguuccucggucuacuguuguccuuuaguguccacugaaucuuaguccggguugcuugcuugaguguacauguagagcuccuuuauuacagcaugagaaacuuacucauggcuauaacauugggaaaaaaauaaaucccucucuucuagcucauuccuguuuuaaaggaucuauuauuuauuuauaugaguacacuguagcugucuucagacacaccagaagaggaggucagaucccaguacagaugguugugagccaccaugugguugcugggauuugaacucaggaccucuggaagucaguacacuucuagcucauucuuuuauggcuuuucuuuuuaauauuuuuuuaaagauuuauuuauuuauuuauuauauguaaguacacuguagcugucuucagacacuccagaagagggcagcagauuucguuacggaugguugugagccaccaugugguuaccuucggaagagcagucggcgcucuuaaccacugagccaucucgccagcccccuuuuauggcuuuucaagauagaguuucucugcaucguccuggcuauccuggaacccacucuguagaccugccgcaggaguucccgccaguauaccugaaccagccuggccucgaacucaagggacagaccugccucugcugggauuaaaggcaaguaccaccaucaauccuuaacagccaucaucacacccaacucccacucaaauauaaugaaccaaagacuuuuagaaaaagaaucuauccugucuugauggcggcagaggcaggaggaucucuacauuccgagacagguagggggugaagaggaaagcccugucucuaaagauacauuuuuaaaaggauuuuucaaaagcuggaggugauggugaaugacuguaaacuggguacuugaaagguaugggaagcaggaagaugaggaauucaaggucauuuucagcuauucuaagccaucuauucaguaugaugccagccugaaauacaggaaaccuuggagggagugagggagggagggagggacagagagagagagagagagagagagagagagagagagagagagagagagagagagagagagcgccagccucugauccggaggcagaccagaagagcacagcaauauguaaguuuacagggaaaggaccaaaaagcaaugucuguauauaguuugaagcuucuagaauaaauuuuguucaugguucucuccuuuuauacacaaugcuuaagagucucuccaauuccaaugaauauuauccuuggccuguaaaauccuuuaaguuuuuaugucgguggagggcagugugcugcccuuggcaacaagaacacuuugaucucagcuacaaacaaacgccucugccccuuugccaaaguccccucucggagcagacucaauuucucaaccuucaaaccuuaauggcuuggucuuacacaacacgacgacucacggcgaaggcaacuaauauauguguguuaggagagauuaugccacuuuuauacuuaaugagacagagccgcuugucauuucaucagaaggguuauaucuggguaaucuaggcaaaucccgaggaguccagaaauaagucacagacucgcugggauucggccucccuaaaauuccaggauuggggauucugaucaguucuaguggccagcacuaaacaacuucaaccucaggugccucagagcgcugggugggacagcaguguaagugugacucccaauccgcugcaccuagggucucccugaggagucacuguagugccucccggcucggcucggcucggcauaaggaaucuaagaacccgggguacaaucaagaccuccucccacucuggagagccccacuuccuagcaaguccucugggugcaagggcacgggaaaaguaggcacagcguccggaucugagucccgagcucacccagcaaaguuccgucaucuggugcaccagcugcuggaagcgcugcuucugcgucuccaccucgaugaaaugcugcaacugaggguccacggcgcccagagccgagcccgaagaggacguggaggacuccaucccggcacgaccacgcgggccgaggcgagcacugaagcgacuugccgaccuucacgugucugggugacggaaccggaacuacaaccucccccgccccccgcccccgccggggaccgcccugugagcucaccgcgucggcgcggggcugcuguccccgccggcucugcccgcuccccucgagccgcugcgcuccgcaguccccgcgagcggaaucggcuccccgcagcaacaccgcgguaacgcccggcccgugggagcgaaacuccaaaaagaaaaga

SEQ ID NO: 9725 - RNA, 4625 nt, Mus musculus
ucuuuucuuuuuggaguuucgcucccacgggccgggcguuaccgcgguguugcugcggggagccgauuccgcucgcggggacugcggagcgcagcggcucgaggggagcgggcagagccggcggggacagcagccccgcgccgacgcggugagcucacagggcgguccccggcgggggcggggggcgggggagguuguaguuccgguuccgucacccagacacgugaaggucggcaagucgcuucagugcucgccucggcccgcguggucgugccgggauggaguccuccacguccucuucgggcucggcucugggcgccguggacccucaguugcagcauuucaucgagguggagacgcagaagcagcgcuuccagcagcuggugcaccagaugacggaacuuugcugggugagcucgggacucagauccggacgcugugccuacuuuucccgugcccuugcacccagaggacuugcuaggaaguggggcucuccagagugggaggaggucuugauuguaccccggguucuuagauuccuuaugccgagccgagccgagccgggaggcacuacagugacuccucagggagacccuaggugcagcggauugggagucacacuuacacugcugucccacccagcgcucugaggcaccugagguugaaguuguuuagugcuggccacuagaacugaucagaauccccaauccuggaauuuuagggaggccgaaucccagcgagucugugacuuauuucuggacuccucgggauuugccuagauuacccagauauaacccuucugaugaaaugacaagcggcucugucucauuaaguauaaaaguggcauaaucucuccuaacacacauauauuaguugccuucgccgugagucgucguguuguguaagaccaagccauuaagguuugaagguugagaaauugagucugcuccgagaggggacuuuggcaaaggggcagaggcguuuguuuguagcugagaucaaaguguucuuguugccaagggcagcacacugcccuccaccgacauaaaaacuuaaaggauuuuacaggccaaggauaauauucauuggaauuggagagacucuuaagcauuguguauaaaaggagagaaccaugaacaaaauuuauucuagaagcuucaaacuauauacagacauugcuuuuugguccuuucccuguaaacuuacauauugcugugcucuucuggucugccuccggaucagaggcuggcgcucucucucucucucucucucucucucucucucucucucucucucucucucucucucucugucccucccucccucccucacucccuccaagguuuccuguauuucaggcuggcaucauacugaauagauggcuuagaauagcugaaaaugaccuugaauuccucaucuuccugcuucccauaccuuucaaguacccaguuuacagucauucaccaucaccuccagcuuuugaaaaauccuuuuaaaaauguaucuuuagagacagggcuuuccucuucacccccuaccugucucggaauguagagauccuccugccucugccgccaucaagacaggauagauucuuuuucuaaaagucuuugguucauuauauuugagugggaguugggugugaugauggcuguuaaggauugauggugguacuugccuuuaaucccagcagaggcaggucugucccuugaguucgaggccaggcugguucagguauacuggcgggaacuccugcggcaggucuacagaguggguuccaggauagccaggacgaugcagagaaacucuaucuugaaaagccauaaaagggggcuggcgagauggcucagugguuaagagcgccgacugcucuuccgaagguaaccacaugguggcucacaaccauccguaacgaaaucugcugcccucuucuggagugucugaagacagcuacaguguacuuacauauaauaaauaaauaaauaaaucuuuaaaaaaauauuaaaaagaaaagccauaaaagaaugagcuagaaguguacugacuuccagagguccugaguucaaaucccagcaaccacaugguggcucacaaccaucuguacugggaucugaccuccucuucuggugugucugaagacagcuacaguguacucauauaaauaaauaauagauccuuuaaaacaggaaugagcuagaagagagggauuuauuuuuuucccaauguuauagccaugaguaaguuucucaugcuguaauaaaggagcucuacauguacacucaagcaagcaacccggacuaagauucaguggacacuaaaggacaacaguagaccgaggaacuggggagaaggaaaggacaggacuugagaauauaacggugaauaugcucaaaguagaucauauacauguaggaaauuguugaagcauuuuuuuuuaguauuuauuuauuuauuuauuuugguuuuucgagacaggguuucucuguguggcccuggcuguccuggaacucacucuguagaccaggcuggccuugaacucagaaauccaccugccucugccucccgagugcugggauuaaaggcgugcgccaccacgcccagcgcauuuuuuuaaaagcugaaauacagagccuuccucagagaacauuagcuuuucauuucuccugaggagauucaagaaccuuugguguguugaguaggguaaucaguccccgaacugggaacuguuggaagcaagacaaagggaucacaauuuccaggcugucuaacccuacauagugagaccuugucucuaaagacagucaacaccacuuuaaauaaacgacuuacugaagguuaguauguagauuuucuuuguuugaguuggggcaccuaacugauuuaucucguaaucauuuucuuuaacaguucauuuaaaggcauuuaaugucagcauuguuguguguagaguuacagccuaaucuagaaaaaagguguuuuuuuuuuuuguggggggagggcaucgagacaggguuugucugugguccggacuggucuugaacucagucagauccaccugcuuuugccucccaagugcuauaaaaagguuauuucuugugcauuuuugcugcuuuucucuuucauguaagguauggcauuuucuggcccccaugagcaaacucugccagaguucccgcauaaucagacgaggaccgauaaugguguguauuccauugccuugcuuuggaauguaagccuaugucuaauugcuuaacaagugguaaggugccaaaugugaaaauuuuuauauuaauuuuuuuggucagcauaaaaaacaaacaaaccaugggcuucaucaugguguauguguuguuuuagcacauguauuucuugcuuuccuuucacuucuuucuaucauagucuucuuucuaguuacaucucucuuucuuucucuccccccccccccuuacacacauacacauacagaaacauacaguuuuaaacuagaugccacaggugagagaaaacagguccaaaugcauuaacccaucagaugauuuaggcagaauuauuucuauaagcgaaggacccuuggugacucuguuucuuguucugaacaggagaagugcauggauaagccugggccuaaguuggacagucgggcugaggccuguuuugugaacugcguugaacgcuucauugauacaagccaguucaucuuaaaucgacuggaacagacccagaaguccaaacccgucuucucagaaagccuuucugacugaucucagcauuaccucuuuggaaaaguaguucaagaauugaagagcugcugaugaggugguugaagaaauggcuaugggggggauuaaacucccaauuuucuuuaucgucuugggacaucuugucaccugagaaugaacaaagaccaauuuuuauguaugggaguugagagucauguguauuugguuguguuuuuaaagcuaaccaugugacaauaauugacagauaaaugaaagugugagaugcauauaacuguauaugggacugcuuucucaaggucccuuuacugcuuuauaaaauaauuuugauagguggacugcuuucuagaauuugauagugggaccacauaggguaaaucuugauuuguauggguucauuucugauuuuuuuagggagaucuuugugucagucaaauuggcaguggggaaagauccuggcacuguuuaacugugagcuuucuuucaugucugaccuggagcugaaaaaaaguccuauggaguguuccugcaauccaacuucuuagguugucucuccccuauacugugacuuacuuaacucgcaaauugaaaauauggucucaagguagaagaggaagccugagaauccaaagggcuuuagucauaaaagaaucuagcucaugaguacuauucuuauuaccagacagccacgagaagaaguuaacuuacuauguauauccagaugcaaaacauucacagaugugccuaaagaaaccgcgacuuaggccaguucagaacuaacaacuguuucagguagaggugcaugccugaugguagacaucgauuccauuaacugcauucuuuuggucacugaaauaaaagcucgcaagaucaauguugugacgaaga

SEQ ID NO: 9726 - RNA, 49461 nt, Mus musculus
guuuuuuuuguuuuuuuuuguuuuuuuuuucgagacaggguuucucuguguagucuuggcuggccuggaacucacucuguaggccaggcuggccucgaacucagaaaucugccugccucugccucccaagugcugggauuaaaggcaugagccaccacugcccggccucaguauucuuaagaauaauaacugcuaugaacugcuaaaguacauuuaauaaguuaaaacagcaugagugauauaauuauauggaucuaacuucauuugccaaccuuggaagaugaagcugauaugcgccuaaucuuauagagacuugaugucccaagugaagggggauggaggaugaggaggggaucagaggcugggggaggggagauggggggagaccccucucagaggcaaaggggaaaaggggauagggugaugaacucuuggaggggggaucaggaaggggaaaacauuugaaauguaaauaaauaagcaauuguuuaaaaaaagaauccaaacuucacaucacacacuggcacuucucccuuuaaguguuaagacaauagaggcaguggaccucaagaaauugaaauuucccccaaagaaagagaugagggcccagguaccagugaauauggagagauggaaggguuuuccaggaaagagaauucgcacagccccuacaacuuaacagaccaccuugcaggacagaacaacagaugacaaugauauguccacgaagggcagaacagcaccuagacugggauugcuuaguugugcauacuucuuauucucugccaggacguaacuagguuacagacuucuugcuuagcacauauaaagucagcacugcacaaaccagccaugggggugcacaauguaaugccagcacucaggagguggagacagcgaguucaaggcuaggcugggcugugugacacacgaucucaaagagggggggcagaaagguuuuguauguaucucaguugaaagagugauuaucuagcaugcaggaaguccuggguuccaucucuugcacugcagaaaccuaacauaguggcagaugucuguaauccuucacuucacaacuaauuugaggugaggcuggcugaaauacaaugucucaaagcaaacacccugaacgacuucauaggagugggagaaguggcucagugguuaagagcacuuguucuugcagaggaucugagaccaacucccagaaaccauaggguaggucacgacuauccaguucuaggggaccugucauuuucuuucuguccccauagacaccaggcauggucccgauacacauacacucaugcaagcaaagcacucauacacauaaaaauaaauaagaauugguuuuggaaggaaaaaaaagcagaacagagacuggacagauggcugcuccuccagaggacccggguucaauucccagcaucuacacagugcuucacaucuggcugaaacuccaguuccaggggaacugacaucuucuuuuggccucugugaucacgagguaugcacaugguucacagacauauacuuucacaaaacuccuauauacauaaauuauuuuuuuaaccuggcuguccuggaauucacuagguagaccaggcuggccuugaacucagagaucugccugccucugccucucaagugcugggauaccugucuuuguaauuugccuacugaggacuuguaccagagucuaguugcugagccuucaagggaccaaggcuuugaccaagcaaucccacuuaauacuacagcauaggggaggggugugcuuugaucacauagaucugagacuccuuggcagcugacuaaugugccuauuaggaaacuacuaagacuaggcaaguuugaaagacaaugagaaaagacuugaacaaguccaguuguggguugguugggaagucuucuggaagauggucacaauugcaguccuugagaagagcugagaaaugugaugauugacagacaucccuggaaugaugcaccaaguggaccuacuaaaagucuacuugcaguagacacugaagagccuccgggaaaggacucaagcugugucugaugccggacucaggcaauaucaagagaccuguuuuagagaccugacuuuuuucaggucucaucuguagggcagcauccacuacaaaggaguccaacugaaaggaaaacagaaguacguggagcucagcucagaaugcaagccuugucuuuagggaaguagagcaauauuaaaagcagcaccagggugaguauaaggaaauggcucagaaauguaucacugaaucgaugaaaagaacucuugagugcugucucucaguacccaucucugcuuucaaaaaccuaacuucugucugagggcugcagccagguguauauagucagugcucuuaaccgcugagucaucucuccaauccuaguuccagaaacuuuugaggcugcuaucccuuaaccauuccaaaagcaauacuaguucagccuaugagcugccugccuauuccacugcuuccagcuuuagcuaugguaaauacgugucugauggaaagaaugguuucccucccuaucuuacuuaggguuuuauugcugcgauaaaccccgugaccaaaagcaacucaaagaggauaggguuuauucccacugaccauuauaguccacugugacaggaaggcagggcaggaacucaaagcaagaaccuggaggcaggaacugaagcagcauccauggaggaguggugcuugcuggcuugcucuucauggcuagcucaaccugccuucuuauacacaauggccugucccuaacuaagacaaugccccacaggguggacuacaggccgauggaaguacuuucucaguugugguucccucuucucagauauaccuacguuucuguugaguugacaaaaauuaaccagcacacucaucaagguuuaccaaaaauacuccucgcucuggaucugaaagagcuuuccaauugcuacuaaucuuaacuucugacucaggcaacuagcuagauucuauagugguccccuuuaucccaaaaaagcccuuggucucaugaccaugcuuuaggaugggauggauaaacucccaaauaaaggaaugagaguacauuguagaaaccacgaauaaaccuguagcagaacuacccuagacacuugucaaaccacaauguguuguuccauuuuucaggguuucugaaucaguucauaggaagugaagauucccauuccuaaggaagcccuagguuacaugguuguagcugcuucuguugauaaugauccacaaaccacacuuagacccacugauacaagccauuguuggagaccgccuuaggccucggauuguauuguuuugggggcuuuuuaaaaaauuuuuauuagguauuuuccucauuuacauuuccaaugcuaucccaaaagucccccauacccaccacccccccacacuucccuacccacccacucccccuuuuuggcccuggcauuccccuguacuggggcauauaaaguuugcaaguccaaugggccucucuuuccagugauggccggccaacuaggccaucuuuugauacauaugcagcuagagucaagagcuccgggguacugguuaguucauauuguuguuccaccuauaggguugcagaucccuucagcuccuuggguacuuucucuagcuccuccauugggggcccugugauccauccaauagcucacugugagcauccacuucuguguuugcuaggccuugggggcuuuuuuaaagccaagucucucauguaacccaggcugaccuggaacuugauaguuaggagagugcugugaauacaaguggaggccauaacaagcuaaggacaugauuaugauaagugugccuuucaacacuauugauccugcagaauaacucaucugugcauucuaaaaugaugccuccuggacucaagguguaugccagugauaggguacuugccuagcacguguaagguccuguauucacucuuuaacaccaccccaaaauuaaaaucaauccaaaauccauuagauagggaugugggugggucgccuccuuucucucccauccaacuucccugggugguauuaaaugagaguguugggccucugaugagagagacugugauuacacuuuugcuauugaccccuugcacaucugcagugcucaccacugaucuuucccacauucucucucucucucucucucucucucucucucucucucucucucucucucucucucucuguuuuguuuuucaagacaggguuucucuguauagcccuggcuguccuggaacuaacucuguagaccaggcuggccucgaacucagaaacuugccuaccucugccucccaagugcugggaucaaaggcuugugcuaccacacccggcauucucucucuuuugcuuucuugaaaucaaggguugaagaaaaugaaagaaaugauugguuacuuccuucucugugccauucagcgaguucaucaccaugaagaagugaaccauggguuuuggguuuuuuaggucacuggcacaugcucaucuuugaagguuauacccagucuccaauucccuucucauguucugcuuccuaucuaucaugaggugagcaaucuccuuggcauacuucugaugccacagcaucuguucgacccaucuagaaacaccgagaagugccuauggacugugagacugugagucaaaauaaauaaaucuuuuccuucuuagacuguuucuaucagacauuuugucacaauuaugcaaaacauaaccaauaauauauaaaugcuaaagccaggcgugguggugcacgccuuugaucccagcacuugggaggcagaggcaggcaaauuucugaguucgaggccagccuggucuacagagugaguuccaggacagccagggcuacacagagaaacccugucucaaaaaaaccaaauacacacacacacacacacacacacacacacacacacacauauauauauauauauauauauauauauauauauauauacuaaaauuauaggaguguaucaccauaccuagcugaaaagguauacauucuuauaauauauaccaacaugggaaaucucaaaauaauuaugcuaugagaaaaaaaucagauacuauauucugguuaauaucauacugauccucuccaaucccccugccuugucuaccccuccuucccuacaugugcccuucuuacugucaugucuacuagggugucugugugaccaugaguuuagaacuaccaauuggaaucugguaggcuugccuaugggaacugaacugaagacaaugacugccuaucucccagaaucaauuaauagccaauauuucaguaaggagggggugagccuuguaagccccuccccaaucuauauugacuaacgaccagcucagccuuguacagcccucauagaagcaacccaggaagaauguuauaaggucagcuugggauauguaguaaguuccaggccugccuggauuacugagugggacucuuuuucagucaaaacaaaggccccuaaaaaugugccaggaaggagcuggagagauugcucagggguuaagaacacugacugcucugccagagguccugaguucaaauccuagcaaccacaugguagcucacaaccaucagagugacaguguauuuauauacuguaaauaaauauuuuuuuaaaagcgugucaggaaaugaaguuugaggaucaugaguuugcaaccaacauaggcuacucucucaacaaaacaaacaaaaaugcacacuuuuucauaccaccugaauacuaauuuuuuuuuugguuguuuugagauaggguuucucuguguagcccuggcaguccuggaacucacucuguagaccaggcuggccucaaacucagagaucugccugccucugccucccaagugcugggaucaaaggcgugcgccaccacugcccggcucugaauccuauuuuauagguaauaagaauagcaguuucuucuggggugaagaucaccugagaagaggaguaagcauuaugagguaauagaaauguuuuauauuuucguugguuacauuggugcagaugaacacaggaaguucaucaaacugcacauuuaaauuuugugcauauugcugugugaauuuuaauguuguaccauuuuuuuccugcacuggggguuacuagggccuugugguaugcuaggcacguauucuaccacugagcuauaccccuggucuucuuuguuucuuuuuuuuuucaucuuucuguuuaaaaauauuuugagacaggaucucgcaucgcccaugcuaaccuugagcugcuuagaggaugacuuuguguuccuggaccuccuauuuccaccuuccaagugcugggguuauauuugugcaccaucacagcucacuuuuguuucugcaucuugagacagaauuucucugaguugccaugguuacuuacuguaaaugaggcagacuuugaacuugggacccuuuugcuucagccucuggaguaucugguauuagaugcuuguaguaucagaucugucucauucaacugcuuuuguuggcuccuuucaucuuucccuuggucacuuccagcacucuuuucuccauccuucuauuucuuaaauauuuacgggagaagaguugauaagguacugauuucaucuguuaucuugaaaaucccauguccucaccauaaaaaugcggaagccauuuauugcaggaaguaggacaaaggaagaguaugucaaagggugacuccuggagagaacauuacagccuuaucuuuccacuugcauucugggcccuugccuuuuuugugguaauucucuacaacccauuuucugggcucagaaggacuuucaucugaguuccugcugugccauauacuugacccugaaaaacugacuuaacuccugccuuaguuuucauuugauuucauuguuguuggguuuuuuuuuucuuuuuuguuuguuuguuugguugguugguugguugguuuuuuauuuuuuucaagacaggguuucuuuguguagcccuggcuguccuggaacucacucuguagaccaggcuggccucaaacucagagauccggcugccucugccucccaagugcugggauuaaaggaaugcaccaggaccaccuggcuuuuuuuaauuaaaaagguauuuuucucuuuuacaguacaacccaaacacaguuuucccuccuccuccuccuccccucacuuuaucucaccugccuuuuccucccuucagauccauuucuccuuuguuucccuuccaaaaaagggaagggccaggucuucuagggauaucaaccaagcacugcauaacaaguuacaagaagacuagcuaccuccccucacaucaagguuggguguggcagcccaguaguggggaaaagggucccaaaagcagacaaaagagucacagacacccccacuaccacuguuuggagucccacaagaacaccaaaccaacaaccauaacauauauacaggggaccugguacagauccaagcaggcuucaugauuucugcuucagucucugugagcuccuaugagcccugcuuaguugauucugugggccuuguucuccuguuauccucaaucccucuggcuccuacaauccgucuuccccccucuucugcaggguucccugagguucuuauucagagcacauuguaaucaaugucuacuuccaaggcugcuuuaagaaugaagcaagauaaaaagcuauuacaaugacuacugcagcuaagaagaagccuuauaaaagauguccuugaacuucuuauucuccuaccucugcucucccagcacuggaaugacaugcuuggcaguacauacaacauagccccuucuuuccuuccuuccucucuccuuccauccaucgcucccuuccucccucucuacuucccucccucauuccucuuuuuuuuuuccagacaggguuucucuguauagcucuaguuguccuggaacuugaucuagaccaagcuguccucuagcucagaggucugccugccuauuuauucuuccagggugcuggaauuaaaggcauaagccaccaacucacaggcccucccugcuuucucuguuuuuuuuuuuuuuuggaggggggucgugauuauaggguuucauguaacucaggcuggccuggaacuuaccauagccaaagaugaccucaaauuccugaucuuccuguguuuaccccuugaguacagguguuacaagcagguaguacacagccauuuuuaauuuauuuuauucuacuaaauaagcaggccugggugguuaguuauuuguugcuauucuauuacaaaguugaagacaggaguggugccaucaagaagcacuuagacuuaguggcaggccuagccugucuaucuuaccuuguacagauauacuaagacguugcagaaaccuccgcaaauaaaaugucuugugauugucuuucuccuccagacuuuaccagcuagaaauggcaggcagagucaaccagaacacagcgccuauuuguuucccuccuugcugacccauuuuggaaaguauuuuaugcuguacuauuuaguugaccucagaguugucuaguccagaggauguuccauggaaagagaacuggcugcucgguguccgucuugggucuaagguuuauuuccaaagcucacuguugacuugcuuuuaaaagagagaacuaauuucuuggcagacaguugguuguaugaccaaagcaguauccucuaucuccauuuaucacuuuuguuugguuuuucugucuauuuaacaaagaggugucaccgggcagugguggcgcacgucuuuaauuccagcacuugggaggcagaggcaggcggguuucugaguucgucgaggccagccuggucuacaaagugaguuccgggacagucagggcuacacagagaaacccugucuugaaaaacaauaaauaggucugcgguccccgcgcuggugcugcugcuccugcugccgccgcucgcuuccggagacuccgcguccugcccgcagacccgaaccaugaacccgggcggcggugagcggggcuccucggaggacagccauggucugcagcgcuccaaggugccgggcuccgacccgcagggcagcaaagaaaugcuccugcugacaucccgggggggggggggagauuccccggagcagcggcaccacguccucuacuuccccggggacgugcagaccaucccauggcuuccugacccucagcaguaagagcuggaguucucucaagugcuagaaauccaggugccaucacagcuugcuuuccugcaggguaacugucgaggaaguuuucugaaaagauucuuuggacuccaguucauccugagaauuaucaaugggaaaauuggagucuagaaaauauugcuaccauuuuagcccgccauuuucccaauaguuauauuuggguaauaaauuguucccgaaugcauuugcacaaauucagcugcuaugacaauuuugugaaaagcaacauguuuggugcaccagaacauacuccggacuuuggagccuuuaagcacuuguauauguuauugguuaaugcuuuuaaccugacucagaacgguaugcuguucaagaacaggaguguuuggaauaaggauuguaaagcaucuaacugugagucuaauccuucuacuaguaaugauggccaaaagggaaacgagaggaccugugagcauguugaugagccuuccgugaguuuugcuccacugucauuggcuggugcaucguuuacuuugauuggauucaguaaaggcuguguuguuuugaaucaguugcuguuugaguugaaagaagcagagaaagacaagaacauagaugcauucaucaaaagcauaagaacaauguacuggcuagauggugggcauucuggaggaagcaauacgugggucacauauccagaagucuuggaagaauuugcucaaacaggaauuacuguucacacucauguaacaccuuaccaaguacaugauccaaugagauccuggauuggaaaggagcacaaaaauuuguucagauacucagggauuuggguaugcaagugaccagccaaauucauuuugcgaaggaaacuccuuccauagagaaucauuucaggguucacaaaguauucugagacuauuaaugugcuugcuuaauggaagaauaaauuuuugaauguuauaaaaaaagaaaaacaagaaagaaagagagagagagagagagagagagagagagagagagagaaagaaagaaagaaagaaagaaagaaagaaagaaagaaagaggugucaauagucuagcuuuucugucucaguuccauuacagucaaugguguagguauuuuccugaaacuaaaacaccauucaacuuaaccaaagaacuaaccaaucaccgaaggaaccuaaucuccaaacgaaccuuggguucauguucuuugguguuuuguuugcauguaugucugugugaggauguugggacuagaguuacagaugguugugagcugucaagugaaugcuaggaauugaacccugguccucuggaagagcagccaguguucuuaacuguuaagccaucucucuagccccuucucuaaaugaaccuuugauccaauagucacccaccuacccaucuguuuguucauucacuucacaaagauuuaugagcucuuggaccaggugcgagguagguagcaaguaggggugagguguggggaccucagaguggaacaggauuugucuuucacaaaugaaagcaaguccccucuagggaccucuuauaagugaacagccuuauaguugggguagaaagggaggauaguuugagaaggaagaaaaauauggauuguaucauauucaugggauccuaaaaaucucauuugacaaaaggauugcugauucggagaacugacugcucuucugaagguccugaguucaauucccuacaaccacaugguggcucacaaccaucuguaaugagaucugcuacacucuucuggugugugugaagacagcuacaguguacucauaugcauagaaaaacaaaacaaaacaaacugcagcaucuuaggaacuccuuugacuaaggccgagcuuugucuucuucauccucuguaugccucugauggugaagaugguaucuagccaaagguacuauccuauccaguguaugcuuauugucucucaugcuguacagauaucuuguuaauggucaggcuugaacuucuugccacuuuaaagcugcuaucaggcuacagacugggagaaugaaaggguuguggcucccaucuuagcauaaggcacagugaaacaagcauaaauaaauccuuauaaccuagguuuaaacaugcgcucgucucucaaauuguguguucuguacugaguuuugaucaucauauuuucucuccuuuauacaccauaacucccagaaguucaaaguauuucccaaacuacugaaaagcaguugaggaacugcccauaucuggucuuaaaaaaguuuacauagcgaauuccuuuaaggcagauagcgagauagccauuuuuccuggcuuuguuaagagguuguauuauuguucugaucuuuuaguagcacuguguucuauagcaauguaugaaaacacaggacuacagagagauaaaaaugaauuagaggaaacugcuguugacaucuggacauauuuuucucuagcuuguaaaaaaaaacaaaucuugacuacacaaucuuaaaucugucuuucaaaaaauuggcauuauaacacaugcuuuuguacuggcuaguuuaauaucaccuuagcacaagcuaaugucaucagagacgagagaacacuaguuaaggaaaggccuucaggagcaucugugugaguuugaagccagccugcucuaaguagugaguucaaagacagccagagcuacauagugagauccugucuaugaaagagcaacaauaacaaaagugccucuauuaagacugggcuauaggcaagacuguaggacauucuuaauuagugacucauauggaugugcuuagcccauugaggguagugcucugggcaugugguccugggugcuacaagaaagcaggcugaguaagacauaaggagcaagccaguaagcugcaccccuucauggccucugcaucagcuccugccuccaggucccugccauguuugaguuccuguccugacuuccuuugaugauaaacagugcucuggaaguguaaggcaaauacaccuuuuccucuccaccuugcuuuuggucaugauauuucaucucagcaauaguaacccuaacuaacuauaguaacuuaguuacuauaguaacuaagacagugcucauguuucacuuaaaugucucauaaacauuugcuuuuaacuuugcaugguuucucacguauugccacaagcagguucagucaacagcaccuuagccaggaauaccacucugaccauucauuccuguccucuagucccugccucuagaagagucugaaucaaauagggucucccuaucucuuccuuuauaacgguuuccuauacaauaagaagaccuuuaaaaucacuucuaggaaaagcauuugauuucccuaagcccuagcuuccacauggaucacauggaucuauaaaauaccacuuucuuaggcuguuguggucaguaaaggagaaaaugccaauaaagccaucccagugucuauauauggaaucaggcaaaucucacgcuugcaugagaaacggccugagugaaagagaaugugggcugaaugggacaaagcuuagaacgacugauuaaucauguuauguuuguuuguuuguuuguuuguuuguuuguuuguuuuugggauuuuucgagacagggcuauaauuuuuauuggguuuuugcuguuguuguugucguuguuuuucuaagacauaguuucucuguguagucuuggcuguccuggaacucacucuguagaccaggcuggccucgaacucagaaaucugccugccucugccucccaagugcugggauuaaaggcgugcaucaccacugccuggcuuuuuauuguuuuuauucguuauuuuuuuauuugcauuucaaauguuaucuccuuucccaguccacccccccacccccaccccagugcuucuaggaggguguucuacuacccacucacuccaggcaauccuuucauaugcagcucacaccaggcacaccuugcccuggaggcaggugaaaguguaagccacugcuaggacccugggaggagccuagcggaauugccuuaagcuaacacuuuggaaggagagguagguagaucucugaaaguuccaggccagccugguccauagacucaaaacucugagucuuauggucucuugccugaccuggauuuuagguaaauuaauuuccuccacaaaacagaaacuauacauguucuccauagaacacuggaaaauagaaggcagguauagugacacagaccuguauugcuagcacacagaugguagaaacaaaaaaagucauagguuugaguacagccuaggcuacagaguuccagaccacccggagcuacauacagaaacccugucucaaauaacaaggauccaggagggggcuugagaagguuuagcagaucaagguaauugucacaaagcuugaccaccuugcuuuuaugcuugaaaaccacacgguggagaagccaaauugcuguaacuugucuucugacucugacaugugcccccuccaauaaguaaguaauuaaguaaguaaguaaguagauaaauaaauaaauaaauaaauaagaaguuuaaaaaacaaaauauaaacugaacaugguagcacacuucuuuaaucccugcauucaggaggcaaaggcaaacagauuucucugaguuugaagaaggccuggucuaucuagugagcucuaggauggucagugcuacauagugagaugcugucucaaaauaaauagauagauaaauagauagauagauagauagauagauagauagauauagauagauagauagguagauaaguaaauacauauaauugcgcaugaugacauacaccuauaauccuagcucuugagaauuagaggcaggaggaugaguaccaacuauagaauguguuuuaagccagcugaaaccgaaaaacccugucucaaaaaauaaaggcccacaaaagaaaaaucuaaggaaaaaaaauaaaaaagaagaaaauuaauccuccugcaacagagcucaaaauuucucuuuucuuucugggauucagcguugauuacuggcugccuugagagugcagaauccuagguagagauuuucugggaaauuaacugagcagacugucaagcauaaaaucaauuugcaaauccauggagaugcucucuauggaagaaucagagcucacuauacuuugaggcucagcucacacagagccucuaaucaggcccagaaaggcaaacaacuagcagcuuuuccgagcuuucuuccuacacagcacaggagacaaaggaacacaaccguuuauucugcucuggcaacucagcucgugccuauuaagagaaaaaaaaaaacugcuuagauugcaucauaacgcaugcugcguuuauucuucucuggcaacucaguguguaccuaguggaagaggaaaaaauguguagaucacauuauaauaaugggugcuguguucguacaaaggaauacggugcagccauuaaaugugauuauguagacuuauauuuuacaauaguaaaguaugaucaggaccuaauuucaggacauaggugcauuuaguggucaagaugauagguguuggaacaagauaaccuggauaugaugcuaggcugcagaucuagcuuucuaaccuuaaacaaaugagagagcuuugcuaucucuccauuuuaucaucuugaaaaggagguaaaaauaaucuccugcuuauuaggcugcuuugaagaugaaauaaaauaccuuaacccuuagaaaagcccuuaggaaaaguaaagugugguucacaguaaaucugccauugacaacccgaaaucagaguuacccagucagucgcccacuucucuaguccucccacgagcugcacucaccccucaccucacugaaccuucuccuuugucuucaaaaccuccagccacuggccgucauauugucucuaugugcagugcuugggagcacacuccauuuacauaaaaaagaacgguugugcccugucagaaaagagcucccucucggcuuccccaagcaagcauaaccaguccagcugcucaagccaccuugcgaacagucucucagcuaggacaaggaucgcccaggccuccuacacaccaccuauauuuuaggucucagauccuccuuuuucuucguagcugcacacuauagcaucauccuuuucucugcucagguacucacucccaacaaaugcuuaauuguaaucuuuacacagucauaacauuucucccgauuaaaaagggcuucucuuuagcccuuuagaggugaagaaggacaaucaggagcuccaggucaucucugcuuacuuaguagguuugaggccagccuuacauacaugaaauucugcaauaauaauaauaauaauaauaauauaacucauaaucucauucccauuacacuauuacauucccuuuaugagcaugaugcuucaaauaauugccuauaaucauuuuuucuauuuuguuggguauuccuaucaucuagccauaccuccguacacuccagccuagauuucuacccaucauuucauaaaaauagaucuagcacugugcaucguaucucacgccuauaaucccagcaccagagacggauugccagaagcgcaggcaaaccugggcuacauaauaagcucuaagccagcuuggacuauagaguaagauuguuucucaaaaaaagaagaaaggaaggaagggagggagggagggagggagggagggagggugagagcgagagagcgagagagcgagcgagagagagagagagagagagagagagagagagagagaaggugcuggagagauggcuuagcaguuaagagcauugacugcucuuccagagguccugaguucaaauuccagcaaccacaugguggcucauaaccaucuguaaugggauccuauucccucuucuggugugucugaagacagugacaguguacucauguaaauaaaauaaguaaaucuuaaagaaaaaaggaagggaggaaggaaggaagcuaccauguacacccagauaccaguccuccucauuagugagcagaacacauucauucuaagaacucccaagggguuuaggaguuguaugucagaaaccaacagugaagacugccauuugucuucucuaaaacuucuguuaaaaucuaacugccagccggguguggugguggcccacgccuuuagucccagcacuugggaggcagaggcaggcaaauuucugaguucgacgaggccagccuggucuacaaagugaguuccaggacagccagggcuacacagagaaauccugucucggaaaaaaaaaaaucuaacugccauucuaacaguguuaaguagcaggggaguugggugugauaguucaaggccaccuuggucuacauagugaguuccaggacagccagggcuacaccaagaagcccugucuuagaaaaaccaaagaauaaaagaagcaucagggggaucagaaaguucaaaggcaaucucagcugcaauagugcgucugaagcuagauggggcuacauaaaucaggucuccacaacaguuaaaugaaagcaaugggugguucaaggucucacucucugcauaaugucuggcuguaggucucuguauugguucccauguacuacaggaggaagcuucucugaugauggcugagcaaggcacugaccuaugaguagaacagaauacaauggcugguaauucccacaagcuuugcuccaccauugcaauagaacuaccuucccguagcauggaugcuagcaugucggggugaagguuuauguauguaccaguucaucuuuuccauguucagugaguucugugggucucuucagaaauaggacuuugaaaaucaguuuguggaaaguaacauauccuggacaacauccugggcuguuuggggggcuccuaugggacccguuugauuaaaauacucaauuagauguaacccauuccugguucuuggaacacucagcccuaaaugggaugucuccaucacaucuuuccccucaggguucagggaaccuugcagaaaagaagauagaaaaaguguaagagcaaagaagauagaaaaaguguaagagccagagaggaauggaagacaccaaggaaacaaggcccucuaaggaucaacacacuucaugugaacucagagacuaaggcagcucgcagagguccugcacagguggaguccuggagcugaaaggaggaguggauacauccuuuuaucccuaaccuagaaguuaucuccaauggauagccacuugccaaugaaaagugaguuuucuccaagagagucucacuggggaaaggguaggcugcacacucaguuauaaaugcuaacagaaaaccaacucaacaguauguugggaaguuacuuguuccauaacaucauaucagggccccaucucucucuacagguccuuugcauauauauuauggcuuccaguuuagugucuuaaugagguuucugaaggucuaaaagagucuauauacauuucacgucccccuuuaggggacacauuuucuuuaguuuguuuuguccuauuacaauguguuaguuauuuuauuuuaucauugucccucagaagccuguuuauuuucuaaugagacacagaaagggagugcaucuggaugguaggaaaggugagagggacuugggggaguagagggaagugaaguuguaaucaggacauauuguaugaggaaagaaaucuauuuuuaauauaaccaaugauaauauaagggagaggggagaaaguaauggguucugggauuccauagcacaauguggcgaguguggucugcaacaaccuaucacagaguuuguaaaacaaaaacaaaaaaacccaaaaaaacuggagaaauggaguuugaaaguaccaaacauaaguaaaggaauaaggaaauuaauuaccuucauauacacauuauauacaaguauuaaaaggucaauauauauguacaauaguaauaauaauaguaauuuauuaaaaaagaggucauggguugggaagauagaucaguggguaagcuugcugcacuugcauacggaccuggguuugaauccccauagcccccauaaaagcgcagugcaguaggaucaggucuguaaccccuaagaggagccagacaugaugauacaucccuuuuagcccaccacucuagagucggagguaggagcauuucugagagucuggggucauccugaucuauauagugaguuccaggcuaaucagugcuacacaguaauucccuaaucucaaacaaacaaacaaaaaucccugguagggauucugaccccuucccaauccuuuccccacacuguagccagggcuauuauuuucagaaagcuuaucugauucauugccuacacuccacaggguuuccaauagcucuuaggauaugcauaaaacaacuuaagcuaguuucuaacgccuugucugaucugacccuccacaugggcacagccucaacucccauuccaauucucucccaacuguccauacauauuauuuaacaccuuuuuucuucauucuaucuucagacauauagccugaacucuucccauaguugucaggucaauauucucucucucucucuuucuuucuuucuuucuuucuuucuuucuaagauuuauuuauuuauguauaugaguauacuguaguuguuuugucuucagacacaccagaagagggcgucagaucccauugcagaugguugugagccaucaugugguugcugggauuugaacucaggaccuuuggaagagcagucagugcucuuaaccacugagucaucucuccagccugauauucacuugcuuaggcucuaugccagaugagucaauucccccuucuuuaauuuuuaaaaagauuuauuuauuuugugcagauaauuguuuugccugcauguguguaugcacaucacaugcaugccuagugccuauagaggcuagaagagguuauuggguucucuggaacuggagauauggcuauuuacuacaauaaagaugcgggggaccaaacgcagguuuucugaguuugagcacuaagugcucuucagcacugagccaucucucaaaugccucuuccuuauggguuuucuagcacgauguaccuucuucuacggaggacuuacauucauuuccauuacacacacacauagccuuuugcuuuuuauuuggcuccccgguugacugugcguucauugagggcagagacuuuggaggaguuuugcucacuuauccuugguacccagcacagugccuggcaacaaguauggggucuuuaaaaaaauuguaggcucuagaucgaugucuggcaucauaugccauuaaccccuacaaccugggagacagaggcaggcacaugucugugaguucaagaucacccuggucuacauagugaguucuaggccagccaggacaacaucaauggaaucccaagacucucucucucucucucucucucucucucucucucccucucccucucccucccccuccccucccccucucccucucucccuuugugucucucucuuucacacacacacacacacacacacaguguucuugcagauuacccaaauuaaguuccuagaagccucaucugauggcucccaacagcuuauaaguucaguuucacagggguuccucuggcuuccaaaggcaccugaagucauuuauauccacauucccaccuccaucucacacaugcaauuaaauauaaaauaaauauguuaggacguuuuagguguguacuuugacacauguaagcucuggaugaccugguacucacuauauagaucaggcuggccucaaauucacagacauuggcccucucuacuucccaaguacugagccuaaagguaugugccaccaugcccugcuaaacuaaacuaaaucugcuaauaauaauuguccuccaggaggccagucuauagauuacuaugguauaaguaucuaggagugucuuuuucccaagagaaagagcuacauauuaguuaaaaguaguaaagcuaugaacuggaaaaugguucagugagcaagacuaauuacuaugcaagcaugagaauuugaguuuggauucccagaacccauguuacaaaaaggcaggcauggcugcauaauugcuggccagccaaccuaacugaagagaaaugaacagugagagaaucugucuugagagaauggaacauaggaggacugagccaacaaugcuggccuucuugggcacaaaagaaaaaauacuuaaguuaaauuuuuaauagcuuuuaauaaucauuuuauaaguaaagggugauuugccuguaugcaugucuguguaccauguguguccaguuccaaggaaggccagaagagggcgacauaucccuuggaguuacuuugggagccaucauguggguucugggaauugaacccaagucuucuggcaaagcaacccggucucucuuuuuguuuuguuugguuugguuugguuugguuugguuugguuugguuugguuugguuugguuugguuuuuugagacaggguuucucuguauaguccuggcuguccuggaacucacucuguagaccaggcuggccucaaacucagaaaucugccugccucugccucccaagugcugggauuaaaggcgugcgugcgccaccaaugccccgugcaacuuggccucuuaaccacugagcgaucucuccacucccuagauagguuuuugaguacaaacuccuauaauaaaagaaaagggauauuucaauauagaacaacucaauuccaaauauaacaacaauagcauagauuuacagccaaggagccgagugaggguguugguagcuggagacuacuuggugaaggaaaggaggauucuuauuaaaacaguccuuuguaaauuuacagacuuggucaaaccaucccuacaauggaaguuuuaggacauucuuauuaccucuaaaaaaaagcuucauguccauuauuccucagucuccauccaacaggaagguuuuggaagucaucacauuuaaugauuacuggcuuaugaugggucaacaacaagcaauaauaaauaaauaaauaaauaaauaaauaaauaaauaaauaagcaagcaagcaagcaacaacccuacaugccuaaguugggaaaagcacuaggcccccacaccaccaacaucgggaggagaacagcuuaacaggaaaauuuaaaaaacacacgucaagagcuagagagaugcagugguuaagagaacuaacucuucuaaagguccugaguucaauucucagcaguggcucacaaccacccguaaugagauaugaugcccucuucaagugugucugaagacagcuacaguguacucauauaaauaagauaaaucuuuaagaaacacacacacacaugucauauaauuugaaaaugguaagugcucaguuuauuugcucaaaaagauuuagacaacagaaaucuguauggaucacuacccuacauguagcacaggccugaaauguagcuuuuggaagcaggaggcaggagacuguguguuuaagguccuguugagcuaccacaguucagacaaagcaaagcaaaaugggagcaaguaagugugaacuaaaaagagaggggugggcagaagaaacaugcuuuuaggauuuugcuacuuaggaaaaaaauaucuaaaagaagaaaaggaaaaaacaauggguagaaaaauaaaaacaaccagcauguuuucagaacuuguaaaaguuccaauaugguguugugacaguuguccuugaucccuucaucaauaggagauucaagaacagaaggaaaaagauuaaucacaagccauaaaccuuggaucaacacucaacugaaaauaaacuuguauucugcugcuucuugcaagccaagacaggagcgcugaguaggguaaugugacaccuucuagaggagguagcugcagugcccccucccacccacuccggggggcugcccugagugcaaggaguccccgcuugaagggccagacuggggaaccaaugagccuccaauaacccggggaaggguggcgguccagacuucccugucuuugguuaugcugcauuuuggccagcuuuccccgcccugcuugggggagggggaggggucugagaaggcgggagagauagccuggccuuuccagaugcuuagcaauagcuaacaaaagugguauuuauucccuccccuaccucugcagacaccuuccgcaucuuccuuccccucaccaccaucugccauucaccagucuugaccacucccccauuugcuucggugacccgguaccagcccccaccaggcuuuagccgccauuuccuggcagccuuuucccaacuccgucccugaaguggaaugugcuggggggaguggauuguuuaagggccuccagccaucuggaaagagaggaagagaugggauuccugccaaauucucucgacccucccgagcccagccccgcaccccucugcuuauugugagcucccuagugaggaccagagagagaaagagaaggcugagagugguucuagcauuguucaggaauauccucacccacaaguucccaggaaccgcuacacaaucccacguggaacccagacacguccuucacucccccacccacauuauuuucugcuuuccuucagcccaaguuucuuuccccaagauaguugagucccugagacucaguucccucgucucuaaaguggagcugucaaugaaaccuaacagcauccgguauuugagaaacagaucaagcacaaaggguagcagcaagaggaaggaggguaaaaaggaugcugggaaaagggucucggcaauauccaauuuuauuuuaaaaggguuagguauggagcucagcgguuuuguccaucauaggcaaggucccagguucacuccucagcuucccucaaccuaggaaggaaggaaggaaggaaggaaggaaggaaggaaggaaggaagaaagaaagaaagaaagaaagaaagaaagaaagaaagaaagaaagaaagaaagaaagaaagaaagaaagaaagaaagaaagaaaauagaaguaacagcuaggugucugggcuggagacaugguucaguaguuaagaauaccgacugcucuucuuaagguccugaguucaaaucccaaaaccacaugggugacucacaacuguccguaacgagaucugacucccucuucuggagugucagaagacagcuacaguguacuuacauauaauaaauaaauaaaucuuuaaaaaaaaagcuagaugucuuaacagguuggccaaacagagcauuauaaauagauaaaugggacacccacacaacggagcaccaguuagccggcuggcuuuucagaaaaaaaaaaaaaaaguaaaauguccuuuucuucuaucuccuuucuaaguaugcuaacaaauuggccuucauucuuucucuaacccaaauagcaugacuuccucucuuuccucggucuucccauuccuggaagcuaccaagauuuauagcuugcuacccucggauuuuucuuuuagacuuuaauaaaacuguccucaagcuuaggguggggcugaagaaagcagagugucuauugguuagggacacuggcuucucuccuagaggacccaggcucuguuccuagcauccacaggauggcccguucuaguccccuccuccccucuggcuuccacugcucaaguggugcacagauaaacacacaggcgacuccccacccauauacauaaaagaauuuuaucuuaaugugcagaaaagaaggaagggagggaaagaaaggggcuaagcaguuaagaccaugccauucccaagacugaacuguagucagugugggaacagguuacaaaagggcucucagcccgguacuuggcaacuaaaucgacaucaccaguuguauggcaauuucucucaagacccauuuugggaaaaaaauaucauuuuuacugauagcauuaaaaauuccucuuagugcuggagagauggcucaguaauuaagagcacugguuugcucauccagagauccugaguucaauucccaacaaccacaugauggcucacaaccaucuguaaugggaucugaugcccucuucuggcaugcagauguucauggagacagagcacucauauacauuaaauaaauacuuuuuaaagauuuauuuauuauauguaaguauacucgcugucuucagacacccagaagaguguaucagaucccauuacggauagacggauggucaugaaccaccaugugguugcugggauaagaacucaggaccuucggaagagcacucagugcucuuaaccgcugagccaucucuccagccucaaauaaauccuuuuuuuuuaauuccucuugauggaaaugguguuugauuuauaaauaaacuugacaucacuuuuucuuaucauuuugcuaggggaugagccaacagucuucugugguuacauauaugauugucucuauuugguuaccuauuuuagggccagauucauuaauuucggaauggaugaaugaacuggugacuuaaagaacccacauauaaauaagcacguuagcagaauacaugacauacuuauuaaagcacagcuuguugggaguuuuucaaucauuccaauccaucugggcugaaaagccucauucuuaaggaagcccgagguugugcuguugcugcuccacaaaccacaccggcacacugacacaagcuauuaugggaacaauuuuaggccaugauuauuguaccauauaacuuuuugcugcucuugccaaguagcuugacucaauggaguggaacguccacuuuagcuucuguaacacuccccuggguaacuucuaugcugggucacuagcagcgguguguguuugugucgggcacuggggggacgaccuguagacuauucaaggaucaguguuguugcccugauggguacuauuauccugaucacguuuguucguucuccagguuccuuccuuugacuguucuccacagccugaguuucuuacuauuuucuuggggguaggggacacacaugagaggaaacuggucagaggacaacuuucugagcuccaucgucagucaucgguguaggucucuuugguguggguccccagggaucaaacauugagaggcacagcaggcaggaagcaccuuuaccugcugagcugucuugcuggccccauuuuaacggcacaaagagcauucuagcaucucaggguucagcuuuccuuuuuggggacuuggugacaucuaguggcuaacuggagcuuuuucacuaauacuuguagaaacuucuggaaaaauuacucagcaccguggaaagcaaaaauaucuugaauuuauuuucuucucugagaaaggguucuaaaaugugcuuaggagaaaaggauagugguuggugcaaugacauaaaagucaaaauggauggccuacuuuccugucaacuguaauagaaauucgaaacaauuugaaaaucaaccaaccaaccaaccaaaaauauuaaauagaaacaauuggugaaucugaaaucucacugccauuuuuuuaacuuccagaaacgauacuuuaaaaaaaaaaguaucccuaaguacaaauuaauaugaaguugucaucuguauccuauaucacagggcauuucuacacaugccagagcauagacagcucaaagacaacgaucaguuccugagcagucauauacccagaaauauguguuuagugugcagcuuuuagugaucugaggguguccgugcuaaccacuaggauacagacaugugagguaccagaagacaagugccgcaggugcucagaaugcucaugggaggugcaugguuggguaaacaaucaacuguggcuugcacaucacaagaaauguugagcuacuugcuaaggaugagaacaggagaucauaaauacuucuuaacagcuccuucuaggguuaaaccuuuagcagagagagaauccuaagguguuuuuaaaaugugcuccuaaguacgcuuggcacaguacucugcauccucucagaacuuucccaaaccaagggccagcaaucaaugccuuuaaauauguuccagugacacuaacacacaauaucagaggaccaguggcucacaggcuuuuuagaugucugaaaacccuaaaagccaagggcuggacagacgacucaaccguuaagagcacugacugcucuuccagagguccugaguucaauucccaacaaccacauggugacucacaaccaucuguuaugggauccggugcgcucuucuggugucucugaagauagcuagugugaucauauaaagaaaacuaauugaaucuuuuaaaaaaaaaguuuuaucaaauaauuuguguagaauggguuuuucccuauagccugcuuuauuuuuucuagaaaaggcauaguauuaucauuuaugguaaaaugaaagcaauuauuugcuuucuuucucuuuggauuuggggaauguugucuugauaacgcacaaagucuccaagaauucuguagagauaguuuaaaaacaaaccuuuaggaaaucaaacauagagcuggguagcaguggagguaggaagaucuuuugaguuugaagccagccuggucuacagacuccaggacagccagggcuacacagagaaauacucucuaaaucaacauugcagggauggagaggcaucuuaacggguagagugcuugcuguggccaggagguagcaacaugugccguuaauccuagcacucuuagguguuuuaucugcauucaugucugugugacggccacgugggugcugggaauugaaccuggauccucuggaaagcagccagugcucuuaaccauugagccaucucuccagcccuaaucccaguacucuuaauuccagcacuggggaggcaggggcagguggaucuuuaucuuugugaguucaaggccagcgaaagaaauaaaggaaggaaggaaagaaggaaggaagaagggaagagagaaagaaggaaagaaagagaaaaagaggaaaacuaaaagaguggaaggaaggaaggaaggaaggaaggaaggaaggaaggaaggaaggaaggaaggaaggaaggaaauaggccaggcauggugauguacacuuuuaaucuaagcacucgagaaucugaggcaggugaaucucugugaggucgaggccagccugguucagccuggucuacagaguucuaggacacccagaaugacauagauccugucucaaagcauaguaaacaaacagaaaugagugcuuguugagcaagccaacaagcugaguucacaucuucagcagccauguaacaacccagccauggucacccacaaagugugacccaguaagaucagugugauuauaaccccagugcaguguacagcaguggcagaucacugggacuuccuggcugccagccuaguugcaggcucagugaaagaccccauuaccaccaagacaauaaggcagggcauuuagaaaaggagauccaauauuguucucuacccucuagcaacacacaaucaaaauuuaggcuaugaauauagcucuguugguacaguucaugucuuguaugcaagcagcccuggguuuguucuccagcacugcauaaacuggacagugacguaugacugcaauucuaauccuuaggaaguagaggcaggaggaucaaaacuugagucauucauagccuggaauauuugagaaaaaaauuaaaauuucaacagcagagaacuuuaaaagccaguuacuguguguccauauaauagaacaugauuuuaaaaaagaaaaucaaacuaugcaagauuuuuccaguuuuuaaaaggaagauuuauuuaacaaguuucacuuaguacaauacaucuaaauggaauucacaauacaagguaagguuuaaaucaaagccccagaauuccauacaaauaacaugaccaaacuccuaauguauugguaucacaucucaaaauuguuccggaucuuuaaaaaaaaaagugaaaguguacacucacgugccuuacaggauauuaaaccaaaaagcuagaauuaacaaacaugccaaauguugucacuuugaaucauagacacagcuccuauauauauuuuuuuuuacagaaaagcauguuuuucaacaugcaucugaaguuuucgauguauugugguauaagagcaacauuuaacguaagugaaacugcuuuaaaccuaaauaugcuugcugcuuaaguacacuccuacaacauaacuaacuugaggaaagcucaaaggggaguugacaguuauggucaauacugaacuuguuauuacauccuagaugaauauuuucaguguucaaaauugcugagcuuaaaguuugaaaacaaucuuaacuuucacuuuacaguaagcaugaaucacaagcuuguaaugcgaaacuguuaaaacuuaaauuuuuguucuuuuuuuuaaaaaaaaaaaaaggaaaaagaagaaagaagcugaccaauagugaucagaagcaguuguacuucccauuuaccaaucauacuggauauaaagacacccucccuacucuauccaguuccuauaaagauagcuuuuauucauguagauguuauuggauggucccuugcuuccuaagcaagguuugacugauagucacuugaguuuuccugaagaacuuggucauauccacucauacugcucugaccaccauaacccccuccauagccaccacucagcugcuggcuggccggaccuccauaacuagacugguuggauaaacccaucccucccaucaucuggcuaccguaagcaccaccacuugccccugcuguagaauucaaaaagagcucuacauagcuaugaucauaagcuccuccacuugucccugcgguagaauucaagaagagcuccacauaucuguguugcauauuugcuuuaucuuuugccauagcugccacagcgucuucaugaguagcaaacucaacaucugccucaccaguaacucuuccaucagguccuauuucaaugugcacucucaugggauuaagaggugagaaaaaauuguaaauaucauucucgguggcucuguaugguaacccccucauauguacacagugccccguggugcucuggaaacuggacccaccaucuccauaucuaugaucagacauuccugagaaacaguaguuuaggucucuuccaaaucuaucagacccaaaaccauacccgucauuauaaccuccauagucaucauagccuccauacccuccaccauaggcaccccgccucauucuuucaaacccggcuccucugccaaugcuauuauacccucuuccagccccuggccuaucguaaggacccgggcgcugcauagucaugagcuuucuagguggaucauaguggguucggacuucagcucggcuacucuugaagauuucgauguaccuaugcccuauucuuuccuuguguuucuuuaaggccuucucagcuaucuccugugaagcaaacugcacaaaagcuuccccugugcuccgccccugaaaguccacuggcagugucaucccauuuggcacaauuuccaacccugaaaagaacugaacaauuucuuccuugcuacagccaaaugggaguccucugagucguacaaaaccaucauuggcaguaucaggacuauuuggaccuguaugcuuuaacacccaauccauuucaacacuguuggauuugaauacuucaacauaucugugucccaugguuucucugucuuucuuuaaagccaauuucacuucaucuucagauucaaguucgacaaaugcuucaccacucggucugccuucucugguguagaugaaacgaacaccugaugugccauuuuggauuuugcaaucagagaagaagcgcaucacuuccucggcugagcaggaccaggguaggccccugaccuucaccacgaaccccucccugcccucugugcucagcaucauggugacugauggacucuugguggcaagcuuggcucaaugcaaauucaauguggcuuuaaaaaaauuagaaaacuauugucaugaaaaaguguauauaauauaguaagagaaacaaagaaaacuauuauuuuacaaguucacaucaguaaguuuuucaaaggagccauaugagcaaagacugcauaaaacuuuuaauccauucacuuagcgagugcuuauaccauuucucuuauguaucaggucuaauuaacagugguuauuucuggguaacaguacuauaggaauuuuuuuuuguuuccauggauacuuuuuuccuuuagauaauuucgaauauucuaaauuuucugcacugagccaauguauuaacaucacagagagaaaauuaaaacuaaauauaacaauguacaacuauaucccauuauagaaaaaugaaaauauucuuuaaaucaaaagacaaacaaaacucaugagacaauacaacaaauccauuaaauagccuaaaaauauaaagaaugaauacaagucaauaaaauacagaaguacuaaagccuaagagauaaauggaagacauuaauauacauuuaaacaaguuuuaggagccagcuucaguccacaguucugccacggacgaaucacaguucuauaggagaacuauguguccucaacaaagugcagauacauagacuacauagaaggcacguucauagaaggauugguugauuacguguaucaaugggagacagaaggguuaauugaaacaaacuauccugauuguguuccaggauccaaaaacuaucuauaaagacuuuuaauggagcacaaaguggaaggggacagaacuccaaagacaagaagacuaucacgaaagagagcagcuccagagcguucuaguuaauguaaguagacuagacucuugcuugcuucacaagcacaaugauucaguauucacauuacuaugugacacguaccucccccaaauguagcauucaaacagaaggaaaggaggacuaggugaaaugaacaaauuuuaaagugacccacugaggagcuugcuuaagagcacuggcugcuuuuccagagguccugaguucaauucccagcaaccacaugggcucaugaucauucaucaaugggauccaaugcccugcucuguauacccucuucugucaugcaggcugcauacaugcagaacacucaaauaaacaaaucuuuuuaaaaaaugacccacugagaugggugugccggcaugggccuuuaaucucagcacucuggaaacagaggcaggagggccucugaguuugaggccagcaugcccaacaaagggaggaguuccaggucagccaaggaugcauaguugagacccccaucccccaaaaaaaaaccgaacaaaucacaacaaaggaggauacaggacugcaggcaacuaagggaugcugauaguggagagcgaugucuuuccccagagcaaagcacaccgauugguuaccuaauggcaaaugaucaggccucaaagcgugcacagauaugcugagcaggagguauuuaugucuuaggaacacacacacacacacacacacacacacacacacacauguaauagagaaaaagaggccaagaauuuaaaagagagcaauguggagaggugauuacgcaugggaagguuggagcgaaggaaaaggaaaggcguaaugcucggauuauaacuucaguaacaaacuuaaaugcagaggugaaaggaucaugcguuuagggaaaaagucugggacauguucaaacuucauucaaaaugaaauugaaaauaaacauuuuaacacacccaucaaaaauaguggaaauucaacagugacaauaagucaacauuacggacaguucacaaacuagaguucaccagaagaauuaaaaacugcacuauucuggaaaaacauguugguaauauuuaccacaccuucugacagaaaauccacuucagguaugugccuuaaggaauuaucugaaauuaagagcaggacuuauugaacuauguaauauuugaaaggcauuuuaugaagaaaaguggagcauuauacauuuaauauaaaguuauaaaauuuuaaaugacucaagauuauucaucucaauuauguuaaaaaauaauaauucacauacccuuugacccuguuagaguuucuuccagguaucuggucgacagaaauacuuuaaaaauguuugcugcaggacuguaaugguaaaaaacaaaucagaagacuaaauggucaagagaaacggaugaaauauauuucuaccuuaaauggaauucuaugcaauuacugacuaagcaaucugccccuaccuggagagauuuccaaaauaaauugaaugaaugaaugaaugaaugaucauccauaguauaauccuaccucuauuaaaauguucaagaauguaacguacaguuucauugggugagagacggucugaaaguagcuuugcaauaagauaaacuauaagaacaaauggagcccaagggaaugaaugccauuuacccuuuaauacuagacaauuucauuuuuuaaaaauucuuuaagcucacuauauugggacaaaaauaaucuuagaacaaaaacauaagcauggaaaauaugacaaaaaauuuuuuaaaacuuuuuuugugugcagggauggggaucagacaucaaauguaaacaauagcuauugaguuuauggucuauuuuuuuaauuuuauuuugugcaggcuuaacggucugcuuaaagaaugauuugacacaacaccccagggacgauggugauuucuacagcauucugucucaauagguccucccuagugguugagagguuuggcuuccuuacguuuccugagaaggccaccaggauucuguuaccuaacguaguaaccaaaauuuaugaguuaagcauccguguacuuauacccguguuacagcacacuuuugguaacuguaauaagaguuggguagugcugaacugugucccuuuuaaacgaauuuauuacuuuucgaacgaccaaaauucaacucguagaucgugauaagcagaaaaaaacaaacguucaaauaauuaagugaaagcauuuauugggcgccucucgagcacgcaucacuugcccaacucauacuuucaaggauggaauucccucgggaccccucacgaccauccggcaguuugaauaguugagcgcaugaauggauggagcgguacucagaccgcgggucucacucuguuguuuauuuuucuuucuuuucuuuuuuucccuaacuccggaccgaccguguuugaaacgcuuuucaucuuacgggucccucuugcgggcagagggggaaaagucccccgagauccagccaaaggaacugauuuacaaaaacacgcacgcagucacgaccguccaccauuuccccaccagacgcagcgcaggccgcuucccggcacucggggagggggaggggggaggaggacgggguuuggggggggagccgagcacgaaaaaggcggaggcgaccccggacccgacucugcucuuccuuaucaccacccggggguccccaguucccacccgcacaccaaccuccaacgagaccgggggauuuuccuucuucuucccucaaacggcuauagcgagacgauagacgacgaccagaacuacuucugcucacguaagcgauugaucacgugagcaucuacgucaugugagaucucggucacgugagcaacucucggcuuaaacucgggaucacugagaugccgcacuuccuccuccuuuggaaauggggcgggccaagguaaagagagcgccaauacaugcguuucuuaccugacuguucauugguucauuuuuggagauaacggccuaguugccugagaaacgaugaugucauuaggaguagcucauugcugauugguccgccccgaggguaaacuuaaaagcccagcuuaacucgggaaacugaaccaaaggauuucuauggccaugaagcuuuugagcagagauacgcggcuggucugugagcuugcgcuuuguccccuggcuuuaguuuucuggagcauucuuggggucagagcauuggacaauggcuuggcgcggacuccuacuaugggcuggcugcauugggaacguuucaugugcaaccuugacugccaagaagagccugaugccugcauaagguaugaaugagauguggagugauccuuccucuuuccguguguuugugugggugucuuugguagaaggaguggagcauuugagcuggagggguagaucucgaacuacagaugcuuuuuuauuccagcaauuuuuauauuccacccgagaucuagacugucucuaaaccaucaucaaugugagcuauccugggauugaagcuagccagcagcuagugcuucgcucccgcucuaucucuaccucacugggaauuuuucauuuauuauuugguuccacgcagacccuuuguguggguuuguauucugcucuuguuuagugcuagccuugagcuagccauacguacaguuggauugggcaagaggaugacuaagaccaaugugauuuuuuuuuucuuuuuggaucacggguucuuuagcuguaaugaagcucgaguuagagaaaccauaggauagcugagguguuccugaaccccccucccuuaagcauagcaccaggcuggaaggcugaccugaaagaacuugauacagcaaaggugagaguugcgaccaggcacaacccuaguuugcaaacuaggauaaauguccguuuuaacgcauggagcugacacggaaaaagcuguaaaauugcugggcaugguggcucaggacuuuagucccagcacuccagugccagaggcaggcagaucucuuuugaguucaaggccagccagggcuacauagugagacacugacugaaaaaggaagagcuguaaaaugguuaucugacagagaugaucuucucaguuaaaguaaacccacuuuaaaaaccagcuauuccugcucuggucaccucaauuaggcaaauacaucaguugucuuuauucuggcauaagaaaaugaauuauaaguuuacacauauaugugggcacuuuucuagaaaagauagguuuuccuuucuucagaauauauauauuuuuugagacaaggguucucuguguccucugccuccugagugcugggauuaaaggugaaugcuaccacaccuggccucuucagauucuuaaaagaaucugugaucuagaaaagauuaagaaccaaguuuuagauagugcauggcucccuuauaaguauuauugaaaacauaguaaggucacccaguggugacacaacuuccucucuguguucaccaguuacuucucugaaugccuauaaggguaaagucaagguauuggacagacaucauaagagaaaauggcuuucugaguuucagacuaugcccauuguaucccugaguuaaaaucugugguaacuugacaauauaggguuuugggggcuuuuuuuuugucuuuuuguuuuguuaaugguggcugguuuuuuuuugggggggggaggcuguuagaaaacuaacacauggucacugcaaacaaguuagugguaaaaaugauaugauggaaauuaagccuuuuuauuucaucauccagaaauaaucauggugaauaucuauauacaaaucugcaguuguuuauuauguaaaugaaaacacagauuucuaauugacucccaaaaaauagcaugacuuuuaugugugaguaccaucaagaccccagugcccugccuagguucaaauucuacguuaguguggcuuuaggcgaagcauucauuuacuuuuguuuuucuugaaguuuggggacaugucugaggguauugcauauguuaagaaaguguucuuucuuagaaagggcugaaucccuuacccuuggauuuggggucauggucacccuauguggaucaaggucauguugaacuguggauccuucuuccaccuugcugggguuacaggcaugcagaaccauguccaguaucauuguuuugucucaauugggcugggggugcagcucaguuggcacgggguuugccuagcauagcuuuuguaaacucagaaugguggugcacauggacgucccaggguucaggagguggaaguucaaguucagcucaugucacacaaguuuggggccagccugggauacauguaagugaccucaaaaaaaaaaagugcagaguagaguaccugguacagaguaagaacuugauaaauucaagucucuguauaugcuauuuugugcauccuauacgcgauuucuuucuuuccuuuaaugcuuuuuuuuuuuuugccauuuaacuguaucaucugagguuuuucuuuuauuccguuuguuuugggucuagcauuuguguaguccucuguuaagaguuauugauauucuucaacuuuugugcauccuauaugugauuucuuucuuuccuuuaaugguuuuucuuuuuuaaaugagaaaggucucacugugugggccuggcugaucuagugccucagaggucccaagugcugagauaucacgagccaccacaccgggccaggcuucauuguuuucuuagaacacuaauuuuaggguguaaagguaugauuauuuugauaaucuuaaacagucauuaaccaagaauuauuauuauuauuauuauuauugguuuuucgauacaggguuucucuguguagcccugacuguccuggaacucacucuguagaccaggcuggccucgaacucagaaauccgccugcuucugccucccaagugcugagauuaaaggugugcgccaccacugcccggcuuauuaacccagauuuugcggaugcaugcgcacacccacagugugucugucauccaucuugccucuuuucacagcaauguagccaauccugcgcuuugucaucuuuuuagaacuuuuaccaaucugcuuuguguuauuaaguauuuuuucugcuccugggggacuucaacccaggauuuaacauguuccaaaauacucugacacugaccuacaccccagcccuucuuauguacauuauuguaguuaauuucuaaggagguuuaaugucuuuuccuacuuuaaaucagcuccuucaacuguuucuucaacggaguuccuuuugguuuuuuuuugccauuuaacuguaucaucugaguuuuucucuuaugccauuuguuuugggucuagcaucuauugcagauacagcugguucuugacuaugaguuauuuugaaauucauguaaugggacaugucaauucuuuauuucugucuuugaagucuuauaccaagaaaucaaaguuaaaacaaaagguaaaucgcauuugagugcaggguaaguuugcacauaggaaacaaagacucaguuugacugaaauagcauccgagaaggaagguggauuuuucuaagaaugugauugugagccaggcguggugguacagaucuuuaaucccaguacuucagagacagaagcagaggcaggcagaugucuguuaguucaaggccuggucuacagagcuaguuccagaacauccagggcuacacagagaaacuaucucaaaaaacaaacaaacaaacaaaauggguggugguggucgugaaaccuuguauucuuugggggaagcuagaagacucagguauuagauaaauggcucuuucugaaaucuugaaucacuguagucucuguauucuaaacgccacgcuacaguagcuucauuucuuuugugggacauaagcauuucaucuuggaggugagcuccugaaaucuugccaaauuccuucaaaagucuuuuuugggauuuguucaagguuuccugauccaagaguaagauaauguuucuccauuuauucaagccauugagaaacagaauaguuuuaacauauaguugauaaacauaguaaucucuauguauccuagccuuugcuggcucuuuuguuguuguuguuguuaguauuauguacgaaugagauugucuucucuaaguaaagcugauaccagaagaagcaguuuaucauacucagccuucucugcugggauuucuccaguuguucguaggccaggcaggccuugcuccuucacauccuccgguuuuggucuccucaauagcuaggauuacaggccugugucagcacagcuuguuaguuacaauagcuuuucaguuuuguuauggguugcauucuuaauuauuuggagguuuucuuuauuucuuuugugcuucggcguggaccuggaggccccaccccuucugugaguucugggucagagguagugggaggagggagagaggaguaaugggaaggaugguucauuuuuaccucagggguugugauuacuaccacggugcuacugcauuuuuagaaacugugaaaucccgagguaccuuaaaaugggagcgcugaaguagucaccuaacacauuggaaugacugucugaauuucuuuuucagugagcaacuguucaugcagauggcagagcucauggucucugauggcuggcgggaugcagguuaugacuaucucugcauagaugacuguuggauggcucccgagagggauucaaagggcaggcuucaggcagauccccaacgcuuuccuagugggaucaaacaccucgcaaauuacgugaguuuagagcccauuguuuauuuuuuauggcuuuaugaaggcuuauuaugaaacagaccacaugauacuuugaaaauguaauguaauguugucugaaugauaaauuacggugcuuaccaaguggaauuaucauauuagccuauaaacauuucgcaauaguuuccagggcuugaauacucuaagugaaaaggaugguugugacuugaaugcuuguauuuccacaucagcaccagaggcuauuguaguuagacauacuauuauuaaguauguaguugaacuauauacucagugaauguuaaaagauaaaaacaaauacucuggagacuauugaaaacaaaugaggccugauacuauucaguacuguaggagaaaaggucacauuccaaaccagauggacaagugagaccguacaaccagugaguaaguccugggaguucagcagcuggcaaacugcuaaaggagacacggagagucagaggauaggauaccuuacuggguauccuggcucuauccaaacucacccagacagacgccaggaaggccaagacuggaggaaugucagagagacuaacugaaauauccucacccuuuucaagacacgucuaucacuguuuggaaaagggacuguuuagggucccaugaggaacauuaaaguggacauagcccuuuccucgcuucugugcuacuguccacaugcguaguuagaacugccuuagcaaaauuggagggucgguucccugcuuccaacaacuucagcuuaaaaaacuggagugcuguaaggaaccaaguugccaagacccggagaagcacacaucucugcuuagucuuaguaaguggcccucccaccaauuuuuuuuuuuuuuacuacuuccugguugguuuccuauugugguccaucuuucuucucauuuuagguccacagcaaaggauugaagcuagggauuuaugcagauguugggaauaaaaccugugcagguuuccccgggaguuuuggauccuaugacauugaugcgcagacauuugcugacuggggcguagaucugcuaaaauuugaugguugucacugugacaguguaguauccuuggagaaugguauguuucuuuuuuuuuuaauuccauuuuuaaaauuauguuaaaaucaacaaugugacuguauuggggggggggugcgcuauggugccuguugagaagucagagggcaacuugcagggaucuguucgcucuuuccaaccauaugagucccagggaucaaccucaggucguugggcuuggcaauaagaaccuuugcuagcuguaccauuucauuagccuaaauuguauguugucugcaagagauuuagccauaauuauuucuuggccuuuugguuaacaccaaguaaaaggucuagccagaaacaagaacuugaggcuauuguuaagcugagccuccaaagagcuaaucucuccccauuucccucucccucccucuuucuuucuuucuuucuuucuuucuuucuuucuuucuuucuuucuuucuuucuuucuuccuuucuuccuuucuuccuuucuuccuuucuuucuuucuuucuuuccucucucuuucucucucuuucucucucucucuuuucucucucucucucucucucucucucucucucucucucucucucucucucucuuuuucuuucuuucuuucucuguguagcccuggugguccuggaaccagcagcucuguagaucagaguggccuugaacucacagagauugucaugccucugccuccugagagcugggaccacugcccagccaaagaaguugucuccaucauuuauucaucuaugucgaauucauacaugccuaccauggcacaugacauauacugugcacuuuugauucaaggacucugagaauacauuauaauuauuaauuauaacuagauccgauacuguuugugagagcccagauaaagaggcaucuaaccgcuaucuuuucucuaugccuauggucucuguaccaccuccucagagcaacccaauagucacagguuaagcaguuuuuuuuuuuaaaaagauuuacuuauuuuauguaugugaguacacuguaggucuagggaugguugugagccuucacaugguugcugggaauugaacucagguccucugcucgcucuggcccaaagauuuauuuguuguuauauguaaguaagagggugucagaucucauuaugagugguugggagccaccaugugguugcugggauuuguugacccaucccugagcuaacuucugagcagguuuguuuuguuuuguuguuuggauuuuucgaaacaggguuucucuguguagcccuggcuguccuggaacucacucuguagaccaggcuggccucgaacucagaaauuaccugccucugccucccaagugcugugauuaaaggugugugccaccacugcccagacacuaguuuuaaauauaaacauggacuuucuaaguggccucuucagauauaccacacugccuggaaaucgccugcuucccccuauuuaccuauuauuuuccucauacagguuauaaguacauggccuuggccuugaacaggacaggccgaagcauuguauacuccugugaguggccacuuuauuugagacccuuucauaaggugagcuagugggcccagaaucuaaacuuccgagcuuaaguacaaagaugcacuucucccccucccuguccuagcuguuuguaacuauagccuaagcuuucaccaacuaggaaaccaucuuugauuuuuuuuuuccuuuucuucuaccauucacauccugcccaccagcaauccugccaguauucgcucugaaagucucucucucucucagauuuauuuuauuuuauuuauaugaguacacucuagcugucauuagacacaccagaagagggcaucagaucucauuacggaugguuguaagcgugguugccaggauuugaacuuaugaccucuggaagagcagucugugcuuuuaaccacugagccaucucuccaggccccugaaagucucucuugauaccacuaacuugcuguccuuccauccacacuggccuuccaggccacucucaucucaccccgcugaaaaccuaucaagggccuccccucugucuccuccuuagaauguaacuguaacuggcuucccauugcacuuggaauaaaaucaaacuccaucagcaugcuucuugccugccuccagcccccaacagcucuuuccagcucggcgcuuugucuuuucuguguaucauauaccauauuuaccccacugcuguauauucacugugcauggaugguaauggaucccacaaaggcauuuccauauaagccuauggugauguacuuccuuauuguuucuuccgugucuugccccaagauuuuaaaaaggguugguuaauuaacauugaaaucugaccagauguuccaugcuuggauuuucucuacuuuaaaaagagccuccgcccauucacuaucuaggcauuaacuguuugguuuuccaggaggguaggucuuuaaaguauuuauaaaugaauuuauauuguuuucuugaacuuuagauagucuaacuuuuuccucagcauuuuagaucuuggauguuauaccggugaaucuacacauugguucauuccacaauuuacaucuuucaaauucugaucuuacuguguucaauaguaucccauauaacuuuauagacuuuauauuaaccaucuaguagaucauuguaauuuauuaucaaugaagccaucuuagguaaguuuacacauuacaguaaaaacaaagauauuucguaaugccagcacuuagacaccacaguucagugcacguccaacauaaauaguauuaaagucacuuuguaaacagguacuuaaaauuauauggccuacuuauaugaagugaacaucuucuggugaaauucccuuacauuuagaacuccaaaagauggucaggcuuuguugugggagacuuuugaucuguagaucagcaaaaucucacaagaaaguuaagacuauaaagaauuguaucuuuuuacagcccaauuauacagauauccaauauuacugcaaucauuggagaaauuuugaugauguuuaugauuccugggaaagcauaaagaauaucuugucuuggacagugguuuaccagaaggagauuguugaagucgcuggaccaggcagcuggaaugacccagacaugguaaagcccugaacccuccucauuuaagagguagcuuuuguacuuuggugucuggcucugaaacucgggccuugcacaagccacgcccacgccgaucccuuggaagaggccuucugugaauauuuacaucaccaugcuguagaaaaugguuucucucggucaauuauuuaggaaauuuuaaaaauguuucagcgggcauuguguguaguugcuuggggucucagaacuccagaggcuaaggcaggagaguugcuccaaauucaaggccuaaagguucguuuggaccuuaucuccaaacuaagaaaagaaaaaaagaacuauugaggggucccugcagguauccaagcaaggacaugaacccauugaagagauaagaaugaaaaccuggugcauauuugcuuugucaaccugggucagauuuuggggagucuaacgccauuguccaaauauugaaaacaaggucugauucuaggugcacaauaaagcucaagguguagcuacauagaaacucuuuuacacaguccaugucucaugugaccaugagagugaguuguauagcuaagaagccuagaaucuaguguggucucugaccaauagcacagaggucagcaggccaugaaguacaugugacaucucccccuaaggauaaggaucuagggagagaaggauggugagaugaucauucuauggaauuugggugaggucugauuccacagauagcaaaaaggucaccagguuguugacaaaaucuucuccuagccuucugggcaggaaaacugguauuuaucgccuccauuguaaagagggcccuguguguuuuaacauuccugguuuucagacaaggacuucuguauccccaacaacagaaacccaaucaguugacuauuuuucccaucugaguuauucuacucuuuguccuaguuagugaucggcaacuuuggccucaguugggaccagcaggugacacagauggcccucugggcuaucauggccgcuccccuacucauguccaacgaucugcgacaaaucagcucucaagccaaagcucugcuucagaauaaggauguaauugccaucaaccaagaccccuugggcaagcagggcuacuguuucagaaagguaagugaugcuucuuggacgcauauuggccaaggaacauauccugcguuagagugucugauucacaggauuuugugaugggcuuuucauacucaaauacaaauuuaucucaagcccaacucugccaaaugaagacacgacuaaccuugcuaacagaguggugaauaauaaggcuuuugccggaacuauuacuuucgaaagacagaauuucucuguuguaguccuggcugcccuggaaguagcucuguuggccaggcuucuuguggguauccaccggagaagacuacucugacauggauuuaagccaauagaaaguccuuuuuuagccagcugacaacugcacucagguguuuggaaucccaggguagcccagagccuuuaucaggaugagccuuuaagcguaaauccaugcccuggguggacauacuucaguucagaagaacacuuagccagaauuugaacuacagaagccaaaaaagacaaauuuaggauauuuagggacuuuccuagaaguauaugaaccauuuuggcagaugaggucuuuuugauuuuuaaaaacaggguuucuuguuuagccugacuguauugaaaugcccucuguagaccaggcuggccuugaaccagccucugcauccugagugcugggauuaaaggugugugccaccacacccagcaugacuuuuaaauuucuaaaauauacugcuggcuaacuuuuuucuucucugagugcaugauaguucugcuaauaagguugaauaucaaauauggcuagugaugagguuaaccacauguucacaauucuuuucuuggcuuuucaggaaaaccacauugagguuugggaacggccacucuccaaccuagccugggcuguggcugugagaaaccugcaggagauugguggaccuuguccuuauaccauccagauuucuucccuggguagaggacuagccugcaauccuggcugcaucauuacucagcuucuccccgagaaaguacaccuaggcuucuaugaauggacuuugaccuuaaaaacucgaguaaaccccucaggcacuguuuuguuucgguuagaaagauaaacuacuauauaggcagaguucuaugucccguuuuacuacaaaccaaacuauuuccugccccucccucuaaaaauaaaguaucccaaaggcauugcccuuaaaagcugcuuuucaacauaggcuuuugaaauuaaguggguacuccugugcaauauuccgagguggacugggaggaggguaaaaguguggaauguauugaaaacagauuucaaaaaaaaagucucuacuucggguuuucuuauaacuuguaaccgguaggcuguagcagaugcuuccguacacugguugauuuuaaccuucacaacccugaagcagcuguuuauccacuauaaucuuuacagccaagucaaaagcaacaaaaaacccuuuagauguaugugguucaagaguuuugccuguauguaugagguccacauacauaccgggugcccaggaagccagaagaacaagugcuuuuuuuuccccaagacaggguuucuccauauagcccuggcuguccuggaacucacucuguagaccaggauggccuugaauuuagaaauccgccugccucagccuccaaagugcugggauuaaaggccugcgccaccaccgcccagccuuuuuuguuguuuugacaagugcccuuaaucacugagccagcaagcucuagcacccagaaccaggauuuaaagcuaaaccagccagacacaaauaacuauauggaggcacugcuuagucuagugcaaaggaaaaaaugaaaaucugcuuccuccaggugacagacuggaugugguagcauguccuuaaucccaguacuagggaggcaauggcaaguauaauucaaggccagccuggacuacaaagugcaagccuggcuggaaacaaacucauaugcccagguuauccccuagagcuaagaaaugcagauaggauuaccuguauuuaccaauggugauuggcuacaugauguccuaagagcaauugaugaacuguccuggugacaaacugggggauucgggaggaaaaagguuuggaaggaugcucagguguuauuuuacacaaagccaguaugaugguguuccaugccuccaauuccagcacuuggugaggauaaggccagagaaacccaggggaggaacuagggacacuuccaacaaucuaaaacaagggauguauauugaagcaugcuccccagacucccuuaaugccugaagugcccagcagugguagcacacgccuuuaauccuagcacuuaggaggcagaggcagccggaugaguucugaauucgaggccagccuggucuacagaguuccaggacagccagggcuauacagagaaacccugucucaggggaaaaaaaugagggccuggagaaaugauucagcgguuaagaggauugacugcucuuccaaaggucaugaguucaaaucccagcaaccacaugguggcucacaauaaucugcaaugagaucugaugcccucuucugguucucuagacagcaacauuauacuugcauaauaaucuuuuaaaaaaaaagaaaaugccugaagcaaaacauauuuaaagcuuauuacuggccucaaaucccuugaaauacaagucucuaccucagggggugggggcaucuucuggggaggugggggaugugcaauauuccaagguggacugggaaggggauaaaaaucuggaauguauugaaaauaaaaaauuucaaauaaaagucucuacacugcguuuucuuaucauuuguaacccgugacuuuaaaugccaaguaggaugccaacaugucacauuucauaccacucaacaggagaaaaacuucagguaauuucugaaagcuuuuaauguauucccucccaaacgaacaacugcaaucaaagggguugaaaggucaagauuuuauugucuucauaacaaaaucugcuuagaacuggaucacuuggcccuguaaacagaacagaaaaacaaaauguuguguuuuguaauuuuuaaggaaccuuuuuacauaaucuaugguccuguguucaaucccagccacagccaaaauccaaauacugaaaucguagaggccauuucuuuuauauauugguguucaaacuuuugcacuugugcaaacuuuugugccuacuaauaaagcauaugccagauucacagaacauaaaaaaaaauacuucuggucccaugcauucagauauggguuauguaacucagcuguggacaauauaauaucuuggaggguacccuauauacaccgaggccugagacaguuagcucuacaaauaaggcuuuacauucaaaaggagaguaccuuucucuucuugucgccucccaauucaaaaugcuugcaucucuuaauagccagcauccucuuagaucugcaguugggcucaacgcacuccagucucagcacaaucuucuuuguaguuuuagccuagaaaagauaccaagucaaaccucucaugaaauuccauucugccacagucugcauuuagcuauggaguuaaaaaaaaauccagaagccuguugauuuuaagagaaaagucuaacaguaacaaaaugaaauggaaacagugcuugcugccacacacuugugguucccagaggcaagguacagccacaggaaugugagguuagccugugcuacauaguucccccccccccaacacacaaaaaagcuacauuaaauugguagccuucuagguuacuuuauuuuugccagccaaacucaugcuaacuaggaauuaaaacuuuuggaauucauaauaagauggaucacuuuccuuaaaacuuccauuagacuaauguacacuuuucuggacuucuacacucacugcccacuaauaaucaacugaguccaccauuuuggccaaagacuugcuauuuggcaguuugaaaguugaaauguuaucaauuuuccacacaaguuagcuggacauuuaaauguuuucauucagcccagcugguaguggcgaacgccuuuaaucccagcucuugagaggcagaggcaggcagauuucugaguucgaggccagccuggucuucagagcgaguuccagggcagccagggcuauagagaaacccugucucaaaaaaacaacaaaaaacacccccaaaaguuuucauuccccuaacagcuuaacaugguaaguucuaagacagaucuggguugaagcccagcucugcuaccugggaaaugucccugccaccaagugggagaacuuuacuguggucaacacuaaagcaacgcuugcuaacaaggggugacaaaauucaaguccuuaccaugugucggcaaucacuaaccuuuuugcggaaaauaggcuuagucugcccaccauagccacucuguuuccugucguaacgccgcuuuccuggaaaaaguuacucguuaggguacuaaguuaggguccuaagucaaaauagucacaaggaaaagucucagguuuaaauuugaggcugcccugcauuaagaaauaguacuaaggggggugggggggagggaugccugcaucugucacaucaaaaccaaauuauugagucuggcaugccagggaacagguacagcccuaacccuugagaggccgagguaggaaguuugcuuauuccgggccagccugccuuacagagggggaggcucuggucuuucucaacaacuccccaccacacaaccaccaccaaauuccaucuaagcagcuuacccugggcauacaaagaauccuugcccuucuuguacugugucaccuugugggguuggugcuucccacauuucuugcagaauguccggcggguuuuaggcacguucaccuaguaagaauaguguacagcacucgguuaccggaccacaauggcgcagaguccucgcuggaugcaaauaaagcugauuuauucuacgacuccucacuaacacacaacgaccauguagcucuaaaaggcguugcagucccacgcgccaccaaacugcgcauccacccgccgcuaagucacgccaucaagucaauuccuccacccagaacucgguucccucugugucgcucucugcuauguuagguuucucggguacaucgaggucaugccagagcccagaugcacgcugggauggugcuguacacgcuggguacaaggauuaaacuggaugcuaucaaagccccacagacgaccguaccauguucgcaggagcgcuagcagcucggaaagagagaggcuagagccgcaacggaaguuuauaggcg

SEQ ID NO: 9727 - RNA, 12987 nt, Mus musculus
ggccaagguaaagagagcgccaauacaugcguuucuuaccugacuguucauugguucauuuuuggagauaacggccuaguugccugagaaacgaugaugucauuaggaguagcucauugcugauugguccgccccgaggguaaacuuaaaagcccagcuuaacucgggaaacugaaccaaaggauuucuauggccaugaagcuuuugagcagagauacgcggcuggucugugagcuugcgcuuuguccccuggcuuuaguuuucuggagcauucuuggggucagagcauuggacaauggcuuggcgcggacuccuacuaugggcuggcugcauugggaacguuucaugugcaaccuugacugccaagaagagccugaugccugcauaagguaugaaugagauguggagugauccuuccucuuuccguguguuugugugggugucuuugguagaaggaguggagcauuugagcuggagggguagaucucgaacuacagaugcuuuuuuauuccagcaauuuuuauauuccacccgagaucuagacugucucuaaaccaucaucaaugugagcuauccugggauugaagcuagccagcagcuagugcuucgcucccgcucuaucucuaccucacugggaauuuuucauuuauuauuugguuccacgcagacccuuuguguggguuuguauucugcucuuguuuagugcuagccuugagcuagccauacguacaguuggauugggcaagaggaugacuaagaccaaugugauuuuuuuuuucuuuuuggaucacggguucuuuagcuguaaugaagcucgaguuagagaaaccauaggauagcugagguguuccugaaccccccucccuuaagcauagcaccaggcuggaaggcugaccugaaagaacuugauacagcaaaggugagaguugcgaccaggcacaacccuaguuugcaaacuaggauaaauguccguuuuaacgcauggagcugacacggaaaaagcuguaaaauugcugggcaugguggcucaggacuuuagucccagcacuccagugccagaggcaggcagaucucuuuugaguucaaggccagccagggcuacauagugagacacugacugaaaaaggaagagcuguaaaaugguuaucugacagagaugaucuucucaguuaaaguaaacccacuuuaaaaaccagcuauuccugcucuggucaccucaauuaggcaaauacaucaguugucuuuauucuggcauaagaaaaugaauuauaaguuuacacauauaugugggcacuuuucuagaaaagauagguuuuccuuucuucagaauauauauauuuuuugagacaaggguucucuguguccucugccuccugagugcugggauuaaaggugaaugcuaccacaccuggccucuucagauucuuaaaagaaucugugaucuagaaaagauuaagaaccaaguuuuagauagugcauggcucccuuauaaguauuauugaaaacauaguaaggucacccaguggugacacaacuuccucucuguguucaccaguuacuucucugaaugccuauaaggguaaagucaagguauuggacagacaucauaagagaaaauggcuuucugaguuucagacuaugcccauuguaucccugaguuaaaaucugugguaacuugacaauauaggguuuugggggcuuuuuuuuugucuuuuuguuuuguuaaugguggcugguuuuuuuuugggggggggaggcuguuagaaaacuaacacauggucacugcaaacaaguuagugguaaaaaugauaugauggaaauuaagccuuuuuauuucaucauccagaaauaaucauggugaauaucuauauacaaaucugcaguuguuuauuauguaaaugaaaacacagauuucuaauugacucccaaaaaauagcaugacuuuuaugugugaguaccaucaagaccccagugcccugccuagguucaaauucuacguuaguguggcuuuaggcgaagcauucauuuacuuuuguuuuucuugaaguuuggggacaugucugaggguauugcauauguuaagaaaguguucuuucuuagaaagggcugaaucccuuacccuuggauuuggggucauggucacccuauguggaucaaggucauguugaacuguggauccuucuuccaccuugcugggguuacaggcaugcagaaccauguccaguaucauuguuuugucucaauugggcugggggugcagcucaguuggcacgggguuugccuagcauagcuuuuguaaacucagaaugguggugcacauggacgucccaggguucaggagguggaaguucaaguucagcucaugucacacaaguuuggggccagccugggauacauguaagugaccucaaaaaaaaaaagugcagaguagaguaccugguacagaguaagaacuugauaaauucaagucucuguauaugcuauuuugugcauccuauacgcgauuucuuucuuuccuuuaaugcuuuuuuuuuuuuugccauuuaacuguaucaucugagguuuuucuuuuauuccguuuguuuugggucuagcauuuguguaguccucuguuaagaguuauugauauucuucaacuuuugugcauccuauaugugauuucuuucuuuccuuuaaugguuuuucuuuuuuaaaugagaaaggucucacugugugggccuggcugaucuagugccucagaggucccaagugcugagauaucacgagccaccacaccgggccaggcuucauuguuuucuuagaacacuaauuuuaggguguaaagguaugauuauuuugauaaucuuaaacagucauuaaccaagaauuauuauuauuauuauuauuauugguuuuucgauacaggguuucucuguguagcccugacuguccuggaacucacucuguagaccaggcuggccucgaacucagaaauccgccugcuucugccucccaagugcugagauuaaaggugugcgccaccacugcccggcuuauuaacccagauuuugcggaugcaugcgcacacccacagugugucugucauccaucuugccucuuuucacagcaauguagccaauccugcgcuuugucaucuuuuuagaacuuuuaccaaucugcuuuguguuauuaaguauuuuuucugcuccugggggacuucaacccaggauuuaacauguuccaaaauacucugacacugaccuacaccccagcccuucuuauguacauuauuguaguuaauuucuaaggagguuuaaugucuuuuccuacuuuaaaucagcuccuucaacuguuucuucaacggaguuccuuuugguuuuuuuuugccauuuaacuguaucaucugaguuuuucucuuaugccauuuguuuugggucuagcaucuauugcagauacagcugguucuugacuaugaguuauuuugaaauucauguaaugggacaugucaauucuuuauuucugucuuugaagucuuauaccaagaaaucaaaguuaaaacaaaagguaaaucgcauuugagugcaggguaaguuugcacauaggaaacaaagacucaguuugacugaaauagcauccgagaaggaagguggauuuuucuaagaaugugauugugagccaggcguggugguacagaucuuuaaucccaguacuucagagacagaagcagaggcaggcagaugucuguuaguucaaggccuggucuacagagcuaguuccagaacauccagggcuacacagagaaacuaucucaaaaaacaaacaaacaaacaaaauggguggugguggucgugaaaccuuguauucuuugggggaagcuagaagacucagguauuagauaaauggcucuuucugaaaucuugaaucacuguagucucuguauucuaaacgccacgcuacaguagcuucauuucuuuugugggacauaagcauuucaucuuggaggugagcuccugaaaucuugccaaauuccuucaaaagucuuuuuugggauuuguucaagguuuccugauccaagaguaagauaauguuucuccauuuauucaagccauugagaaacagaauaguuuuaacauauaguugauaaacauaguaaucucuauguauccuagccuuugcuggcucuuuuguuguuguuguuguuaguauuauguacgaaugagauugucuucucuaaguaaagcugauaccagaagaagcaguuuaucauacucagccuucucugcugggauuucuccaguuguucguaggccaggcaggccuugcuccuucacauccuccgguuuuggucuccucaauagcuaggauuacaggccugugucagcacagcuuguuaguuacaauagcuuuucaguuuuguuauggguugcauucuuaauuauuuggagguuuucuuuauuucuuuugugcuucggcguggaccuggaggccccaccccuucugugaguucugggucagagguagugggaggagggagagaggaguaaugggaaggaugguucauuuuuaccucagggguugugauuacuaccacggugcuacugcauuuuuagaaacugugaaaucccgagguaccuuaaaaugggagcgcugaaguagucaccuaacacauuggaaugacugucugaauuucuuuuucagugagcaacuguucaugcagauggcagagcucauggucucugauggcuggcgggaugcagguuaugacuaucucugcauagaugacuguuggauggcucccgagagggauucaaagggcaggcuucaggcagauccccaacgcuuuccuagugggaucaaacaccucgcaaauuacgugaguuuagagcccauuguuuauuuuuuauggcuuuaugaaggcuuauuaugaaacagaccacaugauacuuugaaaauguaauguaauguugucugaaugauaaauuacggugcuuaccaaguggaauuaucauauuagccuauaaacauuucgcaauaguuuccagggcuugaauacucuaagugaaaaggaugguugugacuugaaugcuuguauuuccacaucagcaccagaggcuauuguaguuagacauacuauuauuaaguauguaguugaacuauauacucagugaauguuaaaagauaaaaacaaauacucuggagacuauugaaaacaaaugaggccugauacuauucaguacuguaggagaaaaggucacauuccaaaccagauggacaagugagaccguacaaccagugaguaaguccugggaguucagcagcuggcaaacugcuaaaggagacacggagagucagaggauaggauaccuuacuggguauccuggcucuauccaaacucacccagacagacgccaggaaggccaagacuggaggaaugucagagagacuaacugaaauauccucacccuuuucaagacacgucuaucacuguuuggaaaagggacuguuuagggucccaugaggaacauuaaaguggacauagcccuuuccucgcuucugugcuacuguccacaugcguaguuagaacugccuuagcaaaauuggagggucgguucccugcuuccaacaacuucagcuuaaaaaacuggagugcuguaaggaaccaaguugccaagacccggagaagcacacaucucugcuuagucuuaguaaguggcccucccaccaauuuuuuuuuuuuuuacuacuuccugguugguuuccuauugugguccaucuuucuucucauuuuagguccacagcaaaggauugaagcuagggauuuaugcagauguugggaauaaaaccugugcagguuuccccgggaguuuuggauccuaugacauugaugcgcagacauuugcugacuggggcguagaucugcuaaaauuugaugguugucacugugacaguguaguauccuuggagaaugguauguuucuuuuuuuuuuaauuccauuuuuaaaauuauguuaaaaucaacaaugugacuguauuggggggggggugcgcuauggugccuguugagaagucagagggcaacuugcagggaucuguucgcucuuuccaaccauaugagucccagggaucaaccucaggucguugggcuuggcaauaagaaccuuugcuagcuguaccauuucauuagccuaaauuguauguugucugcaagagauuuagccauaauuauuucuuggccuuuugguuaacaccaaguaaaaggucuagccagaaacaagaacuugaggcuauuguuaagcugagccuccaaagagcuaaucucuccccauuucccucucccucccucuuucuuucuuucuuucuuucuuucuuucuuucuuucuuucuuucuuucuuucuuucuuccuuucuuccuuucuuccuuucuuccuuucuuucuuucuuucuuuccucucucuuucucucucuuucucucucucucuuuucucucucucucucucucucucucucucucucucucucucucucucucucucuuuuucuuucuuucuuucucuguguagcccuggugguccuggaaccagcagcucuguagaucagaguggccuugaacucacagagauugucaugccucugccuccugagagcugggaccacugcccagccaaagaaguugucuccaucauuuauucaucuaugucgaauucauacaugccuaccauggcacaugacauauacugugcacuuuugauucaaggacucugagaauacauuauaauuauuaauuauaacuagauccgauacuguuugugagagcccagauaaagaggcaucuaaccgcuaucuuuucucuaugccuauggucucuguaccaccuccucagagcaacccaauagucacagguuaagcaguuuuuuuuuuuaaaaagauuuacuuauuuuauguaugugaguacacuguaggucuagggaugguugugagccuucacaugguugcugggaauugaacucagguccucugcucgcucuggcccaaagauuuauuuguuguuauauguaaguaagagggugucagaucucauuaugagugguugggagccaccaugugguugcugggauuuguugacccaucccugagcuaacuucugagcagguuuguuuuguuuuguuguuuggauuuuucgaaacaggguuucucuguguagcccuggcuguccuggaacucacucuguagaccaggcuggccucgaacucagaaauuaccugccucugccucccaagugcugugauuaaaggugugugccaccacugcccagacacuaguuuuaaauauaaacauggacuuucuaaguggccucuucagauauaccacacugccuggaaaucgccugcuucccccuauuuaccuauuauuuuccucauacagguuauaaguacauggccuuggccuugaacaggacaggccgaagcauuguauacuccugugaguggccacuuuauuugagacccuuucauaaggugagcuagugggcccagaaucuaaacuuccgagcuuaaguacaaagaugcacuucucccccucccuguccuagcuguuuguaacuauagccuaagcuuucaccaacuaggaaaccaucuuugauuuuuuuuuuccuuuucuucuaccauucacauccugcccaccagcaauccugccaguauucgcucugaaagucucucucucucucagauuuauuuuauuuuauuuauaugaguacacucuagcugucauuagacacaccagaagagggcaucagaucucauuacggaugguuguaagcgugguugccaggauuugaacuuaugaccucuggaagagcagucugugcuuuuaaccacugagccaucucuccaggccccugaaagucucucuugauaccacuaacuugcuguccuuccauccacacuggccuuccaggccacucucaucucaccccgcugaaaaccuaucaagggccuccccucugucuccuccuuagaauguaacuguaacuggcuucccauugcacuuggaauaaaaucaaacuccaucagcaugcuucuugccugccuccagcccccaacagcucuuuccagcucggcgcuuugucuuuucuguguaucauauaccauauuuaccccacugcuguauauucacugugcauggaugguaauggaucccacaaaggcauuuccauauaagccuauggugauguacuuccuuauuguuucuuccgugucuugccccaagauuuuaaaaaggguugguuaauuaacauugaaaucugaccagauguuccaugcuuggauuuucucuacuuuaaaaagagccuccgcccauucacuaucuaggcauuaacuguuugguuuuccaggaggguaggucuuuaaaguauuuauaaaugaauuuauauuguuuucuugaacuuuagauagucuaacuuuuuccucagcauuuuagaucuuggauguuauaccggugaaucuacacauugguucauuccacaauuuacaucuuucaaauucugaucuuacuguguucaauaguaucccauauaacuuuauagacuuuauauuaaccaucuaguagaucauuguaauuuauuaucaaugaagccaucuuagguaaguuuacacauuacaguaaaaacaaagauauuucguaaugccagcacuuagacaccacaguucagugcacguccaacauaaauaguauuaaagucacuuuguaaacagguacuuaaaauuauauggccuacuuauaugaagugaacaucuucuggugaaauucccuuacauuuagaacuccaaaagauggucaggcuuuguugugggagacuuuugaucuguagaucagcaaaaucucacaagaaaguuaagacuauaaagaauuguaucuuuuuacagcccaauuauacagauauccaauauuacugcaaucauuggagaaauuuugaugauguuuaugauuccugggaaagcauaaagaauaucuugucuuggacagugguuuaccagaaggagauuguugaagucgcuggaccaggcagcuggaaugacccagacaugguaaagcccugaacccuccucauuuaagagguagcuuuuguacuuuggugucuggcucugaaacucgggccuugcacaagccacgcccacgccgaucccuuggaagaggccuucugugaauauuuacaucaccaugcuguagaaaaugguuucucucggucaauuauuuaggaaauuuuaaaaauguuucagcgggcauuguguguaguugcuuggggucucagaacuccagaggcuaaggcaggagaguugcuccaaauucaaggccuaaagguucguuuggaccuuaucuccaaacuaagaaaagaaaaaaagaacuauugaggggucccugcagguauccaagcaaggacaugaacccauugaagagauaagaaugaaaaccuggugcauauuugcuuugucaaccugggucagauuuuggggagucuaacgccauuguccaaauauugaaaacaaggucugauucuaggugcacaauaaagcucaagguguagcuacauagaaacucuuuuacacaguccaugucucaugugaccaugagagugaguuguauagcuaagaagccuagaaucuaguguggucucugaccaauagcacagaggucagcaggccaugaaguacaugugacaucucccccuaaggauaaggaucuagggagagaaggauggugagaugaucauucuauggaauuugggugaggucugauuccacagauagcaaaaaggucaccagguuguugacaaaaucuucuccuagccuucugggcaggaaaacugguauuuaucgccuccauuguaaagagggcccuguguguuuuaacauuccugguuuucagacaaggacuucuguauccccaacaacagaaacccaaucaguugacuauuuuucccaucugaguuauucuacucuuuguccuaguuagugaucggcaacuuuggccucaguugggaccagcaggugacacagauggcccucugggcuaucauggccgcuccccuacucauguccaacgaucugcgacaaaucagcucucaagccaaagcucugcuucagaauaaggauguaauugccaucaaccaagaccccuugggcaagcagggcuacuguuucagaaagguaagugaugcuucuuggacgcauauuggccaaggaacauauccugcguuagagugucugauucacaggauuuugugaugggcuuuucauacucaaauacaaauuuaucucaagcccaacucugccaaaugaagacacgacuaaccuugcuaacagaguggugaauaauaaggcuuuugccggaacuauuacuuucgaaagacagaauuucucuguuguaguccuggcugcccuggaaguagcucuguuggccaggcuucuuguggguauccaccggagaagacuacucugacauggauuuaagccaauagaaaguccuuuuuuagccagcugacaacugcacucagguguuuggaaucccaggguagcccagagccuuuaucaggaugagccuuuaagcguaaauccaugcccuggguggacauacuucaguucagaagaacacuuagccagaauuugaacuacagaagccaaaaaagacaaauuuaggauauuuagggacuuuccuagaaguauaugaaccauuuuggcagaugaggucuuuuugauuuuuaaaaacaggguuucuuguuuagccugacuguauugaaaugcccucuguagaccaggcuggccuugaaccagccucugcauccugagugcugggauuaaaggugugugccaccacacccagcaugacuuuuaaauuucuaaaauauacugcuggcuaacuuuuuucuucucugagugcaugauaguucugcuaauaagguugaauaucaaauauggcuagugaugagguuaaccacauguucacaauucuuuucuuggcuuuucaggaaaaccacauugagguuugggaacggccacucuccaaccuagccugggcuguggcugugagaaaccugcaggagauugguggaccuuguccuuauaccauccagauuucuucccuggguagaggacuagccugcaauccuggcugcaucauuacucagcuucuccccgagaaaguacaccuaggcuucuaugaauggacuuugaccuuaaaaacucgaguaaaccccucaggcacuguuuuguuucgguuagaaagauaaacuacuauauaggcagaguucuaugucccguuuuacuacaaaccaaacuauuuccugccccucccucuaaaaauaaaguaucccaaaggcauugcccuuaaaagcugcuuuucaacauaggcuuuugaaauuaaguggguacuccugugcaauauuccgagguggacugggaggaggguaaaaguguggaauguauugaaaacagauuucaaaaaaaaagucucuacuucggguuuucuuauaacuuguaaccgguaggcuguagcagaugcuuccguacacugguugauuuuaaccuucacaacccugaagcagcuguuuauccacuauaaucuuuacagccaagucaaaagcaacaaaaaacccuuuagauguaugugguucaagaguuuugccuguauguaugagguccacauacauaccgggugcccaggaagccagaagaacaagugcuuuuuuuuccccaagacaggguuucuccauauagcccuggcuguccuggaacucacucuguagaccaggauggccuugaauuuagaaauccgccugccucagccuccaaagugcugggauuaaaggccugcgccaccaccgcccagccuuuuuuguuguuuugacaagugcccuuaaucacugagccagcaagcucuagcacccagaaccaggauuuaaagcuaaaccagccagacacaaauaacuauauggaggcacugcuuagucuagugcaaaggaaaaaaugaaaaucugcuuccuccaggugacagacuggaugugguagcauguccuuaaucccaguacuagggaggcaauggcaaguauaauucaaggccagccuggacuacaaagugcaagccuggcuggaaacaaacucauaugcccagguuauccccuagagcuaagaaaugcagauaggauuaccuguauuuaccaauggugauuggcuacaugauguccuaagagcaauugaugaacuguccuggugacaaacugggggauucgggaggaaaaagguuuggaaggaugcucagguguuauuuuacacaaagccaguaugaugguguuccaugccuccaauuccagcacuuggugaggauaaggccagagaaacccaggggaggaacuagggacacuuccaacaaucuaaaacaagggauguauauugaagcaugcuccccagacucccuuaaugccugaagugcccagcagugguagcacacgccuuuaauccuagcacuuaggaggcagaggcagccggaugaguucugaauucgaggccagccuggucuacagaguuccaggacagccagggcuauacagagaaacccugucucaggggaaaaaaaugagggccuggagaaaugauucagcgguuaagaggauugacugcucuuccaaaggucaugaguucaaaucccagcaaccacaugguggcucacaauaaucugcaaugagaucugaugcccucuucugguucucuagacagcaacauuauacuugcauaauaaucuuuuaaaaaaaaagaaaaugccugaagcaaaacauauuuaaagcuuauuacuggccucaaaucccuugaaauacaagucucuaccucagggggugggggcaucuucuggggaggugggggaugugcaauauuccaagguggacugggaaggggauaaaaaucuggaauguauugaaaauaaaaaauuucaaauaaaagucucuacacugcguuuucuuau

SEQ ID NO: 9728 - RNA, 419 nt, Mus musculus
gugcucagaggcacucaagaugguccaguguuugacauaccaucguaggcuuuccuacaacacagccucuaacaaaacuaggcugucucgaaccccuggcaacaggauuguuuaccucuacaccaagaagguugggaaagcaccuaaauccgcauguggcgugugcccaggcagacugcgagggguucaugcugggagacccaaaguccuucugagacugucuaagaccaagaagcgcgucaugaugcagggccuaugguguguccaugugugccaaguguguccaugacaggaucaagcgggcuuuccuuauugaggagcagaaaaucguugugaaagugcugaaggcacaagcacagagucagaaagcaaaauagauaugcaacuuuuuuaaguaauaaaaaucaagacuuggucuu

SEQ ID NO: 9729 - RNA, 1903 nt, Mus musculus
aagcagucaacaggacccccuucuguacgcacaggcaacccccuccucgcguccgugcgccaagccccagagcgccccgcccugucacucaucucugcgcucuccaaucugagagcccacaagugucaucaccaucuagcgguuggaguuuaccggucccugguuacuaggaagggucuguacccccacccacucccaggccucgacuguagccuuuucugcaucuuugaagaauccuuucuuuucccucuuaggcuacaauacuaacgcuccccacuggcuuucuauacaaccugccuucccuuagcaacaauuccaccaucaaaucagcuagagaaagaggaaaaccauacaaucaaagccuucacuuucuuugucuguauucccuuuucuguuaacaucauuuucgcccccaguaaggggaaaaugcaguaaagacaguuucauucgccaugaaaauguccagguuguaaaaauuuuaaagacucuuucuuuuacacaauuuuaugacacuuaaaaaaaaacauuuucuagcuacuauaaacugcccccugagugcugaaaacagauguaauugcugacauuuuaaauacauuuuuuccuaaacaaagccaguucguuuuuuuaaugcaaucgaugauuaaucuuuggaaagauacucagauuugaaaauuugauaguuuuacagaaauaauugaaagccuuugagguuuuggcuguacuuaccuuugccuaccaggugccugaguacuucuucacaggagacucuggauaguuuaaugaagaccaaaccgaaaugaacuccguaccuuacaaacuagugacuucaaagguuaguauccaaugcugugcucuuuuguuuguuuguuuguuuguuuguuuguuuggauuuuuacaucaaucucaccacacccacaaaaggagcaacugcuaccacauagaaaaaaaggaggcuuaacaggugggcuuuucauccuaucgcggcauggguaacggcuccccagguucugccauuucuguucuguuugucaccuuguaggaggcgagcacugagcauuuuucagcagcaaugggcauguuggaacagcacggccaugagugaucuuucccccuuagaaauggaagaacaagguccaggauuccaagcgguccccagaagaaaugccuuuuuacucccugccuuccuuaacaacuuuagugccaccacccucacaaaacccagaauucaggaacaaacauaugcagaagaguccccgggcacccaccuguuuccacuggagaaucauacuccaaauauaaacuguccaugcagccuccuucuuagaauguugaaacaugacaccccagcuugaggcccucccuggugagggggcccugcgugaaggaggcccuuucaggaggugagccaggaaacacauaaggcuugagaacuaauggacuuucagaauucaaaaugugcuuucucuaccaaagaaacuaauuugucgauugaguaacauaaaaauuuaaaucuguguucgucuuuuaaaagaagcauaaacuuuggaugccagagaacugauuguaauuuaaauaucuguagguauuauuaaaaaaauaacaaauaggaagaaagugccaaagauauaaacagauguguucacaaaggagaaacaaaagauccaaauguccaauagacauauacaaaugcuugauuuuaaaaacaugcaaaucaaaacaauuguguuucagcuaugacaucaaaguuuguaaauucaauaauauuacugacuauuuugugggaauauggagaugccuauacucuguuggagauggcuauuuuaauucaaucuuuuuaugaagggcaacugggcaaaauauauuaaacaauaaauauaacagccuacaauucuuucuuguggua

SEQ ID NO: 9730 - RNA, 2945 nt, Mus musculus
uggcauguccgcucacacucugaguucuucccuugguuaaucuguaaaugcaguagcagguaccagcccagaucaccaguccugcagucgcccagcccacauccuguacacggcccauguaaucaccccugcugaaggcacggacaguauauaggagggcucacuugggcuaggaaagaggauggugugucugggcaaugguguuuaaccacuuaaaggccagcagagcugccccuggaaguagaccuagaaguggaagaaggaaauuaauuuaaccgucucuucuaacucuccggcauuauucaaauagauacaaacaggaaccggaaaggguaggaacaaugagcuugcuagaagaggaugauuggcaaauuuucaccccuuauuucauuucuuccuauccuccccaaugcccagcuauuuucauaugccagauggauugugucaaggauggcaggagggcugagaacaaauggacaaggaacagaaacucuaagaacuagauuuguaaggggucuccuacgguuaucauuaguacagguccccacucauacgaaccuggaaugaacgaaguucccgcuucuguccuucuuuugcuuggugaagcgcucuugaaguauauagagucaugaggccuuuagaccuagagaaaugcagacaaagagagagacagagaggaguuuguucuugauagaguagucauauuguuagcaauuuauucucucaauucguccaauuuccuuaggugcuguaacacucuuuuccauauaccagagucaagguaaagguuugugguaaauaucgggaauagugagaaaagaauggcugaaaaggagaauaagaagcuccuucugacugccucuuaugggaugcacacuggucuccacuaaccggcauuagagacauaccaaacaguucccucccucuuaccaguuauucugaucagagaucauuuccucuuugauuccuugcuuccaagaaccucagacucugaagcagacaugcaggaggaucuauaagcacauagauaaacaggagauaauggggacugugcccuuaguggaacagacaaacaccucgauucuugguuccaauacuugguuugcauugccagaguccugauccauuuuaacccuguauuccuaucuuaugaucccaucucaagccuucuuugucacagcccaguccacccucgcucaaagauucccacuguuuccugcgcugaaauugacagguuguauggcagcauugugcacaucggccguggaaagauagacaaggcaggcagaagugccauccacuggaguccuuucgagcuaaacccacccucuuuugucaucaccagccacuacccaccuucauaccaaccuccacaguucugaaacagucucccccucuuucccuugcuuccagggguaaaaagcccuacuucaaacaugagaagcccugggaacagacaaagaaaaggaagagggugagugcugagugcuugugauagccuagcaccaaacaucucuguuccucggcccugccuuuugagauuaagagacacagucauaaccuagggcuuucaccuacacugaaauggguaaaacagagagggggagaggaaaaggaaaaggggggagaaagagaaaauuuauuuuuaaaccaccuguaggauucuaggucuuuccucaaaaguccaccauuuccuuuauuaagauggccagguagacaugacagucuggaaacuggaggauggcggaagagauggaggccccagaucccaugauucuucaaucagagccugccaucugcuuccccugaaagccaucucuaggagucucaguacaagauacaagguaugcaggaaggcguccgcuucugcaaaaucauuaucccaucccccaaaggcuauaucaaacaauaguaucauuuuuuacacaauaauuuguauuuuucaauaucaucugacauaaaucaaaauaaucuguaauaaaguuuuguguuugcugguuuucaccauaggauuuaagugaaaaguccgaagccugguaaggaaacaaagcuuagguaaaguuccuagguuagccccaccccacauccuaauuauauauaaauacauauauacaaauauauauauacauucgcaaauauauacacauacacacauacaaauaaauauaacagugccuacguggcugcauagaauccauacagaacuucaacgauuugguauugguacucacacuaaccuccauagauccugugcagcucucuugucugucuccguuuuuuuucccucgccucaccacaaauagagccacaucgaacuauuguccaaaaggagagaguaaaagcacugaaugcuucugccaguaccaaggccacacaucccaacacucuccuuuauggaauccgguugucaaaggucccuccccuccuucugagacaccaccccuaccgagcccgccguccaggcauuaaggcccaccauuuucucagcaaaugccacgguggcgcgcgucccuccucugaaaggagcaggaagcccgcggacaugugcggacgcccauugauggaguuaauuaaagaggauggacguuucccucuguauuucccucuagagacucucccuaccagcagcccugucaaagcacaggguuccccggcacagauuuagcuaggggcuggggggggggggcacgggagaaucagaggggaagacuccuugaacuugauccagcauggacagcccccuccccaauccaucuccauugcgcugagggaucgagaggcggcggcuaacaggggccgcggcgcagccgcccgggggcccuuaccugcucugcucgccccgggccggaugccagcccgccgcgcgcagggcagcggggaguugguggccagacgagagugacgacugcacccaaggcugcgucgcucugcagcuccgggucacg

SEQ ID NO: 9731 - RNA, 3789 nt, Mus musculus
acuagcagccaguuccccagagacaggcugagacucuccauuggccugguccaaaggcccaaccaagaacccuccacugaguuggucugcagaaucugcccaagaucuuccagcagacugagccucagacacugacuuggaaccuccacuaggcuggccaauagugccagcccaagacccuucaucacuggucugauucucaaaaccagguuuggcugcaccauccgacugaucgccagucccaguccaagaucuuuccccagccagauuccucgugccagcccaugauccacuacuggacuggucugcagacccugauguagauacuccaccaaccuggucuccgguuccagcccaggauguaccaccagcuugaucuacaguuccaagccuggaugccgcauuggccuggucuacagucucaguccaagaccuuccacuggauugauccucagaucccaaccuggucucuccacuagucuggacaccagcuacaacccaagaccccuuuucacuggccugaucuucaaaccuuggcuuaaccucaacaccaaccugaucaguaguuccuguccaggacacugcauuggucuggucuacagccccaguccaguauccaauacuaacuauauugccagcuccagcccaagacacugcaccaguuugguucucagcuacaguccaggucccaguagccugguccacaacccaggacacuccacuagccuggacugcaggccaugacccaucagugaccugacucacagcccagggcccagcaauggccugguuuccagagacaacccaagaaccugcacugaucugguucucggccccaguccaggaaccugcacuggcuuugucugcaacccaggucccaucaguagucugagcuccugcccagauugcuccaguggccuggucaccagcacuuacccaggacccaagagcaaccucauucucaggccuagccccaguccaggacuuaaugcuacuuucaucacaagccacagcccaggagcuaacaaggccagccuugucauuagccgccccaguccagggcccaauaguggcuccacucucauccucaguccaggaaacacuauucucccagucuccaucuauagucugaaaccugaauuugauccaccucucagcagcaauccaguccucaacaccaaucccauuccaguaauaaucaugaacauuaggcugagcaccugccacagucaccauuucagaagcgggcacagccccuaccauaggcuuugcauagacccuauugucuccaguggcuucuaccugugaacuggauagaccuuuaucccuugccccaagcaaagcuucauucugagaacugaccacagccuggggcugagcagagccccuuguaccuguucuugcuccugauuuaguaccagcauuggaccuaaucuuguuccuggcaccaagcaaggcuucauucugggaacugaccacagccugggacugggcagagccccuugcaccuaccccagccucugccuuaggcgcagcauuggaacugccccugaccuuauuucuggcaccaagcaaggccucagccugggaagaagccaaagccaguauuguacuugccccagacucugccuuaggcacagaauuggaauuacccuugaccuuauuucuggcaccaagcaaggccucagccuggggcugauuaggcuccguuguaccugccccagcuucugccuuaggcacagcauuggaauuacccuugaccuuauucuuggaaccagguaaggucucacccugggaauuugccgcagucuuggcaugggcagagcccauuguaccugccccagcaucugguuuagacacagcacuagaauugcccuugaccuuagucuugguaccagucaaggcaguacccugggaagcgggcacagacuggggacaggcgcccaccccagccucugccuuaggcacaacauuggaauugcucuuaacuuuauucuuggcaccagguaaagccucacugugggaauuggcuacagucugggacugggcagaacccgucguaucuggcccagccccugcuuugggcacagaauuccgauuacccuuggccuuauucuuggcuccagguguggucucacccugggaacuggucacauuagucugggcagagcuuguuguagcuguccccgccucugucuuaggcguaggauuaggauugcccuugaccuuauucuuaguaccaggcaaggccucauucuggcaauuggccacaggcuguggcugaccagaggcuuucuggucugccuuugcuccugcuuuagaaacgccauuagagucacuuuugcuaucaaccuuggaaucagacaaggccucagcuugaguuuuugucccagccugaggcugugcacaaguuuuugugucugucccagccgcugccuuacacuuggcuuuggcuuucccucuagccuuaccuuuuguauuagguaaggcuucacccuggcucuggcccguagccugagcuccuuccuuagacgugguauuggcauuguccuuggccacaggcucagucuggguacaggaaaccauaucuaucccagucucugccuuagccgugacauuguuaucacuucuguuuuuauccccagcaucaggcaaggcaucagucugcgaacugguuuugguguuugccuuggccccugcuuuagccauggcacuggcauuaccuuuacccuuaaccuuggcaucaggcauggcuucagucugaucacugguuacagcuugaggcuggguauccguuacauuaacaucagucauugccuuagcauuggcaucuuucccaccauccaucguggcacuggauguugccucagucucuaucuuggccacagucucagauuguauuaaacaaguucuuauaucugccucugcuucacaaauguccuuugcauugucccaagcaucauucuuugccccuggcacagcuucagccagauuguuggcagcaauaugaggcugaccaggaaccuucauaucuaucccagacccugccuuagacauguuuuugagauccuccuugucagccucagcaccagccauaucaucauuuuggauuauggccacagccugagacugugcacaggacuucguguccacuccagucacuacgacagacauaucauuaagauucuccuuagugucaacugcagcaucaagccuagccucagauugaguccuagucacacucacagucucuuccaguggucuuaucauggcuucagccacaacuccagucucauucaucguuccaaucuugacuacuuccuuggucacugccaagaccucacucugugucacuguuacucuguuaaucucugucucuuuuucagccaauguacgagcuucugcuuuggucugggucauugcuucuuucuugaccucugcccugccagccauugcccaagcuuuagcuuuggucugagucacugccucuuucuugccuacagccucagccucagcaucaguuuguguaacugccucuuucaugguuacuuccuuggcuugggauguggauucagucaaagucacugccucugucaugaccauuguuuccaccaaugaacuggucucagacugggucucuaucucuuccucaagcauugucuuggccugacaguugccacuggaucuuacuagaacagggaccuuggagucuacuucagccacaggcucaccuccuucuccaguuucugguucagucuugacucuagucucagccucucuuccagccau

SEQ ID NO: 9732 - RNA, 4001 nt, Mus musculus
acuggugacgugccccucacgugagccgaagccuacgugugcagaccuccuccuaauucuggucuaccuuaguguuugcucucucuguuauuguugagagcaggcaggccugcugcggaaggaagaggagaagguaacggccuggaugccagcaagucuaugcauggaugaugcuugggggaucgcuuuacucuggguagcuguuagccaagauacgggcgacacagucugcucucuucaugcacuugcaaugccuuccgauccucuugggggugggaggcggugaaucuuggagggagagauuccaggagagaccccggaugaggguuuggggcggggagccuuuggcauguaagggccuagaauccggagggacaaguauuauggguuggugcauggauccuaugaagacagaauuuugagguagugagauauccucugucauucauuagggugcagcaccuuuuggaacaaagaaauaaucaacaucgaauuucugcaugucaauuuaaagcugagacugucugcgaccugcauauaagugguagcugggggauuuauuauaacucggggccauuauugacuuuggcagucgacgugugcgucguucccugcucccacccccaggaaaaaggacuguucucagaguuguacaggaaaaaaaaaggggggggggcuaucaucggggguugggcuggguuggggaggacggaagagauauguggucuucuuccguagcucgaguuuuccccguacucgcugggcccgcccccagugcugcgcuuccaaaggggugugguuuuugcaggaaaaaauggccgaccaccgcaagaaggagugucgggauguagcuguauagcaucggggcguugucagcugaguccagagaacugggggcagggugagaaacaaaaccaugaaauccaucugaccaaucagguccccggauuugggaaagcuaguauuuaggugguauauauuuuguguucugucucugcuuaggugccuguaucuguggcucucgcuccagacuaaaccaagaagcagggaagggaggaaaacuucccagaaucaaguagguccaaggaagaagugugaugacacuguuuggaggucgcugggguagacgauaauggugacuaugaacucgaguggacagacucacagacuuucucugcaccccuucuccugguacuguguuggcgguggggaggacauuauuuugaaauacuguauggugcagucuuuguugcuuuuagucuaauaggaacccgauuuguugucuuuagguauggagaagucaggggcuuagacaaggaggugggagggaggaaagaaauuucucagagcaguggaaauugauguaauuauucaauagaucguugaggcugucuuuaagguaguccggugggcagaagucagugaagaugcacuuaaaagucugauuucuagguacugaugucuauuucuuuacaaggaaggguguguagugucaccuuuggaugaagugacagacaggguaguggggggcaggaagacaagaugagagaggggacugaucauccaaggaggaagguauauagaagguaagaaacacuguagugaaggacaagugccugggaauugagauggauauauguccugccuugagggugauuuaucugguucuugaguucucagcucagaccucuguauccuuuuguuuguagaucugcaagaggcuggaaaggaggaagaaacuucuuggaucucugaggguauaugugagggugucucugugacccugacucaagacaucugcugcaaggguaaagaucauuguguguguguguguguguguguguguguguguguguauaauaaauugaacauaauauaaauauauucaauggacauucuugggauggguggaagaacauaaauuuagagaaucuggcuguuuggaaaacauccaaaauugcuuccagauaaaggacaggaauaaugaugaggagaccaagccccaaauguuagcuaauaucuuuguauauuuguaggcaagugauuaagucuauuuaugaacaaaagcacaauuggagaagucaaaauuuuguaaucuuccguuuuuuucuucuagguaucacuguaucugcuguuguagcugcuccuaaccugcagaaucugaagacuuuaccucugaccugagaacaagucagcucuguguccagcuuaagagauucaccccagcuguacgaugggucgcacccgggaagcuggauguguggcugcaggcauggucauuggggcuggugccugcuacuguguauacagacugaccuggggaaaagaugagaaugagaaguugugggaugaggaagaggaggaagaggaggaagaggaggaaaagucuuguagugacaaaacugagaaagaacuuaagacuaauguugggguaggggcgagaggcaaaccucaagaugacucaaaguccaagguugaggugaaugugggaccugagaaugguccagguguaaagaaagaagugcacccagaaucccagaguggggguggacuagaggcuaaggccaaggcccuuuucaagacucuaaaggaacaggcacgugcaaaggcaggcagaggcauaaggcuuccuaacaucucuaggaauaggacccugacaucaaguuugccuugcccaggaggcagggguggaggcugccacccgggaaggacugguucuagggcuaggaacaggacaagugggaaagucaagagaaagaaccgaagcaagagcaacaaggcuccagccacagcauggccuguacgcaagggcaaguucagcuuucccuauaaaauugaugauauucugagcgccccugaucuucaaaagguccugaacauccuggagagaacaaaugacccuuuuacucaggaaguagcacuggucacacuggguaacaaugcagcauauucauuuaaucaaaacgccauccgugagcuggguggaguccccauuauugcaaagcugauaaaaacaagagaccccauuauuagggaaaagacuuacaaugcucuuaauaacuugagcguuaauucugagaaucagggcaagauuaagacuuauaucagucaagugugugacgauaccaugguuugccgcuuggacucagccguccagauggcuggauuaagacuccuuaccaacaugacuguaacuaaucacuaccaacauuugcuuuccuauucuuucccagauuucuuugcuuuguuauuccugggaaaccacuucaccaagauacagacuaugaaacugauuauaaauuuuacugaaaacccagccaugacaagagagcuggucaguuguaaaguaccuucggaauugauuucucuguuuaauaaagaaugggauagagagauucuucuuaacauucuuacccucuuugaaaauauaaacgauaacauaaaaagugaagggcuugcauccuccaggaaggaauucagcaggagcucacuguuuuucuuauuuaaagagucuggaguaugugugaagaaaaucaaagcauuagcaagccauaaggaucugguggucaaagugaaaguucuaaaagucuuaacaaaauuauaauuuuagaucuguucuaaacaacacugaugugauguuucuuaaguuugcacgugggaacaaugcauuuugugaauucuuagguuuucauugcgcuuguguagcaaagggauccuuugagcugcuauuuaggaauaaugaacaucacagauuaucaauacccauugaugcuggcuuuagauugagccacuuuaaguaugccaaauauauauuagggcuugcacaaagaaaacauuuauuaaacuugcuaucuagguugagauauuuuuauuguuuaacuaaacugacagugaaguaacuauaugucauaaauaagcuauacuuuuguauugauuuaaauuuguucaucuaagaguugugcuuuaucaauaaaguuauguuuaagcagaaggaaaaaaag

SEQ ID NO: 9733 - RNA, 4001 nt, Mus musculus
cuuuuuuuccuucugcuuaaacauaacuuuauugauaaagcacaacucuuagaugaacaaauuuaaaucaauacaaaaguauagcuuauuuaugacauauaguuacuucacugucaguuuaguuaaacaauaaaaauaucucaaccuagauagcaaguuuaauaaauguuuucuuugugcaagcccuaauauauauuuggcauacuuaaaguggcucaaucuaaagccagcaucaauggguauugauaaucugugauguucauuauuccuaaauagcagcucaaaggaucccuuugcuacacaagcgcaaugaaaaccuaagaauucacaaaaugcauuguucccacgugcaaacuuaagaaacaucacaucaguguuguuuagaacagaucuaaaauuauaauuuuguuaagacuuuuagaacuuucacuuugaccaccagauccuuauggcuugcuaaugcuuugauuuucuucacacauacuccagacucuuuaaauaagaaaaacagugagcuccugcugaauuccuuccuggaggaugcaagcccuucacuuuuuauguuaucguuuauauuuucaaagaggguaagaauguuaagaagaaucucucuaucccauucuuuauuaaacagagaaaucaauuccgaagguacuuuacaacugaccagcucucuugucauggcuggguuuucaguaaaauuuauaaucaguuucauagucuguaucuuggugaagugguuucccaggaauaacaaagcaaagaaaucugggaaagaauaggaaagcaaauguugguagugauuaguuacagucauguugguaaggagucuuaauccagccaucuggacggcugaguccaagcggcaaaccaugguaucgucacacacuugacugauauaagucuuaaucuugcccugauucucagaauuaacgcucaaguuauuaagagcauuguaagucuuuucccuaauaauggggucucuuguuuuuaucagcuuugcaauaauggggacuccacccagcucacggauggcguuuugauuaaaugaauaugcugcauuguuacccagugugaccagugcuacuuccugaguaaaagggucauuuguucucuccaggauguucaggaccuuuugaagaucaggggcgcucagaauaucaucaauuuuauagggaaagcugaacuugcccuugcguacaggccaugcuguggcuggagccuuguugcucuugcuucgguucuuucucuugacuuucccacuuguccuguuccuagcccuagaaccaguccuucccggguggcagccuccaccccugccuccugggcaaggcaaacuugaugucaggguccuauuccuagagauguuaggaagccuuaugccucugccugccuuugcacgugccuguuccuuuagagucuugaaaagggccuuggccuuagccucuaguccacccccacucugggauucugggugcacuucuuucuuuacaccuggaccauucucaggucccacauucaccucaaccuuggacuuugagucaucuugagguuugccucucgccccuaccccaacauuagucuuaaguucuuucucaguuuugucacuacaagacuuuuccuccucuuccuccucuuccuccucuuccucaucccacaacuucucauucucaucuuuuccccaggucagucuguauacacaguagcaggcaccagccccaaugaccaugccugcagccacacauccagcuucccgggugcgacccaucguacagcuggggugaaucucuuaagcuggacacagagcugacuuguucucaggucagagguaaagucuucagauucugcagguuaggagcagcuacaacagcagauacagugauaccuagaagaaaaaaacggaagauuacaaaauuuugacuucuccaauugugcuuuuguucauaaauagacuuaaucacuugccuacaaauauacaaagauauuagcuaacauuuggggcuuggucuccucaucauuauuccuguccuuuaucuggaagcaauuuuggauguuuuccaaacagccagauucucuaaauuuauguucuuccacccaucccaagaauguccauugaauauauuuauauuauguucaauuuauuauacacacacacacacacacacacacacacacacacacaaugaucuuuacccuugcagcagaugucuugagucagggucacagagacacccucacauauacccucagagauccaagaaguuucuuccuccuuuccagccucuugcagaucuacaaacaaaaggauacagaggucugagcugagaacucaagaaccagauaaaucacccucaaggcaggacauauauccaucucaauucccaggcacuuguccuucacuacaguguuucuuaccuucuauauaccuuccuccuuggaugaucaguccccucucucaucuugucuuccugccccccacuacccugucugucacuucauccaaaggugacacuacacacccuuccuuguaaagaaauagacaucaguaccuagaaaucagacuuuuaagugcaucuucacugacuucugcccaccggacuaccuuaaagacagccucaacgaucuauugaauaauuacaucaauuuccacugcucugagaaauuucuuuccucccucccaccuccuugucuaagccccugacuucuccauaccuaaagacaacaaaucggguuccuauuagacuaaaagcaacaaagacugcaccauacaguauuucaaaauaauguccuccccaccgccaacacaguaccaggagaaggggugcagagaaagucugugagucuguccacucgaguucauagucaccauuaucgucuaccccagcgaccuccaaacagugucaucacacuucuuccuuggaccuacuugauucugggaaguuuuccucccuucccugcuucuugguuuagucuggagcgagagccacagauacaggcaccuaagcagagacagaacacaaaauauauaccaccuaaauacuagcuuucccaaauccggggaccugauuggucagauggauuucaugguuuuguuucucacccugcccccaguucucuggacucagcugacaacgccccgaugcuauacagcuacaucccgacacuccuucuugcgguggucggccauuuuuuccugcaaaaaccacaccccuuuggaagcgcagcacugggggcgggcccagcgaguacggggaaaacucgagcuacggaagaagaccacauaucucuuccguccuccccaacccagcccaacccccgaugauagccccccccccuuuuuuuuuccuguacaacucugagaacaguccuuuuuccugggggugggagcagggaacgacgcacacgucgacugccaaagucaauaauggccccgaguuauaauaaaucccccagcuaccacuuauaugcaggucgcagacagucucagcuuuaaauugacaugcagaaauucgauguugauuauuucuuuguuccaaaaggugcugcacccuaaugaaugacagaggauaucucacuaccucaaaauucugucuucauaggauccaugcaccaacccauaauacuugucccuccggauucuaggcccuuacaugccaaaggcuccccgccccaaacccucauccggggucucuccuggaaucucucccuccaagauucaccgccucccacccccaagaggaucggaaggcauugcaagugcaugaagagagcagacugugucgcccguaucuuggcuaacagcuacccagaguaaagcgaucccccaagcaucauccaugcauagacuugcuggcauccaggccguuaccuucuccucuuccuuccgcagcaggccugccugcucucaacaauaacagagagagcaaacacuaagguagaccagaauuaggaggaggucugcacacguaggcuucggcucacgugaggggcacgucaccagu

SEQ ID NO: 9734 - RNA, 1291 nt, Mus musculus
caugaucaagugugcuucccuucaaggagaacaagaacaagaaaaagaaaaagaacaacaacaaaaacaaaaacgauguucacggagaacacaaauugcuggcuuuucccuuagccacaaugucaguaagcauuuggccagccucucagugguuggaaacaggagucccaccccccaucccacugugagggagaaggcucuguuugucccugaaaacccaaacagcagccuugaaaaucagggccagauuaagauguccauugaugaagugugucgagagacacuguuguguugcugcaagucuuuucugcagcaggcaggauuaagucugcuaauaagcaugacagucauuaauaacaugcuugccaagucuguuucagaccugaaguuuccuuugcuauccaaggggaguggaugugcagaggugcggggcuuggaagagcugaugaguuugucugaaaagccagugcuggugggggaagcacuggcugcccaaaugcucuccuccuucaugugccucuuuaccagaagugggagcagagagaugcuuguggaagccaucuccccuuaaguggcugucucagaaagaaugagacugaagccacccagagccugagcacuuuccugagggcaaagaggcugcagugagugccacuaaggaugcagcuuuagccagucagcuccucccugggugagaguuccuuccacugucuaaauggagggcuacacucugacuggccaggcaaggcucuuccagagcugugggcaacuucuggguuuuguaguuugcagguaaagugcauuguaaauugcugcccugcagccuucuucaugugguaaaggguaaggggcuccccguggccacuagcuggggaugacuaacagcaaaucacagcauagaggugaaggguaaggggaugcccgcggccacuagcuggggaaacuaacagcaagucacagcaucagagugaauguugcuguugccuguggugaucucccugucuaagcgcugaaccacuuagcagaaaugacacccauaugagagcuugugccaaauacccuucugcugcugcugcugcugcugcugcugcugcugcugcuuagauagaaguaguucccuucuccucuguccuacacuagcugauggauggcuagcauguuaaucaagagaugcacucccuuccuguccacuguagugaccgacccucuuacuccccagucucuacccucacccccaguuuguauccucaauaaacugugugcuuugauuggcaagacaauuaaacagggg

SEQ ID NO: 9735 - RNA, 1291 nt, Mus musculus
ccccuguuuaauugucuugccaaucaaagcacacaguuuauugaggauacaaacugggggugaggguagagacuggggaguaagagggucggucacuacaguggacaggaagggagugcaucucuugauuaacaugcuagccauccaucagcuaguguaggacagaggagaagggaacuacuucuaucuaagcagcagcagcagcagcagcagcagcagcagcagcagaaggguauuuggcacaagcucucauaugggugucauuucugcuaagugguucagcgcuuagacagggagaucaccacaggcaacagcaacauucacucugaugcugugacuugcuguuaguuuccccagcuaguggccgcgggcauccccuuacccuucaccucuaugcugugauuugcuguuagucauccccagcuaguggccacggggagccccuuacccuuuaccacaugaagaaggcugcagggcagcaauuuacaaugcacuuuaccugcaaacuacaaaacccagaaguugcccacagcucuggaagagccuugccuggccagucagaguguagcccuccauuuagacaguggaaggaacucucacccagggaggagcugacuggcuaaagcugcauccuuaguggcacucacugcagccucuuugcccucaggaaagugcucaggcucuggguggcuucagucucauucuuucugagacagccacuuaaggggagauggcuuccacaagcaucucucugcucccacuucugguaaagaggcacaugaaggaggagagcauuugggcagccagugcuucccccaccagcacuggcuuuucagacaaacucaucagcucuuccaagccccgcaccucugcacauccacuccccuuggauagcaaaggaaacuucaggucugaaacagacuuggcaagcauguuauuaaugacugucaugcuuauuagcagacuuaauccugccugcugcagaaaagacuugcagcaacacaacagugucucucgacacacuucaucaauggacaucuuaaucuggcccugauuuucaaggcugcuguuuggguuuucagggacaaacagagccuucucccucacagugggauggggggugggacuccuguuuccaaccacugagaggcuggccaaaugcuuacugacauuguggcuaagggaaaagccagcaauuuguguucuccgugaacaucguuuuuguuuuuguuguuguucuuuuucuuuuucuuguucuuguucuccuugaagggaagcacacuugaucaug

SEQ ID NO: 9736 - RNA, 8906 nt, Mus musculus
gauggucuuacccucaacucgaccuucaccgaucugguuaauuuccuuccucuucucuugccuggcguuguaccgcaaccuacggaaagacuggccacccgggagaggcuuggacccacuagccacagagccaugguaaggaagacacggccacaagcagaaagacgggaaacagccgcuacugagugcuugguggacggaccaguccccagagaacgaaacucuuuccuaauucggaggccugguugguaaagguuucccgcccgauagccggcucaggguccggcugacacaucacauuguaccccaccacggacccaauguccaguucuuccccuccggcagaguccugguggaccaggggccaacacccaggccacagcucccuuuccggauugcgggccuccgcucccagcagauucccaucuccggaauucuggacgccugcccaaacaccccucuacucacuguucugcagcaucgaaaugggcugcgggcgggacuuaauaucuuggaaagagggcagcaagugggagagacgacggcggcggcuccggaccugcgacggccuccgcccucuacccuccaccacccccacuuuauggaauaucccaggcacugaccugcagggaucugggacaauuucuuuuccgccuccuucuuuucucggcugcacucgcccgcccucaggguaauagggagcugguacucagacgggaacaacgaccaggacaagaaggacuucugcacacgucagcucuuggucacgugagagcgacguaauccaccaacucgguuccccacuuuccccucccaccagcagugcggcagaagaggacccgccccccucuuuucccucccccauacuaggccuuguuacucuucuuugcgggcuaaucccaucuuccucuagucuugcuucccuuccuccaauuaccaaaacaggacagcauccuccccuggggcuaagggucacuuguacuuuuuuuuaauugacucuuucuucccuagacuccugggauagcagcuucucccucuaccuucccuccucccaacuaugaauaucuaccauuucuucugaaauauaguccuaguccugaggugaguaagucaccagaaaaguaaaccuggaaggagagucuaucuuuuucucucaugaugcuuuuuuuuuuaauuuucgccuuggcuuccccugcucaccgccugcaugcaacuucugaggggggaaaugcaauaacgauauuuccauaguggggggaauaaggauagagaugagagaucaauguugggugauggucucuaaaagucccacgguucucacuuguuggaaaguguuacccacuuuccucacaggaaucuuaaugucuucuggggccuaucacauaacacagcugaaugaacauagcacaccaugaaugaacuaaucagccagccugagaauauguaaaccuucugauuaagcaacaggcacugaaggacacaagucaaccaggaggaggcuugaacucuccaaagccaggaacagaaaagauucaggggaaaucaagugugugugauuuaaaaaaaaaaaaaaagguguacacacugauacacaagugauaugcaaagaacauuaagaaauauacuggaauacaaagagagcaucugcaaaugaaauaguauuacaggagcacaaagaccaaggcaaacugagcuuggcaucuagcaauuagugugaagccaccacacugauuggcuugacgagcacaacaauucccuugcaauuuuaacuuucaaacauagaaaaaggaauaaaggaauuacauucucucauuguuuaagguagccagguuuguuuucacacacugccugccauacaagguuaacuuaaugcauagugcaaaaccaaauaacaggagacaaagugcuaaggcagcuuuccaaggcaugagcuuccgggguggaggaauuuccuaguuuagcuccaagguugguaucuaaguagaacuuucaaaauccacagaagacaugggaguccaucaauaguccagacagcuuaggaacaagcuaaucuccaggaaguuguuugucgguguagcuucuaaaaagcagaauugagccaggauuucgaacuuaguaaagugaaccaaaucaaugaucugucucuggauuuagaggacaggugcaacaaagagacauucccgggcaaaaagggcauccgaggaaaacguugcuaguucugacccaagcacuggcugagagaggaaauucugccuaaggugaagggaacauuucauccuuagcaaauccauccccauaauguaugaaauuacuucagacuuccucagcuaaaagucacuucugaagauaaacuaaugucuguguucugauucuagguuuaucaagcaaucuucugaaguuguaacuucccaagcaguagcuggucugcaggaagagaaugaacagguaagacagacagaaaccccuucuacucccugacacuuggauuucucacaguaaauuauccaguuguuacuccuauuggaacacaacauucaccguagccuguuuaacacggagagagugcaaagauuggugagucugaacauucagaucuggauuuauguguaucuuugaaugagugucuaucauggacagagcauccgcucuugguuuacagacaaaaucugggguagauagugcaacacucaagacaacacccuggacuguguaugcaccccuguggaauccugucagggaagccagguggccuuagaucaaaaggcaacauagagcauuaccauuuuaugcuguaccuaucuaaugaucaggugauguagaaauuacaacuaaggcauguggugguaggcagguucccaacaucucagugacaguuaaacaaagguccauuauguaaaauaauuaaaggacacuauacauuggggcuggaaauauggcuaaguguuuaagaacacuuguugcucuugcagaggacccaaguucaguuucuagcacccacaugggaguggcucacaauuucuuauaccuucaguuccagggaucugaccccuucuucuuacuuccacugcauaugguaccauauuaaaaauaggaaccuacacaugcacauaaauaaaaacuaaagugaaaaaaaaacucaaaauaaaucaccauuucaaacaauuuacauugcguacuaaagaaaggcauugcauuucacaauuaacuuacucugcauuucucuagcaaaaacaggaguacuuugcccaaaacacaucaaacauaagcucucuugcuaaaauuuuaaucuggagaagaaaggaaggaaggaaggaaggaaggauggaaggaaggaaggaaggaaggaaggaaggaaggaaggaaggaagaaaccuugaaaaugggugugaaacaaagaucuuucagucucuccuaccuagaccccugaaagcugcccuuacucuuuagcauuuguucuuuaugcuaaccagucuuggauaagcugcuugcaguaaggcaacacagcaucagaagugcucuagcuuuugcaaugucagccuccucuuuuguuucccuccauaaugcauaguguuaccaaacgcugguccauuuuuauuuggggguacuuucuaagucauguguuauguguggccagcaggaaguuuccuugggaaguaacuugacuggcuuugcuuuguuuuuacaggcucugaaaucauuauacaaauuuguaugggggcuugcuuaaacauuuuccuuuuuuuuuucuuuuaagaugguguaucggaugucuaauauguccuuuuaaaaggaucugugaguaccuauaauggagaacaaaguggcuuuugagucauagcuccuguuuuuguugauaagaacuauuaacuaaagugacaaagacauacaguagcugaggggauuaaugcuccugggguuuaagagauuuuuagacagggaguggagaaaacuagaaaguucugauaaacugagaaguuggugguguguuucuucuguguuauacgcugaaaugacuggaugagacaccaaagcggggagagauuuuguaacaaggaggauagguaaacauaaagcuuucguccuugaaacuugacaaaauguugugaaaauaaacucacauugcagaauugccugccuuuaccaggcucugacuauuucuucacucuuccuaauguauauauuccaaauaacaagaguaucuuguggaaguucauagcagccaaaaucugaaagcacaguugaaucugaauauucuguucauauaaagcuuucaaagacagaauucaguuaccugagaaaacuacaugaucauaaaauggcagcauaagagcacaguggccaaaccaaaggaaggagaggagaugaaugggauaugguauuguuaugugagucuagugcuuaggaauaccagagagcaaugauauguucucaguuucugauaguugccaacaaggcauuauggacucucuggcucaucuccugcaagggccuccuccacacagaggcccuucacagggaaggcuucuggcugccgugucaaauuucaacauccuaagaaagaggcagucugggggucuauauuuagaguaugacuccccgcagugaacagguggugcccggggacuuacuccugcauauuuugccccugaguucugagggguuuauaagggaggcacaacgaauuuauaagaaaggucuuuaucuccuggggacugacuacuugggauccuguacuuuguucuucuaguuaugagagggaaaagaaacuguugucaccaguguucuuauaaucuacagccauccaaagucccucauucccauugucaguaaggaaugcugaagacucgccauucauguggugaucucagacaugaauggcagaagugaggagaccucacuagucuuauggugauaugaaaucuccccuauuagccagaacucucaucaaugggauaacagaggguucucuaauuauucaaguacaggaugcuuuauaggcugccuccuggaacuccagagcggaaguuaaaucccuuugaaugaaaugcaggcaaaucugugccauuauuaauuuguaaagucuaacaucuaaguugaugacugcauaaaaucuaucuuuugggugagucugaaaguccugauugaaccuugucaccugacaccugugaguccccucuggcucaagaaagggacaaauaaauggcucucucauuuaaaaugaucaaaaguugaauccugaccucacuacagauguguuucaucacucauauugaaaguaugcugguuuuguuugugaggcuauguuucaaaacuguaagauguuauuuuaaagcugcuauuuagaagaaaauauuuucaacgcuggacaaauuaacuuugccaaaucgaugaggucuugcuaguaacugaaaaauuuuauuuccuuaagcauacauuuuaaaagguugggauuuguuuauauauccaaguggaaauagcuuuauuuagacuuaugauuacaaaauaauagucuaucaaguaggaaagaggcaauaaaacauaauuagauuaaaaguguuaauacaaauuucucuccuaucuguguuuccuuuucugaccccucucuucaauucugcuacagagacugaaaauagagagggauggaaauuaaagaaagggaugcaggaguuugaacaccaacgaauagauaaggcauuuccccgaagaagaaaguguaaaugcacaauaauacgggaaagucaaacucaaacguuauagagaaaccguaacuucugguuucugguauuguuauacagaaaaagacuaacagggccccaaguauugggggagguacagagcuuacuggcuccugccgcacugcuugugggaguggaaauugggggcuagagcuuacuggugacguggcugucacgugaccaagagccgccuagagccgaaguccuguuagucgccucugacuggguaccaacccccuauuacucugcaggcgcgugaaggagaaggaaacucgcugggaccgugcaggucgguggaagcugcuuggaaggcgaugugggugggagagggccaagagcaccucgcauccaaguuuggcgaauaugggcuaugucccuuucucaccuacuuuuuaaauaucuacuggacccgcaucucacccucgguucuuuuaguagggagaaguggcaggcuucagguuggggugaggugggugaacugcgauugcacaaaauccaagcaaagaaagaaccgccaggcaucgcgucccgggugcuggucugucccccaagcacuccgugcccucgguccccugucuguuauaggucuccgcuggagccuagacuugagaagaagcaacccgccuugguuggaaccuugcugcagguuugaaggugggauucauccugauccuaaagguaggagaugaggggggcugggaucuuugcgggucagguccgagucgcccucuccuggccccuucuuucuccacacccccucccauuucggugcagggaaagggguguggcggccuuugcuggggaaauggcggacgaggagggggcggggaggcccucguuagcaaagucgggagggugugagaaauaauauuuuuacucaaaaauaccaaauucagaaaagcaccaaucgguguaguuaucucuguccaaguacacuuucaauucuccauugcugucugacaucgcuuuucgauuguccuucugccagacucgguccaccuaucuccguggagggaauacagcagaagccaccagaagaaaaaaggaauucaauugguuuuuguagagguuaguuagaaaacaugcgguguucuggggguggguaggaggaggagagaaaggagguggugguaaagaagccuacaugaggguuaucuguuccuuucaccugccugccuaucaagugagagccucgucuacugucuaucucugagaauccuggaagcauaaagguagauccugaggguagauaugggaagggaguaaagaacaaugagaucauucccuaauaauccaacuuucucagggagaauucgaacgaacgccuaccugucugggcagguacuaacccagucacagcucagagcucuaaugccauuucucucacucuuagauucaugacaagaaucgcagaagccuagaagaggcugaagauuacuagccugaccuauuaauccacacauccgcugaccguucucuucaaucaggugaagaaaggcccucuucuuucuggccacaaggcucacacaccuauaaucaugggucgggcccgggaaauggguuggauggcagccggacucaugauuggagcuggugccuguuacugcauguacaaacugaccaugggaagaagugaggggaacgagcuggaggacgaggaggaagaugaaugggaagauggacaggaucuggaugaagaggaagcagacaauugguuugauuucacagcaauggcucgacccuggagugaggauggggacugggaugaaccuggggccccaggugggacugaggacagacggucaggugguggaaaggcaaacagagcacacccaaucaagcagcggccauucccuuaugaacauaaaaacauauggggugaacagagcuuuaaauccuucacuuguauucuugaccugaacaaguguguuuccacucaaagaaagaaaagguucacgaagaacauaaaugcuggcuuuucccuuagccccaauaucaguaaacaucuggccagccuaucagugguuggaaacaggagucccaccccccaucccacugugagggagaaggcucuguuugucccugaaaacccaaacagcagccuugaaaaucagggccagauuaagauguccauugaugaagugugucgagagacacuguuguguugcugcaagucuuuucugcagcaggcaggauuaagucugcuaauaagcaugacagucauuaauaacaugcuugccaagucuguuucagaccugaaguuuccuuugcuauccaaggggaguggaugugcagaggugcggggcuuggaagagcugaugaguuugucugaaaagccagugcuggugggggaagcacuggcugcccaaaugcucuccuccuucaugugccucuuuaccagaagugggagcagagagaugcuuguggaagccaucuccccuuaaguggcugucucagaaagaaugagacugaagccacccagagccugagcacuuuccugagggcaaagaggcugcagugagugccacuaaggaugcagcuuuagccagucagcuccucccugggugagaguuccuuccacugucuaaauggagggcuacacucugacuggccaggcaaggcucuuccagagcugugggcaacuucuggguuuuguaguuugcagguaaagugcauuguaaauugcugcccugcagccuucuucaugugguaaaggguaaggggcuccccguggccacuagcuggggaugacuaacagcaaaucacagcauagaggugaaggguaaggggaugcccgcggccacuagcuggggaaacuaacagcaagucacagcaucagagugaauguugcuguugccuguggugaucucccugucuaagcgcugaaccacuuagcagaaaugacacccauaugagagcuugugccaaauacccuucugcugcugcugcugcugcugcugcugcugcugcugcuuagauagaaguaguucccuucuccucuguccuacacuagcugauggauggcuagcauguuaaucaagagaugcacucccuuccuguccacuguagugacugacccucuuacuccccagucccuuacccucacccccaguuuguauccucaauaaacugugugcuuugauuggcaagacaauuaaacaggggcacugg

SEQ ID NO: 9737 - RNA, 17771 nt, Mus musculus
ucacaaagggagaaggggcuacuuagggccucagaggucacaaagucccugcaugauugacaggaccugcuguggugggaagagguaggaguaggguaaaggagggggcuugugcucuuggugggaguggaauucggggacccaagcuuacuggugaugcgggucccacgugaccaagagagcugacgugggcaaagguacuuaaagccuuacggccaucccugccaucuuccuccggguaccaacgcuauuaaagcugcggucagucuagcgagacagagaaaauucccucagaacuggccaggugaguguuagaaugaacauucucuguuccgggggggauggggggguauagaaaucgccuagggaugcugaaguccaaggccacaggcgccucugcacucucugcuggccgaguuuuucuagacucgggaacuccagcacagcggauuuuggugggcagcgggggaggggaggaauggcaugaaaggacuaucggguuuauggaagaagccgcuugcuucucccccagcucuuuugcgguuuuauuuugacauuuggcuaggcucccuugcuugccgugcuguucugagaggagggggcaggagaaguaaaacgcgguagcacauacacucccagccaaggggcuugggaucgggugaccggcgggggcuugaaauuuggaagcaaucaguauuuugcacucccacccucccuuuucagacaccuuguugccaaaacccugcucccuccccucccuucccuccccuccccucccagcccccugccuuucuagggcgcuagcaaaugggugugccagcuucugugggagagauggagcauuuggagcuguacgggcuucacaggcugggggaccgugagagaaucugguauuagaccgccaugcuaacugccaagcugcucuccagacaccugcggcccaccaucccuucacccugguccuuuuggcccugaaaagggaauucggguaugcgggcuaaagaaauggcgguugucuggggauuugggauggggaugggagguggagcucagaggagagaaaccagagaaaaucacgacccugaaacugagaaggcgggccuagaggcccuugcucugcgggccagagcuaggccaggaaguuggggguggggggugaagagagcugagcauaagcggggaacacuagaauaucuggcaggacuccccccugcugcaucuuagccagcccuugccuugcucccuccgcuucauugcagcaguagaagggguguggcgcugugucucagaaaaauggcggccagagguggggcgaaagagaagggggcguugaggccuggggagccugcgcaaaugggggaggggaccgggauagcugggaugugagaggcuagaauuaaaggaauugaaagguggaauucuuugccacuuuggugugccaagaaaagaaagcuaacccucggacucuuguucuggaugcugaucuauguccaccagguucuuagucugccccugcagucuguauuccugcccuucaacccguccucagcaggaaacucuggccuaauucgaggaaggauacagagcucugaauucuugcaggucaguguuuggggugaggugagaaauggugauccccugguguggguguggcagaggccugaacauagaaccagaauacuuuccccugaaucuuuucuuucuuuuagacaccuuuguccuggaguguccuuuuuggugcagggaaggggccguguggaacugucuuuguaaguugggggugaagaggaguagucguaagggauuuuuuuuuuuuggcccaccagagugcaagucaggggagaaacaacaaucugucuacccaagguucaaacccaccugucaucuauccacagauccgucuaccuugaggcucugcaacugcgagcacaguggaaauuguuccugaucccaggaagcugguauguacaugagcgcugucugaggacauuugaaugggguucaggauauuauaggugaaucuaaaauuucccccucucugccaggcuuccauauuauccccuccccauuuaggaacaaauaaauuauggguaguggcccugggaaggugaacuagaguugaagauacagccugcagcuaaucucuaaaucagcaagcgcagccuuugacacucgugcgccucucauaccuaacguuuacucccacuagguccagcucagcuugcagccuccgaagaacuuucagacccgagcuugagauccucgauuggacugguguauacauuucgcuuaagcaagccaguuccacaaccuggaucagagacucacuccagguguaccaugagccgagcucgggaugcuggcuguguagcugcuggaauagugauuggggcgagugccugguacugugucuacaaauauacuaggggaaaagaccagaagaagaagaggcugaccaagcccaagaaccgggccucuguggguacuggaagcagggcuagagcgggccucagagcuggauucacaauugaccuugggccaggauucagucccccaaaccccgucgauauugagauaaugaacaaggcccaaggagaagccuccaaucuugccaccaccguagcugaagaaguggcaccagcugcacccaguccuaagguucagaauggggcagaaaguaagguccaggaguuaaauggggcuaaaacugaggcuaaucuggaaucaguagucaugccuucagcuaccuguacaguuacaccuccucccaagguggcagggggucucacugcugcagaggcuccagaaaucauaggagcucccaaagugcuggaagcucccagcaccacagaggcuucuggggcaguagcagccccuggaccaacaguaucuccaaugauagcccagacuccugggccagugguaccuucgccaacaauagugucuacugggccagcagcaauucccugggcaguggcacaucccggggcuguccagucuccugggccagcaguaccucccauggcaguccaaucucuugugccagcagcaccuuccugggcaguaguagcaccuccuggggcagucuacauuccuguggcagcccacuuugcugggccagcagcagcuuccaggguaacccagucuccugggacggugauaccuccccuuccacccccaucaucaguacuucccaggggagucccaucaguaccuggcagaacaguccagucuccuggggcagccgugcauccuguggcagcccaaucuacugggguaguagugccuccuagggcaguacaguauucuggggcagcagugacuucuggaggggcagcaguaccuuccggaggggcagcaacuccuagggcagcagcaucuacccagaggacagcaagcacagaagucaugcaggucccuaggguggcagcagcuacugaagccacagagacuccuagaauaggaacaccugccaugguagcugaggcuucucugcccgugcauucuggggcugcagagaauccugggacuucaggguccucuaagacagcagccacuggcaagaaagcagccccuggagcucacacuggggcuauaccuaaagcugggucagccacuggagcuguacccaaagguggaggaggcaaggguggaaacaagaaccggaguggaggcaagggcaaaaauaggaagaacaagguugauguggaugaguuggggauggguuuccguccuggugauggggcugcagcugcggcggcggcuucugcuaauggggggcaggccuuccuagcagagauuccggaaucugaggaaggggaaucuggguggacugacacagaguccgauucugacucugagccggacgucccgcagagagggaaggggaagagaaccauucccaugcauaagcgccccuuuccauaugaaauugaugagauccuagguguucgagaucucaggaaaguccuagccuugcuucagaagucagaugaucccuucauucagcaaguagcccugcucacccugagcaacaaugccaauuauucauguaaucaagaaacaauccgaaaguugggaggccucccaauuauugcaaacaugaucaacaaaacugacccccacauuaaggaaaaagccuuaauggccaugaauaaccugagugaaaauuaugaaaaccagggcagacuucagguguacaugaauaaagugauggaugauauuauggcuucuaaccugaacucagcgguacagguaguugggcuaaaauuuuuaacaaacaugacuauuacuaaugacuaccagcaccugcuugucaauuccauugccaacuuuuuccgcuuguuaucucagggggguggaaaaaucaagguugagauucugaaaauacuuucaaacuuugcugaaaauccggacaugcuaaagaaacuucucgguacccaggugccgucaucauuuaguucccuuuauaauucuuauguggaaucagaaauucuuauuaaugcccuuacucuauuugagauuaucuucgacaaccucagagcagaaguguucaacuacagggaauucaacaaggggucccuguuuuacuuaugcacuacaucuggggugugugugaagaaaauucgagccuuagcaaaucaccacgaccucuuggugaaagugaaaguuauaaagcugguaaacaaauucugauugaucugugcccucaagaugugugaucucucgguuuuacacucgggaagcauuaacagugagacacuauuguuuuucuacuuguguguguaguacaggaauuauucagaugccacguuugaauaauucagagugauguuaucugugauagucaccagcuuuaagcugaaccauuuucugaauaccaaauagucccguaguccuguaguccugugguuugacuugugcugcuugggugggauauuuucccuggguccucuaugugaacuaauagcaauccuguucgugaauggccuacucagcucuuacuuguuuugacuugaauuuugucaccaaagacuucauauguguaccaucaauaaaguguauguugcaaauggcaagaaguuguucuggugcuuuaaguaagucugucugccaccaaucacagacacuauagcauaugccagcaagauuuugcugaaaggacccugauauagcugucucuugugagacuaugccagggccuagcaaacacagaaguggaugcucacagucagcuauuggauggaucacagggcccccaauggaggaacuagagaaaguauccaaggagcuaaagggaucugcaacccuauaggaggaacaacaauaugaacuacccaguacccuagagcucgugucucuagcugcauauguagcagaagauguccuagucggccaucauugggaggagaggcccuuggucuugcaaacuuuauaugccccaguacaggggaaugccagggucaagaagcaggaguggauggguagggagcagggugaggggaggguauagggaacuuucgggauagcauuugaaauguaaauagggaaaauaucuaauaaaaauuaagucuggcugcaaagguaaggaagaugaacacacagggacuaguaacaguaccuggcauaggcucagggucacgugcuuguuaccuaggagauugaggagaacaucaaugaaggaugcccuuaagauuagccugaaggacagcauagaagaguggccuagaaaggacaaaugauaugaagaaagacagggguaggaauucuguuccuuugauagggaggaagcuaguuucccugaaauggaaaaacagaaccuguggaagaggagcgauaaugauaacacugauaauuuagggagaagaaguucuuuauguuuguuuuuaaaggucguaaaccuucagcuuggguaccaaaauauucuguuauucaggguguaacaggacacuuuacaaagugcauaaauaaaaggaaaaacagagcugguggauagcuuacauggcaaagcccuugccucacaaguaugaggaccuggguuugaucuuuagaacucacuuaagaauguugugugugauacuguccacuuguaauccuagcccugugggugccuagacgagaacaacccugggccgcacuggccagccauucuaacauaauugaugagcuccaggccagugagagacccuguaucaaaggaggaauggaauuccugagaaugauacccgagauuguccucuggucccaaacaugaacauacacauagaaaguaaucugguagcaauugcaagaugaauugaagcugacauggguuuaggaguagagauaaaaugagcauuuguuugaaaguuauaauaaaucacacauaaaauuaugaaugaugaaaugaggugguaauaugacacaaguugcacacacacacacacacacauccaagcccugccacccaacaaguucugacaggaaaggacucucuuagacaagaccauauagugaccaaaucucauuuaggaugggaaaaaaaucagaacaauaaaaggaccuuuggugcuggccccugguagaauucccaaaacuagagcccaacuccuuuagaaaaggaguugggguaagguuuuucuuguacccucacccaaccccuuuguuucuaaguguaaguucuuucuucucuggcugauucacuuaucaaagaagaaagaaaagaaaaagauacuaaaauauucucuaaaugcagccugcucugcugacaucccaaaaacauaguuuauagagcuuaggguucaaucaccagcaaaacacauacacacacacacauacacaugcacacuguguguguaagagagagucagagacagacagacagccacagaaacagauguauugcacaucuaaaaauaacaucaccauguuaggaacaaaguagaugugauauauuuuauaauguaacauaauguauucaucccauaauguguaugcauauaagaugauuuuuuugcacaggaauauaaucaccauuuguuaauucagcuaaaaacaauuaaaacuaauauuuuauauaagcaucaaacuugauuguagccaaaaggcugaaaagggaucuguacacucauuauaagacaugacuuuuuuuaaaauuauuggccauuuuauuuauuuacauuucaaauauuguccccccuuccugguuuccccuccacaaaucccccaucccauccacccucccccugccuucaugagggugcucccccaccuacccacccacuccugccucaccauccuacacuggggcauugagccuccaugggaccaagggccucccuccccucccauugaugccagauaaggcaaucucucucucugugcuacauauguggcuggagccaugggucccuccauuuguacacuuugguuggugguuuagucccugggagcucuggggguucugguuaguugauauuguuguucuuccugugggguugcaaaccccuucagcuccuucaguccuuucccuaacuccuccaugggucccaggcucaguccaaugguugacugauagcaucugcaucuguauuugucaggcacugucagagccucccaggggacagcuauaccaggcuccugucagcaagcacuuuuuggcaucagcaauagugucuggguuuggugacuguauaugggauggguccccagguggggcagcacuauguucauagcagccuuauuuauaauagccagaagcuggaaaaaaccagaugucccucaacagaggaauggauacagaaaaugugguacauuuacacaauggaguacuacucagcuauuaauaacaaugaauucaucaaauucacaggcaaauggaugcacuaaaaaauaucauccugagugaaguaacucagucacaaaagaacacacaugguauguacucacuaauaaguggauauuaggcaaaauguugggaaugcccacaguacaauucacagaccaugugaagcucaagaagaaggaagaccaaaguguggaugcuuccguccuucuucgaaggggaaacaaaauacucacaggaaguauaggaaggaagggacuugggagggagagaggagggaaggggaaaagggaggcaggaucaggcaugggagaagaugggggcagggaguacagaggaucaagaaauugggguguguaguagugggggauggagacguggggguagccacuagaaagucccagaugccaggauagcaagaggcucccaggacccaacagggaugacaauaacugacauacccaacaaaaggaauauagaaccuguugagaccauauccaguggauaggcauggccccuggucgagggaugagaacauccucccaucucagaaauuuuaacccagaauuguuccuaucuaaaggaaauucagggacaaagagucagcagagacugaaggaaaggcuauccaaacggcacaacuuuuaaguauaugacauauuuauaaagauucacauaaaugaaauucuuucagauauuuagugugaguauuucuguguauucuuuacauaaauuggggucauauugcacaucaguagcucucaauguguagcucacaaaauauugcagguugcugaaaauguacggucaaaacaauucucaagacaauacuaauauguuauuugcuguuuucauaacauugacauuugauacaaaggcaaugagaaaauuaucauguuacagcagaaaucaagacagugaccacaaacuacacuaguagugauugcauuuuuuuuuacaguggcacacucaaauucuuuaaauccaguuuuauuuugaaagguuucaacaaaguccuucuucauuaugaaauaacauguaugauaacccuccaugcuugagugccugucuuucaaguauucacugugcugcuaccuuaaaucaagaguaguuuucuugaagaaacauuauuuaaguugguguuucucaacuugugggcaguggccccuuugggggugauaaaaugaccuuuucacaggggucaccaaagaccaccagaaaacacauauauuuacguuacaauucauaacagaguagcaaaauuacaguuauaaaguagcaaugaaaaggauugggucaccacagcaugaggaacuguauuaaagggccgcaccuuaggaagguugagaaccacugaucagugguuuaaguuguucacugaaguagcuauuggucauagaacaucauuuuuacuuaagaacaaauaaauuauuuuuuuaaaaagaaaggauaagaaaaagagaaaauguguuauuuauacacaguagaaagauauuuagccauuuuuuaaaaaaugacaguuuuagaaaaaugaaauggaaucgggggucauugugcaaaguuaaauaagccagauuuacaaagacaaacaccauacauggagccaaaaaaaggagaacucucauauaaucuguagcuuuucacacucauaaauuuggcaggcagaagaaauccuuugagaaaagcauuucacaguacuuucccccaacaauaaaaucuuagcuuuuaggaagaaaaaaaaugggggaacuagaauggucgccuguaagcuuggcuacuuauaguacuugaagauuuuucuggguacauuaguacccauaaugaagguaguggccuuuccauccuucuaggggaaugcugcaggaagcuuuggaaccuagaacugaucagccaguuuucgugguacugcagccauggucauucaauaauuaauagcauugcugugaugaggauggacucaggguuuucugacucauuaauaaggagagccugaaaagaugucaguccugcuguagucaugucuuuuucugccugacuuagaauuaacaucugagcucauacacuacagauggguacaccagcaucucuuagcuuaaucccaguuacugaauuauauuagccauccccauuugcccugauuggcauaggaauguucuaucucccuugaaaugaaacccauucuauauagauguauguauccagguuuuaugaauguuuaaaaaaacauauaauaggcuuucuauuuuguaaagacuagcuuugagugucuuaaaucacaucccauguaaaaaucaacagcauaaaguagauguuucugaagcuuaagacagcaguucuuauuuaauuuaguuaaguaauaauagaucuagauacugggcuuuaguuguguauuauucuauuauuucucaaguauggccacugaauuauuccuuacaaauuggauaggauuagauauuuguuucuaagaaaauugagaaugucuaggaaaaaaaaacaguuaggaggccugaaugggggguucaacauaaaagacaaagaaauuaagaaagcuuacuauaagaaucccuuccacuuagagcugccagacagaccuccaagggaaugaguuucaaaauuaggcuucuucauugcuuaauugcaauauaaguugaauguacugccuugccagaucucuuuaguaaaacaaagaauacugauaacugaaauaagugauuugggaaauccugagucucuuugggcuuuuacaaaauuaguucccagugugccuugaugaggaggaaacuauuaaaaugugucauaagagacucaaaauuagaaaauuuaaaauaccuugggugugagguuaagacaaaguaauauaagcaaaaaaaggagaggccuagagaaauggcucucacauaaaaaagcagagcuuggcucccagcacccauaauagggaucagacagauguccauagcuuagcuccagggccucugauguucucuucuggacucagugggcaccuacaugcacaugcacagacccacauggacacacacagaguuaaaaaauaaguaaaaccuaaagaaaucaagagaauuauagauuuugaaugagcuuuuauuuuuaauauaagagcaguacaaauuauucacauugagacucccgacuauuauuguuguugauuagcacuagacuugaauaaaauaugaagagcaaagcuucaagaucagucccuaaaauaauagacuuggaauauaaugucaggaaaaguuuguguugcacaaacauggggaccugaacuugcauucucacauaaaggucagguaaucucagcauggggaaggcagagucaggaagguucccgagagcugauuagccagccagucuagccaaauugagagcuccaaaauuaaggugaagggugacugaggaaguacauguagacacacagagacagacagacagacagacagacagacagacagacagacagacggacggacaaacacagagagagacagagggagagacagagggagagacagagggagagagacagagacagacagacagacacagagagagacagagacagagagagacagagacagagagacagagagacagagacagacagacagacacagagagagacagagacagagagagacagagacagagacagagagacagagagacagacagagacagaaagacagagucagagacacagagaccagggagacacagggagggaggcagacacagauuggggaaggaauaaaauguguguguaaaacaguaaaaaaauucaaucgggggguugggggagcacauuaaauccaguagaaaauaagagagaaaggugaaauuuuuuagauagcauggcaaucaaagcgcauaguucaaauguaucacuaaccacaguaaugaaaauaggcugcauccauucauuaaaagauaucauccaaauuugaaaauccagccacauacugaugaauaagcaaagagaaacuuuggaaauaaaaaacauaagaaguuauacaauagaagcacuaaacaaaacuuagcagacacagccuaaacacguuuuucaaagacuuuaagagagaaaaacguuauuauaauaaagaagaguugaacacuuuaacgagcugcuuuacaucaacaccauggcugucugucaugucugucagugaaaagaaauguacuguuagcacacaaguacaaacaacagggaugggccuugugcauaucaaaaaggcauauauugggcagugagaugucucgguggauaaagaugaucaccaucaaaccuaacgaccacucaauccccagacccacuuguuggaacuagauaaccaacucccacaaguuguuaucugaccuccacaugaacacuuuggcuugagugcccaugcacccauaaacagacagacagacagucagacagacaggcaggcacacgcgcgcgcacacacacacacacacacaaagaaauauaaauaaugaaaauauuuuuaaacuuuuuaugugaauggaaguuuagucuacaugcaugucuguacacuauguaagugcuuaaugcccaggcaggcaaaaagagcacaucagauucccugcaacugaaguuaacagacaguuguuacauguuguugcugggaguucagccuguguuuucugaaaaagaaaauagugcucuuuuuuuaauuuuuuuuuuuacaguccagucauuuccccacucccagucuguccucccacaguuccucaccccauuccuccucucccuggccuccaagaagauaucuccacuccugccaguccucucuacucccugggucucaaaucucucaaggguugggugcuucuucaucgucucccacugaggucagaccaggcaguccucugcugugugucagggcaccucagaccagcuccuguaugcuaccugguugguggcuugguguuugagaggucucaugggucccaguuaguugaggcugcuggucuuccuauggaguugcccuccuucucaccuucuuccaacuuuccccuaauucaaccauugggguccugagcuucugcccauugguuggauguaaguaugugcauuugucucagucagcugcuuguucggccuuucagagggcagucaugcuagauuccugucuauauguauaccauagcaucaguguuagaccuugaagccacccuuggagcuggaucccaaguuggaccugucacuggaccaccuuucccucaggcuuuucucugguuuugcuccugcaguucuuuuagacagggacaauucugaguccgauuuuuuuuuccugugggauggcaacccuaucccuccacuuggugcccugucuuccuacuggaggugggcucuaucuacauguucccucucccuacuguugggcauuucaucuaaagucccuccaaaaaaaaaaaggagauagugcucuuaauccugagucacaucucuagcccauaaaaaaauuuaagucacauacuauuuuuccacuuuuuaaauguucuuggccuggcaugauggcacaugaauuuaaucccagcacuugaggagcagaagcaaacaaaucucugucaguucaaggccgaccugcucugcaucgugaguuccagagcugccauaacaaauagugagacguguuuaaaaagaaaagaaaacucuuaaauugucaaaauagugagaagaagagaauagagccagggaucuagaauccaauggagugagaauguuugcaacuacuaaggaagaucuguguaguggguuagaccuguauccugauuguagcaguaugauauaaugacacggguuauauacauauuuuguucuaaugucaauuuccuauuuuuuuuuguuuguuuguuuuuucgagacaggguuucucuguauagccuggcuguccuggaacucacucuguagaccaggcuggccucaaacucagaaauccaccugccucugccuuccgagugcuggaauuaaaggcgugugcccccacggccggcaguuuccuaauuuuaauauugaacaauaguucuggguaacuuaaacauugagaaaaaaaacuaugugaaaagugaaagagauuucucuguaguguccuugcaauuucuuguaaauacauaaaggacuucaaaguaaaagucauuaagcauuacuagaaaaaucuuaaaguguauucaguaaaaucacaucaaauuuuugaacaaaaauacuucccaguagagugguacauuguuguggcuagcccuggggcuaguuauauuugauguuaauuccauucuccugugagugguugugaacaaggaaugagugagcacucaggugauuuccuguaaaccugcuucccaccuuaauuuguaaaauaaaggagagcugaugauugggcagauaaaagggaagguggagcgccaggugagagcaagagaagaaggagaaaauggaagagggagaggauguagaggaagaggaagaagaagaaaagcggagcagaagcgcguggccuggagaaaccgcaaguacuaaggggucucauagauguggaagaugguaguguagcaguagaucugcccaaucuaggcccacagcauguaaucauauuaacugugucgaguuuucauugccgggucauauuugggagacuuacggcaacaguacaugccuauguugaaaucaacaagcugauuuaauuuuagaaguuacagaacccaauaaaaguaaaauacucucuuuuuuaauccugcaggagaagggguggaaggauugauggagccagagaggucaaggacaccacaagaaagcucacagaaacaacuaacccagucccacaggggcucacagagacugaaccaccaaccagagagaguacaugggacagaccaugguccucugcaucuauguuauggugguguaguuuggucuucuugugggacccuuaaugugggagcagggacugucuuugacucuuuugucugcuuuugcgacccuuuccuccugcugaguugccuuguccaaccuuaguaugucuacugcaacuugauaugucaagggcugguggguauccaugggaggccugccccuuucugaagagaaacagaggggaaguguauugggagggaacagaggggaaguggagggaagggacugggaggagagaagggagucccuguggucgggauguaaaaaaaaaauuaauaucccccuuuuaaguaaacauaguacauuugcaacugguuaugaauuugggcauaugccagcuaucaacaaauucaaauaaggucacaaaaauuagcuuauugaaccaaaacacaguucagauuuuaaaaagagaagaaaacgacauuuuauuuuuaaauccaugauucaagcugagccuaauggaccaagccuauaaccuuaccacuuacaaggcugaagcaggaggauuggacauucgaggacaacaugaacugcacgggcuacugucucaaaauaacaacuaaagccaaacaaaauaaaaaccugagccagacauaauggcacuugggaaacaggcagaaggaucaccaguucaaggcuagccugagcucuauagcuacacaaucucaaacaucuaccauaccaacaaaagcaaauacuugugcucuggguuauuagaauaugucucuaaauguucuguauguuauaaagggaagcguaacagaaugaaugcaagaaaacuucaaagaaaauaugguuggacgaguccagaaauaagcucaaggcacaguuuuggccccuauuuccucagaauaaaaccccacagauuucuagggaguugcugcagaugaaguucugggugucauuuguuaauuguuagagcccgugguuguccauauagcucugcucugacuguugaagaaagaagaaagacaaggaggaauuugaggaggcuguacuaacacuauccuggaaguuuuaugucaaguagaaaugaucaaaaaugucuaguggcaugugugugaccacccacaauccccaaggcauggggaagaaggcguuacaggacucagguacuuugguacccucaguugucaaauacuuugaauuuguucagaauugccaucuuguuucuacagaauguacccacacuuuuuuaaaguuguguguguguguguguguguguguguguccugugugugcaccuuugucauggaaauguguagauggaagacaaacucaguugucagucuuccccuucuauauuccgacaguauguuguuugugauaacaugugcugagcuaaacagccuauuaguuuucacugauucuccuaugucuguuuagcauaccaccagaagcuugcuccaauuacagauacacacuaauauguacugccuuauguaaugugcugguucguuuuuuuuuuuuuucaauuugacacgaacacagacagacaucacuagaaagaaggaaucucaauggaggaauuuccuccaccagauuggccugugaaaaugucucaagaggcauuuucuugguugccaauugauguagaaggacccaccccacugugaacagagccauuccugggcagaugagccugggcuguaugaaaaaaaaaaaaaaagacuaggaagccaggggaaucgauccaguaaagcagcaguacuucaugggcucugguucuguuccugccuccagguuccugucuugaguuccugccuugguuucuuucaaugauaagcuauaacaaguaaguacaauucagcccuuuccucuccgaguugcuuuuguucauagaaacagaagagcaaacaaugacacguggguucuagggaucugaacuuuacagcaaguacuuuuaucaacuaagccaucuccccaagcuguacccacaucuucuauaaucaauaccuccaugguuuccuuagagauggcgcuuuccuaaugcucaggaaaaagagagacuauacaugguaccaaucaaacuguucaggggcaaccaauggacaaacaccgugacuacugugcuagccucugcaugguaucugccugaacucaaaaagacaguuuggaauuucagugugugauauguaaacuuuucauuuccaacacucucagauucauuuguuaucuccaguuugagguuauagaguuggccucagaggucuacuaggauagcucugcauuucuucuccucugagugaucugguuucagaggaggagaaaagagucaggcacuuuugugcugagcaucauggcucuagcuccauuguggagccuacaugcuuucuaagaaguuuccuuguugggaaaguuugcaccucuauuacauuucaacuaugccauagagagucuggagaggugucucaugguuaagagagcuugcuguucuuacagaggaccagagauucccagcacucaugaugggcucuucauaacuacuaauaacuucaaaacccagagaucugacacccucuuuggccuuccacauuccuguaauuccagugcugaaguugaugaauugcaauuuugagacuagcccgggcuucauaucucaaccuuauguccaaaauugaaaaaggaaaaaaaagacuggaguauucguuccucuucuauaaaaggauguuugcucuuugccagucgcuacuaacaaauucuggucucuuacauucagaucaagcauaaaauggcuguaucuuuugcuguuugcugucuuuuuuuuuuuagauuucuguucccuccaugagucucugcagaaguuuucucuuuugaguuuuaaugucuuuguugugcaaaauugugugauaaucuaaucuguucuuuauaaaaucuuuguaaauauugcucugugcagacuuugauguuuaauuuguauuacuuuguugugaugauaagaauuugaggauuguaaaauauuugaaucccuugugccuauaagccuauguuaaaauauuuaaaggauuaaaagaagaauga

SEQ ID NO: 9738 - RNA, 6597 nt, Mus musculus
cauaccccucuaccuuaccccgcacuuccgcgccaccaccacuccacagccccgggacgucauggcuaacaaacagcucuuggcuuuaaauggcagauccgagaaaacaagaugucucaagccuuuccuuuaagcccgaggaauagcucagguccgccaugacucuggccgugacugugacacgggagguacguuuucccaggauaaaucuuucuaguuucacuagguucauaugacuagaaaagaacaggucugggcccccagcaccugggcucccaugucgugagggcggaaaguagaaagcagagucaucucugccucaagcuucaucaacucacccaaggcuaccgucccaaggcgacaagcacggucuuaugcacuguccucacacuguguggugcggaucuggcgccuuagagaucugggaagucggcaaggggcauuggcaagggguaauggcgggcgaaggccuuuucuccaggaaggcaugaggugaaggcugagggcggggaaaggaaauguaacaguaacgcaguucuuccacucucaguguucccuagcgaugggauugcauguucagggagcuguggacggaggccugcagggguuauuugucaaauuuagcaacccugcaaaggucccucuugacauuagauagagaggccuacaaaaggugguuuguuacauuuuggaggccuucaaaggugacuccucaggaucuggggggccuguaacuucugccuggcuguguccagugauuacuuuguggaacucaaaacuaauuacagcagcacucgcugcucuuugcucccacaaauugugaugguuuagugaggugcagcaagucuaucuggcagugauucagaggugccuggugcccucagaaaucagaggaggaugaaggauccuaaggcauugaacccaaguucucuauaagacgaaugagugcucuuuacugaggagccaucucuuuagaucccacugucuucguuguuguuuuguuugcuuuucuaagacagggucccucuguguaucccuagcugcccuggaacgcacucugaagaccagacuagacucgaacucagagagccuccugccucuggcucuugagugcugggauuuaaggcaugcaguuaccagugcccagcuuaucccugcugucuuuaacugucaucaucaggcuuuuugagacauagucucucacucaaucugggacuugcugauuuggcuagacuggcuagccagguagcuugggggaaucuaccuguuauuguucugccgaggugggaguuacugguguguaccaaacacucagcacuaaugugggugauagggauaacaguucagguuucaaacauuuacccagugcuccaucuucucaacuccuuauaaacccuuuuaggaacauugucaauaucaaagaacaugaugugccuuuuaucuauuuucuuuagaaacggauugagagcucagacaaguaaauggucaacacaaaucuauuggaagaacuaauagauccauuucuauuuaaagaaccuuaauuaagccacuuuuaccucacaaaaugaacaauaauuucagccuuucucucuauauguguuuauguguuuguguguuugaguaccuguacacaguaauacaggugucagggaaggggggaggggaagaagcagaaaauuguugauauuguuaagagaauacucauuaauguuuuuccuucauauacuauuugcuucauaaaauuaaaaguuuaucuuguauuaauuuuacagcuuaaauuacauuugaacaauauuuuuauuauuucaauuuuacauaauuuauagaccucugaacaugcagaaacacuucuggacauuuauuauaacagauuuguuaacugaggucuggagagaugacucauugguaaguguccuugcuguuuaaucaggaaaguuuugaguuuagauccugguacccaugucaagauugaguguggccaugcagguucccguagcuccugugcuaugcagugugaaggcaguagagacacaaguaccacuggggcuugcagguagucagcauaaauccaggucccuggagagcuccugucuucagagugauagggaaggacaccucuuuuggcuucuuugcauguaggguauaacauauccacacacaugugcacauagaacacacacacucauaugcacacacauggaaagggagaggaagacugagauuuuugccuggaugguaauauuuucuuucauuuuuuuucuuuuaauuauuuuuugagaagguauuucacuauuucacuacguagcccaugcuguccuggaacucacuguuuagaccaggguggccucucauuuccccaacuccccuugccuacuugccuauguuuccuaagugcuaggauuaaugugggccacaugccuggccuuuuauguauguauguauguauguauguauguauguauguauguauugcuuggccuuuuuuuguuuguuuguuuuuaagacagugacaugaaguccagacuaaucucaaaaugauaaucuucccucacucucccaacugcugggauuacaggcauguacaugucauugugccaacaacucaggcauguuacacaagcuucccucauuugauuucuguugcugugauaaaaucgucugacaagaggcagauuagggaauaaaggggcuuguuucuaccuccaugguauuccucaggccuuggagaggggugcuauacaugucauguuuagagccaagauuaagagucacuuauucucagcacuuugguugauaauggaacucuguauuaaucucuggucacuguaaaaaaaagaaauuucucuucuagagaccgggagcagcauuauucuuuagguauaaacaggaauacuuagaaggcagcuugacugaauuucauuuuagcaaaacaaaacaaucauaguaaaucuucccuccccaggaccuguagccucuccaguuuuugaccaucuuuacagugucggcuaacaggcauauauucacuucuguggagcaggccucagaucuaaugaaaaaggauuggcugcccaugaucuuuauuccauuuagaguagagaagucucagcaggcaaaaagguagcaagaggaguaggccuuuugccuauguucucucucccugucucucuucccuccuucccaccuuccuuccuccuuuguuccucccuccucccuuccccucuuuccaaccucccucuaugucuuccuccuccuccacccucccucccucuucccucccuuuccccucccauccucccucuuccuaucucccuuccuuccccucucucccuucuccuucccucccccucucugucucccucccuuuuccauccucccucccccucucacucucccucucuccccuacccucccuuccuucucccuccuuccauucccucccucccccacccucccccuaccucucuccccucucucucucccuccuucccccuuccuccuccucccuuucuccccuuccuuccuccuuccccuucuucccccuuucccccuccuuuccuccucccuccccucccucucucuucccuccccucccucccuuuucccuccccuccucccucaucccucccccucccucuuccuccuucuucccuuacuucucccuuccuccucccucaguccucccuccccucccucucauccucccuccccuaucucccucccuucucccuccuccccuaucucccucccuucucccuccuuccuccucccuucucccuccucguuccucccuccucccuccucauuccucccuccuccucccauccucccucccucccuugucucucuccucucucccucucauacccuaccuccuuccccaccaacccuucuucucccucccuuucugccccuaccccagucuguggucuguguuuucucuuuuuuuucaagacagggucucaguauguaccuuggguauccuggaacucacuaugaugaccaggcuagacuaacucucagagagaagccagacugucucuguguccuaacugggaucaaaggcauguaccacuaugcaagaagucaugggaucccaucuugggaugccuaaggggauagacagcucugaggaaguggcaaaggcagagaggagaguugaggcagugggaaauggcuuucuaggucugacucgugacccucugccccuuaggcuuggcagugacaaguuauuuguaaauggcacaacccagacaaaugccuuuccacacacacccccugcaguuacaaauguguggaauccagauuccccagcuagaauauuugucuuuucuuaggugguaaugauuuccaguuguuguacaaggaagcaaagacuauauaaaaaauuucuuauaaucaaacagucuaaauaagcagagguucugaaguugaaccgaggcacccauaaagcuaaaagcaugguggugggggcgguuauguggcaaguaaggauugccauccaaucagagaggcccgugacucauagguaugaugucacagccaucuguccagucacagagugaugggcggggcucuggguggggucuucuguggcaccuauaaacuugcagguacugcaagggcagcaucaguuuggcccugaagcuaacugaagacagagcuguuggucugauagguggagcuguuagucugauaggugagucuugcugugaagagguaagaauuuguggccccauggggcuaagccagguggguugggcuaauagagucuggucuccagcccaguucacagaaguuuuauuuccccuugagguuuucugggggcacagagagagaagucaugggggucccaucuugggaugccuaaggggauagacagcucugaggaaguggcaaaggcagagaggagaguugaggcagugggaaauggcuuucuaggucugacucgugacccucugccccuuaggcugggcagugacaaguuauuuauaaauggcucaauggagacaaaugucuuuaucucuguccccacuccccacugcaguuacaaauguggaacccagauuccccagcuuugagcuuagcucacuuguuaaagagggcagccaaagcuccucucccuccccaccccacccccgccucaugguggguaggcagccaucagggccuagugugcacacagccccuccuugugccaucaccucccagaugcccucagguuggcuccuggccucuaacugugguuagcucuggggcuccacucugcccagcugagcagugagaauaggggcagcuggugcacuugggggucgcugcagcaagcaggguccccuggcuuguccugaaaacaugacuuucuaagaucuguugguuuucuauugaaaaacggcaugcaaauuauuuauucauaauaaaugaauuuuuaagcuuuuauuccuaaucuggucauaguuuuaguaggcaacuaacuacuuuuugguucuuucuuucagucaaaaugggugauagaccagacuugucggaaguggagagauucgauaaauccaaacugaagaaaaccaucaccgaaguaaaaaauacucugcccucgaaggaaaguaaguagugggaauuucuaguggaggugaacagaggugaaaguugguauagucaguucauaaacuaauguucaauuaaaauugccucgauggaaguaguagcuaaucauaauuaauguagcaauuaaaauauccaauacgugccuuuuuuccuugaauaauggaagugguuuacaggauaggucccaguagugaugguaucauagauuuguuaaucuugguauuuuggaaguagcacuguauaaaucucgauuuuggccaguauuuuaaaauuuuuauuagaaauguuaauuacacaucuuccaggaugcaaaccuuugaaucuauagcuuuauccauagaaaacuaugcaagcuaugguuucuucuauacauaacuacaaaauaaggugaaagaauaaguuuagugcuuagguguggucaggcuuuccagacucaagguuugcucuucagaaagacagccuccuggaggaggugaaaguguacuuguaaagcugagaggcaguuuauguccugucagcuguaacugagaacucaaaaauuuaaugaagucaucugaagugaucuaacucucuaguuguauaaggauaaagcugaaagaaauguuuuccuuacuccucaacuaucacucaaauauauauauauauacauuauucuaaggcacacgcacacacacacacacacacacacacacacacacacacacacacacacaaaccuccacuaugaggauaugugguuagugccuuugcauuguaaaugaaaaggcauguuaaucagcccuucgagacuuaguaagcagaucuuuuagaagaaacugaacuuaauauuaagaaaagcuaaacaaguaaauaagaaaaaaagaaaagaacauuccuucuaaugauauuuuuuuguauuuuucuuucccuagccaucgagcaagagaaggaguuugugaaaagaucauaaugaggaucuuuuccaacaaauaaaugccaacacuggcaagcagucuuggu

SEQ ID NO: 9739 - RNA, 990 nt, Mus musculus
aaagcagagucugaggugugggaaugcuggagaugguucgggagucccgggccugcaacgaugcuggggccaugggguucucaggcucuuggacauccaggugcugcugggauuugcagaagagcagagaauggaguggggagaggggccaugggcuggggacagcggcuagcccagggccaggggaaaggggagcucuggcuugucccaugggugauuguccuuagcuuggugggggcaggcuagguggaagucguggcugggagcgcagagaggucuucuaugggagaauuaagcugcaucucugcugucagugucuucucugaggcuccccuugguggaucuuggugaagagacacuccacgguuuauugucaguuuauugucauggcaguuuauugucauggcagaauauggguacguaaaaccauaccccacuucucagggugggccugagauuaaaugccuuuugcaggaaggaaugucugggaagggaagcuuauuggcuaagcccuucgggucucuagguaccucauuagcauagagaacucuauuugggccuacaugaccaaugaacacauuucuuuaagugaggaguguggcauguguucuaggccaggagucuggcagggagcugggagucgccuaagucuccugugugugcccacugagucucugggucucaacccgcucuaccuuaccaaacuuccuggcauggauuuaugccccacacccagguguuuggaacccccaggugcucauguguucaaauaauagacaccacagagaacaagaaaacagucaccuaccggaguggagucaacagguagaauacugaaagaaugauggcuauacugacagacauaaauagcaaaaauauuauguuuuuaguaaacguuccucccccaugugauuugcuguuauuaaaugagaauugaauuauuuuauccugugaggcucaauaaagcuuuccuauaauuuuaacuaaaau

SEQ ID NO: 9740 - RNA, 1680 nt, Mus musculus
gcccggcauuccgcgcgagccagaggaaggcagagggaccgcggagcgaacugcacgccccgugcagagccagccagccagccagccagccagcgagcgccgguggagcccgcguggagggagccgccgauugaacacccugcaagaugaacucccugcugucccgggccaacucgcuguucgccuucacgcugagcgucauggcggcgcucaccuugggcugcauccucaccaccgccuucaaagacaggagcgcgcccgugcgccugcacgucuccaggauccugcucaaaaaaguggaagacuucaccggacccagaaagaagagcgaccugggcuucaucaccuuccacaucucugcggaucuggagaagacuuucgacuggaacgucaagcagcucuuccuuuaucugucggcagaauauuccaccaaaagcaacgcugugaaccaggugguccucugggacaagauccuucugcgaggcgagaaccccaagcugaaccugaaagacgucaaaagcaaguauuuuuucuuugacgauggacacgggcucaagggaaacaggaaugucacuuugacucucuccuggcaagugauaccgauugcugggauccugccucuugugacuggaucuggacgcgugucugucccguuuccagauuccuaugaaauagccacgacuuuuugaagaauucucucugcauuggaaacggggacaucuguggacucaagaaaucgcaucuccucaucauuucccucaagucuugcugacuucucuuuuguuuuguuuauuuuaaaacaugcugguuuuguucugggacuggcugcacucauccucaugcuucccugagccuaacauagagacuauauucauugaucuuagugugugugugugacauugguuaucacucuuccucuguauaagaauuaacaucaaauuuuauaguuggagggaaaggcuaauagaguucuggaacuuucuuuauucuaccaaugaaacaacaaagaaguucaccagaguagguuauuauuagacaguuggauaaugaggauugaaaauaauacacaguuuugucauauucacuacauuaucccaugugauauauaaaauuuggggagaauuuuaaaauuagauguuuugguauugucacaauaacuguauuuuauuccugagauuccuuguagguccacauugaaugccguuuucuuauaucuucuaggguguguuugauuacuagaaaaauugugauuuguuucguaagagucugacaugcaaaauaguuaaacacgagucagaaaucuuacugcuuuccuuccuugccagcaaaugugaccauuuaaauagugaacguaucuugaggcuguaaaugauucugccucucuuuaagugugugucuuacagugguuucucaacaaagauugcugugcaguguaucuuugucuuagcacuguugcugaaguuugaaaauguuugcauguuuaacaugagaucguauguucuaguauguuuaaugccauuaaauaaaugcuaacugcuuaaaacucuuguagguccauuauuuaaucauuauugggauguugauaauugcacuugugguaugauuuuuacaaacauucauagauuuuuuuucucuauaaccuaaauaguaagcagugcaugcauuagcucucuucaaaua

SEQ ID NO: 9741 - RNA, 1680 nt, Mus musculus
uauuugaagagagcuaaugcaugcacugcuuacuauuuagguuauagagaaaaaaaaucuaugaauguuuguaaaaaucauaccacaagugcaauuaucaacaucccaauaaugauuaaauaauggaccuacaagaguuuuaagcaguuagcauuuauuuaauggcauuaaacauacuagaacauacgaucucauguuaaacaugcaaacauuuucaaacuucagcaacagugcuaagacaaagauacacugcacagcaaucuuuguugagaaaccacuguaagacacacacuuaaagagaggcagaaucauuuacagccucaagauacguucacuauuuaaauggucacauuugcuggcaaggaaggaaagcaguaagauuucugacucguguuuaacuauuuugcaugucagacucuuacgaaacaaaucacaauuuuucuaguaaucaaacacacccuagaagauauaagaaaacggcauucaauguggaccuacaaggaaucucaggaauaaaauacaguuauugugacaauaccaaaacaucuaauuuuaaaauucuccccaaauuuuauauaucacaugggauaauguagugaauaugacaaaacuguguauuauuuucaauccucauuauccaacugucuaauaauaaccuacucuggugaacuucuuuguuguuucauugguagaauaaagaaaguuccagaacucuauuagccuuucccuccaacuauaaaauuugauguuaauucuuauacagaggaagagugauaaccaaugucacacacacacacuaagaucaaugaauauagucucuauguuaggcucagggaagcaugaggaugagugcagccagucccagaacaaaaccagcauguuuuaaaauaaacaaaacaaaagagaagucagcaagacuugagggaaaugaugaggagaugcgauuucuugaguccacagauguccccguuuccaaugcagagagaauucuucaaaaagucguggcuauuucauaggaaucuggaaacgggacagacacgcguccagauccagucacaagaggcaggaucccagcaaucgguaucacuugccaggagagagucaaagugacauuccuguuucccuugagcccguguccaucgucaaagaaaaaauacuugcuuuugacgucuuucagguucagcuugggguucucgccucgcagaaggaucuugucccagaggaccaccugguucacagcguugcuuuugguggaauauucugccgacagauaaaggaagagcugcuugacguuccagucgaaagucuucuccagauccgcagagauguggaaggugaugaagcccaggucgcucuucuuucuggguccggugaagucuuccacuuuuuugagcaggauccuggagacgugcaggcgcacgggcgcgcuccugucuuugaaggcgguggugaggaugcagcccaaggugagcgccgccaugacgcucagcgugaaggcgaacagcgaguuggcccgggacagcagggaguucaucuugcaggguguucaaucggcggcucccuccacgcgggcuccaccggcgcucgcuggcuggcuggcuggcuggcuggcucugcacggggcgugcaguucgcuccgcggucccucugccuuccucuggcucgcgcggaaugccgggc

SEQ ID NO: 9742 - RNA, 1582 nt, Mus musculus
cauuccgcgcgagccagaggaaggcagagggaccgcggagcgaacugcacgccccgugccgagccagccagccagccagccagccagcgagcgccgguggagcccgcguggagggagccgccgauugaacacccugcaagaugaacucccugcugucccgggccaacucgcuguucgccuucacgcugagcgucauggcggcgcucaccuugggcugcauccucaccaccgccuucaaagacaggagcgcgcccgugcgccugcacgucuccaggauccugcucaaaaaaguggaagacuucaccggacccagaaagaagagcgaccugggcuucaucaccuuccacaucucugcggaucuggagaagacuuucgacuggaacgucaagcagcucuuccuuuaucugucggcagaauauuccaccaaaagcaacgcugugaaccaggugguccucugggacaagauccuucugcgaggcgagaaccccaagcugaaccugaaagacgucaaaagcaaguauuuuuucuuugacgauggacacgggcucaagggaaacaggaaugucacuuugacucucuccuggcaagugauaccgauugcugggauccugccucuugugacuggaucuggacgcgugucugucccguuuccagauuccuaugaaauagccacgacuuuuugaagaauucucucugcaucggaaacgggacaucuguggaccuaaggaaucauaguuuaaaacugucaagaaacacgugcuguaacaauuuaugugucgcauuccugcaugccuacacugaaugugauuuagaagcagacguuuguucaccucguguaaagcaugcuugauuccuuggggggggggggacaguuaauaucguuuguuagauaccauaagugguggaaauaaagugacuaaagaccgaguacaugaugauucuguaaaucacuguaacacauuauugauaugccgacugucugagaaauaugggucuuuccagguuuuuccuccaaaaguuuuucuguuuuacauuuuuuugaaaaaaauuaauguuuuaaccauuguuagugaagguugaaaacguuugcaugacuuucccauugaguuucagucuguaugcuuacuaccacuaggugcuaauuauguacaguucuccacaagucuccauuuuaauaaguuuuggaguaauauuaacacucaucguuuaauuuuuuucauuuacaaacucucuuauauguuauuguauccuauugccagcagucucgggauguauauaauagaaacaugggcuguuugcagaugaacacugugaaccccugaagcuuggggaaucauuucaagcuuaaauagcuagcaaaaaaaguggagucuaacuuugaucuuggauauucucauucccuaaguuuauuccaccccugauaccugagaugacaucauaggaauuucauguguaacuuacauuguauuuuuguaacccugaaacucucuguuuugauguuucugaucuuauguaaaaguagcuuguguucaaguuguguuaaaaaaaaacuucuauaggaauagaucuccuuucacacucu

SEQ ID NO: 9743 - RNA, 1582 nt, Mus musculus
agagugugaaaggagaucuauuccuauagaaguuuuuuuuuaacacaacuugaacacaagcuacuuuuacauaagaucagaaacaucaaaacagagaguuucaggguuacaaaaauacaauguaaguuacacaugaaauuccuaugaugucaucucagguaucagggguggaauaaacuuagggaaugagaauauccaagaucaaaguuagacuccacuuuuuuugcuagcuauuuaagcuugaaaugauuccccaagcuucagggguucacaguguucaucugcaaacagcccauguuucuauuauauacaucccgagacugcuggcaauaggauacaauaacauauaagagaguuuguaaaugaaaaaaauuaaacgaugaguguuaauauuacuccaaaacuuauuaaaauggagacuuguggagaacuguacauaauuagcaccuagugguaguaagcauacagacugaaacucaaugggaaagucaugcaaacguuuucaaccuucacuaacaaugguuaaaacauuaauuuuuuucaaaaaaauguaaaacagaaaaacuuuuggaggaaaaaccuggaaagacccauauuucucagacagucggcauaucaauaauguguuacagugauuuacagaaucaucauguacucggucuuuagucacuuuauuuccaccacuuaugguaucuaacaaacgauauuaacuguccccccccccccaaggaaucaagcaugcuuuacacgaggugaacaaacgucugcuucuaaaucacauucaguguaggcaugcaggaaugcgacacauaaauuguuacagcacguguuucuugacaguuuuaaacuaugauuccuuagguccacagaugucccguuuccgaugcagagagaauucuucaaaaagucguggcuauuucauaggaaucuggaaacgggacagacacgcguccagauccagucacaagaggcaggaucccagcaaucgguaucacuugccaggagagagucaaagugacauuccuguuucccuugagcccguguccaucgucaaagaaaaaauacuugcuuuugacgucuuucagguucagcuugggguucucgccucgcagaaggaucuugucccagaggaccaccugguucacagcguugcuuuugguggaauauucugccgacagauaaaggaagagcugcuugacguuccagucgaaagucuucuccagauccgcagagauguggaaggugaugaagcccaggucgcucuucuuucuggguccggugaagucuuccacuuuuuugagcaggauccuggagacgugcaggcgcacgggcgcgcuccugucuuugaaggcgguggugaggaugcagcccaaggugagcgccgccaugacgcucagcgugaaggcgaacagcgaguuggcccgggacagcagggaguucaucuugcaggguguucaaucggcggcucccuccacgcgggcuccaccggcgcucgcuggcuggcuggcuggcuggcuggcucggcacggggcgugcaguucgcuccgcggucccucugccuuccucuggcucgcgcggaaug

SEQ ID NO: 9744 - RNA, 1675 nt, Mus musculus
auagccuuuuaaaucugcuuuauuagguucacaauauauacugagcaucuucccaugcaauagauaaauucugcuaacaaaaaaagaaauguaagacugagucgaaaacacaaguuucaauuagaagcuggcagaaguuggagccccauggggaaacaagugacaccagaaauauuacaacaguacaucacaaacauguaaguuuugaaagcagggguccccaugucaucuucagagaaaagcucaggacucagggcauaaggcaaaacucaucaugguggucaugaugaggcgggucagugcuaaccgcccgcaggcuguggcucagcugccuuucccucagcuucuccaugagcugucucacaucauccccaaaccucuguacguucuccucucucauccuucccuggggcuccccaacccuaugcaucaggucccaucuguagugcacgaugggcugccgaacccggaaccgccugcgaccuccucuaggcacguaguagucuccagcuucgaaaggcagggccacaaucggaucccuuuugcuagcauccuguggcuuuucuuccuuuuccuccuuuuccugauggucauucuccauguugagauuuuucacgccuuguuccacuuuggacuccauuucuccuagaagacaagagaaauguucaaagauucagcaccgaggacagaggcccauuugccaccauucacaaucuuggauguccauauguuuguuuuucaaauuuuauuuuuucuaccugaaaggcucaacacgcccucuagggggcccccagucccagacccucccuccccacaacccaccauuuucccugcagaucuguuuccaaagcuuuugcaggcaucaaaauggaggauggaacugugggaauggugggugguggaaggggagcugggagguagaaugaggggugugggauaguaggugggaagggauggaugagggggauaugaggggacuaacgcccauccauccccguucagucuccccaccccacccccaccgccacugaaccaaccugggccuaucccuugcggcguaguccuccugucaauucccgcugccgccuggacucucgguuuccagucaaucugcagacagggugggaugggaaggacugggcgccgagcucagcaccgcacccgccuuccucggacccaccgcccaucccccuacagggccgcccacgaucucuagcagccccguccccauccccguccccauccccguccccguccccauccccguccccguccccguccccgcucuccggggcucgcucuagcgcucuccgcugcgggcccgcccagccgccccucucccgggacccccgcgccguccccgccccugagcccgggcgucccuucccgggcgcagccgggguuccccgcgcggugcacaaagccgcggugcgcgcccgcccgucgcgaggcugucgcccgcagggccgcggcgugcaggccccuuaccugucccgcucgccucgggcccgcugccagcccgccgcgcgcagaggagcuccgagcugcuggccagacgcucgugacgacugcacccaaggcugcgucgcucugcagccccgggucacgugagggcccugcgucacugccaagcccgcucccccuguucgggaggccggugcgacaggaggccccg

SEQ ID NO: 9745 - RNA, 7792 nt, Mus musculus
agugugaagcucuguuggcagagugcuugccuacuguguacaaagccuugaaucugauccccggcaucaacugaaagcggcggcacccaccugcaacgcucgcucacccucgggaagaggggucuugaggaucagaugcuuaagguaauaagcaaagucaagucugggguacauggaauacugucucaaaaagcacaauaaaaacaauaaacaccacccuaaauacccaggaauucucccaaaguuuucauucaaacagauaccuuggucuacuuucaaauaugcuuaauauuauccaguuauuaccucuccagagaaaacgccccauguugaaaauuaaagggauugcuuuugcuaaggauucugcaggaaucauuaaccuagagcaguuuuuaaaacuuuuuuugaaaucuguaugacccugcaugaauacauguguauuauguugggggcuggagagauggcucagugguuaagagcucugguugcuuuuccagaggucccgaguucaauuccuagcaaccacaugguagcucauaacuaucuguaaugggaucugacgccaccuucuuauaugucugaagagugucaguguccucccauuuguaccaugucuguguagagaccagaaaagggcaccagauccccugucacuggaguuaaagggaguuaacauuccaacauuucagaagcugaaggauugccaugaaucccagccuagcuagccugggcuacagaauaagacauugcuucaaaccaaacaaacugccagcuauaguggcaccaccuguaacugaacacuggggcuggggguucaacuggaauucaaggaaacccagcgggaucuuuauacuuaagaccccacuggcaggauccagcagacuuggcccuaguugguaggcaggacaggucccagggaagaaaagggugggaacucagcagaagaaaaauggcacggaagcccagcccccaccccucugcaucugaacacaggcugagugaggccauguccucucucaaauauggcauacuauguuccacacagaucccugugaggcaaguauuucccccaugaaaagaccaagucuuaaccaagugugucuauaaugauugccaguuuuauuccucuggcuaaggaagccagagggaauuccagguuuacauuucuguuuaauaguucaucaagaguuuagugccuuuauugccucuacaagcugguuacaaauuaauuuuaauuaacucccacuuauuaaaaaaaucugcaguucuuugugagacacguauucauuaaaaaaaaucaacauaaguaaaaggcaaaauuaaaacacaccacaccaaaaauaagcacuguaaauuuuuugauacguauaauuauacauguacacacauaauuaggaauuuuccuaucuaugugaguugauccuaacuaugcugcuguuuuuuucaauuugcugucuaauuguauauuuccaugcauaaaugugaaacuuuccaacugaaagauaaacguggaaaaugggucaaaaauccaaaauccaaugagaugcugguaacaacgaaacuacauaacagaaaauaccgccagguaauuauuauuaaaaguaaaaugaaguucaaagauacaucagaaaaugcuaagagaaagaaagcagcagccacauuucaauaucagagaaaaaaacgauuucaaggccugaagcacacaggguaaggacggcuucgggaaugucuuugcuuccaaugcaucaacacgaacuuguuucuuacucuucuuaucucuucccuaagccuuuccaacucaucuacgccucuuaucacuucuucgggguucagaugccuugcgggaguguccucuuugggcucugggcuggguucagcaggcucuccucuauggcucccuucaguuuccucccucacauuuucuccagaagccugaagaguuucuccugccugcugugguggaucuucugaaggauggccuucgucugcuuuugguguguucugggguguuccuucguucucgucacaagacuuuugcauguugauuauuuucuuaaugaauuaauccuagggggauaaaaacaaggaaacaaaaccgacuaggugucaggcagauggacaagcuuuuguguucccauagcgacugacuuuuguuucaggucacuuaauugccaaaaaguuuucuaacuagacaagucagguucugagcuccugacuccaccccuuccuccaccccccccaccccccccuugcucuccaacuccaucuucuccugucccggcuccagcccaccauuuucccagcaggcccugcaacaaaccucuccuagcacugaaaugggagcggcguggaagcaauuaacccuucccucaccacauggcucuaacacucccgcccuuucgggcuuuuccaagucaucccauccucagcuucucaccagcaacagucaggucagcggucuccucucucuuuuaaaugucuuuagccucucccuuuccuuccuucaccccauuuccgcagcaggauuugcaggggccuucugugcuuaauccggaugggaggcagccgugacgccccugggaugugcuuuggugucuuccacacuccuacccccacccaaagggaccugaagcaauugcacccuugcacugaccuguagguaccuggagauuuuccucucuucuugcaccucgauuuaugucgcgcucaaaagaucaagagugcugaagaaagacaggaguucuuggugagcacacuagugccuaaaucaaaaggucuugcuaacggauagcacaaaguuuuuccacaucccccucuucucccucccuuuguggcaaccccgccuucaucuguacccuguuucccagcaagagggcaaagaaucagacaaguuuuccccacaguguuauuguuucuucucuccgucucucgcaguucuccuuuccccgucucuuuucuuucucugccggacucgguuagcuaccucccucccaaucugccccaucccucaucaagcagccccaaaccucucgcacaaaauaguuuagcagaacccuaggauaagagaaagagugcgggaugagcgugcuuucuguucucugcucccuccacccuaugaucucuuaagccagcgcccacuauuaaaguaccuggaaguagcugggccacucuucucuagcaggacagagcugcuacuggggaacugggccuagacuauaaggacuucugcacacgucgacugcuggucacgugaggaucgcgucaucaaugagcuccagccuuugguuaccccucccauuaacaugcagcccgcccccuacauucccuucacuagauacugucaaucuuuuuuccuauuugccaauaggagacaauaaaacucgucucgucaccaaguaguaucuauucaccuuacucagauuaccaggaaaagagcagucuuuuaggguacgucgaccaauucuccuaauuugggaagucagcucuuucucucccuugcucccuauacuucccuuccccuccccccaccaaauccuacaguccaccauuucucugggaagcuucucugucuuuaaaaugggggaagguuguagaugugcgcuuguggggguagcggaagaauaaaagccuaaggaagggauguuuagcuucuugagucguuuucugugguguucuguuguaagaaucaggguuuaaaaugauauuuaaaaagagauacuucauauucacuauuucacacuagaugaggagaaaauaacuucauuaaaucaauuuuaagguuucaaaaaguauucuaaugacugcaagugaaagcacaguauuuacaacauauugauguguugggguuuuuuaaaaaucuuacuaaaauggcaucguuugcaaaccgacucugaaaacagccgauuuguuucguuaguuuugucuccgcaauccacgacucucuuugccugagcuuaggcuauuauuagacgucugaacuuuuaauugaugacugcuggcagcucccacuugcaaauaaaggcuucagacagacuucuuuuccuuguccuuugugggagccagugucuuuguuaaacagaaaagccugcuuuucacucagugaacuuucgugggacucaacgaaauauguuuguugguaaacuuuuguuauuaagaacagaauguuuguaaggaaagagcgcucacaaugaagcagaaaggagguaacucuuuguaugucacuauugacuguggggcuuauuaagcauguaggguuuuccauucauucauucauucauucauucguggaacucuagauacccugguaggauucaaagugcuccauuaaaacaagagccaucucagagaacuccauacccuaccauagagcuauguacaccacauguucacugcugcuuucuucaccauagcaaggaauaauguucagcuuaaaaaaaaaaaagaaugaaaaaauguuguuacaaaauuuucaggaaaauaaacgcacuuagaauguuuaauauucacugagaucacacaguaucagaaggaaaauaaaucacauagucuuccccauaagcaaaaccuagucgauaauauauauguauauaaacgaauuuacauguaggcacaguauaacauucagaaaugaaaacaagaaagucuaauauuuggaggugaggaaggauugaaugcaaagaauggacaugagauaggaagaggacagaaaucuaaucauuugccuaguucuaacuuugcuguggauuucuucuuuucuuuuccuuguugcugauagauaagugcuuacaauacauucaguaguguagguguaagcucaaacgcgcagccucacagcuucagaacagauauuugaacuguacuccuaguucuaacuuuguccuggauuuuuucucuuuucuuucuuuucuuuucuuucuuucuuucuuucuuucuuucuuuucuuuuucuuuucucuuuuucuuuuuggugauagguguauauucacuagagacagcauaaacuccaaugggaagugccacagcuucagaacagguauuuuaacugcacagaaguccauugagaggcauagacuucaguucuccguaauuucauugccuggcauuuuuuuuuuuaauuuucaaguuuuuuuuuuuacaauaaaguuuauaaaaauaaacuaucaacaugcauaauuguuguuaucaaaaaagcagagaggauauuacuaggguguuuaaaaaaaaaagaacagcacuauuuuaaagaagaaacagagcuucugaaagccacaguucacuaguaucugcaggaguggugcuauuugcagugguuaucuaucuaucuacuuggagaaucaagggaaagacaauucgguguggcuaggacugucucuuggcaagugugaucacagcaggauguauuugcacaaaaaaguccaccacugugaaagaaaggcucucaaaaauagauguuuuguuggcuuaauguuuaauaauuuauaauuaagcacaaaugggagauauguuuucuauuauuugaggaguguguaacauaaauuauaaauuauauuucuauuugaggaguguguaacauaaauuauaaauaauuauaguuccuuaccacucacaacaaaauguuuccacucuuugugaugcuaccguugcauuuuuauauuauaauucuaugaauuuuaauguuuggauucuuuuuuuuuuuugguuuuuugagacaguguuucuguguauagcccuggcuguccuggaacucacuuuguagaccaggcuggccucaaacucagaaaucugccucugccucccgagugcugggacuaaaggcgugcgccaccaugcccagccuaauguuuggauuuuuaaaacaucacuacagccagaacauaguucauuauccccccccccaccauccaucuauuuuccaccuuucccucucccuugccucucccuugcccccccucucucugucucacucucucucugagacaggguucaggguuucucucuguaauaucccuggcuguccuagaauucacucugcaaacuaggcuggccuugaacucacagaauucugccuacugaugccuccucccaagugcugggaucaaaggcauguaccaccacugcccagcuucucccaguuucucuuuuaaccauaucaucuuuuuaaucauaccauucuguuuuuaaccauaucaucauuuagcaaucuugauuucuacuuuaauauaacauuguuuugucuuucucauucagcauaauccugcuguucuauaaaacaaaaaagaaaauuaacaauuccaaaacaaaguguuuuuuuuuucugaagcaacaaggagcucaaggauuuaacauacaucucaagauuccaaccagcagacacacaaagucacucaacaaguuauaaaaggugacaagauauuuaacauuuuaucucuccacaaggucacugcauuguaaucaaugaaauucagaucauuuuaaagcucaaauguugccccuuugaggaaaaacuugcccacaaugcucugacuauccguuuuagguuuuuuuuuuagguauagguacuccauuguucucuuuccaguuacuauucagucauauggcuaucccacugugaacccauucaccuacugaagagcauuugaguuuuucuaaugcugaacaucuaugaagaacacuguugaaggcauucauguauagaacguagucccuucuagggacuaccuagcacauccaucugucccuccaaccuaccucaaacauuacuaucaaaugucauucuucccugcuuugaacugucagcuuacuucucagauguccuccaguggcaagccacaaguaauuccucaucuucggugucggcaugcaucuucugaugagccccaggaccacucauuaccaagcuagucaugcacuucugugacucacugugucucaaaucucugucucuuucaucucucucguuguucuuacugccauuuucuuccuuuccuauacacugcccucuuuuggaggguucagagacaggguuucucuguguagcccuggcugucuuggaacucacucuguagacuaggcuggccuggaacucagagcugccucugauaccacugcugccaccaccauuaccaccucugggcuacugccccuuuuuuucccucuuagauuaugaugcuagauccuuagagccuccaaagcuaccucagcuggaagugaucuguuccaucuuugucauuaaugugauaagguuuggaccuguccuguggccuuuaacuaaaguuuucuagcacccccccuuuuuuuccuguccuugggggugaguguuucugcauguauugggggagggggcucuaacuggacagcagugaccuguggauugaucaugcccugguucuccugcuucuggagugaugcuuguaauaguaacacgucucccacaaauuccaucauuuuagaaaagagucugaguggccugcgaguguaucucagugguagaauuuuuaccuaccaugcacuaaguucugagcucaauuccuacugaacacacacacaugaucacaccugggguaucugcucccacaaaaaaaauugaugaaaguuuuguccuauccuccuguucugcuuaccuguggucacagcucuaaugaugugcuugguggagauuauuaauccuaguuuucuaaagucuuacaagagaaaauucauuuaguuuacuaguacaaaccugacaaagaaccaguugauccaggccuucaguucuuuucuccgaaauuucagaacagcaguguaaguuagucauu

SEQ ID NO: 9746 - RNA, 7792 nt, Mus musculus
aaugacuaacuuacacugcuguucugaaauuucggagaaaagaacugaaggccuggaucaacugguucuuugucagguuuguacuaguaaacuaaaugaauuuucucuuguaagacuuuagaaaacuaggauuaauaaucuccaccaagcacaucauuagagcugugaccacagguaagcagaacaggaggauaggacaaaacuuucaucaauuuuuuuugugggagcagauaccccaggugugaucauguguguguguucaguaggaauugagcucagaacuuagugcaugguagguaaaaauucuaccacugagauacacucgcaggccacucagacucuuuucuaaaaugauggaauuugugggagacguguuacuauuacaagcaucacuccagaagcaggagaaccagggcaugaucaauccacaggucacugcuguccaguuagagcccccucccccaauacaugcagaaacacucacccccaaggacaggaaaaaaagggggggugcuagaaaacuuuaguuaaaggccacaggacagguccaaaccuuaucacauuaaugacaaagauggaacagaucacuuccagcugagguagcuuuggaggcucuaaggaucuagcaucauaaucuaagagggaaaaaaaggggcaguagcccagaggugguaauggugguggcagcagugguaucagaggcagcucugaguuccaggccagccuagucuacagagugaguuccaagacagccagggcuacacagagaaacccugucucugaacccuccaaaagagggcaguguauaggaaaggaagaaaauggcaguaagaacaacgagagagaugaaagagacagagauuugagacacagugagucacagaagugcaugacuagcuugguaaugagugguccuggggcucaucagaagaugcaugccgacaccgaagaugaggaauuacuuguggcuugccacuggaggacaucugagaaguaagcugacaguucaaagcagggaagaaugacauuugauaguaauguuugagguagguuggagggacagauggaugugcuagguagucccuagaagggacuacguucuauacaugaaugccuucaacaguguucuucauagauguucagcauuagaaaaacucaaaugcucuucaguaggugaauggguucacagugggauagccauaugacugaauaguaacuggaaagagaacaauggaguaccuauaccuaaaaaaaaaaccuaaaacggauagucagagcauugugggcaaguuuuuccucaaaggggcaacauuugagcuuuaaaaugaucugaauuucauugauuacaaugcagugaccuuguggagagauaaaauguuaaauaucuugucaccuuuuauaacuuguugagugacuuugugugucugcugguuggaaucuugagauguauguuaaauccuugagcuccuuguugcuucagaaaaaaaaaacacuuuguuuuggaauuguuaauuuucuuuuuuguuuuauagaacagcaggauuaugcugaaugagaaagacaaaacaauguuauauuaaaguagaaaucaagauugcuaaaugaugauaugguuaaaaacagaaugguaugauuaaaaagaugauaugguuaaaagagaaacugggagaagcugggcaguggugguacaugccuuugaucccagcacuugggaggaggcaucaguaggcagaauucugugaguucaaggccagccuaguuugcagagugaauucuaggacagccagggauauuacagagagaaacccugaacccugucucagagagagagugagacagagagagggggggcaagggagaggcaagggagagggaaagguggaaaauagauggaugguggggggggggauaaugaacuauguucuggcuguagugauguuuuaaaaauccaaacauuaggcugggcaugguggcgcacgccuuuagucccagcacucgggaggcagaggcagauuucugaguuugaggccagccuggucuacaaagugaguuccaggacagccagggcuauacacagaaacacugucucaaaaaaccaaaaaaaaaaaagaauccaaacauuaaaauucauagaauuauaauauaaaaaugcaacgguagcaucacaaagaguggaaacauuuuguugugagugguaaggaacuauaauuauuuauaauuuauguuacacacuccucaaauagaaauauaauuuauaauuuauguuacacacuccucaaauaauagaaaacauaucucccauuugugcuuaauuauaaauuauuaaacauuaagccaacaaaacaucuauuuuugagagccuuucuuucacagugguggacuuuuuugugcaaauacauccugcugugaucacacuugccaagagacaguccuagccacaccgaauugucuuucccuugauucuccaaguagauagauagauaaccacugcaaauagcaccacuccugcagauacuagugaacuguggcuuucagaagcucuguuucuucuuuaaaauagugcuguucuuuuuuuuuuaaacacccuaguaauauccucucugcuuuuuugauaacaacaauuaugcauguugauaguuuauuuuuauaaacuuuauuguaaaaaaaaaaacuugaaaauuaaaaaaaaaaaugccaggcaaugaaauuacggagaacugaagucuaugccucucaauggacuucugugcaguuaaaauaccuguucugaagcuguggcacuucccauuggaguuuaugcugucucuagugaauauacaccuaucaccaaaaagaaaaagagaaaagaaaaagaaaagaaagaaagaaagaaagaaagaaagaaaagaaaagaaagaaaagagaaaaaauccaggacaaaguuagaacuaggaguacaguucaaauaucuguucugaagcugugaggcugcgcguuugagcuuacaccuacacuacugaauguauuguaagcacuuaucuaucagcaacaaggaaaagaaaagaagaaauccacagcaaaguuagaacuaggcaaaugauuagauuucuguccucuuccuaucucauguccauucuuugcauucaauccuuccucaccuccaaauauuagacuuucuuguuuucauuucugaauguuauacugugccuacauguaaauucguuuauauacauauauauuaucgacuagguuuugcuuauggggaagacuaugugauuuauuuuccuucugauacugugugaucucagugaauauuaaacauucuaagugcguuuauuuuccugaaaauuuuguaacaacauuuuuucauucuuuuuuuuuuuuaagcugaacauuauuccuugcuauggugaagaaagcagcagugaacaugugguguacauagcucuaugguaggguauggaguucucugagauggcucuuguuuuaauggagcacuuugaauccuaccaggguaucuagaguuccacgaaugaaugaaugaaugaaugaauggaaaacccuacaugcuuaauaagccccacagucaauagugacauacaaagaguuaccuccuuucugcuucauugugagcgcucuuuccuuacaaacauucuguucuuaauaacaaaaguuuaccaacaaacauauuucguugagucccacgaaaguucacugagugaaaagcaggcuuuucuguuuaacaaagacacuggcucccacaaaggacaaggaaaagaagucugucugaagccuuuauuugcaagugggagcugccagcagucaucaauuaaaaguucagacgucuaauaauagccuaagcucaggcaaagagagucguggauugcggagacaaaacuaacgaaacaaaucggcuguuuucagagucgguuugcaaacgaugccauuuuaguaagauuuuuaaaaaaccccaacacaucaauauguuguaaauacugugcuuucacuugcagucauuagaauacuuuuugaaaccuuaaaauugauuuaaugaaguuauuuucuccucaucuagugugaaauagugaauaugaaguaucucuuuuuaaauaucauuuuaaacccugauucuuacaacagaacaccacagaaaacgacucaagaagcuaaacaucccuuccuuaggcuuuuauucuuccgcuacccccacaagcgcacaucuacaaccuucccccauuuuaaagacagagaagcuucccagagaaaugguggacuguaggauuugguggggggaggggaagggaaguauagggagcaagggagagaaagagcugacuucccaaauuaggagaauuggucgacguacccuaaaagacugcucuuuuccugguaaucugaguaaggugaauagauacuacuuggugacgagacgaguuuuauugucuccuauuggcaaauaggaaaaaagauugacaguaucuagugaagggaauguagggggcgggcugcauguuaaugggagggguaaccaaaggcuggagcucauugaugacgcgauccucacgugaccagcagucgacgugugcagaaguccuuauagucuaggcccaguuccccaguagcagcucuguccugcuagagaagaguggcccagcuacuuccagguacuuuaauagugggcgcuggcuuaagagaucauaggguggagggagcagagaacagaaagcacgcucaucccgcacucuuucucuuauccuaggguucugcuaaacuauuuugugcgagagguuuggggcugcuugaugagggauggggcagauugggagggagguagcuaaccgaguccggcagagaaagaaaagagacggggaaaggagaacugcgagagacggagagaagaaacaauaacacuguggggaaaacuugucugauucuuugcccucuugcugggaaacaggguacagaugaaggcgggguugccacaaagggagggagaagagggggauguggaaaaacuuugugcuauccguuagcaagaccuuuugauuuaggcacuagugugcucaccaagaacuccugucuuucuucagcacucuugaucuuuugagcgcgacauaaaucgaggugcaagaagagaggaaaaucuccagguaccuacaggucagugcaagggugcaauugcuucaggucccuuuggguggggguaggaguguggaagacaccaaagcacaucccaggggcgucacggcugccucccauccggauuaagcacagaaggccccugcaaauccugcugcggaaauggggugaaggaaggaaagggagaggcuaaagacauuuaaaagagagaggagaccgcugaccugacuguugcuggugagaagcugaggaugggaugacuuggaaaagcccgaaagggcgggaguguuagagccauguggugagggaaggguuaauugcuuccacgccgcucccauuucagugcuaggagagguuuguugcagggccugcugggaaaauggugggcuggagccgggacaggagaagauggaguuggagagcaaggggggggugggggggguggaggaagggguggagucaggagcucagaaccugacuugucuaguuagaaaacuuuuuggcaauuaagugaccugaaacaaaagucagucgcuaugggaacacaaaagcuuguccaucugccugacaccuagucgguuuuguuuccuuguuuuuaucccccuaggauuaauucauuaagaaaauaaucaacaugcaaaagucuugugacgagaacgaaggaacaccccagaacacaccaaaagcagacgaaggccauccuucagaagauccaccacagcaggcaggagaaacucuucaggcuucuggagaaaaugugagggaggaaacugaagggagccauagaggagagccugcugaacccagcccagagcccaaagaggacacucccgcaaggcaucugaaccccgaagaagugauaagaggcguagaugaguuggaaaggcuuagggaagagauaagaagaguaagaaacaaguucguguugaugcauuggaagcaaagacauucccgaagccguccuuacccugugugcuucaggccuugaaaucguuuuuuucucugauauugaaauguggcugcugcuuucuuucucuuagcauuuucugauguaucuuugaacuucauuuuacuuuuaauaauaauuaccuggcgguauuuucuguuauguaguuucguuguuaccagcaucucauuggauuuuggauuuuugacccauuuuccacguuuaucuuucaguuggaaaguuucacauuuaugcauggaaauauacaauuagacagcaaauugaaaaaaacagcagcauaguuaggaucaacucacauagauaggaaaauuccuaauuauguguguacauguauaauuauacguaucaaaaaauuuacagugcuuauuuuuggugugguguguuuuaauuuugccuuuuacuuauguugauuuuuuuuaaugaauacgugucucacaaagaacugcagauuuuuuuaauaagugggaguuaauuaaaauuaauuuguaaccagcuuguagaggcaauaaaggcacuaaacucuugaugaacuauuaaacagaaauguaaaccuggaauucccucuggcuuccuuagccagaggaauaaaacuggcaaucauuauagacacacuugguuaagacuuggucuuuucaugggggaaauacuugccucacagggaucuguguggaacauaguaugccauauuugagagaggacauggccucacucagccuguguucagaugcagaggggugggggcugggcuuccgugccauuuuucuucugcugaguucccacccuuuucuucccugggaccuguccugccuaccaacuagggccaagucugcuggauccugccaguggggucuuaaguauaaagaucccgcuggguuuccuugaauuccaguugaacccccagccccaguguucaguuacagguggugccacuauagcuggcaguuuguuugguuugaagcaaugucuuauucuguagcccaggcuagcuaggcugggauucauggcaauccuucagcuucugaaauguuggaauguuaacucccuuuaacuccagugacaggggaucuggugcccuuuucuggucucuacacagacaugguacaaaugggaggacacugacacucuucagacauauaagaagguggcgucagaucccauuacagauaguuaugagcuaccaugugguugcuaggaauugaacucgggaccucuggaaaagcaaccagagcucuuaaccacugagccaucucuccagcccccaacauaauacacauguauucaugcagggucauacagauuucaaaaaaaguuuuaaaaacugcucuagguuaaugauuccugcagaauccuuagcaaaagcaaucccuuuaauuuucaacauggggcguuuucucuggagagguaauaacuggauaauauuaagcauauuugaaaguagaccaagguaucuguuugaaugaaaacuuugggagaauuccuggguauuuagggugguguuuauuguuuuuauugugcuuuuugagacaguauuccauguaccccagacuugacuuugcuuauuaccuuaagcaucugauccucaagaccccucuucccgagggugagcgagcguugcaggugggugccgccgcuuucaguugaugccggggaucagauucaaggcuuuguacacaguaggcaagcacucugccaacagagcuucacacu

SEQ ID NO: 9747 - RNA, 2063 nt, Mus musculus
acguagaucucaugugaccaggagucgacgugugcagaaauccugcuagucugguccuuguuuccaucuggguaccagcucccuuuagccuugcagacgguggugcgagaggccagcggccagaagagacagcuugcuucaauucaucagguuaguguuuuaagccguuacugccaaggauuuuuguaguuuacaguggucuaggguagugacuugaguccugguuaagucugucccuccaccucguaccuuuaauucuucaggaaaggacacuugugaaacgacuagggggucccaagagaaaacaaggggggcugugacgauuccaaaauaaucauacucugagauuuuggacccccacuuugcuucccaaaccucgucucggaucuacagauaguuggggaagaauagcuccuuuuuacccucugucuggugagaaagacaggcuaacuugcggggugggaaggaggaguccuuugggaaacaaagggugggaaacuuccauaagcaagcccuuaaaugcggagagcucggcgagcuggguccgugguagugcucugcugagcaccgagggcuugcuugccccacccccaacauccccucccuucuccguuugccugcagguuuguucuuuguaccgcaccaggcuaaaauaaguaggaaaaagaaaucgaccagaucuguaccugguaagugagggggaacuuuauaaaagacucccccaggauaugggucggugaaggccugcagaggcugaaggccccaguccccucucccuuccccccaccccuuucggaggggccuguguuaggccugggagggagaaagauuuguggagggcuggggcgggaggcgggaaggaaggccuuggaaaaugcuggagggagggacuagagaggggaggggguggaaaauggagguaagaggggcggggacagggaaaccuugauugcggacuggguuucucagguggaagguaucuggugagggcaguuagaccgaacgaggguggggggaagagaggaggggaaagagggaaguggggagagggagagcgggagggggcaagaguggacggagggggggugggauggggagggcguaagcaaacggugaggagaccuuugugcacagcaccugcccaucuaccaagucuuccaucuaccaccaccuccuccuccuccuccuccuccuccucccccucccccuccccuccccccucgcuuccuagaaaucauugcauucccguauucugcaggaagcagcaaagaagagaagcagacacaagaugaaacccugccaaaaaauggaaggaaaccuagaaaaggaggaugagccaaagccugaggaagagccaaagccggaggaaaagcccgaggaggggcaggaacccgaggaggaggagaaauccgaagaaacuuuucgggagaggcugauccggucucugcaggauuuucaggaggauauacacaacaggcaccugagcagugaugaucuguuuagagauguggaggagcuagaugagaucaggaaagugagaaacaaacuuauagugacgcguuggaaggcuaaccgaagccauccuuaccccuauuuaauguagcuuggcuugcuuucccuuuuaucugauguuaccauugcgaucuagcuuucuuuucauuagcauuuuccugauaagaccuuugcccaucuuccuacuuugaaucuguugcuguuaguggcuuuagcuguaucucuuguugucuguaucuuacuguugauuauauuugaaccaaucuauaagucucuggcuuuaagcuuuacugauuuguaaaaaaaaaagaaaaaaaagaauaacaaaaugagcuucugaugggauacaaaaugagaaaagguuacaaaauaauaugggaauaucauauuuugaaagacaggaguaccuuuguauguuacauauaugcacauauaaacuugugaaagaugaaugauuuuucuucugcuuauuuguauuugccauauuccuaaaaugaacacgcauuauucuugcuaaaaauaauaaagguuuuauaacuaaaaauaagaau

SEQ ID NO: 9748 - RNA, 2063 nt, Mus musculus
auucuuauuuuuaguuauaaaaccuuuauuauuuuuagcaagaauaaugcguguucauuuuaggaauauggcaaauacaaauaagcagaagaaaaaucauucaucuuucacaaguuuauaugugcauauauguaacauacaaagguacuccugucuuucaaaauaugauauucccauauuauuuuguaaccuuuucucauuuuguaucccaucagaagcucauuuuguuauucuuuuuuuucuuuuuuuuuuacaaaucaguaaagcuuaaagccagagacuuauagauugguucaaauauaaucaacaguaagauacagacaacaagagauacagcuaaagccacuaacagcaacagauucaaaguaggaagaugggcaaaggucuuaucaggaaaaugcuaaugaaaagaaagcuagaucgcaaugguaacaucagauaaaagggaaagcaagccaagcuacauuaaauagggguaaggauggcuucgguuagccuuccaacgcgucacuauaaguuuguuucucacuuuccugaucucaucuagcuccuccacaucucuaaacagaucaucacugcucaggugccuguuguguauauccuccugaaaauccugcagagaccggaucagccucucccgaaaaguuucuucggauuucuccuccuccucggguuccugccccuccucgggcuuuuccuccggcuuuggcucuuccucaggcuuuggcucauccuccuuuucuagguuuccuuccauuuuuuggcaggguuucaucuugugucugcuucucuucuuugcugcuuccugcagaauacgggaaugcaaugauuucuaggaagcgaggggggaggggagggggagggggaggaggaggaggaggaggaggaggagguggugguagauggaagacuugguagaugggcaggugcugugcacaaaggucuccucaccguuugcuuacgcccuccccaucccacccccccuccguccacucuugcccccucccgcucucccucuccccacuucccucuuuccccuccucucuuccccccacccucguucggucuaacugcccucaccagauaccuuccaccugagaaacccaguccgcaaucaagguuucccuguccccgccccucuuaccuccauuuuccacccccuccccucucuagucccucccuccagcauuuuccaaggccuuccuucccgccucccgccccagcccuccacaaaucuuucucccucccaggccuaacacaggccccuccgaaagggguggggggaagggagaggggacuggggccuucagccucugcaggccuucaccgacccauauccugggggagucuuuuauaaaguucccccucacuuaccagguacagaucuggucgauuucuuuuuccuacuuauuuuagccuggugcgguacaaagaacaaaccugcaggcaaacggagaagggaggggauguuggggguggggcaagcaagcccucggugcucagcagagcacuaccacggacccagcucgccgagcucuccgcauuuaagggcuugcuuauggaaguuucccacccuuuguuucccaaaggacuccuccuucccaccccgcaaguuagccugucuuucucaccagacagaggguaaaaaggagcuauucuuccccaacuaucuguagauccgagacgagguuugggaagcaaaguggggguccaaaaucucagaguaugauuauuuuggaaucgucacagccccccuuguuuucucuugggacccccuagucguuucacaaguguccuuuccugaagaauuaaagguacgagguggagggacagacuuaaccaggacucaagucacuacccuagaccacuguaaacuacaaaaauccuuggcaguaacggcuuaaaacacuaaccugaugaauugaagcaagcugucucuucuggccgcuggccucucgcaccaccgucugcaaggcuaaagggagcugguacccagauggaaacaaggaccagacuagcaggauuucugcacacgucgacuccuggucacaugagaucuacgu

SEQ ID NO: 9749 - RNA, 2248 nt, Mus musculus
cacgugaccaggagccuaugucugcccaagucccucucucaucccgguccuuuuugccuguccagaccccgucuuucuauuaccccuugaucgagaaggaaagcagaaguaaguaaguucccuggauccucuagauuuggugauuguccgaggugccuuuuaaccagugggaucggaccugcgaggcagaaucccgaucuuccacuacgcuugagccccgcccccccgcccacgguuuugguagagaaaaugguggucuugggaguggggugggguacaaaggacguggagacgugaggucugaggaaggugaaccacaagggagcugucuuuggggcgguuagcuggugcccacauaaagggggugugcgucauugcuucuguuucucuuccccauccccgccccccuacccuguuuggcgucuaacuguagauuugcaggucucaccuaggagccucaaaagggaccacaagguccagagggugggacaggaugaucagugggacaggaucagggucugagaaugaacaccgaagguaacagucugcggacuucaccgcuccgccccugucacugcaggagaggccuguggcaaggccugcugggaaaaaugguggucuuucgggaaggaggggggcuuacugcgcagcagccagcgggagagcccaagagcuacugagugagcuaagauuuaaagacacccgucccaaucagggaaaggccgggauugaaaaguguagcugggguguugauccagcccgccaaguauugugacuccauucuguuuuuucuugucucaagaauaauugcuugaagaaacuucucaacauggaaaacacgcgcagugaaaaugaagagcaaccagagagcacucugaagaucgaugaagagcagccugcaguggagcagucuccugaaaaucagugcucugaggaggaucaauccucggaggaucuguccuccgaggagcaguccuccgaggaggaguucuuuccugaagagcuccugcccgagcugcucccagagaugcugcugucugaagaucguccuccgcaggagugccucucacagaagaaccaguucgaagaccguauucccauggagcaaccucccugcggggugggcaaacacaagcuagaggagggaagcuucaaagaaagacuggcccguauccgcccucaauucauaggagacauucauggcagaaauuuaaguaaugaagaaaugauacaggcagcggaugaguuggaagagaugaagagaguacgaaacaaacugaugauaaugcauuggaaggcaaaacggagccgcccuuacccuauuuaauaugcuccacuuuucauuguuuugcuuguuaauagcauuugcuaccuggcccuuguguuugcaucuucuuauaugcccuuucccaucuuaguuguaacaguuuuauucagguugugcaguuuuauuucaaguguuugacauguaacuggcacgggucuuuguuuuuguuuuuguuuucagaccuucuaaaaucugagugugauccauuugcauggaaagauauacauuauauaugugaggugauaaaagcaaaagguauaugcauagcaucccauuuuuguaaaaggaaaacacauuuauauauuaauaugcaaagaaaagcuaaaaacuauauacuuaaagacuaacauugguuaucugugugguaaagauaauaagugauuuuuauauuuuuuuaaauuuugcuuuaucuaaaguuucauuuuucaugaugaauacauuuuauuuauguugcacaacaaacaauauaaugaaaaaugugaagcaagccuaaaaucaaaaaguguuagucagcuuauaaagaaaaugugcuccuuaauaaauauuuaucagaacuuaaaaguuaauccaauguuucuucugaaucucuuuucuaagauuuaucuuauuuuuuaaauuuguaugaguguuuugccuauaccaggugugugaauagugccugcggaggucagacgaagguauuggaugcucuggaacagcaguuacagaugguggugaaaauugaaccuaaguccucuagaggagcaacaagugcuuguaaccacugagccaucucuccagucccucuucugaaucucuuagaagaaauagaagcgggacguuuauuaucaguaggaauaacauuuuccaaguuaaauaggaguaagacaugcauaccuuacaguguugcugugaaaguaaacgagaaaagggugcuuugag

SEQ ID NO: 9750 - RNA, 2248 nt, Mus musculus
cucaaagcacccuuuucucguuuacuuucacagcaacacuguaagguaugcaugucuuacuccuauuuaacuuggaaaauguuauuccuacugauaauaaacgucccgcuucuauuucuucuaagagauucagaagagggacuggagagauggcucagugguuacaagcacuuguugcuccucuagaggacuuagguucaauuuucaccaccaucuguaacugcuguuccagagcauccaauaccuucgucugaccuccgcaggcacuauucacacaccugguauaggcaaaacacucauacaaauuuaaaaaauaagauaaaucuuagaaaagagauucagaagaaacauuggauuaacuuuuaaguucugauaaauauuuauuaaggagcacauuuucuuuauaagcugacuaacacuuuuugauuuuaggcuugcuucacauuuuucauuauauuguuuguugugcaacauaaauaaaauguauucaucaugaaaaaugaaacuuuagauaaagcaaaauuuaaaaaaauauaaaaaucacuuauuaucuuuaccacacagauaaccaauguuagucuuuaaguauauaguuuuuagcuuuucuuugcauauuaauauauaaauguguuuuccuuuuacaaaaaugggaugcuaugcauauaccuuuugcuuuuaucaccucacauauauaauguauaucuuuccaugcaaauggaucacacucagauuuuagaaggucugaaaacaaaaacaaaaacaaagacccgugccaguuacaugucaaacacuugaaauaaaacugcacaaccugaauaaaacuguuacaacuaagaugggaaagggcauauaagaagaugcaaacacaagggccagguagcaaaugcuauuaacaagcaaaacaaugaaaaguggagcauauuaaauaggguaagggcggcuccguuuugccuuccaaugcauuaucaucaguuuguuucguacucucuucaucucuuccaacucauccgcugccuguaucauuucuucauuacuuaaauuucugccaugaaugucuccuaugaauugagggcggauacgggccagucuuucuuugaagcuucccuccucuagcuuguguuugcccaccccgcagggagguugcuccaugggaauacggucuucgaacugguucuucugugagaggcacuccugcggaggacgaucuucagacagcagcaucucugggagcagcucgggcaggagcucuucaggaaagaacuccuccucggaggacugcuccucggaggacagauccuccgaggauugauccuccucagagcacugauuuucaggagacugcuccacugcaggcugcucuucaucgaucuucagagugcucucugguugcucuucauuuucacugcgcguguuuuccauguugagaaguuucuucaagcaauuauucuugagacaagaaaaaacagaauggagucacaauacuuggcgggcuggaucaacaccccagcuacacuuuucaaucccggccuuucccugauugggacgggugucuuuaaaucuuagcucacucaguagcucuugggcucucccgcuggcugcugcgcaguaagccccccuccuucccgaaagaccaccauuuuucccagcaggccuugccacaggccucuccugcagugacaggggcggagcggugaaguccgcagacuguuaccuucgguguucauucucagacccugauccugucccacugaucauccugucccacccucuggaccuuguggucccuuuugaggcuccuaggugagaccugcaaaucuacaguuagacgccaaacaggguaggggggcggggauggggaagagaaacagaagcaaugacgcacacccccuuuaugugggcaccagcuaaccgccccaaagacagcucccuugugguucaccuuccucagaccucacgucuccacguccuuuguaccccaccccacucccaagaccaccauuuucucuaccaaaaccgugggcgggggggcggggcucaagcguaguggaagaucgggauucugccucgcagguccgaucccacugguuaaaaggcaccucggacaaucaccaaaucuagaggauccagggaacuuacuuacuucugcuuuccuucucgaucaagggguaauagaaagacggggucuggacaggcaaaaaggaccgggaugagagagggacuugggcagacauaggcuccuggucacgug

SEQ ID NO: 9751 - RNA, 15211 nt, Mus musculus
uuuagggccuaauaaaguacccuagguuuuccuugaauauucuuuagaaauuaaaaaaaaaaaagaaaccaaguauccaaaauaacaaaaucaaaauauccaguaacaaaguauccaaaagaacucuuuuaauaccagcacucaggaggcagaggcaggcagaucucugugaguuugaggccagcuuagucuaucuacagagugaguuccaugacagccaggacaacacagugaaacucuccaauaaacaaaauaaaacuaacaaauaaacaaacaaaauacaacaacaaaacaauacacaaaaaaaugauuuacuuugccuaaggcauauuuuuguguucagaacugauuauucuuccuucccuuucucucuuaccaaaagauguaauuuugucacuguggagucgggcuuugaacuuauauaugcucaugcuacagucaguaagauacagucuccuccuugcucccuccugaucaagaucuagaacucucaguuccaucuccagcaccaugucuuucuggacacugccaugauugacacaugaugauaaaggacuaaaccucuaaaacuguuagccagccccaauuaaauguuuucuuuuuuuuucauuuuuuauuagguauuuagcucauuuacauuuccaaugcuauaccaaaagucccccauacccacccacccccacuccccuacccacccacuccccuuuuuggcccuggcguuccccuguacuggggcauacaaaguuuacguguccaaugggccucucuuuccagugauggccgauuauccagggauccaccccauaaucagcauccaaacgcugacaccauugcauacccuagcaagauuuuauugaaaggacccagauguagcuaucucuugugagacuaugccggggccuagcaaacacagaaguggaugcucacagucagcuaauggauggaucacagggcucccaauggaggagcuagagaaagaacccaaggagcuaaagggaucugcaacccuauagguggaacaacauuaugaaccaaccaguaccccggagcucuugacucuagcugcaaauguuuucuuuuauaagaguugcugugguuauggugucucuucacagcaauggaaacccuaauuaagccagucucuuaaccucaaacaacuggaauuuuaggagggcuaauuaacacauaguaugucuagucauugcacaauggucauacuggaacuggguucuauuauugucugacaaauauacuaagugaacaccuaaaagcauguuuaggcaaacagcuuaguauccauuaaaaaggggugauggagaugacaggacauuuuuuuaaagaauuuauaucuagggcugcauauagcauagacuucuuuuaaucccaaaacuugggaggcagagacaggcagaucucugggauuucaaggcuguccuagcuaggauuacuauugcugugaugaagcaaaugggcaaaagcaaguaggagagggaaggguuuauauggcuuaacuuccacauuguagucugucuuuuaaaggaagucaggacaggaacucaagcaaggcaggcaucuggaggcaugggcugaugcagaggccauggaugguguugcuuacuggcuugcuucccauggcuugcucagccugccuuuuuauuuuuaauuuuuaauaacucuucucucauauacuacaucccaaccacaguuuccccucccuucacuccucuaaguccuucuuccccacccuuccacccucucuacauccacuucuccauuucucuucagaaaagagcaggccucccauggauaucaagcuaacaugucagccugcuuucuuacagaacucagggccaccagcucagugguggcccuacucacaaugggcccugcccaaugaauuacuaauuaagaaaacgugaugaauuacuaauuaagaaaacgugcuauaggcuugccuacagccuaaucuuauggaagugagggucccaucucucaaaugacuuuagccuaugacaaggugacagaaauccagccagcacaaaggccauccugguuuacagagcaaguuucaggucauccagggcaacauagagagaugcugucucaagaacuuaugucuaagauaaagaaaagcuacuuuuuaaaauuagacucuaaguuaguuuagcuuuauuuuucuaguccacuauuacuuauagaaaaaucauaauggauaucaacuauuuuauggauuuauaacugugcuguagauauagaacagauucuuucucacaauuuccucaauguuguuucaucaugacgauaauguaaauauuuauauucuuaaaucuaccuauuuuugaugggcacuuucccaauaaucuaauauucagaaagggcauaucugaauugaggguauaaaaaccucuauuuuagggcagcaaccuuugguuucaucaaugaaaugucaaccauuuagaauguauuuuguaguaaaauguaaugcaaaaaaaaucuaacaucacucccagaaauauuuccucaauacauuucuugacuauaucauucuuucauuuauucaaauguuccgaauuaugaaauauauauauauauauucauuccaauauuuauagucuguuccucuauugguggcuaaaauacuguuuaacuguguggcaauuuauacugaguuuugcgaugcagcaacuccuuauuuuuuuuuuuuuaguuuggguguauuuugcaugcauguaugugugguucucagaaaugaaguuauggaugguugugagccaccaugugggugccagaaaucaaacccaugucuucuacaagagcaacaaguggucuucgcugcagagcuggcucucuaggccccuccauaccuuuuuuuuuuuuuuaagaauuuucccauuugacauuuuacuuccauucacucauuuuaaaacaaugaaaaaaagaaaccauaaauuugagagaaagggagggguacaugggaggauuugaagagggagcuuuuaaauuauagacucuaaaaaagaaacaaucuuuuuaaaauagagaaaagcagcccccaccaaaacaauaaaaauaggguccuuuucuuaucaaucugggaacaaaaucacuuauauauauauucugaucucacuuuauuaacauauauacucauaauucuauggguauaugcuaaaauauuaacuauaguuauuucugguauguuagacauccuuguguuguaccugaccuccuccauucagcucuucucacucuguauacaccaggcuucccaauuagagacuacacguaaggucuucuuugucuggccuuuaguuuggcaagagggaagaggacacuguauguuaugauauagaagugaaacacugaguuuagccauuccuuuuuaucuuggcaucucuuuuuucagaguuuauauguauaugacaacuguuguuagauggcccuuuuuccacucagguguauaccauuccaaaguaaccuuugccuagggguacuaaaucccauggaaugggcugaauuuaagucaccucccccucauauagcccuuacaacucaaaaaugcaguuguaacuuauugagguauuuacagaaauugaggcuucagaaaagcuaacuccaucagcaccauagcccuuucugcugcagaaaugaagaaacguauuucuguucacccaucuauaguaacuugcuuuaccuguacaaacugaauauauaguccaugacuauauucucugccaagaauuugggaaaagacuucaaggacucugacugguccuguaggauuugauucuuacuuccuauuugcccuuuguaauacuuuccuaaaugucaacaacuugcuaaaagcaaaaaauaauaguuggggguggggcguggcugggaaauuugcacguuaagauuagaaaaaaaacacguauauuucugauagaaguuaacacauaccccauguuuccucugcuaagaauuaaagcuuuggggcuaggaccugggcauagcucauaaaagaauggcaagaaggggcaauuaagaguacuuauccugguguagaggucagaaccacagaaguagagaacaucacuaacaaaccaggcugcuccaagugucacguguaagcaaucugcccagagaagccacaccaaagagggaaaauaacuugaccuuaacugcuacagcaagaaucuuuuaaaaaagcuuuugacuuuuaacuaugugucugugugguggcauauacauguccacagaauuaccugagauggccagaaggcaccagauccccuagagcuggaguuacaggugcuugugaguuaccagaaacaaacuuggguccucugaaacagaacaggcugagcagucucuccgguccaagaaaggaauuuuuccuuugaaagccaguuuucuucugugccacccaaauaccucgacccuguauuugcuagucucaggaacauaaaaagaacaccacacauuuuuuuuuuugcuuugaaauuuagaaacaaguuuuauuuaagaucugaaauacaauuccuaaaauaucaacuuuucagaaaacuguggcuacacaauaaugcauugccucuaucauguuagaacgugcauuagacucaaauacaaaaaccaggaaacaaaucaccauccuucaacaauuugagcaaagauagaaugaaugccuaaggaacaacaaagauggacuugcagaggaugggcuguuuacagacgucaagcaccauaaaaaaaaaaaaagcacaaaugcauggguuuccagguauauacauuaaguugaaccuuuggcacuaggaaccagggcaucucaucacguagcauuaacacauauuagaaaacuguguagugucaaagggauagaaccaccagcauucaagcaauguugucaacuaggcaauaaaauggucuacugaauuucuucuuugucuaauuacugcauacacugguagcaacuuugaaaugaggaaaggagcugggcacuccuuuuauuuucugucuacaacagaacaggaaaacaaacugaaacauaagcccuguuuuacacugacaguuuuaaagaacaucaauuauaccaugaaaggacuaaacagaaguguuuacagauaccagacaauagugagcggucaguagaccuucacagggcuuugcgaugauagucagcagaagccacuuuguaaucacuggcaguaaacagagaggcagaauucuuugccagauacuuaaggaaaucaugcagauagcccagcaauaaugccaggcuuuucucaucaaggggcguauaggccaacauugccccaauucucacgaauaaucucaggagguguggcgccccauagaucugcgacaucggcgcaucagggugagccagcagaaucucagcauacugaggccuuucaaacuuguacagcagcugagugcccagcaucacauugaaauacucuuuuaucccuccuacaacuucauuaacugcguacuccuuauuaucaacauuucccugcgacuucuuacaauuggcauacuccucaagaauggcaucgacauucuuuuuagcagggagcuggaacaacugcuucugccucguaaccaagucccaguccuccaccagccacgguuuuaauucuucagggaucuucaccuucaccuccauccuacucuugaaugccuccucgcucuccacaguggggucagcccgugcccuuuucuuccgagggggcugggggacuucacugguacugccuccgucuccguugccaggagccuucugcuuguucuuccuggucuuccgcacagaaccggaagggggguucucagcagagcgaccuccccaucuuccgggcagggcuggaucgagauucuuuggcugcgaaccagcugacuucuuucccgaggcagcuccucucaucuuacuucucugcauauugcuucgaguugguuucuuaaaguugucuucuucagcagauuguuguccacgaguuugagaagccugcuuucuggaacucauucaacccuguuuuuauuccaaccacuguaauacauaaaguauuguauuugguuguuuacuauggugacuuaaugacccaucagaccacaacacaugcuaaagucuguuggaauauauauagauuuuggguccuauugcagaggaccaucuguaagugcuuuucugucuucuaucucaaaauccucacucccacccacaacucuugccucaccuaacaacucaacagacacacccacaaauucgucucuugaugcuauuuaaaagauaaggauuuauuuuuagagaaagauacugugacaaaaccauagaaaaaagcagagaugaaaucaagacuuuggaacaagacuaagaauuugaaagauauuuaaaaaaaaagaauuugaaagaaauaaggaaguuggagguaaagucuagguaggccuugaguacugugauggcaacauacacagaccuaacaccgaggaacacaaugaucaaagguuagagucaaaauggguucuguaugacuaagcccggguaguuuuaguaaaguacagaguuuuaaagaauucguuugacaccaucaguaaacaaggcuaguccaucgauaguuacaugcauaaaggaucucuuuuaguaacuauuugcuagaagagaugagaaacugggaaaggaguuagugacaacuuucaggcuuuaaggauggaugcucuuguaucacaaguaaacugcuuagaggagaaagguacuuaguuuuggacuuuuauaucuggagagugcacucaaacagagaaauggagauuuauuaucauguagcuugaagcauacacuauaaaccagugaacguuuaaauaaagagagagaauugcauacauagaacuccagaaaagauagggaagaaaguauuugaggaguuagcaagaaagagaccacagguaaaauggugagacuuucaucggagaguuaagauugugacuuuagaagauaaagagguugaguuucaagagaaauaauggucagugaaaaggaauuaaaaaacaagcuuccugcuaugauggcaugacucauucaacaauccccuugacuuacacaauguuccuucuuucccuuccaaggauuccuaguauuuccuaggauggucuggaaagaugaagugggaauacaaccuagaaaggaaaguagguaucugcaaugaagaugaacuuuugcaaaaacauguaagaaaaaaauuguaaaugugccuuagauauaugaaggaaauuaguaaaagagcuuuugauuugccaaauggaguugaagacauauauguauguauacucucagucucuuucauuucauacacgaggaacuauuucuuccuaguuguuauagaaugucauguuacagcugaacagcuagcauaguacuccacaaacacuuccacaugggaauguggauaguucauugaauugguacuugcaaugaggaacuggauacacuuauuuauagcugcuucaguagggaggaugauacaaauuauacaugcacacuacagaauacccaaaugaauuaaacagaggccuauauauacugacacggaaaacuguuuaauguccuuagguaaauagguaaguagaacagagagggagccuaaaauggacaggcaggacaggaagaacuaagcacagcucuuaggaacagugugauuccauuugcuuuaaaugugugcaaauguauaaaacaugcgccuguuacauauccaggguagccccucucccccgaggagagaauugcuauucuagcuuuaauuuacuaaggacaaaagcauguacaaauggggcuccuguuuacacaaggguuuggaaaaccacaaccauuuuucuuaagagaccaacacauuguaaaacaagcauuucuuuugaagcuguugagggaugggaauguaacacaguuaggaguacucgccuugcucaucagcacuuaccaaggaacuugagaaugacagcugaacuuauuuaaauaaguuuuguuccuccccacuuacacauuugagguaggcacauauuauugaauauuagaucucaucuuuaaaaaaucauuuaaaggaaaucacauucccacguuaagguuauaauaugcaucuuuugggcuaugacuagacauuucuuuucaccccaagcugauuuaguggauucagguauaaauaacuauuuaaggucuuuaccauggcacuaaauugcuuacccuucaaaaacucuaucuuauaaacccauccccaauuuguacaugucuuuguccuuuugaguuggcucuuaguaaauuuaucauuuucuagaucucuucaaauuauuuuugacaaaugcuuucccuuggaaggcucuuuagugucugauguuaaaggcuuuuaaagcucuuggccccaguguuguagacaauguucuaaauauuucauuacaaaaacucaguacuagacaccaauacauagauauauuaaagagcacuagguaaguaucucugaaggauauauuccaagaggccguauucaagguaguugccuaauuggugauauagcccgaucaccaguuaacuguuuuaacuuguauuccuagccaaaaccguggcaaguuaauucuuccaucuucaagcacacuagauucuacuaguccaauuauaccucgaguuucaaagaccucuuccgacccccccccccaauuccccaauccacuuuuuugcuaaucuaacuuguggggcaucuucauuuguauauguaggauuucaagcaaccuuuuauauaaucaccuuuuuuucuuccauagguauuuucauuuccuuuuguauuagggugcuucuuauuucacacugacucagaaauuuuuuuuuuguuguuguuguuauaagaguugaagugugaggcuggagagauggcucagcgguuaagagcacugacugcucuuccagagguccugaguucaaaucccagcaaccacauguuggcucacaaccgucuauaacaagaccugaugaccucuucuggugucugaagacagcuacaguguauuuacauauaauaaauaaaauaaaucuuaaaaaauaagagcugaagugugcuuaauauugucuuauggacugggcccacuuauauaucucgauauuauaaaacaaaccuggcuggcugcuucuuuguaaccuuuagcuuuguuucacucagggaaaaugauagccaaagaaaugccauagaaauuaauuccuaugcuauuucuuagcaugcuuuuaguuucucccaaauuuauagcaaucuuuuaucaauguucacuacugaucagucuauccuuuucucaaugagaaaugcuauuuuauaaauauucauaaauguauguggcuuagaaaauuauguuacuuuuaagucgcucucuuccaaagcugaggauggccuagccuagaauuuacucuaacccucuugcuuuccuaccacuggaacuauaggcaugagccaccacacccauuucugggcucuccugauuauucugguuguucuugcaacaguaucauaaugguuccauuauuacgguuuaaagauauuaauguugcucuagaauacuuguuaaugcauauaaaugguggcugacguggcauuauuuuagcaggaaaauacugggguaacccucuagugacuugauuaaaugugauauacucauaauuuggaauaucaucucagcuaaaggacugucacugugaaagaaauaccacaaaaguuagaucuaugaaggaacaaagacauucaaagacuauuuguuaaauaaacauagcuaguuauauaucaacaccuuaguuuauacaaagaaaaucauaaaacaacuuuuauacacaucuguacacauuuuaggcaagauuuuaguuaggucaucuagaaggaaaugaagaaaauuagugacugacuguagagagaacaagggggaaaugagaaaaacaaaaaacccugagccauauaucugauucaugaauuuuugugauguggucauucauggauuuuacauccuuucaccuuuuacuucaguaccacuguacucagauagucccaaagguccaaggcaagggccuucucuuugaggcuuucccauuucagaucucucuggccucugcuuugccaguaucuauagaucuacuauggaucaacucucacuuauucucuaaauugccucucugccaggaaacugccuuccccuuaaacacaguccuuacaaaggagagaaauuaaggcaauuauagaauuccuuuaaaaaugucgcugugaagagacugaggcacaccccuuccuuucauagguucauguaaccagacuccaauuguacuuuugugugugucacaagcccuuuaaaagugaggggggcacauuaauuagaccauguuuucaucucuuggucucugccuaaaaucaaguacauaucagcuuucucauauggauacuggaacauucuacaugucuaaaaaaaugaacauugaggaaagaucucauaucccaggcuagaugcaaacuuccuagauagcugaggucaaccuugaccuucugaccccccugccucuauccucuaauagauuguaagcaugugccacugucugggccuggucugggcagugcuggugauucaaaccuggagcuccauguaugcuggggaagcaacuuuaccaacugggcuacacucgcaacccaacugauggucuccagucugaacaaaggaggaaaauuacauaaagauugcuuagcaugcuggauaugguagcuaaaauuauaguucuuggaaauuuccucauaaggaaauagccuuaaagcuauuuuuuaaagauugauuggaaaaaccagaagucuuaauuucagaagucaguccuaguaguuaauggcugcuucuggaaaaugagagaaaccaacaauauuaauuaaaaaaauaauuccaagaaaauauuauuuauuucucuacaaaaaugugcuuuuauauauacauaaaauguuucaugacuauuaaagccauauaaguauuauuacaggaaauacuuuuaugaagacaucuuggaacaaaggaaguuucuugcucagaauuacacagaaagucgaagagccagcaaucaaauccaucaaaucuguauuugcuguagagaaaaauaauguaauauuuggaagugugaagccuucauagagcacuaauuuuuaauuaagagaauaagauuacgcaugacuauauuguuuauccuucccuuuucagaauuuaaagcacuuucucagauggcagcuuauuaaucuucaaaauacugcuacacaucuaagaagguugugauauagcuggucuguaaacugaggccagaaggaaggcacuuacccuguauucugcaaccaggaaugguucugcaaccagggucagaucuccugauccuuacuguauagcaaacuuagcuuuucugaugaugaccuagaaggucaaacaaagagauggaaaaggacauaaaaagauaugagauggugacuuuccuuuccaucaguaaauaaaauuuuaucucacacaaaggacaucaaagcugauaauguagaaauucuauuuuucuuguaguuuuauuuucagauaaauguacuuucuuguauguuuaucaauuuuggaaaaaaauuaauuaauuucuauuaaggauaaugugaaauaaauaaaauuguaaaagaacagcaguacaaacggcugcgaauccuucauccagcuccaacaauuaccaacugaaggccaucuuguuucaucuguaaccccacccacugcucccccccccacgguuuuuuaagcuaucgggaaaaaaaugacuucagaauuccagaauauuucaaauauauaccaugggaaaaaaagacaaauccaggaaaccccaucugcccaccccucacuuuaaaugauuaaucuaggguccugaugauaccccuccccucgcugucuaucgcugaaauuauccugaagcagacccuagucauccauggauuuugaagccauuuucugacaucauuuaaucccuaagcauuucuauuucuuuccacaaaauaaagcauucugaaaacagaaccacaucgccaccauaagcauuaaaaaaauuaauaauuugacaccgauuucauugaagaauauuaauccugcauuuaaaaauccccgauacgucuucaagaaaauuuuacaauuggugugcucgaaucaggauucaaacaaggccuacuccucgcaugugcuucaggaggucguucucaaucgcuuucccccccuacauccuuuuucuuuuugacuuaaugugggaaaauuccgacccccacauucuauuagcaauuaugagcuagcaauuauuuuuaucaggaaggcuuaauaaaugccugucgucauaauuucuucuaagaaagaggaugauguacagaaaaagauacgauaucgagcaaauuugcguaauuuaaaauuuuucaucgccucuagaaauaucuuuaguaacaauugcuacuaccuuucggggacaggcuucacaccgaaugccucacacgcacuauuuuacuaggcacaucugaauccgcgucugagauagcuacuauuaccauuuuacaaacauggaaaccgagacacagaaaagagccuugcccaagcugggcguuggcgagcaggaauacgaauuccgcuuuuccugaaugagaaggcacgaguuaauccuauccauaagucaagaagaaaagaggaaaucaucuacccuuccuccccacccccaccccgaaaccugaaacgagaauccagcucucuccagcagccgacgugugaucacugcugcuccuccaaccgccauaguaaagccagguuucucuggcaacugauauccauaggcagacacgucacccuggaggcgggcuuagcccaucagccaauccuagccgucuugucugaguuuuagaauguuccauacccagaugauuggacagccgcccccacgucagcagugacacucagccgcaguaaaggcgggugcuagcaaccugcuucuucaugcuuagggccgacugcaaaccaauuagcauccuucuucagugagggcucccgccaauggcgaugguucuuuuaggaucuuagcccgcccuccaagugcgcuccagccguugggucagaagucuauagggcagcgcguucacguggcccgucuucacgacccagaguuccccugaccguggguuuuuuuuuucccccccucgcgcucgccuucucuccugcagggaggcauuauggguuuguggguccgcuccccucccccgcccccgccccgcugggaaaggaagugccgacguggcuggcggaaacaggcuaggcggaaaugagcuaagguucccgcgagugggaagagcgagggcagacccggggccacgcccccgagccuguugcgcaacucgcggaccuggggagagaggaaaaaaaaacaccaacgcccccccaaaaaaaccaaaggcaaaggaauggugaagguuuugaggugugaggcgugugaggguggugagugccacugggcggaugccuggaugcuuuggagaaacggggugucugcgcgcacgcgggcgcaggcaggcucgcguggcuguggagugugggugugggcgcacagccgcccucguggcgcuggcgaugaugggugugcgcaggcgugcugcccugguggggacgggaggggccgugugugagugugugugugugugugugugugugugugugugcgcgcgcgcgcgugagcguaggcgaggucccucauuuugguggauuuuucugccuuuuuuauguuugcaaacugcauuaauaaaacugagaauaacuaggacagugcuaguaucuaaaggaaagggcuucuguaagaaaaggccugccgauuuaaucaaauuccuuucuuuucuuugccuuuuuucguuuuuuuguuuguuuuugaggccuguuguaacuagguagcccuggcuggccuggaacucggagauccaccugucccuucacggccuucgagcgcugggauuaaaagcaugcgccacuccacccaguccgauuuaauuuuagacccuagagaugaucauuauucccacauuauaguccaccaaaauaaacuucuuccaugguuaagauucagaacuauauuaguaacguaaaagggcguuucuuucaaguuuccaguuguacacccccuccucucuguccccaaggccuccccuuugcccuucaccaaauuuacugcgaaucucccuuaugcccccucaccagguuuaucgcuaaauuggcacacaaaauuuuaaugaaaacauaggcaacuaaauuccccagugauagagacaacuccaguuuccuguggguggugagccucaccuaccuuuuuuccuaaucuccaagcggagugaucaaauacacauucggccaauuuuccagaaaguucacuggcugagcaguaaaccucuugaaucugccgcuagaugucaccaaaucccagccaaaggaguuacugcuugguucccagggauugugagauugauuuuuuugcuccacccacuucuuauuuuaugggcucccuaaucucuggcugacucauauauauaucuuaaauuccuaaagaugaauaagaucaaguucugugaaguaacaguacuaggcaaggaauuauauauccgaaaauucugguuaauuuccuuaagcaaaaaaaaaaaaaaaaaaaaaagucaccuguucuggcacaucuuuuguuuuuucucaggauugauaaaugggccuaaauucugaugcuaaaacccuucgugagcuguggcgcagccgcaguaucagcgcuugggaggaagaagggccgcaaauuaaaggccagcuuagauuacauauugaggccccgucacuacauaaauaaaccaaugaaagaauauucuuuuugcucacuuuuuuccccucuugaaauuuuuaucagguacguguguuggccccucagguuuauguagugguucugugcuguccggagugagaagguagguacuuaauauaccaaaaguuauauuuuaucacggugagagucaucacacaguuaaaacucuuaguuccuaacuacaguuuuaagccuguuccccccugagggagcucaccugugugacggaccuuaccugaagaucaggccuagucuccgaugcaggcgccuagggagacucuccagccacaagggcggcucaaggugucucuccaggugugcagcgaaaga

SEQ ID NO: 9752 - RNA, 96803 nt, Mus musculus
caggcuaggcggaaaugagcuaagguucccgcgagugggaagagcgagggcagacccggggccacgcccccgagccuguugcgcaacucgcggaccuggggagagaggaaaaaaaaacaccaacgcccccccaaaaaaaccaaaggcaaaggaauggugaagguuuugaggugugaggcgugugaggguggugagugccacugggcggaugccuggaugcuuuggagaaacggggugucugcgcgcacgcgggcgcaggcaggcucgcguggcuguggagugugggugugggcgcacagccgcccucguggcgcuggcgaugaugggugugcgcaggcgugcugcccugguggggacgggaggggccgugugugagugugugugugugugugugugugugugugugugcgcgcgcgcgcgugagcguaggcgaggucccucauuuugguggauuuuucugccuuuuuuauguuugcaaacugcauuaauaaaacugagaauaacuaggacagugcuaguaucuaaaggaaagggcuucuguaagaaaaggccugccgauuuaaucaaauuccuuucuuuucuuugccuuuuuucguuuuuuuguuuguuuuugaggccuguuguaacuagguagcccuggcuggccuggaacucggagauccaccugucccuucacggccuucgagcgcugggauuaaaagcaugcgccacuccacccaguccgauuuaauuuuagacccuagagaugaucauuauucccacauuauaguccaccaaaauaaacuucuuccaugguuaagauucagaacuauauuaguaacguaaaagggcguuucuuucaaguuuccaguuguacacccccuccucucuguccccaaggccuccccuuugcccuucaccaaauuuacugcgaaucucccuuaugcccccucaccagguuuaucgcuaaauuggcacacaaaauuuuaaugaaaacauaggcaacuaaauuccccagugauagagacaacuccaguuuccuguggguggugagccucaccuaccuuuuuuccuaaucuccaagcggagugaucaaauacacauucggccaauuuuccagaaaguucacuggcugagcaguaaaccucuugaaucugccgcuagaugucaccaaaucccagccaaaggaguuacugcuugguucccagggauugugagauugauuuuuuugcuccacccacuucuuauuuuaugggcucccuaaucucuggcugacucauauauauaucuuaaauuccuaaagaugaauaagaucaaguucugugaaguaacaguacuaggcaaggaauuauauauccgaaaauucugguuaauuuccuuaagcaaaaaaaaaaaaaaaaaaaaaagucaccuguucuggcacaucuuuuguuuuuucucaggauugauaaaugggccuaaauucugaugcuaaaacccuucgugagcuguggcgcagccgcaguaucagcgcuugggaggaagaagggccgcaaauuaaaggccagcuuagauuacauauugaggccccgucacuacauaaauaaaccaaugaaagaauauucuuuuugcucacuuuuuuccccucuugaaauuuuuaucagguacguguguuggccccucagguuuauguagugguucugugcuguccggagugagaagguagguacuuaauauaccaaaaguuauauuuuaucacggugagagucaucacacaguuaaaacucuuaguuccuaacuacaguuuuaagccuguuccccccugagggagcucaccugugugacggaccuuaccugaagaucaggccuagucuccgaugcaggcgccuagggagacucuccagccacaagggcggcucaaggugucucuccaggugugcagcgaaagaccgaugcuuucuaucucccuccuuauauacucacaguccagcgggcgucaugggauucuugucccgugucugguuaucuuagcgacugaugucauugggggcugguuaucagguacagccuuggggguaguggaguuccugacuaagcuguuuuucgaagacaaagggcauuuucuccccuacuauucucguuacaauuccgaaaaaaaaaaaaacgugguugugucuuuuaaagucgauaguaaguaggaaagcauuucacuuagguuucacagcgcauaaugaugucgccuugaggguuuuuuuuuuucucgauguaccugugugaccugugcauuucgcggcuaaaguucaccuucauuuaggucuuuucccucuguugcgguucacccuauuuucuauggaaggaucucacugaacucagaguuuacuacaugggcuauacuggcuugucagugagcucccaggaucugcccauuucuaccaacagucccccuuaaaauacggggguuauagauaggugccccauguucggcuuuuauauacgugcuggggaacugaacuuaggcccucaugcuugagcagcagacccccuacaucucccgagucagaccaucaauuuuuaauauuuucucuauuucagauguuguuuuaaauccuucccauagguauuucuuuuuucuuaacaaaauucuacuacacuauaaucagccaaaaaaaaauagguuuuaguuacuaauuauauguauuuguacacacgggugaaggauuuuuaauuuuuuuaaauuuuacuguuuuuaauuaggcauacaucuacauguguguaugugacauguguucagaagucagaggcacuggguccuccggagcuggaauuccuggcuguucugagacaccugacauggaugcugggaaccuaacuuggguccucugguagagccgucucuccagccacaacagugaaagguugucuuaaagcaguucuccaacucagacaaaucagaagcaucaguaaaacccaguaaguuaucagaauaugagauucguaggcucuacuuuacggcucauaaaucaaaggcuuuccggguggggcuuggcaauccacgccaguacagauuguucuagugaauccaugcacucgaaaauuugagaaccacugcuuugggcggggcgggugggggaggggagcuaaaaugcaauacuuuuuuuuguacaccacuagagggugccauagaauguaaagccaaauguguucugauauacccugcauaguaucagucuuguuuugcagacuaagaaauguguaggugucaccaucaguguuccccuuucagagucugaaacaaacuggacguuauauauuguucccugcuuugacugauguugacaaaccauuaagaugaugauaggaaagcaaaccaaguauggcgaaguaacuugaugcuuuugaugcauuucccccucucuauucuaggguaucacacaaaagcucaggacuguucuccuuaucucuuaccuuucagugcucuuucuauccugcaguuaccauuuuuagucuaugucauaauguuuuauguaugauaaacacaguuuugaaaacccauuuaugggucacucacucuauugcucuauacacucuaguucuacuaauaagcuuauagcuuaggugacacuuuguguuauuuuauagugaugaaaaugaguucuuguauccaguuauuuccauucauauguaauuuacaaguaauaaaugaauacuuuuacugcguuacuagauaauuccuggcauuugggauucuuguauugagcuuucuaguucucugauuuagauccuauuuaagugauuuugauuuugauuuuuuauuugugauauauugaugcuuuuugacccaagagaaaauguggagaaguuuuucuguuguauuuugaccaguuuugaauuugacaccagacauguacccuuuaggccuccuccucuaagucauuccaaugguagaauguuggcuccuuugagcacuguuagaaccaguucaaggaauucaacauugagugaagcugaacaaguauuaugacacaccacauugugguccuuuuagaauaacugugcauuugaaaacagauguguuucagauuucaaaguuauucaaguuucaauuauuucuugcaacaaguucucuuaaauuuucuaaacuuuagugucaccaccuauuacauggaaagaaacguuucaugaucuuaacagcuacccuguauaauaccguaugcagcuagcacauguggcuauuuuaagucaaaauucauuaggauaaaaaaaaauugguucaguaugguuguucuggccacauaauguuacuagcuggugucuaaauuuggcuauagaucauuuucaccaucacagaaugcucugcugggcugcgcugauuuaggugagaggagguguauguaaaagagccuagcauagugcguuucucuugacggaugcucccgaaaaggugauuuuuuuucucuguuuuucucaagaucagagcugggguacuucauuuuauggauagguucaggagagggaggaaagcuacccgagguacuuuaagaaggggguaugccuggcccuggaaucuacauggcugauugcugcugccguauccuaauagguuuagccuugugcuuuacugaguaggauugcaagggcaagagcgugaauagugggaauugguuguacagucagagugguaaggaaaaauggccuagagacaguguuuccuguauucaagguagcacaggacucagcuuuuuccauccguuaucuuagcaaauccucccagaagcccagagaaguuaaacagucaccuaaaguugcucaaccaauaaauugcagagcaaggccagacuuguuccugacuuuaaagcccaggcuuuuuccuguuaugcuguguugccccauuaaugugaaugucccccuguaaccuuaacuuauuuauuagugggauaaaaccucaaguagauuccugacuuaucgucaguucucagaaaauaaggaauagucuuuagaauuuacagccgcacuguugucuuuacaugauuucaacuggaaaggaaagauagcuucauuuuguuugguuccgaggcccaaggccagacagaaacuauuuacggucucagccuucacagaaaagucaguggcuccaugaacccuguauuaauuugcaaggcuaccauuagcucauacaaugccuuugugguaaucagaaucauaggccaccuaagggcagacaaauugcagagaucugugcacuccaauggaacagggaaaaaaauuccccuuuucuuaccccugcugacaaccuuacccaggcaguuaguugaaagacauguuggccaggacuuuugcucucuuacuugacuacuuuuguauagcauguaacuuaccugucgguauauaugguuuuuacuuauauuaccuugggaauaccaaaaccuuccuuggucugaaaaggucguggucaguguugaucagacaguguuuuauugucuauccccaguguccucgcaugccuuagagugcuuuacccaaagcuuuauuuguuauccuaucauauguguguacguguguauaauuuucuuuauuuuacuuauagagaugcuucaucuacaugugugucugugcauccuuuaugugccucgugcccccugaggucagaagaggacauaucagaaggaaacuuuggaaguaucaaguagaagcgggacagauggcucagcagguaagaaagcuuguugcucuugcagaagacucggcuucaguuccuaggccccaugugguggcucauaagcaucuguaaguccaguucuagggaacuugacaccuuuuuugugaaccccugugggcaccagauacacaugugguguacauacauauaggcaggcgaaacacucaugcacauacaaauagauaaaucuuuaaaagaaguuuuuuaaaaauugguucugauuaucuuaucugauuucuuaaaaugaugauuauuuaauguauaaguuaaaaacuauuacagcauuucaaggccaaacaaaauggcauuucuauaauaaggaugucuuuuuugucuauuuauacugccuuaauccauaggaauuucauuaaacguguccugcaaauuuugcuggaucugucuagcccauggcaaagcaaaaaaugggaacagucaagggagaagguucguccuuuuaggguauuucuuuucucuucuguaauuuaaauaccgccucauggcucuguuugacaucgaaaaacuuauuucaaaugaccaaacagcugagaauugaaccuagucagcgaugacuuuagauaaccuugagaugccagacuugcacaggaucccuuguuuuucuccuccuuaguuaauaguuuagcuugaaucgugccaaaauucugguuuugucagcaacacacuugacuuagagggaucauguaaagccacccaugguauacauuaacucagaaagauaaagacgauuuucgccagucauugucgaugccuguaguuugaacuuugccucacgugguugcuuugaaucguuuuuuccccagcuaaguuucuuauguugguaauuuccacguauagucuacaauuuccuagaagugauaaaguuacagcuuuggaaacuguaauagcugccauguuugaaagaacaagccaguuguucuugaaaggacauaucuaagcuuuuuaauggaagauacuggguugcuuguacuauuuccuuacuuuaguucugaauguucccuuaauaaaauaguucuuuaaagaagaagugaucaguuaugguuuagacuacaaacauggguuuagaagaccacauauuaaccaagacauggaguaaaauguauauuuuuuaguagauauggaccaugucagauguagggaaugagccagauugaaaacaaaacaaaacaaacaaaacccuuuuuauuagaguuugauaaggucuccucaaaggaucguaucuucaccagaugccauggggagcuuugcuguaaugagcuacuacuguaagcagcauuucacaauuaucaggaaauuaggaccagagagagguugaaaaccacagaaagaaacuucagcuaguuggccaaauuacuagccagaaggcagaacaaaacacaggcaaauggaagcaaggggcaagaaggagcuaagaauguauugaugcuuucugcuuacccuugaugcagaaggcaaagcugguauggaaacaggucagauuguggaaugugugacagggggugucauuaucuauuuuuggaagauguuuuuccuaccuuguugacaguuuuaagaguaggacaaccauuagaaagcaaaggcugugugugugcacaugcacaugugugugaaagugcaagcauuuaaagaccuuacugcucugcuuaaaaagguagauucuacaaacuacacauucaaauagugguuuugaucuacuuucagcaguguguuaccauauggauaagugaaugaggguguuuguacacuagggugagagagcaaauagagcuuaggguauggggacuucggaggacauguuccuuccaggcccugaggaugagauaagaugguuaguaauuaaggacagagaagcgaguaagaacagcuccuaaaagguacaaagcugagauccacccagcugcucccagccuagaguugcggcugggacgucggggagauccaggaggguacagccagcuuucaauagagcuggucugugaaacuuggcugagaggacagaggaaaauugauguuugcucgagagugggacugucagcugugcuuacugccucaucaggcucccagcuguaaacaaaaguccuggcccuucauggcacugcagagcaguccaggcugguguaagucucugaggacagcuagaccauuuucucauccuggcugacaaccaggagacagaagaaacaauagaagguagaaugggggaaggggcagaauugcaaggggaugaggagcagagacuauuggaaaggaguugucuauuucagaucuuaggucuuuggaugaaauuaguagaguucuuuuggggauagcagaccccuuuacuguguacaugucccugaucauaguaaguuaugaaagagguuucagagacuccaguguguuauccacccuuucauuuacaaacauacaugcucaucaccaugcuauguauccuaggugaugcuaaacuaauagaagagaacucacauauucgaagguuuuauaaggaguuuagggauaugugugaaguugagucuuagcaauaccaaauagaauuuuuguuuguuuguuuuugagacagagucucauguagccuaggauagcuuugaacuuauuauguagccaaggauggccuugaauucuugacccucuuauauccaccucuacgugcuaggauuacaggcauguaacacuauucagcaaauaauagaccuucuaaaaugcuaagugacaaauuuggaauagaaguauugaagcacuguuucuggcuaugaucccagaaggugggauuugagagaacauuaguagguuagacaagauuuggcuaugaagaaaauacaucuggaauuucagacaaaacaaaauuauuaguaaaacugagacuuccucuggccaaagcaguaaguucauaugccacauuucucacucucuuauacuuuucauaauggcuauaccaaaauucaagucucccuuuaagugucacuuccucacaguggguccuaccuuauccccaggaccaaguugaguaucuugcuuuauguuccuauagcacccacugcauuugcccuuccaggaugccaccauuuuaacuugaugaacuaaacuuuuuuuucagugcauuuguucucuauauuauaagcuuagaaggguuguuugauuguaucuucucuuccuccuccucuuccuccuccucuuccuccuccucuuccuccuuuuugaaaaacucaaaugucugccccuuccuuuggaagacuguccuacuccugcuuagcucuggaggcagaggcagguggaucucugagaauuuuaggccagccuggacuacauagugagcuccagggcggccagggcuguucagauaaaccaugucaacaaacaaaaacuguuuuacuccuaacaucucauuucuuuggauguuucucuuucgguuccuuucucuucauucagguuacaagucucugcagucaggaaagauuucuaagauaucauccuucccaauuucaccacagcuagauagcccauaauaccugaaguauuuucuccauuuuucuacuuuucucucucuugucauacuauaggagcucugaggaaagguuuuuuuuccuucaccguguugucuauguauuuuuauaguacuuagcaugugauggcaaguacuucaugaacauuugugaauuaauccagaggagaugacacaauauuguuagguaaaagccagucuaaagguugauuggauucuuaugcaugaagagaaaucuuuggaaguuuuucaacuguaagaggaaaaaauuauuuuaaaauugcuguuuuauuuugauaguagaaauucuuauauauguuaggcaagcacuaggcuacaguucuagcuccugaaggaccacugaccuuugaaaagaauaacaugaaugcaaaccuugccuuacucaagauauuugccucccauugucuugugguuccauguucucuaccucacuaucauucccaugaccccucaccuccacaaacugagauuucucuauuaguccuccuaacuagagagauugagcaguauuaccaaacacucauguaacuacaggcacacuugcucauucgggcgccauucuuuugccuaccuucauuuuaccaagcauaguacugauagcuacagaggaagaccuuccgucacacuggucacucagugguugcuuuaaauuccuggugaagggauuugccuuaccuggguucagugacggacacuuuauaauacuagauccugcaaaagaaauucagucucauagguagaccuuuuguguaacuggagacucagagaauugauacuuaugccaguuuacaacaaacuuuucccuuuccauguagauacagaauggcaugguauagcaugucuggaagggcauucgggcaggagcuauuccuuguccuucugaaaauggucuuacuaaggcaaaugauccaacaaguuuucucuuuuuaaaucaagcacaguagaggaacuuacaggaaaauggccuggauuuaacaauaaacuagaaggccucccuuauacucugaauagauccaaagcaagaguauacuuuuaaaauagcuuccaaggacaauuagacauccucauacugggguagguauuaauccuaggcuagggaauuggacuguuuucauaaccaccugucccaggguuaagaugcuagcaaaugaggaugucaaaaggguacuacugcugucaccugaauuuuugaucuuagccauucugucuggugugagguggaaucucaggguuguuuugauuugcauuucccugaugauuaaggauguugaacauuuuuucaggugcuucucagccauuugguacuccucaggugagaauucuuuguuuagcucuauaccccauuuuuuaaugggguuauuugaauuucuggaguccagcuucuugaguucuuuguauauauuggauauuaguucccuaucagauuuaggguugguaaagauccuuucccagucuguugguggccuuuuugucuuauugacagugucuuuugccuuacagaaacuuugcaauuuuaugaggucccauuugucaauucuugaucuuacagcaccagccauugcuguucuguuuaggaauuuuuccccagugcccagaucuucaaggcuuuucccaacuuucuccucuauaaauuucagugucucugguuuuaugugguguucuuugauccacuuagacuugagcuuuguacaaggagauaagaauggaucaauucucauucuucuacaugacaaccgccaguugugccagcaccauuuguugaaaaugcugucuuuuuuccacuggauaguuuuagcucccuugucaaagaucaagugaccauagguguguggguucauuucugggucuucaauucuauuccauuggucuacuugucugucucuauaccaguaccaugcaguuuuuaucacaguugcucuguaguacagcuuuaggucaggcauggugauuccaccagagguucuuuuauccuugagaagacuuuuugcuauccuagguuuuuuguuauuccagaugaauuugcaaauugcccuuucuaauuuguugaagaauugaguuggaauuuugaugaggauugaauugaaucuguagauugcuuuuggcaagauagccauuuuuacuauaguaauccugccaaucagugagcaugggagaucuuucuaucuccugagagcuucuucgauuucuuucuucagagacuugaaguucuugucauacagaucuuucacuuccuuaguuagagucacgccaugguauuuuauauuauuugugacuauugagaaggguguuguuucccgaauuucuuucucauccuguuuauccuuuguguagagaaaagccacugauuuguuaacaguugugacaacugaaguacagaauaguucaauaauuuggucaaugucauguaguuacuguguucuggauuuuucucagccuuugaaugagcuuuuagaggaagaaccugaggcugagagaauuaucauucaaaccuaugcucugugugguacuaaagcaccacacugucuuaaaaccaaagugucaugaauagagcuaguaaaauagaggguaagcuuacauauucucuagauccauucuguaagacaaaauggccccuacguuuaggugauggcaauauuuuccccuuauuucaagaaauuaauagugaggucuguuuuuaaauaacacacuacacaguacagcacaguaggcacuuuuauaaagcuuugcacguguuagcagaggaugaaaacaggccuacucauaugacuuuuuuggguaggcuucauguuaguggacuuugucuugccaugcggagaauucuuuguuuuugugaauuggcuuagaggccauucuuccccuuggcuuaagaccugcuaacaagcuguucugacuaauaagccuucagcccauauuuguagcccauaaauauuauucuagcuggagacugugcuagagcagaaugugagguugggaagaacauucuaauuccuuucccugcagagauggcugucuccucaacagaaccaacauguagaacaugggggaagccgauggcugugcugcugaaauucccacuacuggacucauuugucacugaugguguuuagcuaaguuguugggauucuaauuacaaccugaucccugucuuaauauguaugguauguuauuaauguuuaauaagaacauuacaauucuuuuuuucagugauguaaccuacaaggucauuuuaauuuuguuucuguaguaccugaagaccacauuguguguacauaucuguauggacucuugguuuucuaagauuucuucuggaucucuuuuucuguauucaauaaauuaacagaaagggaaugaacaaaacauauaauacaguaagugggaagauaggcuuuuauucuaauuacacauauuguguauuauuaggugccagagcugugcaggcuaaugaguuguauagaaugcaucucuugccuucaaaaaaaaaauguauucuacauuucucccauugaaccagcgaguagcacccuguuugcugaucccuggcugauuccugaucucgauuguuuauuuaguguuccuuaacagugcggccuaacaagauuaaucccugcauagugaaguacaguuuuugagauuuuaguaggcagaaguaaugagauaagacuaauaaugccaacacugauacagacacucaagaguggugggagaacacauuacaaaaucuaaaagaaguaacacauucuggguaccaucgaggcauuuagauugcucagcaaaacgagagccuaacuuucaaucagccuaauaguuuaaacagaagaguguucuuuuaugauaggugagaaaaugcuuuuggaaauguugaaggaauaaauuuauucaguguauuucuuccacuuagagagcugcuuuggcuuggccugugaauuugcagagagcaaaaggaccuguuguagauuaaagaaaaaaaggaggcaaaaccccuggcauuccacaaggcagaacaaacuguuaggaagauagauacaccaauagccuuaacaacggaguaaauaaagccuuuccucuugaaaaauacauucaugaaauauuuaucuaauuaaauauuaacaaagaauuaaugaaaauaccugaaacacuuugucuucauaggaccccgacacaccccuuaaaaugucuaaaucuuagaaucauaucagauugauuuaggcagaaaauaguucaggucucuggauggguaaguacucuagacaagacucuuauauuaccuuuucucaauucauugauaagaaggacccaaguuuaacaauuuugugauugaacagauugcuaaaugucaaaccccuucagugagaccuagcacuucccuagucucuguacguaugugggaagaaugacgaaaaugaaagccauuugcucuggaucuaagguuggcauuauguaaauacuucucugcuuaagggcuccagugagaauaguaccuuccaccuggcauuagcucugaguggcuuugugaauuccuuuggucuauuauguugguugguacuuuggcuucuuuggcacccagcaccagcugaugcccugaucugaggcccaguuggacaggguuuauugcucaguacuguagcugucuccagggcauuguucuugagacuuccaacagggcagauuugugcaguuagcccaucuggacaagaucuguaacaaguaaagcucugugcaauaagcucaucuccauaguccacccccaccauccccgccuccgggcugcagcagccugacaccccagcuccaucagggacaguaucaaagagauacucucugcuccuuucaaagggguuuugcuuguggcuucucaucgauuggcacuaccugggcagaaauaggaacauaggggcucucuucccuuuucaauguaaucuccuccuauaaaccaguuuuuaacauuugauuauuuguaugagagugcucaaauggccaauaaaaguauuuucuagaucugaauaugguagugcauacuuuaauccuaauacuugguaugguuagacaggaggauuauaaguccaaggcuagccugggcugcaaguaaguuguaggcuaacuuuggauauauaucaauaccuuuucucaaaaaaaaaaaaaucuaggccaaaguacuuucuucaaaaucaagggaaacaaaaggauaucucaaugaaugcgaaaggucagacaaauucaguauguaaauagagaaagaaggcuggucuucuccuugcacuauaacaucggacuuguugacuuugaguuuagaauucuaugugaagcgaugaaguuaugagggagagaugaaauugagacggagaugggaaaagagaaggaggagagcucugauuacauacuuaguuguuuuucuggguccagagaaaaggacuuuaauauuuuaagauacuauuuguuuguguauuccaauugcaguccucaugcuuuaaucuuucucaucuuauuuuugugcucuucauggucagaucacuucaaagaacucaauguaccaggcccuugugucuccaugagacacagcaacccacucuauucugaccuuuccuguggcuuuacugaacaauccuauggaagaagaaagggaagcacaaaaggguaaagaaacaacccaaauuauggcucucugcccucuacgacuauuacccaagauagauagaaccaauguuuguuucccuagaagccuagguagggacccuauccaugccuacuuccuccuuaguaacuucaaagccuacucuauuucagaacaagguuguauggcacuguuauuuucuugccaauaggagguaaaggagaaagaagguucugcaaaauaaagagaguggagaaaaaggagaaacaagagagcaguagucugucuaaauaguguuucuguacuccacuucuuagauuuuaguaucuuuuauaucaccuuuccuaaucauuaaauaaaauucuuaaagaauaagccccucccccuaccuuuuuccuacccagcagcauaauaaaacuuguggcuaugcuauuugauuagggacuauaacaaauaugucuggaaccaagaagcuuacauagaucuggaaggguacagaguccuggguucuugccccaguucugaaaauguuaucuuuucuaggagaagugaaccuacuucuguugggccauauaacauuuuccuagcccaaugcagccuaugacuacauuguuguuaagagguucaaaaccugugucuuugucuuccuaucgguaaggauaucugaguaggucauucagggcagaauuuguggacugaaaggacaguggaagggagagcagugccaaguaaaagccaggcucugaauacaaguagaaaagaugcagauaguaaaaccaagaaucccacagucuagauauucuucacagaggagccccagcaaugacagaaagucauuuuggcauuagccacguagacaaacaaagggaaauggcagaguaagcagucaaucuggaugaggguauauaagccauguuuguaaguacagcuacuauuggcacuaggcaguccccacauagcuugggaacugguaauugaaguuaugaguaugagaucagaaggaacuguucaaguuccugagagagucugauggaagggaaaagcccaccugggugaaagcaggaagccagcaacuguacacuauagccuccacccuguucacagugccugguggauaucuucugaccuuaguacuuuauagacaacccaauagaagauauugaagacaagaaaaguaaaagggaagacagcccuggagauggugucaauucucuuggcucgguccacauagaguuuccucaugguuucuccuuccuuuagaagagggguuggagguuggggacuauaaaugcuggaaccuuccauuggaccuccaucccuugcuuguaagcaguguccuaggccauagccacgaaaauagaagcggcucucucuuaugaugucuucuuccuauaauuacaagagauaaaaggugguauguauauguguguauauauauguguauauauauguuauauauaauauuuauguauauuaagcuauaugcuaugguuucauuuacagccaugcauugaguucccuuugaauauguguaacaacauuuggagucaucuaaaaccuacugaagugccaacaucucaacgucaaauucugugacagguaaacagaacaauaaaaccaccagauaguaaggcugagauauuuugacuugauaaauugauuuuaauuaauuuuaaaagcuuuagaaauaguuuguuuguagauaguacauuuuaaagcuaauuuugaaugaaagcauggcggaggcacauuuuaaauacgcaguaagcaacaugaccauuacuacaauaguuggcugacaacagcugggaagcaggaagcaaggacaggaagauagaaaucaaagaaauugaagggagcaggaggaggaagugggaagaaccauccacaagagcuuuacuucuggaagaagcccucagucccucuaccccacaacuuacuuacucuauuuucucauuuuagagcagauuugagaaauauauccuucaaauagaagaugauuauguauauuaaaaguguugaaugcucugcaguaaaagcuucagcuaagagauugccugaaaugaaguauccuuuugucugauuucaucuaccaacucaagugugcccagcacugaggagguucccgagucucucauccccaacacuggagaaguccaagguaaaacaagaagaguaagccacccuagcuaccugacguaguucuuuaacuuauaagaacaaggaauauauauguauaugcagaaugagcacaaagguguuaaacauuuuguacaauuuaaaggacacugugggauguauauaacaaggccucugcagcuacagaaaucaaugaaaaaguaguugaugagguacugguaugguugguaauaguaacgucuuaauuaugauaucacccaaaacugaccuguuaugaggacaagccugagcaucaguggcagacaaacucaggccacaaacccuuucucugcugucuguuaguucauauauagacagauucauuccuauauuuccaguggcaggaaccaugcuuggacccuaauugauacucagaagcugucuguugaauagacaacugggcugauaagccacaugcuucaggauaugaggaauggaguggcuuuuuguucuuggaugccaauaucuugucagggucccaaacuaaagaguguacucagaaaaguaucuuguucaguuaugaaauacuugacaggaaaaaacaauuauuauuugccccacuauacagugguucaauagccuuuugcuucuguaaauggaggaacacuuuuuaaaaauauucauuauuuuuauuugagguguaugggcaguuggccuucauguauaucugugcaucauguguguguacugguggggcccuggaacugaaguuauagauuguuguuagcagccaugugcaugcuggggauugaacacagguccucuggaauaacagcuagccagugcucuuauccccuaagccaucucugcagccugugaggaacacuuugaacacaggaaaaaauuaacgucuacccaccagaaagcuuuacuguccuguucuugaaguaucggggucuucguagagaauuagauguguauauaucagaggcaguucacuauccuggcuuguuaaucuugaaaaguuacaguuuggcagccugaaggcucugcucauuuaucauuuuggccuuuuuuuagucagagaucuuuauuaaucgcacauguauuguauaauuaauauucacacucuugcuacaggggagauuugcugggaccauugguaugcagaauaucuccuaaggacuuagaacuaugauagggguaaguaaaguaaacaaauacuugcuagcauugcaguauagcuguaccgcacuguagugcacuauucaccucggcacccagcuacaagacacagcuacagaggcuagguacugagaaaacauuccgagcgaggaacuuagauccaacuguaauugcuguuuuuauaaaucccauuauuuccccuuuuauccagugaaucuaaggaaauuguguggaaauauuucucaggcuagaagaaaguaauuuuauacagaagagaaaauauaucuaauaaaguaagcuauucuugguucuuuuuaguuuuaauauguaucuuuuuggcuugcacagcaaagauuagugcccuaaaagaggccuaaauuuggauauuagauacuuaagacaaacucugaaugacgagggagugucauuggcuuggggaggaacaacaugccauugaauaucccuuugcucuuucuauggcuauugaaaagaguugaauuuguuucuacuuaccuaggagccaagugcuggaaggcuagagaaggaagcugggagauaaugcccaguguaaaagguggacuaugaagacggaauagaguaauaaauauggaagugagacacucagggagaaaagauucuggacauggggcagaacgcucaauggaagacagagaggugagcaggguucugaaaguaaggcccugagaggauuugcugguauuuuguaaauuuucuaguucuuaaguuacuguauugauaauagcaaggauucuugucuaugcaguuugacagccuuugccuuugacuggugugcucagagccaggggcuaggcuaacccugcaggggugcugagaguaaggcuuucaccucuuccucuaaacuccuuagaccagcugcgaaggcaaagggcauguaaaaccaucgccauuuccugcacugccacaggagaagagcaagcaccaugcacgggagacaagugguggaggaggugguacuaggagcaagaugaguagcacuguaguaacuguaguaauauuuguuacugggacagcgacacaaguguuuuagguaggaaaggggcucuggaguauuugaaaaccuguucuuuccuaggagugcaaaguuaaaaaacauuaaaaaucaaacuaugaaucgaagaguuugguaccuggagaaaaguuucauacaacuaaagaagaggcagagaugauuauuuuaggaaagggagcauccugauuuuuucauccccuaauuauguacauguuuuccuaccccuucgaugagguaggaaaaucuuauaggcagcucucuggaagaaugagucuuauucaaagauauguaguugaagaucaguccacuagagggcucacucuuugggaacuaugaaagaacuaaagagaggaaaacuagaagaagaaucuguaugagauaggagccccgucuuccccagaaaggaaccauaucaagaaaugugaagucauauagauuguaugaucauuggaagucauaauaguggugugccaggagcaacugaggugggaguugagaguuaggaggaacaaagcauccuuguauuacuaugucucaggcuaaaguccgaguguguguguguguguguguguguguguguguguacacgcgugugugagcacucgugcacauauuugcguguguguguuacuguggaucaaacgcaagauuuauacauacgcuuggcaagcacucugccacugagcuagaccugcugcccccuagagucaagauuuuaacagugcguucagguaauuuguuuucucugcuccaagaaguaauuuugugcugugcauuuuggguuugaagccucuggauuagacagaaaacauggaaucaaagcucgagacacugucucugaagauuaagcaaccaguaccaaggcuuucagcuuugcucauaauuggagcuugcuugucucaggguagccuaagcaccucuguugucaugacaacuuaccuagugccuauugucugggcaauugagggaaaacugcuucuguugucaugacaacaacuuccucuucuaucuccccuuggugaucacucuguucuggaagaaauggggcuaacaaacaagagugaggaagaccaccaccucaagccuaccaacucugaagugccugaugcucaagauacauuccaccaaucagaagaggcaaguaguggucuuucaauuucaguucaaacauggggaccaucuuacagugcuccauuugaaaggcacuggugucugacucuuaguucuuaauagaggacgacuuaaaguaccuuccuucuguaugcgaggaaaaccaaaaacacuaucauuaauucucaaagcaauaacaucaauguuaagccaauauaugguucuaauaguggcaaauauauuuuuguuugcuuguuuugagacagggucucuauguaguccuggcuauccuagaacuugauauauagaccaggcuggccuuaaacuuacaaaaccuuuagucucuaccucccaaaugcugagauuaugggcaugugcuaccaugccuagccugggcuaauauauuuuaagcguuuauugcaugcauacucuuaauuucucuacugccuuauaaggguuaaugucucauugaauagauaaaggaaacaguaccagaaaaacuaaguauuuaauuuaacugucaacagccugggacuagaauucccaggauucccaauugccuaguccuagaguccuggguuggguuuauaggaggaguaauaggaaggaaagacugcaaaggagaaggaaagugggcuccaccccuucgguacucaccauacgcugacgucucugccuucuacgaagucucauaaauuccuuaugcugacgagagacaaaauugacugcagcauacucaagcaaggcagcaaauacaaagagcaggcauacagccauccagaugucaauugccuuuacguaggacaccugcaacauccaugaacagagaaguuauccuuucuggaguccuuccauggacuguccaguggauuucuaauccauaucaauugccugcuauuguucaguuuuauccugaaauuucugugguuuuaaaaaauucuguccuguuacauaucuuuaucugaaggcuacccaucauccuucaucuuccugcagucuucacccuccacuuucaugagccuguccccuuacucuuuauuucccuucuuuguuauucuugcaugcccguuuugccuucucucucuuccucuuuuauuucuuuugauucuucucuuuuaguaaauaaaaaugaucaaaucacauuugcuugcccucugggaugcccuggguuucucuuagccaugggagguguguggagucaguuacgacucagagagaagggguuucagcagaggucacuuaguuaaaaggugauacuaggacuggaaaaauuuggagcuuugaagucacuggccuugacauuugcuuugguucuagccucacuggcagacuagaaucucccccguuccuguucggcuguugaccccgugggguuuucugcugcuuuugcaagaguuacugcugaggaguaggguacaguggugagcuaaagcuucaucucucaccuuggagagaacagggcaggauccugagggagugcuaccuagcccuucucaugacacuucaguaauugcagggcucucugggcacccacucaucugcuuccugccauguuccucuuguuaccugccuuugggagcuuugaagagcuuuuuuucucccacuugccugguaaagguugaacacacacaaaccuccucaggaaaaaggcucagcuggaugggucuaagaggagggacagaacuucaauuuauugagaaccuuucaguuccuuaaccggagggauuuccuguggaguuugagcucacuccauauagcuucauaucaaggguaggauuugugaaagugacuccuuuuuaccagcuucuguguuauagagcacugagauugcugcagacuccagcuauagcaaaggucgcaugggauacauucucuacuuacuggcugucucugugagaguagagauugauaguggagauggcauccaggacuuccuguguuacaggcauagugcuuuaccaauaagcuauauccccaaccuccuaucuuauugguuuuuaaaagaaaguguucuacacacaugagcauuuagcaguguuuauaggaaauuuuggcaacacaauuuuagaguggucauagcuacuggcaucuaauggguaaaagacaagggugcuauaaagcauuauaaagcacauaccauuccucccuccaaacacacacacacauuuguucuaacugacaugugaaaguuggcaaacccugcuuuacuucugggcagcuccacugaaagaguaggaauggguuacucagauuaggaauuccuuggugcagucuccgauucaauaccaaugaagaagguaucccauuuaacugucuaucucccagacccacuggccucucaaggacgucagauaccugcuaugaagaucaguaaugaggcaaugauaagggauagucaugacgggcuuuaggcuauuaaugaaaagggcaccuuauguauuuguggcuuguuaaugauaaaugugucacuaauaagguuuuuuaaaagaucacugugaucauaucacaaccccucccacuacagcucuuuagagguucucuauuaaccuuguguucuagaugugucgcacuugccauggucuuugaccucucacugccucuucggccucagcgugccccuugucaucuaugaucuugcuguaguaaaauguuucaguguuuuuaaagaagucugucucuuccucuuuucucugugaucugacuaacuugcuguuuagcuuccaucuuagauagcauauguuugagaugccuuuccugaucguccuaauguguguuuuacuguaugugcuuggcuugcccauaacuuuuuagcauccaccacacaccuggccaguuccuccacuagacugagcuuuuccaugccaagaacuauuuuuauguuguucuguccccaauacuugagugcuuggcacacaauaaguguuuuguuuuguuuuuugaaugagcagauagaagguuuagcaauguguuugucucugcuggcuccuacuugcugucucugcccuucuuuccuuucuuugccucacgagcuaagggcaaaauauagagaauuggagccuuccucccuggugcagcuuuauaucuugucauccauuuagcuuuuccugucgcugagccucuugcagcuauggagaucaagagccuggcaaagagacagaaaucagugccuuuagggugcuacacaagguaaugaaggaaugcuuccuguagacuauagcgaaagacugccccaccugaguucccuuacaaagaaaucccuuauacucucuuccuacacaauagagguguguuuuggaugggaguaguguugcuaucagaugccucuggccuggccucaucaaacaugauguugcccaaacugaaggaugagcaagaucugcuuggcuugcugguuccuuugcuccauggcucuaccuaccaagacuguucauuucaggguacauggccugacuauuuugcuuacagaccaaugaggcuauuaaaaagucaugaaaauaugacaagaagguccuaaauguugcaaacaaccucuugacaaagucuguuuuuccaaaugaggaaacugugugaaaacuacaagcagauggacuggacucacuuacaggagaggaugagaaaggaaaucucuuggcaagaggcauaaauggcauuaucuucuuggguuaugaagaaucuucuuacuugacagagacaaaaacuugggguaaggcucuuaaugcagugauccaauaaaaagcuauuauaguaaugcaaguaucauagcccaggcuggcucuaugacucuccucuaaggacagucugccucuaagagccucauuaacaccccagugaauuuagaaaacauacaggaagggaucccugacuacuacuucuugggugcuugauguuaaucugaacuugaccacuguuuauuucuauagggggguuggaauaacuuacagguuuccuagcaaaugaaaaauuacuaggggaaauaucuacuagacuccuagauccaauacucacucuuuuuuaacucugacaccugauaauuguaaaaauaauuaacauuuauuaaguaauuauuaugugccaaacacuguccuugcaugucaauacauuaauuuauuuuucacaguaaccucguggaaagggguagcauucuuagucucauacuacaggcaaagcaacugagagacaauuuaaccaaggucauacuauuaggaaaugaggcuaggauuuaaaccuaagucugccugaccuacgcuacacuuaaucuccccuauagcaauuucauaaaccaucaauauccacauuauacacugcuugaguguccagugaagaagucuuauauggaacaaggaaugagagguuguuaucugagggccagguucccaacaaaucagaauaagagggaauauaagaggcaagauucauuaugcuuucaugaccaaguacaguauauaguaugugcucaauaaauauucguugaaugaaaaaaauggccucacucccugauuugcucagagccuugcugaccauaaggacuuugaggugaccuuuaaauucccuacaugaauacacaaugcagggagaacuguucuuagucccaucagcacaaauuuuucugcauagucaaaacauaaacaggccccagaugaucagagucuacugucuuuaauugcuauuauauuugcaaccucaaaauauucuccuuccccccaaauaaauacuauauuuagagcacuuuguaauagcaccuuauuuguuauagaaagaggacagaauuuaguucaaaccucuacugucucuuugguucuuucugaucaucauucaccuugagaaggucacuuaaccugcaaucugcauuuuuaccuguacuaugaaauaauaggacuaucuaugauaaugcucuuuugcaugcuuguguuucccaaagaaaacuaaguaaggcagaauuucuagucgaucuguagcauucauguuguuaugcuguuuuagagaagaggaaauguugaguggcagcuauugccauuugcaguuaaaaaccaaaugcaaugaauagaggagcauagcagagcaugcaaugagugggaaauagggggcuugaugucaggcagguucuuuuugcauaucucuucaccuuaggcaaagaggcccuggauccagagcucugaguugucauggugaggacuguggugaugccaaggccuacacgagcaggggccgcauccauguugauccagaaggagacccaggacaggaugacgaugaguaggcuggggauguacauuugaaucagauaguagcccaucugccgcuccaggugaaacuuuaccucaaugcaagugaauuuuccugagaaaagaaaugaaguauuuggcucugagucuccauacugcagcuuagccugagggaguauaggucaggaauagggcagcccugcugaaccaaccucugggaugcucagaggaugccccagauagugccagauuucaaacugugaaagcucucaacucagcccuaaagauugccuacuugcucccagaauuuuuacuuccagaauaagauuuuucauguaacaauuacaaaaagaggacaaagaguaagaaggccccagaaucaaauucucugagguugaaucucaaguuuccacuuaauagcuaugugaucuuaacuaagucauccaaagcuuguuuguuuguuucuuaugccuuuuguuuuugagacaaggucuuuuuaugugguccagggugauaucaaauuuggaauucucuucugagccaccacaccaaguuccacucaaguuuuuugcacuagauacuagcuuagaaacagacugauuaacuauagcaacuccaucauugagcuguuagaaaaguuaaaugaagugcaguaguucaggugcucagcacauaacuauuccaguuguuaaagcguuguuaagaagggauuaguuuggacuucauuuauauuauaccauucuuccuugcacuugcucauaucccagaaucccagcuagaauaaacucugugucuuaagcaagugagaacaaccaucuagcauacaacuggaaaagauucgcaacagagaucaucagcucuggacccuggaaagcaggcucccauagaccagugguucucaacuugugggucgagaccacuuuggagguguaaugacucuucugcaagaaucaccuaagaccaucagaaaacacaaauauuuacauuauaauucauagcaguagcaaaauuacagauaugaaguagcaaugaaaauaauguuuugguugggggucaccacaccucgaggaacuguauuuuuagguucacagaaguaggaagguugagagccacugucacacaguaucaggaaucacuauuguauucugccauaaaacaaugcaucgguucuaggcacacaucucagugcucuucuuuuccccaaaccaccccccuuuacuuuauccugauugccauggcucggaagccaagaaaacaguaauuuacagcuucuuuuaaaaccagaggcguuugauaacacaagaggaaaaggagacaauuuguauagcuaucucuaaguauccacugggagauggcuuucaagauuccccuuacaaauaccaaaaucuguggaugcucaaaucucuuauacaaaguggcaucauauuuguauuuaaaauaugcauacccuuccauauacuuuaaauuaggucuauaucauucauuuaaacuguuuauuuguuuguuuaguguguuuguacauauguacguuagaggacaacuucaguaguuaguucuugacuuccacaaugugggucucaggaacugaacucaauucauuuacccacugucuuagucaggguuucuauuccugcacaaacaucaugaccaagaagcaaguuggggaggaaaggguuuauucggcuuacauuuccauacugcuguugaucaccaaaggaugcaggacuggaacucaagcaggucagaaagcaggagcugaugcagaggccauggagggauguucuuuacuggcuugcuuagccugcuuucuuauagaacccaagacaaccagcccagagauggucccacccacaaggggccuugcccccuugaucacuaauugagaaaaugccuuacaguuggaucucauggaggcauuuccucaacugaagcuccuuucucugugauaacuccagcugugucaaguugacacaaaacuagccaauacaacugaccccuugucaacuugacacacaaacacaucacuaguaagccucaacccuuacauucuuauucauccccaaggucuaaauaacuuuaaaugucccacagucuuuacauauucuuaaaauuucaaucucuuuaaaauaucucuuuuaaaaauccaaagucuuuuuaaauuaaaagucucuuaacugugggcaucacuaaaacaguuucuuccuucaagagggaaaauaucagggcacagucacaaucaaaagcaaaaaucaaucuccaaccguccaaugucugggauccaacucacgaucuucugggcuccuccaagggcuugggucacuucuccagccaugcccuuuguagcacacgcgucauccucuaggcuccagaugccucuacuccacugcugcugcugcucuugguggucaucucaugguacuggcaucuccaaaacacugcaugaccccuucaguccugggccaucaauugcaacugaggcugcacuuucaccaauggccuuccauggccucucacagugccaagccucagcugcucugcucaauuccuucaugccuucaaaaccaguaccaccugggugacccuuacacguuaccaaguccagccagagcacaagguacaacuuuggcuauaucuggaacgcagcaacugugcucucagaaaacacuucccagaagaugucaccucaaugaugcuggucucuucuuaaucaccgcuaauuucuuagcuccagcuaaccagcaucaauagucccaguaaugcaaaguuuuugcuuuaguaguucugguaucuuguuaaucacagcugauucuucagccccagcuaaccagaacuacagaaucuucacaaucaaaacagcaauggcccugaaaagagucuuuaauuuucccucugaaauuucacaaaccagaccuccaucuucugcaguguucucaacguugucuuccaagcuccuacacaacauccgacagagcucuuaacaacggauggaucuucaagcccaaaguuccaaaguccuuccacaguccuccccaaaacauggucagguugucacaggaauaccccacucugcugguaccaauuugucuuagucaggguuucuauuccugcacaaacaucaugaccaagaagcaaguuggggaggaaaggguuuauucggcuuacauuuccauacugcuguugaucaccaaaggaugcaggacuggaacucaagcaggucagaaagcaggagcugaugcagaggccauggagggauguucuuuacuggcuugcuuagccugcuuucuuauagaacccaagacaaccagcccagagauggucccacccacaaggggccuugcccccuugaucacuaauugagaaaaugccuuacaguuggaucucauggaggcauuuccucaacugaagcuccuuucucugugauaacuccagcugugucaaguugacacaaaacuagccaauacacccacuaagccaucuugucagcucuaugauauaacauaauaaugauauggaaaaagucuguacauauucacacagaugaaauuuaugaugaacacauaucuuugcuuuguucuuuuuuuauuagaaauuuuuuauuugcauuuuagauguuauccccuuuccuaguuuccccucugaaaauccccuauccacuucccccuuucccuacuuaccagccccacccacucccacuuccuggccuuggcauuccccuauauuggggcauagaaccuucacaggaccaaggaccucuccucccauugaugagcgacuaggccaucuuuugcuacauaugcagcuggagccaugaguccuaccauguguuuucuuugauuggugguuuagucccagggagcucuggggguacugguuaguucauauuguuguuccuccuauggggcugcaaaccccuucaacuccuuggguacuuucucuagcuccuucauuggggacccugugcucaguccaauggauggcugugagcauccacuucuguauuugucaggcacuggcagagucucucaggagacagcuauaucaggcuccuguuaccauaauauagucauacucuguacauaacacugaaucuuauccuuuuuuucuauuuguacuuucccaugaagcuauaagaacuguaaaaauaucauguucaugacuguauauuauuuuaccaaguagauacacugccuuaacuuacuucuaccaugugggugaauuuuuagaacaauuccaaguuuuguuugcaauaauaggagaaauguaacuagagccaaugaauauuuuguaauauuuucuuaaaauauauucuaaggaguggaaguccuguauaaauaagcaggaaaaaaauagcuuccuaaguacuguuuuucacaauacaguguuuccugaacuaccuacacacaccauaagccucaugauacuuguuagccaugcaaauuucuaggcauuuccucuaguauauauaaucaggauccccgagaguuacagccuaggaaucaauauuuuuaaaagacucccuaggggaaugaauauauugaguaaaaaaagcuuggaaacaauucaucuacauucaaauugccauccccccucccaagucucuaccaauuucuacucccagcugcaguuucuaaguucaaggaacuguuccccccacucccacacaacuaaguugcuaaagaaaaugaagacccagcaacucuugggaaagcugaaguagugagcuguccaguuuggaaaaagaguuccucuccacuucccuugcucuacaugcagaauaagaauguguucugauguucaggagagcuaaacaguggagauaacugugggaagcaugcauacucagcuaccuuuucccucaggccuguuucuucuauuugagcauaacuauugacaacuccuaaauguagauuuccugacuuucacacagaauugacccuaggaaaaauaagacauuuuggcuguucauugucacagagcccuuuaauuugcaguauaugagagacauacaaacauggauuguaauucugaaucuauuagcugugugacaacuaauucaaacucucaccucucccuguuaacuuucuuuuuaagauuuauuuuacaguuauguguuuuuucguguuucugagaguaugagcaugucucagugcauguguugaggucaggggacagcuuguaggagucaguuaucuccuuucaucaaguguguucuggggauuaaauacagguugucaguuuuaccuacugagcuaucccuauagacuuucuguguucuuucuuugaaaaugguguugauagcauccuccacgauggaauaagguuuaggaaacauagcucagcuguugagacucuaguagaacaugguugccuuauccuguugucucugaacuugagaccuucuagugccucacagauaauaaagacuugccugauucuuaccuguauuguagugcuugguacaauacccuagauccuucucaucccgcaaaauaaauugggguagagucaaccccucagccacuuggacagcaggagcaucuucuagccacucaaacaugaggucauucaugguguagccaacugcaagugacagagacaucaaaagaguuuccgaguguguguuuggggugaagauagagguggaguuaagguuagcaaggguauggaguugagugacaagauuugggguuuagaaaugacauacucagcuuggaaaaggaaaugauucugaagagggaauuuccucaguugucucaugggccuguacuaaaugagcaacucagaaagauccagacuccucuacuaacguggaucucaagcuugggaaaugcuuagagagaaauuacucuggcaaucuuggaauguaggccaagaagguuggaaagaugucaaggaccccagcugggaaccuccugccacaucuuaagcccagaggaguaagcauguguacuaaccacauguccuaagcugagccucagagccagggcuucugccacuuuuccucagggaagagagaacuauuucuguccuuccagucaugcaugggagaaugugcauaccacagacuccuagccagggacuugaauuggaaaaaaauugagaguugauagcugaacaugccaaguugcucacagauugcuugcaguucaugaaggcuugugucccagacaugaccguauucucauguguaagaggagacugauguuuacagaauguaguauaaauccuacuguaguugugugacuugaggugagucaucuacucuucuguaaagugaggcuaguagagccugucccaacuaaguuuguaaaguuguugugagggauaaugggauccugcuugugaauaugguguaugaauucuagagggcagacaaaagagcacuuuguuugcaccucuguucccauguaguagaaacaaugcuacaaguuuucuucucugaggaauaucucccguccugaucuuacaguuuuaccucuugagccaggugauaggugaagaguaaauggugacccauccuugccauccuuuggugucucugcacauuuggcagcccauaaagguugacacauuucccagaaaggagacuggcugaguucaccucucuaggcauuuuccuauaccugaagcuguccucugauucuuugcaaucauuaucugcauucauagagaauuaguuccaugaauacuuuuauauaugaacaucuucaaugucuuaauucugagaaaguaaaggugaagcuacuguagggauuucaggaauaaauuugggcacaggaggcacccuucagauaguuucccauggccagaagcacauuuguauacauggcugggagguauuuuguucuucagcccuauggaauggucagcccagcaaguaaugugggaacacaaaacccacacugggcugggugucaaggagccuuggcuucuauucuuauccacaacaagaacugauuguguguacuugggaaaaugucuaaaauaucauuaacuagcuguuacuccaggccuugccuugugauucauuagaaacacuuacagcuuuccagcugcauuguacaggucuguauguccauugggaaguucuugagguccauugggcaggacaaaaugagggucaaucuggugggaacaguaaaaaaguaauggcaucaguuugcuguguuccagcacuguacagcauggaccgucuucccacccuucuaccuccaucuggcuucuuccucuugauacagaaucuccuuguuauacacuaggugcaccugaugcuguagagaacauuuccauucuugaagaugcgcaguaacuuguugucuguggucaccucauggaaguuggccccuuucucauuggcaaagaagaggucugguuuccagauagagucgagcauggaugggucuaggucgagagagucaucuggauauucucgguaggccagacgugggucauuccacugcugccgcaagaagacauuuacccgguaguccuagaaggguagagaggagggccuaucagauucagugcuuuucccagggguccaauaaagcuaacaugagcagaaaggcaaugagcaggaaaugauggagaugcaucuugagagccaauaggcauuuuccaguggagaaaguccaguuugcgaaaauauggcaaagaugggaagucauaagauauuuauuuauaucuuaccuacuaugugccagacucacugauaagagcuuauuguuuacuuuugguaggccaggagguugaacccagguucuugagcaugcugggcaaauucucuaucucuaccacauccucagcucugagugcuuuccucguacacaccauuuuauuuaaacccugcaccaaucuuguauggagaaugguuucauguucuacccuuuccuuaugaauaacaacguccugggaagauugguguccaccugcuuaauacagauaguaggugcuagaggugcaauuugaacucaggucuuucuaauucaaaagccugugcccugccucagguuucuucacguauuugaugaacauuuuuuaggcuaguuugcauuuagcuaggaaaacucuggacuaagaauagccucucagucaucaacucaaaugucccauggcuaaagcuaugaucacaaagcaagaaaagggcagcagaagggaaauucuugcaaugugguagcacacuggaauaggaagaccccuuaccaugguggucucagugacggagccaaaacuguugaugaagauguugcaggucacauucacagguggaccuaaggguagcaaagcauagcccguuggcagggccuuccagaaaucucaguguagguuccucaagucccucucugagcuucagaucaggccacuguggagcaaagacugauagcuacacagacccacaggcaauggggguagaggcuuguuuugagcucugagaucuaaccuuagacuuccagccucuuuccuuaagggcaucgagcaaguacugccuaaggaaugugccacccgaaacaguaagcauggaggggaugaaguacguggaccucucuuaccuuugaaauugggccuaauccuagcaucauauccagauguucgucccauaagcuuguccaagaaaucagagggggacauaggcugggauccuuugaguccagauuugacauccucuuuugccaaagccacacuggaugggagaagaaaagaaguuugaggaugguugcacagcuugugcuuuccugcccucaucccccuuggguggauuugcccagcacacaggaagauaagcgagaaugauucucugguguaguaaaugagaagagccaagcaguuacgagcuuacauggcugucuaacaauaguucugggaaguggcuuucacauaggcuaagucuuuuuacucuuaauucucacuacaugauauuaaggcuguugucuccauuuuccaggcaagaaaaugggcuuaagaguuauagaaacagaggaagaguggauggggggggggugagaaggaaggccagggaggaauggagggagggaaacugcaaucaggauguaaaguaaguaaguuaguuuacuaauuaauuauuuuaaagguaguuacuugcccaaagucucagaacuucugaguaacgcagucaggaaucagucacuggacuaaagaccuacuuaguguucuauucccgaagacacuuugaaagcauucaaagaagaaugccaucucacccaguguguuaauguggccuagccaaggauaggaggaguuuuagaagaagcaguuucucugagaccugauaucaguugcuugggcuuccuguaagauuuccaggaguuaggacccagcuucuuugggaguaggucucauuucugccugccugccugccugccuuuuucuacccccucucucccucccucuucucucucucucucucucucucucucucucucucucucucucucucucucccucccucccucccucccucccucccucccucccuuucuuucuuucuuucuuucuuucucucuuucuuucuuucuuucuuucuuggcauagcaagaagguauguuuaaguguagugucauggccauuacaggcaggugaauucaacuaugguaauaaccagggauaaauagccaugggagaauuucccaauagagugaucauacugaaguaaacucccaucuuucucuaccuaagaucucgauuugggggagaugugaguauguuuuggccuggcaucgaauauagccucuuuucuuuugccagucuuccuccuaagaacugagcagaugaaucagugcugcacaagcaugaggaacaguguucagauccucagcacccagauaaaacucugguagacaugguaacaacacacauguaaucccaccucuggggagccuagcuuucuuguaacagacucgaaacuggauagauauagguucagcaaaugacccuaccucaauauguaagauaaagaauggucaaagaagacacuugauaucaaccguaggccuuuacacauauaugcauacaugcaugucacuguacacccacauguauuugugccuacacauauauaaacauguaugcauacauacacuuaaauuuccccaguaauucuguguucuagucagugacugguggaaucauuaaagaagcagagguaccgcauuaaauguuucacaggcuuuaucuagguuaguucucaugucagucgucccugauuaucucuguuaaaauugguucuuuguauccaggagacacuguuccuaggaccccucuauggauaauauauaaagugguauagucuuugcauauaaccuuuguacaucuuccuguauacuaguaaaucaucucuggguucuaauaccuaaugcacuuuaaauguuauacaaguagcuguuuagggaauaaagacaaggagaauccaaauauggccagcacaagugcuaauaaguauuuuauuuugagucugugauguuugaauuugaagauguggacaacugauggguaggaagaccuaacuguacauagacuaugagacuggggaucuguaagguguaggugaaaugacuucucuaagggccuauagcuagugguaaagccagaauucagaaccagagccaauaacuucaagacuuaauguaucuaucccaguacuugucacaagacaagcagcccaggauguucuauuaaagaaccagagugaggaaaggccaagaccugucacacugacuucuuagaguuagaucuuggauucugaaagcaggaggaaucccuugcccuggggacagaggccacccugcccacuggcaggagaagccagagcagguggcuuaaguauauacuauggaaauccaaggaggucgguggggaaggcagacgucuguagcuucaccacaggauauccacaccagccaggugcuucugcugcugcugcugcugcugcugcugcugcuguuggccaucugccaccugccugcugggaggccacauggcccugcauacagagcaagcagaccucuacuguccucagccucacucaggucaccucuucucuggucccuguccuaggacucuaagauaggcugggaaucuucugucuucagucccgaagccuguuuugguuaccagaaucugagauuaucuugucuaaagaacuaagacuaagaaugaccauuuuauccacccuuuaguuccuggaaaguuccuaacacugacaggaccuagaagggucaagaacugacaauccccauacaagguccuggggugguaugaggagagaauuuugauuaagcugugggcuacuuggucaaccuguagcaggucacuacccuucucuaugauccauuuuccauauauauacaacaaauagcuugaagcuaggauucucuaagagccuaucuugcucuaaugacauccacuuguucuuggauccugaggcagccuccccucaacaaaggucagcaaagcccaacccaguguccccuuuauguuuauauccugucagcucccucuaugcugccaguccacuuuuagcuguuuuuucuuucuaagcacacugucccacucugugccccuuccugccugccaucauguguccgcaagcaauggggcugaaaguaccucagaagcaagaugcucugggacacuccuuguguuaagagggaggagacacggcucuggcauucacucuuuucacuuugugaggcguuccuuugaagaccacuguagcugagccauagcuaucuugucuauucagcauauccugucaaccuagaccagcucuuguuaaaaugcaaaaggagcaaauaaauggucaggggacauucaaaaggaaccccaagaauucuuuaccugcaaagccaggaaauaacugcuaccuagugccucucaaaaggacagugagcagccauguguaaaagggcaggguaauugcugaaagcuaagguucaggcaucccagcuccaacaugcuguggucccguggcaguccuguaccaccugcagccuauuuggcaggcaucugguagagguuucugucauuuugagagguccagcugauauggagauaagguucaguuacaggaugaaugacauccauuuuagggcucagcuaccuagccccuacccaggcccaugcaguucacccauacagaugcuccuauacccucaauggggcugcaccacuguacuggacagcuccugguccugacugaggaggguguguccuccccugaugcccuccagacgagguuuguuuuuucaaacuuagaagaaacuguggcagcugcccaaucuguuaccaccagcccccaguuaguguuugcuccuccuccucaccccacugaacucaccugagcaggaccuucccuggcaagguccagagaagaaggaagaggcuugcuggaacaagaguugucauucugcagggaccuuggaguccuuucucagcuuggcugccaaggugagagcagguauccugucggaaagccaauaguauagagccccucuccaacuuggacuggaauaaagagccuguguggcugggcuaggaguugagcgcucuuuccucuccugcuucuuuucugcccuguccuuagcagucagggucuagaacuauuccccugaauagaucugaaccugacacagauaacccuaccagcuccggcuugagcuugucuuagacugagaagggccucagccugccugccggucagggaaccagaaaagauucucuuuggguagcaaucacucuccaaacccuggagaguccuggaggggagggaggaaagagaccaguagaaagauguuucucucccucccacaucccccuagaugcacccucugaaagcagcaauuuaaaggcacagucgccaguagcuggagugggguucccagcuugucugaguacuagggaggagcuugggcugcugagcugccacuuggggagagccugggguguuagguccagccuccaacucuaacaggaggaaugcuagcucauguguagucaguagucagccuuguuacuccuguacccagcaucccgcuuuuuagccuggagucaaaguggagcccuagaguuaaagacuuaaugcuuuuucuaagggaauaaagaccucagaaggccauggggcggccacaggguauccugaagaugaaacaggucagagguguggagucugacuccaggggcugcuuuucuguauccucuggauggaggccugggggaugacagccuacagucuguccuucucuuuaccugcccagcucuaugguucuccuguucccuucaaccuguaaugugugcauucucuucccuccuugguuccccucagucagguacucuuuguggaguccugugaccucucaaagcuccuuccuccucagugucugucccccagggcuacuugcgggaagggacaacuauccugggugcuccgcugggccauuggcuuuaucagccuuagaggaaucucaggugggcagugagauugggggcaggccgcaggaccgaaugugacccuuccucccuuguuuucugcacguuugucuauggcauccagacgcuuaagcagcuccacugucucccuccugccugcuugcccaaucucgccuucugcaccaucuaagggagcaccaggacuugcccgaguacccgucccugccugccuuauuccauucuccuccuccuccuccuccuccuccuccuccuccuccucacugaagcuuccaucauccaccuuucccgucucagucuuacucuguuccuucucugccuuucccuucccacgacugucucccuccuuucuuuccccccucuuucauuguuuucucucucuagcuuuccuguaucuuaaaucuuucacacucuccuccuaaauuauagcagugaggaacuuuuucuucaguggaaacuccccuaccggcucugcagaguuggcgugugugcuaggggaagggaucaguaccauuguacacugguuaauuuguugucuggcuggccguagccuguccaacguaaucagaaagagguuggggaagauuggaugcuguugcucaaggguucuuauugccuauauagagggauuaauaacaaggcauccauguggagaacuugcucagcaucccccgcccuuuuuugcuauguuacuaaggaagaagauuuuucaaauuacagaugaaagccaaagaagagaauuuucaagaaucaaugcuaaaauauugaugaguaagcucagucuuuggaauugggacugaagaaugcgacaugcuucacugcuuacauggugggcaaaagcaaaauacugauugcccucguaacauguuuagccucccuuuuaccugcucaccuuuccuccuuauuucccuuaagcauuacauagcccacuuuuaggcagaaaccaaaccuggcaccuuucagggucccggggagcugagaagguucccacuugucucuuuucuguaauuuccccauccuugacaacccugauccugucucuuccuuugcccaaacaaacaaguaccccuacuucuuucagguuacaggacaagacccugcagaauuaucuggcuguauuuuucauuccacugauuugucugacacugucuguuccgucuucccagcucgguuguauuuucacguguugccuacagaauacccuuuccuguauccuuaccugucuggacucaguguucuuguuacuuugucaaacaagucuuagggaacaccaccacugcccuuaggugggagucaggagagccuccguggauucucccagaucucucuuuuccaucuccucagcauaccacacucgaugauuuccuugcuucuucccaacucugccgagagcucccugagagcugagagauguuaccugacaaaucgauacauagcacaggauaggcaacuagggagcauguuuuaaaagaugcacccuuggcacccagauucgcaaguuuaccaccuaugaaucacucucugucaagauagaaugauaaguuugacauacagagaaaggagcagcaugaagcaaugguaauaaggagaaauaagaaagcauuuuuuauucccuugccccuugggucuguggccucacauucagucaucuggaauucuuggcuaauggaaggcauaguccccuggagacugguccauuguuguaggucucaccuccuuugugccccaugggaucacugagagcuggaaagcauggcagggucagcuuccugggaggacagauucuuucuuaugagaggcugcagcaaugagcaaaugucuggcuuggcugaugaagagguacagcuuuccuagggugcccaggggcagacucuggauaaagaaggaagccaaaacugaggaagcugccacuugguuuuggcaagaauuagcugagaggcuaauuccaaauuuguucuaccgacaagaaagccgauucucugaaaugauaugggggaaagguacaaaguugugucuagccuuggccuguaacugcuuuuccuucucacuaccaugaagcccaugaauccccauguucuaaaaaguacuguaucuuuuccaguuuagcaguuggaugcuacauugccaugagaacuggcuuuugugaguccuugaggugguauagaaguuacaguaaacaaccuguuuuucauauguugcuuugaaaaacauuacucccauaaguauagcuuuguaagugcuaaaagugcauuagacacauuuucacaaauguuuaauuccacaaagggaagccaucagucucaauccuauacauuggaaauugcagcugcacccugcugacaagcagaguugcagaaacuucuuugugaggagcaguguuucauuauuggaauggguauuguuugugaauucugugacuucugggcuauacuuggggaggcaaaauuggagaaggguuuagcauaauuucuugaaccuauuccaauaaccggggaugcuaugguuuugauacuucccauuucccuuacugacguagagaauggacugagacauaacuccaaaaggcaggcuguauucacagucuugagaaaacucccaggcuuaagcaaguuuuggaggcaaugggguagguaguuaaaaggggguguguauggaaauaaaagacagaaaccauuuuuucuuaaaucugcugcugcugcuucugaccagagcguuucccuuagauauccaaggaacaaggcugugucuuuuuuuuuuccuguaugugaaauuuuucuuuucagagucauuuucaacuuccaaggauguaucaguugacuugaaaguaggagcucuacuucuggugcuugggaacauuggcagcagagguaggaggccccuaagcccucuagauauuagaagauggggcaaagaguaugcagaguacaguaucagggaugccuggagucucagauggggcaaggaagaacaaaacuguauguguuagauauguuugcaguucuccccaguuguuggagagugacugguucaaauucgaugcuucaaaaauuugaccugcuuuuaaauuaacuauuuuaggcauagauuuuauaggaauaacuuggaacuacaaacuucugggaggaccguggaaagcuuagcugaguuccuuaagucuucaaagacagggcagcucucagcaccagaacagcaucagagaacaaccucugccuuuguugcuggcuucuguagucagugcccaggauauaccuguuuggcagugcucuagcuagaagagagguauugacuagcccugagguucacaucguuucucuccugcuacauccucaggauuaucguucacuccauuagucaugugaaggcaauuuacuggcugggcagucguuuguguagguuucccgcagagcuugcauugacuauccucaucucuuggcuuucauaacuccuucacauccauauucagaguugauaggaccaugucaugacucuccucagagcuuauuuuguuuuguguguggccaugccugugaauuucuuauuucugucguuugggcauuguugauaaucuguggcuguguaaaaugagaaguccuuacauaacaaaaaggacagaacuugggaaaauaaacauuuacuauaucaaguggauuucauuucugcaaauucauguacauguucaacaaagacguaucgugcaaaucauacugcagauguucuaggugccagagauaugauaguaaacaaagcagaagucugugcucuuguguaguuuguacucuaguggguuaguaauauaauuccauuccaagaggguaucugcauggcuuaucaucagguccaggccugagagccucuccuagcauuugagcagguuacauauuacaauggcauagaaaccaaacagcuuuucaguaagcaguagugagcuucauuuccaucuaucguggaauauaccugccggaacugacauagcucaucacucuccagaaauguucccaaaugcuuguacugucuucaguaauccagcccuaaacacauucucacugugggaccucucuaaaugguuucuaauaacucagggcucugguuucuuucccccuccuuuuccaucuuuauuuuuaguuuuucugucugucuuccuuucuuuuuuuuuucaccaugauguugccgauacugcaggaguaggugucaaggaaaacuuugcuuggugacuacauggaauuauguacaaaguugaauucgcaguagcuuucucacuauuauagacagagcuaagucuaaaaaaaccugugggccaagaguuagaaauguaauugaaugaacauuguauuagcccagccuuguacucuuguuuggcucauugucugagugugcacaugugugugcaugcagacuaauauacagacaguccccuauuucauaaucuaaaggugauacuccugcugcuagcaauuaucguccaagagugacuugcuguaggggaagaauuuggguuaugaugagcagaccuuuugauuucuggcugugguuucuauauauacugugcuaaugaagccccuuuggcugcaguuacuuagaauaauuagaaucccuagguaagaugccaaauugaaccauauuuuguaccagaaaugguuauucauuuugcaaaguuauuguguauauggcuccaaaugaaaauuuuuaauaaagaucaagcacuucaaaaaaaaucaacagagaugcuaaucagacaacaggcuacuccaaaccucagcaggucacauacaucagcuuuugcugccaccaccuccugcaaugucagcaacauuguuguuagacacugaguauuucucugagaaaucugacuucucuccccauugucgguuucuuucuguaaccuucacauugccuuucuaccaugcauuacaucccacguguucuauaauccccucacuuuccacagcagugugcccacugcugagucaaaggcaggugcucuuucacaacugcaaacccaguacaacuagccucaauuaugguuugguuucaggagagacaaauaggaugcugaggucuugauauuuccaggcaaccaggggcacagaggcaggaaaucuguucagcuguauuguguuaagcaaggagacuugggggaccauguguuuccauguauaucucuaggucccugaaaugguagaauggaauagaagacucacugaguagggaugaacauguuagcaggguggagaagugcccaggaggaaauuggcagugagcacaggggagcuuaugcagguauacuagagggagagaauuucuuuuuucccuuuugcuaucagauuuuuuuuaaugguucuaaugccaacaaaauguuugcugugaauucauucaaaauaaaaaagcaguccgcagcagucagaagagaaagauaaauaagccucggauuggcaugcacgccugcguucucagcacuugggaagcagaagcaggagguuaguauguuuaaggucagccugggcuagagagagagagagagagaguaugaggcuaguuguggcaauauaccaagauccugcuaacaaaacaaaacagauaauuaaaacacacacagacaaacaaaaccaacaagaaacauuucaccaccaccaguauaccaggacccagucaccugaagaagcuuuuaaucaguacugaagugggcaguaucuggggguuuuucguucauggcaguugcauuaauugaacccuacugcagaauuugguuuacuauacccuccaaaguauauuccccaagccgcuggccugaguggauugcuuuauccuguagagacuaaaaaggaaguguaauuauuguaagagacauuucaggcauuguauucaaauuaucaggggugaagaagucuuugcuccagguuggugggauauggaacaauuaucucacacauuucagcauucuguuacaauaugacaugcuauaucaucaguucuuucgugacucauuuugcagaugggcaaacaaagucucacuauacuauacauguauauuuagcuucuuauacuuccacuauuauugcacuuugauuuccccaaacacaacuauauaauguuuacaaaaugacaaaaaaugaagauagacaauagaagagauuuauaaagcacccccuccauagcuaguggucaggaaauccauagcuaucuauguuccauucuccgcuaugucucuacugcucuguacuagcaagcagcuguuccagaguaucagcuuccagagaugaacuggauuuuucugaugccuggcaaggguuaaguauaaccuuuucauuuagcaaaucaggcaguaggaaguagagaauguuugauucuucuuguguauaucuccaguggucuuagagugugaguggagacagcauucaacuuuugaaggaaucuaaagccacccuggaggcuccucuacaaaggaacuacaccuuccagccuggguuccccagaaugucguuguggaauacaccuuuuuuccacaggucaaacgaguuaccaugaacucaggagaaauaaagccagucaggcuuugacuagcuauucaaggucaagugauaauaaacuggauucuuaauguuugcuuaaaauaugaagggccaguagucagaaucaaugccugauuccuuaccaaacugcugugcuuagugaugacguugucucaaucccagugaagauauccuuucauccacaagaugaaccauggauacaacuaacuaaguucuucuaauagucuucuuuucucuacaaaguuccaagcccaugauacuaguucucuuuacuacugccuacuaccuugcuauaccuccaaccaugaccagaaaugucaguacaauuaccuguccucauaggugauuuagacaugccuuuuaccuuuguuugauggcugaaacaauguuuugguggcaaaugggaagaaagguuagacuucccuuaacucuuucaaaucuucauacaaaaaucaaguaagauguagccagaucuugaaaaccaaaugcaaaucauucuuuuugaaggccacaggugugccaguaagugaaaggcucgagaugauccgaggauuuagugaagauguuagaggagacuuccgcuguuuugguuccugcauuaucuguuucuuguaauuguucccucccagcaaaagcucaaacuagucugcuuuaugcucuuugacauuucuaguguuuccuucuccagaauacacgcgugugcauaccugugcuauguacuauacuucauagccguagucuccucuugguacaacacaaguucaggaaaucuggccuuccugaguuucuaguuuuuaggaacaggccaaggaagguauuuuauauugagucacaagucagucaaauuaugcauccuccauuguuuaagaaguaacuuguucuaaaaaaaaaaucagagcugagguaagagaagagaaauaacaacaacaacaaaaagaauuggaugaucaauuuccugcaaauuucuugacauucuucccauuuacccaaaccauaguguguguguguguguguguguguacaugccuucugucugucugucuucuguguauguggugguuugaaugagaaugaccgccguaugcuugcauauuugaaugcuuaguuccuaguuguuaaaaacuuuucuaggaaggauuaggagguguggccuuaugggaagaggugguacacuggggaugggauuugaggguucaaaagccagugccagugccauugccaauuaacuucuuucucugccuugugcuuccagaucagauguaaacuuucagcuacuguucugaugccaagcuugucugccuguuaccaugcuccucaucaugaugaacgugaacucauucucugaaaccguaagcaaaccgccacuuaaaugcuuugaacaugguguuuccucacagauauaggagguagaauuuuauauauauauauauuauguguguucuguuuuuuuugugugucuguauauguguauauacacauauacauaaacacacauacauauacacacacacauaacacacucagacacacacaaaagaggacaccagguaucuggagccaggguuucucacugaacuggacuccuacuauuuuggcucggccagagaggucaaggauugccugucuuaguaccucaguguuggggugacaggcaugcacagccaugucagacuugguaugagggugcugcacagucaagaucagguccuuguguguguacaggcaagcacucuuacguacuaagcugucuccucagccuucugaaccacuuccuuaaacaggacaaccaucuuuugcagcuauagcauccauugucucaguacugugaugacaauaaugucuuggcaguguauuuaucuagcaaccuccucaauaugguuuuggaauuuaauauugugcuccauagugggcagagaggcucuuuagcaacaagaaguaagcaaccuguagcaaugugcuuccuucucagagagacaaguagguacuugcuaugggcaacuuuugaguuucccugcuuuaagaaagcccaaccuuacuagguauggugguauaggucuguaauccuagcauuugagagguagaaucagguggaucaggaguucugagcugccucagcuagauaacaagugugaggccagccuagacuacaugaaaccuugucucuaaaagcaaaacacaaaccaaagaaaguccacccuaagaacacuggccaguguguugggccuugcuaauucaggucauagccugcccuuguccugacagcucucuugagcucagugugaaauagagggcugacucccuuuaacaucagagcuucuccuucucugaccuugcugaggggagacggaaaccgcacccuaucccuguggaaugucacguugccuuggggauauuacggguuuagcuuccuuucucccccuacaagaaccuguccagcaagcaccuggauuccuggaaugccucuccaugcaaauccuguacccuaagcuguaaaaugauaaauaccuacccuggaaauuccuagcuucucccccccaaacuauguugcccuugauuuaccaggauuaaaguagaucugccucucugcaguugaucccaggaaucauucccgucauccuccccugugcuguuagcucuguucccuuuguccucguggccuggcagccacagucccugggacaaggggggaccacagcccaguaccugcagauccauucuaugucugggagaauacaucacccguuuguuauauugagaacuuucuuauguagaggggauucugucccuacaacguugacuucugucuccuagacacuuuauauggcacuuccguagccaucauuuucuuugacucauauccuuauuccuagaaacaagcucagaaaugacaacuaaacauccagguccaacagacagggcuuuuggccccuaacaacuucucaaguauauguagagcacugagaucaccagagcccggcuuauagggaacacuaauuguaugcgugcuuguugaauaaagaaugaguguuugcaggaacugucugaaaaaagaagaggcucacagauaggguuccuacacuccuuuucuguguuacuucuccaugugcguaagcaaaagacaugguguuuggugguggugguggugguggugguggugguggugguggugguggugguguguguauggggugcagguuuucuucuguuuauuuuuguccagaacacauucuucaaauagugcugauuaguguauuucauuugacuccauuauucucauuaaguaagucaggacaauaugcuccuuaacuaucuucagaaaguagacaaagugggcaggcuuuggguagcccacuaggguucaaauccuccugcuauuuauuaugugaccuuuuacaggcauucuaacuaacucaaguuccuguauccccaguuuugucuuaguuguuuugcuuuguuuuuagacaggaucuugcuauguaguucaugcuggccuggaacucucuguacuccagacugccuugggcucaugaucuuccugcccuguccucccaagugcugugauuacaugcaugcaacaccauaccccauucucugccccuguuuuuuaaaugagaaaauaaaucacucucucaggguagguguaaauacuaaguggacuaggagauauuaaccacuagagcagggucagacacacgaucacuugguacaugaugauucuaaugcucagcccuucuuuccuuucauuugcucugugaucugaaauggcuuugcucuagguguccguagcuuagugguaagaagauaccagaacccagaaggugggcaguacaaggaauaccauuuagagcaauacuuacuaggccauugauauuauagcugguaaagcauccugaaugaggguguggcucuggcagaagagagauagaaauauugcuaaggauacagaggccuaggaauugagaggacacagagaaaaaggagacauaguggggaaaggaaaaaggaagaggcaggaagaaaagguuuguaaaugauagugaagggguagaacuaaaagauacuaaauuacuccuggaacaugaagcauaagugagggauaauaaaaucaacaucuuuaaugacgagaaaaacaaaguaagaccuaccuuguuucuggaaagcuccuauagaaaggagcaagugcuggaguccuuuggaggcugguuaccguggugaugcucuaugucuucuauuaccuugugacucugacagcagaugguuucuuucugcuuuaguuucuauuauccgggcauagcccuuggugaaguacuaguguuuccaucuccaacacauuuguuaugcucugagaccuacugacuguugucuagcuacuuuuugauaaguugcaugccuaggaagacaauggagaaaugacauacugggaauccagaagcagaagccuuuguaccucuuuucagaugaacuggaaggcauguuuaacaagccaggcgcacgucauggguggggagaugggagaacauuuuguaacaccuuccuuuguaagauaaaguaaggugagcacuucccuagaaaacuuggaucaacaaacauuuuggcuuguugaagacugagggauuuucauggaaacagaauuuucgauauuauuauaaaacuaagcagauacuaaucaaaccaggauuguuggaccucauaugggggaaaaaaucccuaacuuucaaguagacacaaagauuaaagaaggcucaagaggauggaaggaaaagccauccagagacugucccaccuggagauccguccuacaugccaccaccaaaccuggacgcuauuguugaugccaagaagugcuugcugacaggagauggauauagcugucuccugagaggcuuugccagagccugaccaauacagauuaggauucuugcagccaaccauucgacugagcacagggaccccaauggaggaguuagagaaaagacccaaggaacugaagggaacuaaaaacaauaugaacuaacuaguauccccagagcucccagagacuaaaccaccauccaaagaguacacaugguaggacucaugccuccagccacauauguagcagaggguggccuugucagacauccaggggaagagaagcccuugguccugugaaggcucguugucccaguguagggggaugcuagggcagggagguaggaguggaugggugggugggggagcacccucauagaagcugggggaggaggaugggauagggggguuccggaggggagaccaggaaaggagauaacauuugaaaucuaaauuaauaaaauaaccaauacaaauuuucaaacaaaagaaggcucaugagaacaguucacaguuuggcugugguacacacauggccagugauuggguaguucaguuucugccaucacccuuucaucuucaucuuacucauuauauguaaggugauucucagaguucaaauacugaaaccaaaugcaaugugaaaacugaaaacuuccagacccuauugugaucugccuaauccaaguuucggugacaguguagcccaggcaucugcacuuucaaaucuuccuaaugauaacguccacaaaaucugacaggaauuuaaaugggggagugcuuucuagacuacugaaacccaagggacacccagacagcagagaacuugauuuccccgauacaaaggguuuacaaacacauuggccccagaguggaggccugcuaugcucuccaucuguacuccauuccccuccacacuugucugaauguugcuuuguuuuucaugggaaggaggcuuaaauaucaucuccacuuuccuggccucucacuuaucuuauaccgucuuuguuucauugcacuaguuggaguuuguaaucccacaucccuguguaccaaagugccccucccuacucgacuuggacuccacaggguuguggccaggccuguuugucucacucgugugcacuugcagcaucuagcacgggaaccaugacagaguuuacaaagaagcacuggagcuuaucucagccucuggaauaaugcuggaaggcaguguuuccauggggccaguccuaaaugcucucuuugcaaggucucuagcaaaaccaccaugcccagaugggaagauggcuacuggcccaguguguacugacauggggggaggggagaaggaaaagagugagacucgcaagacuguucucuucucaugacacuaaucccaucgugaggaccccacacucaucaucucagugaaccucauuaacccccaaagucuucaauuuuaaaugucagcauucuaagugacaguaagcacuucagcgaaugacuuuuauguccacaaaaccauuaaugggucugggaagauuguucagugaguuacagugcuuacaucacaagcaugagaaucugacuucagguccacagcaccuccauaaaaaguguggcauagcugcaccuuucuguaagcccagcccagggggaggccguggaaagaaggggauauuguguuugaugggcugcuggcauuguaaauaaauuucuagguccagugugagaccuugucucuagagaauaagacagagagcauuagaggacacuucuggccuccacauuuguaccccaccccccacauacacagacaagcauacaccacacacauacacauaaaaaguguaauaauggguugaagggggauaaaacaaacaagaaacagacccaaagaaaaaguacagguagaaagcagccagugcugguccccuucucuauagauuccaggguuuaaaggcaauucuuauauuguacccagaagcacagcaaagaguaaaaccaaagucuuggaaaggaaaagaggagacccacagcuccugcuggccagguaaauacccgagggcaggggacaguauucugcuugcucuaccucuuagcuugccuacucagcauucuuggccccugaaagaaugcucaguuucuugugugcagucuggugacaaaugcgagcacugguccccaugcagaauucccaaggcugcauccauucugaagggcugccucaggcaacuugcaagagaaugucauguucccucugcagagacagcugagaauaccuugaaaggugaagcucuaaggaucaagggccuguggccucagaugagcauccagcauuucugaguauucaccggggcccagcaggggaagcugcuuuaaacauguuuucaccacucuuggagguaggagcuaccguugacccucuuacagaugaggagacagugaauggguugucaccaucacacacucgggaacaggaacuggacugugauccucauguucuauccauagagcucaggaucagaaccccuuucuaaaaguguaugcuacuaucucauauguaaggcuaggacucaggcaaagggaggccagccgugguccuggauucagucauccaguuaaugcuagagcuguagucagcaauuaaaucccccuguccucuucagcaucucuccaucuaaugacuccggugucucuacacuagugauaacuuguccuugugauuccagccacauagaguacaaccaaucuagaugggccacugaggucucccaaaucuuugggcuacaucaacugugagugcgcuugacucugggacugugaguccauggugagagcacgccuuucaguuuggaccaaaguacuggagaauaaucucagccccaaccaguaccauggucagcacacaguuguuuuguggcugccaucuuccagagguuccuuuagccuuccuuucuugcuuaggagacagcugcuagcccugccaccgucugucuuccuauuaggcuuucucuuuggcuagcuuugugacuggaccuagacagaguugguuaccccuacccagggccuuuaaugagaaagacuugauuauacccaggcagcaaaaaugaauaauucagcaaaggaagcccaggaauguuaguguuucagagcagagucccuugagaguaggagaagcggagacacacugcaucuuauggggguggggugacagaauacugcuggacuauuugauagaagggguguguguaguguguguguguguguguguguguguguguguguguguguguguguauugaaaacuuagauuugguccuuguguuuaggauauuuauagguagaaaggugcauucaaccaccuccaaguucucaucugagacgcuuuggccagacucagacugguuugcuagaguuuagagcaaagaaugaggcuaaggaacugucuguacuaagcuaaguaucaugucaaguuuccaauuaaugacguuauuaucaauggcaccucccuaucaccagagcugcagcagagggaagcuuuagagucuuaaggaacuugaguuuggugccagggucugucauuuaguagucauacugaguuuggaaaaauacuuacuauccuugagucucauuauuuuuaucuguggaauagaacuaaugcuuucuacuucucaguauuucuauaaguguugcauuggaauguacauauguccuaacacauaguaauugcucaguaaauggaagauucagcauauagaugcuguugcuaucuaaaaugaucaguaaauugcuuuauauacauaauagacuuaauaauaaaaucuucacuaaauauuuauuguaugccuagaguacuagagacaguggucagccaaaucauuugccuuugcagagucuaauaacucucaacaaguguuugauggaauaaagcuagaucucacacaugcuuagaaaguaauauauguaaacuguugagguccuagagguuauguaugguugaagagauuguuguuuucuacacugugagauucagguauucacuuaggcugugagaauaguauguagauuaugucagucacugggggaggggcacagaggaaggaagaugcauguuuaaggaggaagcuauguccguuuguaaauggggacaucaacuccauuaagaaaauaaaauaagcaagugaccuuuauuaccugguaacaugaacaaaccuucuaggcucuuaccccugagguuuuauuccucaacuuacagccuuguuaacgaaucggguuuggggacauuaggaauuagaccauaccucuucaguauaggaccaaugggagugacccaagcauuagcuucaugucugauuuauaagucaaaggccaggucauagugugacucaaugaaucucuugccccaugccuaguuucagccccaaucucuugggccaggagguuaccuaagcaauagccaguaagaauaauacagccucugacauccccuuaaagagguagcucucaaccugugaguugauaccccuuugaggauuuaaugaccuuuucacagagguggcauauuagauauuuguauuaugauucauaacaguagcaaaauuaccaucaugaaguagcgaugaaauaauuuuaugguugggagucaccccacaacacaaggagcugaggaccacugccuugaagacuguccaccauggcacaugccuauccguccaugaaguucagugcucuauaauggucaaacagaagcacaugagggccgugggaguggugccuuuuggaacauuggugaaggucaaagaaacuaaguugucaugaauauuuccagaggaaugcuucuucauuucuuuuuuuuuuuuuuuaaacuuuauuuccucgucuuguuauggaaggagcaaguggcucuaugugcuacaaagagcugaguggccaccacacauggugcggcauuucucuuaggcuguagaaucuuucuuuugagauuuagggaagaaaaauggucaggguucaucuucaucaccaggacuauugaauuuugauacaaguuagcauugggggcccucagcaacuucgcaagagaaauccuuggagaugcugucugacagaagccugccauuccuuaccucagucuucccuuuguucucucugguguuucccccuuucaguuuucauauauccccagaacuggcuuaauuuuagccaaguauugaaaucgucccaggaaaggcagagcagccagccucugcucuucacugucaacugaguugaagacugaggaagccuggaggcuuacugguugccauggugaagagugggcccugagaguauuaagaagcugggagcuagagcuuuuuuguuuguugguuuugauuaguucuguuugcuuuauaccccgacuucuccuucuuuuucuccuccccugcccccuaccccuccagagucucaaaucacuaaagcaggagauuacuaggggcaaaaucaggucccaggcuacauuaaacccaggcugcccugcugaggauaauugcagugcauuuggcaaugcagacucuugggagggccaaguuuggaauuuaaguuguuauaccuuugugcaggcauggugcagcauccugagacagaaaaggacuccuguggaaaaagagagacagcucuguucuggaacuuuuggccuguguuuucauagcccaagggauuugggcuuuuguuuuguuuugacagcuccuagcaucuaguccacacaauuuuccucaauuaacucucuucucucccacugcugaccagguagaacauauuuguagagaaaguguggguucuggaagaaccaugcacauauuauguaauaauuauuguuaucccuauuauuauuucauaaauaauucuccucacuucaauccguguuucugaaaaagggagacagcugacucaggaagauuuuuguggacuggacugcagugaaaacugaccucgcuuccuuuuuaauugguacccuggggcugaaggaggagcauuaugaagggaaggaaacccugggcacacagcaaaggcggaucauggcauauguaggaguugcagugucucugcucucuugcauucagugcuaauugcauaaugcuaccuggacuggaugaguauggaagagcaaaaaucucaagaaccucauauccuucguccagccauuuuuuccauccauagaaugcauagggaacgggcauucuuuuuuaacucuccaaauguggauucucagcuuccaaguuccuuuuuucauuugcaccuauuugugaauuugugacuauauaaucucaaauccuuuucuuguauccauguuuauuaucccuaauagauggccugauuccuggaggcagguuuuguacuaucaaaucuaucagaauaucucuugagggaucuaaauagcauagggaauaugucuuaccuuacugcuuauaguuugugaggcacagggaaggccugugcugcauauaaugugugauauuagaaaaauguguuuauuacaucgauaaaauaaggcuaaaugcuuaucacuugcuagauguaaaauaaauacuagaaauaaugaagacuuuaacaugagaggcaaaaguguacaauuuuuuaguagaaaauguaugugaauuucuuuucuguuaagguuuagagguuuuccuuaguguggaaggcacaacccauuaaggagaaggggaugaauuuuuuuuuacuguagucuguuaaaaguaaauaucucugcuccacugaggaaauaaauaggcaagaaaaaggaaaacagauaaagaaagcaacaaauguacaaacaacuuaaaagagggaaauccgaauaaacagaauaagccauucccuuucauaagcagggauaggugaauuaaaguagcuccaggaugugauuucauucacaucagacugcagaaguauuuaaaaagaauaauguaauaaauguuggaaacauaauaugggaauugggauccucauauaucucuaagguuuaugcaaaaacaugcaaccauuuuggagugaaauuuggaaguuuggggggaauuugaauuuuuaucuaaccugugacacaucaauucuauuucugguuauacacacuaagaaauaaauucagauuacacuaaguggcuugcaugaaaaugauuuuuguacuuuauauaacguagauuggaaucaaccgaaauauccacaaacaagagaaaagaugaguaaaauucaauauggugugcaaugccauaguucaaacaaacacauuaaauccauacauaucgguagaauuagcucgauaauccuuauacuacugaaacaaacaguaagagauacucugaauaauacuacuuaugcaauccaaauagacaacaguaucccccagaaaguccguauaaauaggaacaaugauuaagagggaaauaaacaaaauugaagaauaacuaaaaauaaaaucaaaugaaaugggcuaucaaugaaccaauaguaauagugugacuuuaccagaguuuuaauaauugcaaucauggaagaaggcaggacagagaggaggaaggaaggaaaagaacagauaagauacaauauaggaaaauacucaaaacaguaucuggugccaaguguuugcuuucuccuccugcaccucuuuccuuccagcaauaaguaggagugaagagggaguaggaaaagcgggguccaugaagccaagcaccugguagcuuaguauaugucgugcugccauaaagggggaaacuaccacagacugggggaaagccagaaaacuugcucacaguuuccaaacuaggaaguugaaguucaggugcagcuggguucaguggucagcucucagguuaucaccuugcuguugcauucuccauaaaagacuauuaguucuucccauagaagaaagcagaagagcaagaaauacugaguucaccccagcagucuuuuuauaguguuguuuaucuacucaugaaugccaccuccaaacguuuucuucuuagacaaugaaguuucuagcacagguguuugggcuaaagaaccuguauauuuggauauauucuuggauucaguucaucucucuaggggaagugucucuguugaagagccccugaaaugaaacaaguugcuuuagcuaaagaccuuuaaggacccucuacauccuguaugugucucauuagaaugugaguucugguuucucauguucccaaugacucuaucuuuguacuaaguacuugaguucaaggccagccuggucuacagagugagcuccaggacagccagggcuacacagaaacccugucucggaaaaaaacaaaaaaacaaacaaacaaaaaguggccuagucaguaguaucugacaauccccuuucagugagaacagcaucuucaguugcucuagagaagggggaaacuuuagcugcuuuccuaaaagagccagugcuauaucugccuggagauuucccuggggugaaugggugugugugugugugugugugugugugugugugugugugugugcgugcgugcaugagagagacagagagauagagagacagagagagagcgcacaccaugagccucacagccaauaaacuugacauaucuuuaagggaacuacucucuuuauauggggacacaaaaaaaauguccccaagcugaagagucucaagaaggacuugccucagucuuuauuguugaaacuccaucaguuugggcaagucugacccaaaagugguucuggggguagaagccccuaggccaaaaagagaagugaugggaugaccccucauuccaaggacauaguuuaaguagaccaauccaugagacccugauucauggcaaaggagguaagcagauaguagugcauaguuacagucuggcccuggucuguuuuuauaucuggggaauaacacucuguugugguuccaagacagaacuaagccaauuuccugcaaauuuggaaaacaguauagacuggaacggagcagauaagcauacaugggggcauaaaaggcaaaagcuucuagaaagagcaguugcuucucauuuuuuuccuuuuauuucuucugagucaagugcucugguuaggauucacgcugaacccuuguaaggacuugacacugaccuugauuuuuagauguacuaagagaaacgcccuauauggcaaaguggucaccugucuuucugcaggaagacagacucgacaaugucuuaagcauccaucuuucuguacaugugucuccuugccucuguuuuccucuccaccucuucccccagcuccuaagccguaaggcccucaguccuccuggcucuacaucugucgucuuucugucugucuuugccuccaaggucagacgauugggauuugcugauuuuuaaaaauuuguaaauauuuuguaggcugccugcccaggaacacaaauggcacagggaguaccaguccacuuuggauacucuuuugcccaauguccuugguagauuaugggagggagggaagggggcuagcagcagaugauaauaagggaacucugccaguaguguguugcagagcuuagggaacagcuuuuguaaucaaguuccccucuugcuccuccucgccuuguggauuccuccuggagagaagcacuggggguaggaaagagcagagugaaagaaaugcccaucgaauuguggaguagagucgcuacagugcgucuauaaucgugauaggaacuuuacaucuguuucacuuggugcucaccuuggcucugggacgucaaccuuuuccuggguuauaguuaggaaacuugagcugcucgggcaugugguaagcuuccccguccagggcucacaugaagcugugauuugaacccagauuugucucacuccagcuacauugccauuaaccacagggcauuguuaggagcaguaacuuacaugccuagccaugccacaaauaugugugccuaguaauagaacauucucccugggucucagguccucugcuauaacauaaggagaaacagccuuuguccucccaaacuuggggauuauaguaaagccagaguugcgggaguaaaauaaacacugcuccgagaucuggcugccugaguuucagugaugccaucgcccuucacuguuucugugguguuuagugaaucacuguagguuuccaggccuuggcauaaagugaagaaaguggcuucaagggcaccagccauuccuuuggcucucugagcaucucacuuguuuuggacaagcuaucugaugcuggaaggacuuggucccauucaacuuuucuuugguaugcuucauaguuuggaaugaacaagaaaagacuaaacagguccagcacuugcuauugucccuauuauuacccucuccuaugcgucuugaucuuagcaauuacccuuacucaccuccuuguuauuaaucagugccuuggcucaaauauauauauauauugguuuucuguucuuuguucuauuggucucuuuacgggagaaugaccugcacauggacagggccaaagccaucuagaagaggucucaucccaggcugaaaagcagcucucaacaaaaucacacacaccuggaaaguggugucuuccaggccauucccagccaaguccagaagcacagaagccuuccagcugccgcauggucugaggcaguccuggauggccccaaaccaccaccuccuuugggcccagagcaggacaaauaaaauugcaacagggaccugcccugugacauaaaauuacucauuuuccacagcuccagaaugaaaggaguagucauccccccccgcaucaguacaaugugucagagaggagccaugggcaacaucaucaauaucucggccuuccagucucugcacaucguuauguugggcuuggacucggccggcaagaccacagugcucuaccagcucaaguucaacgaguucgugaacauggugcccaccagcuucaacaaagggaagaucaaacugugcaauggcacagacaagggcuucagcugccacuucugggaagugcgcggccaggagaagcuacagucacuauagaagcuguggccgcuguggaaguccuauagccgcugcacagacagcaucauuuaugugguggauucaguggacguggacuggcgggaggaggucaauuuuauaucuuaaugcaauugcacuaaauaguauaaguugcguugguuguacuggcacaugccaguaggauuuacuaguaaauauaaauuggacuaaauaaauaaauaaauugcaccaaauaaaaaugagugucauugucuucauuugaugucaccugaugcuguucuuagaaagaugggaaagaccuagucuaaggcuuggauuauaaaauaaacacaugacaaucauacauauccuaaaauguuaugaugcuaggcaaauauuuauaucacgcaacaugauucuguggcaugacucagagaugacccugcuugccaucuagaagggaacuaucuuaucaggcagauacgaagcuuccuagcugguggcaaaacaagugagucuccuggcacauuguagcauucuguguacuugaccaggaccuucagaaaaaauaucuaauaaaaaaauuuguuuagaauuaaaaaaaaagauugucucuuaucaccuccucagaaucuuuuaggagguagaagagcaucaucuucauuucucagaugaggaaacuaacccgcuuaaaugaaacaaugugccuaugaaacuuagagaucccaaaagacuaucagcugucaagguguaaaagugugugaucuacagauuccaaacacagaaugaugagccacagaaagagaaacaugggaacgguuuaauguuaagcugucuuauucuucaagaacuggggauuacuaaagugugagcuacacacaggacugaaagggugcagagcugguggggacugagcaagaugagcagagucaagaaagaguaggacuucuuccccuuaugccuagugagccugacuuuggguacagagauagaaaugcaccgggcauccuacaaagcuagccuuauagugucuugaaugagucaguccugcugagcagcugaugguuuucucagcaucuggccucauaggagguguucucugagcgccaggaguucugcaggucacccagcccccaacacucggguuucuuucaaaagcagagcuggagggcacaucugccaaguuccucugcuaacaagcaaucucuccucugguagcccuucugcuggaauaauugagcacagcagcaugugcaugugcuaaugugcauguguuuguauguggggaaaguggggucagccgcugcgagccuggggugaggugagguuucugucuccuuuccaguuaccuugugaacugcuuccuucuccagauauuugauuucccucccucccucccucccucccucccucccucccucccucccucccuuccuuccuuccuuccuuccuucuuuuucuuuuccugcuccuucucacauuccugauaggggauuuccugugccccuaaagccacacuguucuagaaccuuaccaagguaaauucuaggacuuccucugaaauggaagguaccuccaggaaaugggauggguuccuggagcaaagaccaguaagacuaacucagaagguagagggaacagaaggggcauucuagccaggugauguccauagucauuagggguuuagaggaaaaauaucugaguaaaaacguguuuuauguccuccuggcuauguaaccuuauacugcuucaguuaccucagccuuuaaauuaggagauaagaacaguaucuuccuuguguagcuuuccauggguuuaaguaauuugggucuaccuuuuuugggugaggcucuggagaauuuguucccaacuuccaagauccaggagcuuucauuggacacauuccugcccaggugaagggccaugacaacucuuaaagguuucugucugaggaucagagccucagcugcaacccaguggacucagcauugaagcugugcggaucucuaagaagugcguccuggggccagcuccaaugcugucauuguuugagugacuucucaucacagcacacauaauagccucgguuauggcaggguccgugagacuugcagggacaaaauaggggggagguggucaucgcgugcaggggcugagaagcugucccucuccuugguacgagcaaguuguacaacagcaucuaucaguguaguucacacagagggaaaccucaggagguuugccagccagaagcugaagggaaggcaguagccucgaaucaaugcuaacuccagcauagagagaagaggaaaaacagaugagagauccaggccaacucugagaaacagagaauaaaaauagcugccggucucucucucucucucucucucucucucucugugugugugugugugugugugugugugugacacaaaacuuuugcagggcucuaguuacagugcacugauacagcacuugccuaguauuaagaucuuagcuuugauccccagcaccacagcaaaugucaggcuucugccgauggccaguuacccauccacauacuggcaacacgauguggagucaguuggauuuuucuaacaacauaggaaguugagcgagaaggcugguagggaguuggggaggacuuggagaggagagaacagaggauaagaaucauuaauaacuuaccuuuuaaaucauaaauaaaaauucuuaaaaggaaaaaauguaaacauuuauucugcucucuuuaggaauagguaggugaguaugaauucaaccuuuuguaccguguccacaggagccauguagcaacccuugaucagugaaucccuugcuaccagaauugccuuugcaguaaccauacucccucaagcucugugccugcaguaguugugaguucuguucuuugcaggcugcuugggaaugccuuugaggaacugccaauggcaucauguuggcugacacuuaaacugcccacagcugauuccuggccagugugauagcaugcaauugaagacugagaguggaagggagaaagagagucuuggccuaucccaaccauaggaggcaugucaagaggacugcagaggaugcagagcugagagcccuauggcuagaagagagacgacauuuacuccacagagccuucuaaggagauaggcuuuuuguuuugaucgaagcagaaggaggauggaacaugagcauugacuaguuccuaaggaugagguaaagaaagauacugcuuagaagacauuuaccaggaggaagcugggacggcaguaauuggaauaagagcaugccaggccaaucacuuuguuaucagaauugggaaggaaccacagaaacuauuuuugcaagaccuuaguacuuagaaucauuaagcaucacggccaccuuaguuagccucuccccccuuugguacuuuuauugcuuauuugggaauuucauaccaugcacccugaucagacucacuuccuauccaucucacaucuacucccccuugugaccacccccaaguaaaagaagaagaagaagaaaaaaacacaaguccaauuuguguugcccauauacucacuggagcaugguuaaacucccaguggccagucuguuaaaaaaaaaaacugacauuccccaccuucauucccuccagaagccaucaauuauggagagcuacacuucagcauccuugucacaaguuuuaagaguucucuucaguggcuuacugucuacauuguuaccuuuuuggugugugucuguguuuggggggggggugggaggggggauaugcagccaagauccuuugccccacagugggcugggccauuuuauagcaauugacaaugaagacagucccccacagccaugcccacgugacaguaugaucugggaaaucuuuugagacuaccuucucaggugugacucuaggcuuugucaaguugacaguuaaaagcaagcaggacauguccguacugucaauuucuuugggcuaaacagaacugaagcacuucugcucacauucuggagauaaaccagccccucuuugcaagggacuccagcccuucacuauuccacaaacggaauuguuauucucugaaacccgcuuuggaaaacucuucucuguccagugaggggcucuaauaaaauuuaucaguucuuugggggaauauuuucauucguuuguaauugauaaguucuuuccuauucauuauuuguuugcaggggaagugaagagggguuccuuuuuacauauaguuuauuuuugauuuauaugcacugguguuuuaccugcaugaaugacaguguaaggaugucagaucccuuggaacuagaguuacagacaguugugggcugcccugugagugcugggaauugaacccagguccaucuggaagagcagccagugcuguuagccauugagucauccuuccagccccaagaggucuccccuuuuuugagacaggaucucugcggcuguacuagaacucucaauguagaccaggcuggccuugaacucacagagaucuacuguucucugccuucccaguguuaggauuuaaaggcauaugucagcaggucuacugagguuccuuuuuuaaaaugcagaucaccuucacaagaucaagccagccaaaacucccaauauggauggaguagagucucaugaggccccaugucuagcugagaagcuauuggcaaauggauguccacugaggaagagucaccuaucuucagaaauacgagcccugagguuacccauccuccaguagaugaucccacacuaauccauccauucagacaguacuacaugaauucaguagggauuauuuuuuuguaaagugccugaacuugguagggagaagugguagaauagauagaagaggaauuagaagggguagaacuggggguugcugaaucaaacacauaugcauaaugaauaauaaaauauuaaauaaacaauacaaacuacacaguguaagcugcuggagaagggcagugaagaggugugucuuuguugagauuggagcuuugcacuggaaggaacagaaacccgacugguagcuguauggaguggcuaugagauaaacaauagaguaguuguccagauggacaaagucagcccuccucucuaaacuaugacugcaauauggagggugagaucucuuaaacauauagggcauccuaccuaucccaugcuucuccuaugccugcagugcucuccgauuguuuaauaaaagagccaugugaaggaaguguauucgucuauggucucgugaagagaagauccucuguucuuauagccuccccaugugacaucuaccuagcacaagcccuggcccuacauccacaaugccuucauaggaaggcccugaauauggucuucgggaaccgccaaucgcacugucucagcugagaaagaucccuuguauccgaacuagcuuguucccuauugacucccucugaugacuccagaccauagacucugucauaacaccuugcaucacagugggcuggaggcagcuucaguucuacucuaaugaaacccaucaccugcuaaccaagccaauguaaacugaagaagggucaaaauaagguauuucgaaauaaaggcagcuccaggcacacaccccccacccccuacuuuccugauccacauuucagauugccgucccuaaggcucugcugaaucaacuuuugguuuuccuccccauguucuuuucuagccauggaagauuuugugcacagucauuauccuaggucaaugaaucuugccacuuaccaaaguaggaagcccguggcuggggugugugugugggggggggucaugccuacauaaacccacucauccauccauccucccucucaccaagagagcuucguucagcaugccaacacuuagucccaguuguaaaggagagaagagaaaguuuugcccauugggggggagucuaaaauaagcuccuuagagcagaagccauguuuuucgcuucguccuaaccuguacuucuugugucuguuccaauguagacaggaggcugacagcagugaggcuucacuccauccuugcugcaagccuagcuguaauucuccuccaucagcacuuacuagacauucugcagugguagcucucgccccucccuucagucucccuggaaaguccugugcugagcuagcagcugccucacuguggccugcagagcuccauaaccucuaucagcacccaccuugaagaggccugggaaaaaaaaagagagagagcuucuccuguuuuuauacugugcagauauggucacaauaauuuuauaagccagguaaaaccccagaagaaaucaggcagcacacgaguaugcaucagaauucauaacacacguacacaugaauguggguauccaccuguaccacguuccccuuuuauacuuuugugguuagcauucaaaaauagguuucauuuugacaucucccuacauuuagguuuuuuuuaauccuuuuauaguucccuuucaauuuauauguccugaaugaguguguguguguguguguguguguguguguguguguguguauacauacauauuuggaagggguggaggaagguaguuuuuuuuguuugguuuugguuuugguuuucaagacaggguaucucuguagcccuggcuguccuggaacucacuuucuagaccaggcuggccucgaacucagaaauccgccugccucugccucccaagugcugggauuaaaggugugcgccaccacugccuggcaggaagguacuuuaaaauagacuauaccaguaucauguauuuaaaucuuaauucugcauaugaagaaaauauacaacauuugugcuuuuauaccuuauuucauguucuauguucuccaguacucuacauuuuccuuaauuucguuuucuucacuacugaauaaaaucgcauuguauauauguaccacauuuucugcauaugaauaccuagacugguugcauaucugggauguacacacaggcacaauuuaaugauccacuacugugaucaaggcuaauuugagcauuuaaaauugcugaggauagacuuuuaaaauauuuuuuuuauuauuuaauuuaaaaaugugugugggugcauaugggaacagugcaggugucuacagaagacagaauagugugucaaaucaucuagaguaggaguaacuaggaaguugugagccaccuaauaggaguccugggaccugaacuugaguccucuggaaaaacauuguguacacuuaccuaccaaaccacccuuccaggccuuggccaggccaaucguagaguguuuaaugugagcuuaagauguaacuugucaaaaaagaaaaaaaaagauguaacuugucagaaaauagaaguuuuuugaggaacuaccagaaacauaauagaauuuccuaauaauaauagaauguacucuuuuaagggcaguguagccuagugcaaagagccaauccuagauucuugggauucuuaguuuauuugaugaauaauuugaagaaguuauuuaaauuuggggucuuguguuuauuaucuguaaaaugggagcaauaaaagggcaguaauauauauguuauucauugcaacaagggagaauuagguuauaccuuaguaagauugugugagggaugccauauaggauuuggcuuaaugugauuuugaggagggccuauggaaagagagcuuuacucaauguuggaugcuuucaaggaagcagggucucaaagcaugugguaugugcaugagugugcuccgccuacacagguguguauggagaccaauggcugaggucaagauaucuucuacaguugcuuugacaccuuaaucuuugggacaggcucucucacugaaccugaagcugaccguuuuggcuaggaugguucaucaguaagccuuggggacccuucugucucuguuuucuagugcuggguuacaucaauguguuaccacaucaggcuuuuccuuggaugcugaggauccaaacagaucuuuauguuugcacagaaaguacuuuaccuacugagccaauuccccagaccuaaacuuuugaaacagaguuucucauugaaccugggacuuauugaucccuuuaggcuggcaggcugaugagcugaaggaauucuccugucuccauucaggaugcaggcauuuguauaauaaggcaucuuaguaauguugugcuuuauggagaacuaugaaagugaaaacaaaugagcagcaauucaucuuaacgaagauaguggcaaguucagucaugcccaugcuuuaaauaguauucauauuuugucuguguucagaucuuguuacaccauagucuugaucuuucauggucacagaauggccucaucugauguugacauucuaugacuuuguuuaccaggggacuggaagagcaaacugguaagaccaggacagauucuagcuuuaggaacuauuugguucuuucuuacuuccuuacuuauucccaaagacaaacauagacuguagaacccgaaucugugguagacaggcuuuugauaccacugagauuuugcuuagagaacauagccugugcuaagaauacuagucuaauuaguuccuuauguugcaggaugagcuguugagaccucucagaagacaauggguaugcagcaccaacaguguuaguuaauuacuagcaguuuucagaaaugaaaugauugguaguuugggaaaccuacguuucaguuauuuuauuuaccucuuagcauauaggcauggcaagaauuguuuguuaccgcauaaaauuuccuugacuagaaacccugucucaaaaaaaacagaaaaaaaaaauucccuugacuaguuucgaggaaauccauguuagugaggacaauguugacugcccauaaaaaccguaaauccugaauuuagaauagcuuauuguguuuuuagaguagaauguuaacuuaugaguaaauguuauuuaggggucagaaguaaucauuucuguuaguuguauuauuccuacugugagauucacagcuuguauagugggcaugaagaaacaaucaaacuucccuuuuggguucuaaaaagaaucccaugugugccuuauuuuggcaauaguuggguauuuggggagggguaauuaaaaaaaaaagauauccagguguggugauacaugccuuuaaucccagcaccugggaagcagcggcaggcacaugucuacauacuugaggcuagccuggucuacagauuuccaguucauacuacauuccagaacuacauagugagaaccuguuuuaaacaacaaccacaaaaaaaguuuuuuuuuucaaagcauacaggauaaaguaggauguugugugucuaaugcucaaaguuaaagaaagacauagacuguauugggagcaaaagcauuaucugugacaaguugaauggacccaguuucuaucccucuaaguuaauggacuuaauggugcuugggauggagcccagagcuuugaucuugaaauguaagugcacugucuaccucaguuacuuaaaauuuuuaguagaguuagccaguuccuguaaagcagucugaagucucucugaagaacuacacaggcuaacaguagugacuacagggugaagaagcaggcuuauguuuagggcacaccagcaaguguggaagaaacacugaugauguuucagagguguggcaagaagcugaagagucagggaugagagucaauagccccgaguuugcacagcacaaagagcuagugguuuaggagcaagcuagggcucagccaguugaagcuuuuacauguccugcuguugcuauuauggcucuuagauaauagcuaugucuucuuuccuacaucugcugaaagcuugaaauaauguaauagcuucagaccauucccgacaaauacauacccuuagcaccuauacagaaacuguguaaacagaaaugaaguagagguuucugaucuaaaaucccaagaaacagauuuuggcacaccgauauuuuacagucuuuguguuuaaauauaaauaauguuuuuugaaagguaugcagucacuaaaauaagcuucuguuugcauacuuauaucugguggaugaauucuacuuuuaauuugucggguuacuuugauacugucauacugauuaugacaggcaaaagucuugauggcuagauuuaauucagagagaagcuuagauaaaccuaguuaucuuuuuacucauucuuuaauagagcaaaauguuuaaucguugugucaccuaaauggucauuuuagaaaacccaaagauagcuuaggcauagaaaauauuuuaaugauuuuauuguucugggcucaggaaaguguauuaguuacauuucuguugcuguuauacaauaccaugaccaaaaccaacauagagaagacagcguugguuuuggcuuaugguuacagaugcuagaauccauagugcuggcaggguaauggacagaaugcuagaccacaaaagauguuuaccgagcacuuaauauucuuuaauaacugagcucuuacugauuaccccagcacuggccauuuucagacuggaaaggaaaauuuucaauuuccuucccaccccucuuccaaugaaaaguguaaaaagagccuccuacgccaccauuuggggcugaucucuccucagagucacugccauguuucuauccgucuaugguguuaguaucucuucagauagaagucuaauaaaaaggacagucugucuuaaacucgaagcaugaaaccuuuucaucaguaaauaaaagaccugggucuaagguagagauagugcaggugaaugcugacccaccuccauuucuguuggcaccucccaggcaaacgguuugacaccguugaauuugucacuugcuacuugaaggggaaugcaugcagugggugagaguagggcguuuccuuugcuguaaugaacuacaaaccuggcuucaucaauuccauguguaggaccuuugacugauguucauugacagcaugugcaugugaaaccaggcagccagcaaucaggcuuccgugaacccucacuagaugggcaacaucacuugaguucucugaugcucauauuucuucuguucauuauacuuaaggaaaacauccaccuuagccuacugugagaccuugaaacaaaauuuguuagcaaacaauacaaaaagagucugaucaguagaccguauuuaaaauagcgucuacaugaaacaacucaguaauacugcgaaguagugacucuguaagggugggcuuugcugcucaguuuuucgaugcuggcucuugaagguggccagagaaaguggcuauagcccacagcaggcagacuccuuucccucccaaggaacccaccucgcugggacuaccucuccaccuaccaccacuggggacauuuuuuucuauaguugccuuuaauacauaauuuaguguuuucugaaauacuuuuccugcagcaacuuccauggcuaauggacagaauacuagacuugaaagaauuaggguugaauucuagacuucccaggacuacuugagaaagcuucaguuugcucaugugggaaauagguauaacaacucugccucauauguugcugaaucccguauugauuauguuuguauagaaugaccuaauagaaacaugauuauuucuucagcucacgucaaacuuuuacuuaaggaauuucguuccugagguaggguagggcaggacugugacuguagcacuuggggaacuggaagagaaagaucucaaguucaaggcuaacucccagaaaacuaccucaaaggcuaccucaaaguaauggggggaagaauccaaugaaaaggaguagauuauaguacaauauggagcuaagauauuauccaucaagaagugaacauggauuuguggugagcuagagaaaaaccaaaaaaggagagacaagaggaaggagcaggaaugaaucuguagacagauauuggaguuuccagagaaguuucaaguuagaauggaacauuaguaaucaauuuuuaauuguuuacauuguaauauaucuucuccauuucuguaaacccuuucaauaugucaguugcaaaagccuucagaugaaaggauuuuuaaaauguauaaaucagggaagaauaauguuucugaugguucuugucaucaaauaauaauaauaauaauaauaaauagaagaugaacuguggaaucugaaguuuauuagaagcuccaguucugaaccaccuaagauucugaacacugaagauuucaaaggaaucucuaaagaagacauuaaacuuuccugacaaggguaaugguggggacuugggccaacuuuauuugaauucgaaaggacaggcugccccuguacuuccuucuguugaaguauucaccuaacacaggcguacuccuuugugucaguugucucuggcucuuuguuuggcuaaguguuucuaguagccuuuccagcucucuugacaagugcuacagugacacaccaucccauuucucuaaacuugccaggugcaagccaagaaggggaaagaaaacagagauuggaggaauguagggaucugaguauuaacaauaauugccacuugcugugcuaugggcuaagcugaaguggguuaggaacccaaccugguugaccacaaagccccaaacauugugcagccuguuucagggcccaucucaacgagcuucccuagaugaaaagacugagagccaggggcaggcccauugggugaaagaacugggcaugaaauucagaauugaauaucugucuacagggcacuguauuuuuuuuauuggagguuuucuuuagcaacucuccugacaccuuccacagaagccagcuuggcuugccauugccagcugacugcccugacacauaggauugccagguuaacaaaucaaaagauagccaguuacauaugacuuuuggguaaauaaugggcuuuuuaaaaaaaugugagcauguuccauccagcauuuagggcacacauauuaaacaguaauucaauuuaucucgaauacaaauucaauugugcauugugcauuuuaucuggcaauccugcuuugacuggauauaguguuucagagaguagagggaugaggacuuugggaaugucccauacaauggccuuagcacagggagccuuuguaaccugcuauggcuggcaacucuugagacaacugcuuuaagugcagagauuggauaguucuccaccacugguggagccuaaccaaccuuucugagguuccugguuguacccaguuaucauacugaacgaccuacaucuugggaaauacuuuuugcuggcaaauugacaguuggugacagguuuaaacuucaaggagcuggaaacauuggaaaacaaaugaauucugaaacugcuaagugaaacccaagacauuuuaguauuuuuauggagcacauauccuaauugcuguuuuaaaaauaggcaaguuuggggauaucuaaaaguccuagaucugacaguugucaguggcagagaucacuaaaguucugcuucuuuaucaggcacuucgagagugucagccccucucaugguuauuauuaauauuguuuuuguaccucagcauaggcaguguauuaaaaaugucauguucauuauuuuguauaagcccugauggguccugugcccuauaauaauaacaauagaagugcaagucgggggggggggggagugugcaugccuguaaucccagcacucaggaggcagaggcugaccgaucucugugaguucaaguccagccugguccauagaaugauuccuaggacagccaggauacagagaaacccugucuugaaacgaacaaacaaaaauauaacaauaggaagagaucaauugugaaaucugaagauaguaaccauaugaggucaccacuauuauaucuuuucaggaacaaaaaagcaaagacuaagaggcucaaucauugccuagugucauagagcugacuaaccaaaucuguggauguuuugaaggaaggaugcuggagucuuuguuuuuaaugauugcuauugaaccaagggcuuugcuauggcuggcaugccauugaucacugcuccaacuucagcuccagaaucuagguuugaaaucacuauaugcuaugcucauaucgauccccgaccaaguagaaggcuacuugauaucuagccaaaaucgugaaugcuaccauucaaagaccccuuccuuuuguuucguuaucauggaggauccucugagaagaacacuucuuugacuuugcaguuuuucuacaauuguucuuuuuaaaagaaaacauuuucccuugcuggucaggguccacacaacgccaagaguuaggccaggauagaggaucuauuagcacccccugauucagaggguagcccucaacuuggcagggccaugagauaaguugagcuucagggcccagggucccucaucucacuccugguuucccagggagaagccaacgagagugaagcucuuugaccaggaaucauuggcaaauggaagagcccaaugcagacaaaagccccuaaccccacauccuaccuagagacacaggucuucucuuuugccugugccagcuuauaggaugucacuugggccuagacuugugggcaaauuggcugcuuagacagagcuuagcuggggcaugagaaggagaaagcgagggcucucuguggggcccacuugcccuaagcuccagcaaaugauguguacuuaccugaggcacuuaacucucagcagggaggauugaggcuucccuugcuucuucguacuaucuguuagccuaguuucccaggaaagggacuuuagcuucaagguuagacauucuguucuauagcacaccaaguuuagauugcagugccaccacucagacugacccuucaacuggcuaugcagccagauacuugccuuuguuucucugaaaggcccagaaaauucuaucaucauugcuguuguugcaccaggaggaauaggcagguuuaucucuguaaagacugcccggggcugugguaucaagaaguggccuaggcaacuguuagagcugauuccgcaguggacagauguagcccacaguauugguggacccuauagagagguagaaaggcuuugugccucugucacacuaccuccugggucuucauccuuuuggauagcauggaugcuuguuuucuccuacaagaagcagagcuagggcacccaccccuuccccaaccagcugugcccuaagggaguuuccaggggguuccuacucccaguagcacccucauuggcuguauauaagaauaugguugugggcagggugaaugucaagugggacagugggggccagccuaaccaguguacugagggcugccugagauccguggaagagacuuuaguggccugcggacugcuguauugaggaaguuuucagaugaaaaguuaaauaaaauaagcaugagauccauauaauuaccaaccacagccaugcuaaaggauguagaguaaaacggcuucccuuaaucuccaaauucccaccccuuucuccagaagcagccauuuuuuagcaggcuagguguaccauuccagaaauagacauucccccucgggaagguucuccuuuuuguuucuggcuuagucugaauuuuaacugugaugacucuucuuuuuuuuucugacuucauauuuuaaucauauacaaaggagagaaaauaauagaacaaaccuccauguucucauguaguuguaauaauuaucaacauuuggcucauuauuucauuaaaucuuguuauuacauuuuucuggagugggcaaagcucaaggauugugacauuuggcuauaaagacuucuaaaauaaagacucuuuaaaaagcauucuuguggccagggaugcaacuuaguaguauaggcauagaauacugagagucugaguuggauuugcaauagcacauaaacucagucagucuugguauuauagccacaccuaagaagcaucccagcagucuuuucuaucgauugucucuucugaaucccacuuauuugaagcccaucaagauauauaaaacccacuacauuucaaacauucacuuuauauuuugcuuagaggaguaugaaggguuaggaacuugggucauagcagccagagaagcucgcucgcccauccuccccuuugcuauucuuguucaggaaagaggcucuguauucaagcauucuuucagagcagaacaauugucccagcaaguuccaagcaaugaaucuggacagagguauuuucuaaagguacuuuugucuuuugccuauuaggugacuucuguguaccccauuacucaaaugauaaaaauaaguauaucuauagaguuaggugacuauugacaaccagggaauaauuuuauuuuuguugucauuagacuucauacaucugcacucucuaauagggcuacccaggcaaagccagccaaguuuucaggguucuaaguggguuacaugguuucuucccacuggauauuuggcauuucucagguuugaguguucugaguuuauuuaucugaauauuuucucuucuaagcgacuuucuuacucuaucccaagcuauuugcauaucucccuuuuacauaaauacacaauuuacaagucagcccuguccauccuuacauugcuccuugaguuaccagaagaacaacacccucacuccccacaacacacacugugcaugaccaaagaaugcgacaucucuggcccucagcccucaguucucuuggccaaaaaggcauggccaagccaaucggcauaaaguuggguguggaaaguucuaucugcaaacacacaacacuugauacaucgucugccacucugccaguauucugugccaggauugugaaaauuuguaaaagccagccacucgccuuuccaaauuuggccugugaugacacaguauuggaugggacaagaaaagccucagcucuagacgcucuggaugagcccgagaacucagucauacugggccuucucuguuuccuugucuaucuuccaagugaacauucagagaagugaaccaucagauuaggcacuuacgagcuuaucuacuuuucagggagcaagucacuggacuucucaaugcccugguucaguggagcaaagaaaacuuguuugcuuucuggccuuccagaaucugauaugacaggggagaacauggagguacuauccagauguuuuguaguucauugaagacaguugcacaacuaaacuaagcugugaucaagggggcccacguuuucugguuuacugcuagaacugcaugaagcacacuguuuacugguauacuacaacccugcuuuguucuuccucacaggcucccaaagcaggcagcagacugcaaccaugaaggcucuuggugcccucuggaggaauguucaggcauugcagaagcccagccagaauggagacuuguuuuuuguucagcucacuuaagagacccaaugaaagcagaaucauagacacagguaggguggaugggguuuucuugggucagggaaauucuugaagacuggaaaaaaaaaguccucugaggacuguaacaggagcuuagaagaaggaugcagagggacugugcaggcagacugucaugucagauagacagagcaaccgcaaugcacuagauccgagggagcugggaaccuuaggggacaggggagggugugacauaaucgccuggcugagcaccuuuccuagccauuagcagaagagcauugcagaaacagaaagaucugccccaucagugaggagagagaaaaggagggacaagagaaagagaacagaaaaucaaauucagaguaagacaguggagaugauagaaaggagcaaagaggccucggggaauaugguagauaaguuugugucugggaguuuacuggggaauuauuuccuucugaguagcauaaacagucccagagaugcugcugagaauggcugagaugcaucugaggagucaaccugagcgauuccccccacacauagaucagcuuuggcuauuggcuuuuugauuuccccacaucagaauucccaaaguuuagggucaguucuuuuugccaucgucccucuccuccagggcugucaauauaaagaagaccuacagcuucacuuccaugacaggccgagucugugucuggagagcagaccuaggaaggcaugggucuuaagauccucagcagucagucauggccuuaguguaggaugcccugggaagcuccuaccauacuguuccucaugaggcagguucaaggaucccuuaccuuucaaguuguacaagagcaaaagauuuguuuuagaaccagccucauacagucuacaauucuggaguccagaguuguagguccuacucaguuuuccuccucuauugucucuuaucucaagacaaaaaccacaggacaaguucaggaggacauaccuuauuuuuuagagguauagaaaugacaaguuccacaacuuuccuuagagccauucagcaguagaaucuugcuucuaaaucaagaggguuaugagugugaggcuucugaggugagagagaagauagacaaagaaaccacauaagcgcuccuuaaggugcaccuguuuuagaaaggacuagaaaaguuugccuagcuaacaucaccuuuuauauuugguuccuucacagacgucagaaaucacucuuaccauuguaaaugguucacaaauacuuccccucuuuuuacugcuuggccauauuuuuucauagaauccucuuugagacaaggacuguauuuucuuucuccccccccccccaacucugacugcugcuuucccaaacgcuccuuccgucuccuuagccucaucuucacucugaugggaacacuauuuccugggaagaguuuugacuagcugcuugccaguuugugauaaugucuugucucagaguucauuuuccuugaaaauugccuacaugguccacucuggccuuuuugucccuugugaccuuggcacaggucuugcccucuccuuuguaucucuguuauccaaauguacucucauugcacgucuggcuuuuuugagccuggucacacacagucuguucauagaaucagcagcugguucuaucugcauucuucuaaaaccaaagcuuuugaagaaauuauuuuaaaugacuuuuuuucuuccccauuguguuuccagugccaggaagagaaagaaugcuuuuuuugcuuacagaggaaaggaaagguuccauggucaagggcaacgagcagugagaguugggugcgguguguuugguaguauaguaaguaggcuuuugauucagacccccuucucaucagggcuacuauuucacaugacuuuacaugcucagacccagguaugacacauuuaaauggacccaaggaucauuugggaggauucaagaaccccuccauuuaauuuacaccccuaauucacacuuccugauuuauuuaaagcaaaaugaaauucuagagaagcuuuaggggggaaaagagagagaaagaaaaaaaacaauugggagugaaaaggcauaaagagaagauggagcccuuaaagaagggaguaucccaaaggagguggggacaaggggaggagaaggggaggaggagaggaggagggaaacgagccugucucuuuaaggggguuggcugucaaucagaaagcccuuuucauugcaggagaagaggacaaagauacucagagagaaaaaguaaaggacagaagaaggagacuggagagaccaggauccuuccagcugagcaaagucagccgcaaaacagacuagccaacaggcuacaauuggagucagagugccaaagacaugggugaguuucaaaaacuccagcaucaaagaugcaggcacaggaguucaacuuuggggcuuuggguuuccaguggcuuaaauaaguuguguuuuggcacuuauuuucuguuuuaauuucuuagcauuuaacuguauuaaccccuucucugcugugcugagcauacugcuucacugccaacgaauccuggcaguacauguggugucuuccagaccuuuggaaaaugcacacagguuggcuaugaucauguggcuucuuaccccucacuuccuuguccucucuccuuuccccgaucuuaaggcccugauuauggucagguugugugggaccccuuguucugcuggaggcaacuugaauauugacuaagcuacaaaugcauuaaguacuugcuucccugauacaaacuucaaagcauguuuugcaucaguaggauguggaggaauggggaaaauuggacucagacuuggcagugccuauaguggacauuccagguucagaaaaugaaaauacaguucacagugguuuuaccaugcggaauagauauggauuguaugugcuuguguaugcuuguguguacggaugcaugugagcacacacauauaggacaacauuucuaguaucauggacuuacccuuaaucccagauauaacaaggaggcuucuaucuaaaggcuuuuguuaaguugucugagaccugaggguuuuucuauguuccacaacuauggaagauguaaaauucugcuguccagcagugccuguucagaguaagguguguggggcauaagggucuuugccuagguaagaugcugcagagauagguacuuauugcucacauguggggaagauaaaaguagcaacuugaacacauccugaaggagaggagauucaguuuuccuguguguucaccgugcaacuuuguaaccaguaaaaagauccacagaaguaguuuuucaauuagaaacugaacuguuguuaaccuuggcuuuuuucaucucaagucacugagggaacuguuacaaguauauauguaggcaggauaguuaagaggguggcgucuuagacuacugguccaaacaaccagguuuggaucucagcucagucucuaaggaacucugcaaaauuaggcaugucaccaugaaucaccauuucaucaucugguagacaggggcaacaauaacuguuuugucuacuuucaggguggaagaucaaguaauaaggauguggcagcccugucaguguagagaaguccuauaaacccuguaaauucugaugacaacgacuacucugcaccagugcauaucuaggcuaacccuuccucuuugcaagguugucuuugugcauaccuuguauguaagaaacauuugaucucguaaauguagcaagaugggaaaaagucacuuccugcucuggacccaggaacccuaucuaacauucauguggcugauuaaauagguuguucuuucaaaacagaggaggaguguaaguugaauuacuuccucaggggauaaggcccugaagagauaaagacaggaagagagaaaaugaccagaggagcauguucuuguaauggaggcugaaugaucucccccagaggauguggauguggguggguaagcaauacauggacuagggauacaggacagaauagccacugucucugcaaucacucaguaacacaguaucugagaccaugugaauuuucagccauuucugaccaggcaguggaaugcuauugcuucugauguggaaugcuguucaacccuugcaauagaccagucaaaucauagaguuuggaauugaaaggaacauuggaacguaucugagguggaguucuguguggugucacaugccuuuaacaccauaggaaacugagaugggagaaucauuagaaaaggcuagcuagacaacauagagagacucugauuccaaaagaaguugucugaaccaacuuucaaugcagaauucauuucucugacuaagauaaauauacauaugucucugcuuaaucgccuccagaaacaggcagcuuauuaccucaaccagaaaaucucuuaggauuggaacugagcaagacuauuggguccggugauaccugagcaaaaggguuaugggcuguggaauagcuuggcaaggagacacuucacaugagucuuuggaauagcaacggaacugagaaagccagagagccauagugaauauuuuucugcucaguaacaaugccaucagugaacagcaagacaccugguuccucgagcuuuuugucaucugagaacagcagccguuacccuggcaaccagacugugcaucuuagaugcuucccucuaagaguggcuugaaaguacaaaauguggaggcagagcagaggcugagaauucuacuagguaccugaggacuaucuggaugccaucaaaggcaccacaagaaagcuaagacuuaagaagaaagcagguuuagaccaguacauuaaaggacucuuccuagagacgcugacugaagugaucaagggcagccuucaccacgccacuucuuaccuugcucugccuagcuagaagcucuugaaagacuagagagauuaagcaauuugcccugcuuugaggggcuuuaccuuagcccugagccaggaccccaagaaaccuagucaacaauaagguccccucagagcugucugaguagugguaucuuuaacccagaaaagagcauaggaacuguaauaucuucaggucccaguccagccagugacaucuucccuguuguuuguuuguuugcuuguuuguuuguuugcuuguuuguuuguuuaguguguaugagagagggggaggagaggggggagggaagaagggaaggggggagagagggagggaagaagggagagagagggagggagggagaagaaaggagggagagagggagggaaagagcucggagaaagagaaagggagggagggaaagagcuuggagagagagggagggaaauagggagagagagagagggagggagggagggagggagagagagagagagacagagagagagagagagggagggagggagggagggagggagggagggagacagagagagagagagagagagagagagagagagagagagagagagauuuauacccuugaaaaucauuccuccgauauaguucuuuuguuuugaaggaaaacaaaaccacaaauaaucaucuugguucauagaaauuugggucuagaaaagaucaagccaggacugugaccugauaaggcaagguccuaagucccaagcucugccaugcaaggcuuugaaaaagagucaguggcaucccagggaagagagugggauucuacaagucaccuucacacuuuaaccaaggaaagaggggaucugguagcauaaaguacagcuacacuugucgcuagugacagauuguucuucauuuccucacaacuggacaagguugagacaauguuccaggaacagauuuuaacaaucacccuuguauuuuggccuccaaauguuugcacaugaauugguauuucucuccgcccccucucuguaugucucuguauauguguuucugucuaucugaaaaagaacauagaaaguaagguaguccagaugcugucccugaaggugguggugguagugguggugguaguaguacuagucaccauaaguaguagcagcagugauacuaauaccugccuaauaaggcagugggaguucuuguuuauuuaaccuuguccauaugacuugacuaucaagcaggcuugacuccccagaccuuggugccuuuagaacccauuugagcucuugaaugugguauaagugcuaauaucauacaggaaacacaaagucaugggcaggcuuugucuuaauaagaugaggccagaagcaaagucuuugugucucugucacugccugauaauuguuuuacuuguagaacucacacccacucaucaacaucuagcccuagugccagucacagcuacucuaguaucuuggccauuugaauggcuauaggcccugaucaaggcagccucuguucauagguugagguuaagggguggauucugggaggaggggaaaacugcagugcagauucgagacuuagggagaugggaccaguuucucacucaaagaacuugccuguuguuuccuucuauuguauagggcucuucuaucucucccuuugucagcuggauucaagagacaagcugggaauugugugggguacaauuggucucuuucuaccauuucuuucuaugaaagcccuuccucucuucccuuugaugaguuuccagauucgcacugaauuuccaucauggaacugguucuugaggugugcccagggcaugggaauggagggagggcuguagagcacuuggcuccugcuuaaagagacagcaucaggaucaggagagucagugggaugggccuuaaucugagacucacaauaguacuguugaucuccaacugagaacauugaugagaagaguucuauuacagauugguuacacuuggggggugguaaagagaugaaaauaaccaguucugaacugaugucuuugauuauauuuugaccacaggauuugguaacauccauuuuaacacuagauaauagguagcucugguuuucaauuuaagaaauaaauuuguucucccaaacaaaaugggaaguuuucugagacaagcaauugggcuccuaauuucuuuguuucuugcaacaucuuuguuaugaguaauguguuuaaucuuuguucgcaagccauucaaacacaaaggaaaagaaagcauuagaaaaggucauuaguuuucucugugaucacgcauuaaaaugagacauuuaaaucucauugaguagcauuagcauuauguaauucuuuuauacugacgccaucacaucacaguuuauacuuagcugggaaaugacagaaugccuuuuaacauucaaaacccuguugagccugagguauuccgaaacagagagcuuauaguuuuagacuguuguucccaaguucauuucuuggacucugaaaaaucgaagugaacccaauggacuuuuaaucaguaugcuuugacugucgacuacuuugaugaaaggacaaucucuguauguucugaguuuuccuguuagaauucacauuuugacuuuugcuugggcagacuagcugagauuuugcacuucuguugaacuuaaaugcccuuaaaacaaacauuuuaucugaauuuugaggaauuuagcaucggaugcuugucuugauauuguucaacuaucuuauagccugucuuauagauuuaucuaagggcauuuguguuagaguucacguuagagaugcagcaaagucuauacccugguuucuugcuuugaacaucaguagagcagaaagggaauguuaaauuauuauccgagcucuaauagaauagauaagaauguguguuuaaaaagguaucggguggugauuuagaguugcuuccaaaguucugucacccaguaaaaacaccaaagcuuagauuuuucugguuauuuugaugaccaccaaugauuauauguuuaagaugauaaaccauuccuuguccauuucauuacuugaugagaagauagaaaccauccuuaguguagaugauauagaaggacagcagcaaaaaugcugagcugauuucucuguuugccuggccauaccugccucaccauuagaccaucccauggugaaaaugcuggggugagugaaugggaauagagugaccacuugcuaagguagauggaucuucuuauccugggcuaaauaaacaguucugccauuguuuacuggaucuaacccccuccccacccccaggccugcagggccuugcagaauaccaaugaggcuccugagaucucaagagaaaacaaggcuucuuugucuggggaaguuauggagggcuguguccaaggcuugacccuuugcugggaagagagagggaacaguggggucacugaccuccccucccccaccccagacuucagagaccuucuuuacuagaagagucuaagaguuggaggguggagaggaguuaaaagggcagagaaugaagauaggaguccuguuuacuucccagcacauuuucuggacuuacaggauacauuuaguaucuuacccuaaugauaaaaaagaagagcaauuucuggagugucuccacaaagacagugaucaguuucagcuguuuccuuuuucucuucuggacacaugucuguauuauacacauuuguauacaugcaggcacauacauacuuuugcuugggcuuuugagcuccaucucuaaugccagugcauguacaaguaucuucaaagaagacacucucugaagaccagggaaaggcugcccuuucaaugaaugguggguaguaguacucacuuauucuauggcucugauaaaaaaaauugccucuaucccaacuuuaccaugauacacauaguuugaucuuuuaacaucuguugacauuucucaggguagcauuugggguuuuaauaaaaacugagcucauauuaagggaauaaagcaguggauuucuaucccccuaguacccuauuguagaucauugaacuuggcuuggagaaauacaugaauauaaaagugcaaacuuuugggaauuguuuuuauccgauaaggagauaaagaauuacaacauacuuaucacaaaguacuauccuugggcauaguuucugauuauuugcauguacaugaucuguaggaauagauguauaaaaaacaagcagccaauacauacauguguguauauaauacauucuaagcaugugugcauauauauuauauauuacauauguauaugcauauauuugaauauauuguaucuauaugcacugauauaucuauauaugcacauauauccggugcuaguuucugucuucucuggguugcucucuucugucuagaauaggaaggauuuugcauuccuugcaacaaguuuacauuaugugaaauacucuuucuguucaaauugugucugaaaauauuaacaccuaugguuaguacucauuucaucuggaauuccaaguauauuuacccucuguagccaauuacucuauuuccugcaauuauacaucuacuucacuuauuauuccuuaguaaacuaaauauucuaaucugguaaaguuuguaccuuuucuguuucuauaucccauguacaacucaauaguuguugaauaauuaaaccuagucaacagacuaaaacaguuaguguuguacccugaguccacaggaaaccuagacgaacccaaauaucgugaagucugcugcaauucgcaaaagucuuuuauuguuucaaguucgaacucaguucauccaccuagcacucacugugugaaugcuggcaaguaagccugagucgggaaaacacuggguuuauauacacuauaguuagaaauagugugacuauuuacagaaaaggggaguagacgaugggaugguacugaagcgggaggggguguuaaugagugucuguuuaaggacuaauuuuauggcuagucguuacugucugagaccagaccucuguuuaccuuuuacuuuucccauggucucccuugagcuuguuauuucucuaaggucucaaggacaggcacuuggagaguuaucaggaggaguguuggguguugguuuuuggagacacacagguugggagaaugucuugagcuaggggagguagagggagcccugggcugccaaaacagcugucuguauaucaugcuugccucugggguggggaugcgggugggggaaggaugggagccucugguggggaaugcagaggcaaacuguccauacaauucugaagucucucuaauaucaguaauucgugguuacaauauaagaaaaagagggacucaucaccucuuuguauuacuacuugaauuauuugagucuuuuauaaaacccauacauucugaguauuguaggcaaggguucauuuuuaagaaugggacagcugggacaaaguaagcauucuggaucaggcucaucuuccaaaagcuaaaaccuguagauucuucuuuauaacucccaaaauaaccacacucugugcuugguaacaugggcugcuuggcccagcaguauagugugaguggaugaguuaccucguaugcguaccugacuuucuccuucuucuuccccaggcuuguuagaguguugugcuagaugucugguaggggcccccuuugcuucccugguggccacuggauuguguuucuuuggaguggcacuguucuguggauguggacaugaagcucucacugguacagaaaagcuaauugagaccuauuucuccaaaaacuaccaggacuaugaguaucucauuaauguguaaguacgucuucaccccaccuccagacucaucucuuuuccccuccccucccccucccccugucuuggagguacaaagcucaugagcacggagcaagacagcaucccugacauagcccucaguguucagguucuaccaugucauguuggaagcucuacguaaggggacaauguccgauuuagaauggacgccugccuccucucacuccucucuguuuucucacacauggccugauuucugcuaaguagguuaaauauugccugaauuuucuccacaauggcagguagcggucuaaugacugggcagaguggaaucccugguuuuggucucacacucugcuuauguguacucaggcuuaguaauaaguccguucugcuucuagagcaagucgggcuacucucccuucaugcaucucucaguuugucuaugaagcagcaccucugaagggucaaaaagaagcagcaagcuuggcucucuaggacgcaggguaacaagggauauggggagaagcuaugcucuuggccaccugcugugugacuucauuuacuucagugaggaaaggugaaggaacacaugaaauaccuaguuauuccucucaagaaccccuagccacccaggcaugugccuuacuaacugacaagaagaguggugcucucugaauaagguuaucuggauuuucugucuguccaugcaggauucaugcuuuccaguaugucaucuauggaacugccucuuucuucuuccuuuauggggcccuccugcuggcugagggcuucuacaccaccggcgcugucaggcagaucuuuggcgacuacaagaccaccaucugcggcaagggccugagcgcaacgguaacagggggccagaaggggagggguuccagaggccaacaucaagcucauucuuuggagcgggugugucauuguuugggaaaauggcuaggacaucccgacaaggugaucauccucaggauuuuguggcaauaacaaggggugggggacaauugggcgugagucuguagccucauccccacccaagguuggguccucuccugaggccuagcuuuugagugaggaagcgauggcuacagccgaacgcuauggucaggaagaacguggugccuggccggcuuagccucaccuuucgaagguucccuggaaauuuucaucuuaaacggaaaagcaucaauuuuauaggaugcuuuguucaauaagaccauuucuaaccaaucuguugguaucccuuuacuuuguuccuagcaaggaaaacaagagugggcccacacuguacaagaaucuuaaaugcuaguuauggaauggagacuuaaacacauaaccucaaauguaugguggaucauagaaauucaagaauugacuccaagucccaggauucugggauucuaugcuauuagggggucccagagagacuuaggcuagaucugcauauuucaugcuuaucuuagcuguguuuuagaaagacauacauuguuuuucagucucuagacuuaaagaucuuugggggucugaauauguguguguuguggagaugacuuuuugugaccagcaguuagcuuagaaugguuuuagaucugaaauuuaaaucuccuauuggcguuguucagugacuggggaacaaaaauccuguggcaaagaacaucuuguaagcucagccuaaggcaaaaauggcacaacuuucuuucaggacuuuuuucuuuuuuacuuuuuuacaccuucucugcccuccaaauuccuugaagcccccucuaacccagggauccgccucacuccaacucccacccacuuccccuacccuccaucacacuuggggcaaguuaucugagagauacugccaaugacacuucacaaaagugcccugcucacuaaugucauuuaagggagaugccuggaauuugacuucauuggcacaugccacuccagcaucuuccaguuuuuguuucaaggucugcaaguugaugcugauuuuuaaccacuccaugucaauuguuuuaguuugugggcaucaccuaugcccugacuguuguauggcuccugguguuugccugcucggcuguaccuguguacauuuacuucaauaccuggaccaccugucagucuauugccuucccuagcaagaccucugccaguauaggcagucucugcgcugaugccagaauguauggugaguugaaugugggaucuuuagauucccuagcaucuauagaagcaauguguacuuguuuuugucuuagggugaggaggauggugauuaugaaauuauuguaaugaugaauaaaugcuucuuaguuuaguaaguucuuuccacugaaacuaaggaugcucucccugaaaggaaacauggaaauuuggggauguuuuuauuucuccuccuccuccuccuccuccuccucuuccuccuccuccuccuccuccuccuccuccucuuccuccuccuccuccuccucuccuucuccuccuucuccuucuccuucuccuucuccuucuccuccuccuccuccuccuccuccuccuccuccucuccuucuccuccuucuccuucuccuucuccuucuccuccuccuccuccuccuccuccuccuccucuccuucuccuccuucuccuccuccuccuccuccuccuccuucuuccuucuuggcuguucucacuuuuucuccgauugacugauauuaacaacgcaaagcagcacauuucaauaauauaaaacuucacaauuagucaauagcaccuuuguucuauguaacuuuuuagaaaaaaagaugaugcauacugucaauaucagguuuacagccaggauagagaagguagaaagcuauguagaacgucuccgcauggccucuagccuuaugaaguuuacucuggcugcuuuuauguaucuuagguguucucccauggaaugcuuucccuggcaagguuuguggcuccaaccuucuguccaucugcaaaacagcugagguaagugaaugagaagagugcuuuuuaaaaaauagauuggcuagacauggaggaauuucuaccuauaauagaaguuucuccuuaugaacuuaaguuuuaaggauuauauuauuuccuuauuggacuuuguauuagcagauuucccuucuacaaaauaauggugaaauguacuugaaucaaugagcauacuuauuaaaagucaaaguacuuauuaaccccagagcugcacuagaagucuuccuuucccaaacuccucucauuaaaagaaacauguguagcuuuaaguaaagauaauacuuagcaguaaaauuucccaaaugaaaauuuucauuuugguuaaaaacguaccaagaaaaugggacaugcacagagacacacaugggcucuauaaaaugcuuuuaauuuggaacuccuuaauuuccaaugagaggugaaauaaguauauuugaaaagaaaagaaaagaaaagaaaagaaaagaaaagagaagaaagagcuucauugaggacagacgcaugccaccgcagccagggaauaagaagcaaaucuuggggaggaagucugaaaccgucuuucaagggaaaguauuggcuuugaccuuugggcuccagguuccaacuguaggaaaugaguucauuaugugggaucauuaaucacuuuucugcaucuucgagaugcugugggggugagguacuaugauaguagcaaaugggagguugacacuuagggaagugaacauuuaguuagagacacagaaucaacauacaggaaugggugucagcccauccagacagccguguucacuguuuacaguggauugugcuugcuuuucuguucuaagaaauaauucucucucauacaucuucuugcaguuccaaaugaccuuccaccuguuuauugcugcguuugugggugcugcggccacacuaguuucccugguaaguuauuuuaagauaauauuagaaaagaagugguccagggauagcauuaggccgaaagacuagcagagagacuccuuacagccuugaaaggcuguaggcaagcugugagaaggcacagcaaggugugggguuacacaucucugccgugaguugucaagcauugaccagggcauggcacuguaaacaugaucuacuguauccuaggguucuagauaguauaaaugcucucgguagucucuggugggaaacaggagggacucgucauauuagaauuguucugacuaugaugcaguccuguggcccagguccuucagguaguguuaauguagugccaaugcagugugcuccuugugcagaggugaagccuuaggugccagugugcaaggugauguaucuaccucagaucucugagguagcacuuaacuacaaggaggagcucacagaauccuccucaguacggcagagggguucacaaaaagccagcacacuugcacuuugugaaaucaguugauuauaagagaguggagggcuauggugcaugaaguagcugugugugugcagcacaugcauagccaauguccuucaggaaaggucagugguuagcagaacuuagcuguggaauacauuguauggauauguuaguuaggaaugggcuauuguggaaaugucuaacagaagauuucuguucacaaauauagacaaaaaauagggacguguuuuuaauuuuuauuuauuuauuuuuuugcagauagacuauuuccuuuuauuuaauugugauuuugcuucagcucucccucauucccaaaagguuuugaguaagagagagcuucucuucuuacugucacuuaccuucuuuucucuguucccuacagcucaccuucaugauugcugccacuuacaacuucgccguccuuaaacucaugggccgaggcaccaaguucugagcucccauagaaacuccccuuugucuaauagcaaggcucuaaccacacagccuacaguguuguguuuuaacucugccuuugccacugauuggcccucuucuuacuugaugaguauaacaagaaaggagagucuugcagugauuaaucucucucuguggacucucccucuuaguaccucuuuuagucauuuugcuccacagcaggcuccugcuagaaaugggggaugccugagaaggugacuccccagcugcaagucgcagaggagugaaagcucuaauugauuuugcaagcaucuccugaagaccaggaugugcuuccuucucaaagggcacuuccaacugaggagagcagaacggaaagguucucagguagagagcagaaaugucccuggucuucuugccaucaguaggagucaaauacauucucuuugaugcacaaaaccaagaacucacucuuaccuuccuguuuccacugaagacagaagaaaauaaaaagaaugcuagcagagcaauauagcauuugcccaaaucugccuccugcagcugggagaagggugucaaagcaaggaucuuucgcccuuagaaagagagcucugacgccaguggcaauggacuauuuaagcccuaacucagccaaccuuccuuacggcaauuagggagcacagugccuguauagacaaagcggggcggagggggggggcaucaucuguccuuauagcucauuaggaagagaaacaguguugucaggaucaucucacucccuucuccuugauaacagcuaccaugacaaccuugugguuuccaaggagcugagaauagaaaggaacuagcuuauuugaaauaagacugugaccuaaggagcaucaguugguggaugcuaaagguguaauuugaaauggccuucggguaaaugcaagauacuuaacucuuuggauagcauguguucuucccccaccccuauccgcuaguucuggccccuggccucuggcauaauaucuucacaauggugcuuuuuuuccugggguuuuauccauucacucauagcaggugauuagacgaucuugauuaguuucauauuucccaauuguuuaucucuuguuuggaguuguaucagaaagaccuggaggaugauucuuugagcauaguucuuuuugaaaacaagaaagagaaacugggcagaaagcaucacaaaaauauuugaaauuguacggucccaugaaauuauugggaauucccccaaguagucuaccauuuguagaacuaggcuugauaaauuugaaccucaauuugaauaauuggucugguauuuucuuuucuaauaaaugacagaugauuuuacuugcuaauauuaucucagcauuuugauaauuuaggcuuaccauagaaguuacugucucuugguauauauaggucacauaauagauucugccagcuguuagcuguucaguucauaagcuuccauagagcucuggagccgcagagaggacaggcagaauuugaaaccuaaagaacucccagauuucaggcuuauccuguauuuguuaacuuugggugaaagaaagaaagaaagaaagaaagaaagaaagaaagaaagaaagaaagaaagaaagaaagaaagaaagaaagaaagaaagaaagaaagaaaaagaaaggaaggaaggaaggaaggaagaaagaaagaaagaaagaaagaaagaaagaaagaaagaaagaaagaaagaaagaaagaaagagaaaaaaaaagccccugaucgaauuuccuggaggaaaaguuauuguagcuguuucauuguagauuugugcugucauuccccaaagugcuuucugcuguguugaaagagauauaagaauuuacaagaagacacuugagacuuguucuugggccaauauauaagguaaacaagcaggaugcacaagagugaggagagcuaaaaggacauguaagaaaccaaucaagaucaaggaaggugaaauaaucuauaucuuuuauuuuguuuugguuuaauauaacagauaaccaaccauucccuuaaaaaucucacaugcacacacacacacacacacacacacacguacaaagagaguuaaucaacugcaaguguuuccuucauuucugauagagaauuuugauuuuaacaacauaaaggauaaacuuuuagaaacucaucuuacaaaauguauuuuauaaaauuaaagaaaauaaaauuaagaauguucucaaucaaacaucguguccuuugagugaauuguucuauuugaccucaauaacagguacuuaauuauaguuagcucgaggugcucauguaucuuucaggccauguaaguuauucuuauacuacuucuaugaaaaauguaauagauaaugcauuauuauuauuauuguuucuuuuuuauacuaaagauaugaaaaaauauaugcaaaaugcaaaacaauuaccgaaagaaacucaguaaauacuugucucaaauugag

SEQ ID NO: 9753 - RNA, 21889 nt, Mus musculus
aggggcgggacccguggcagaguuaaucaguuggucacugcacuccugagcacaguccugauccagagguaacuguggacauaacugcuggccugaagggagccuuggaaccggcaggugaguaucuccccuggcauuugcgggaccaagcacaguggcgacugcuagugcuugcucuaucgucuuuguguuuucaggcagaccaagcugucugcucacccgaguuuacagauuucccuguuucuagccggugcagagcauaguccugguaguggugguggugguggugaugguggugguguccccacccugggagguucagagggaccagcagcuucgaggaguuagugaaggcuggaaguaggguuugguugggugggaaagggacuuuuaggguugugguucucgccccucugucccgcccugugguuacaaaguugugaaucccaguuuuucuggcuuucagcauaaaagagggccuucggguauccuugauugaaugacauuguguuuggccauguggaagcuuugaagauaacgauucuccacuauacuuugguuaacagauuguguccugccccacuggggugauacagaagauuucugccuucugaccuuuggggucuuuuccuauuguuccuuuccugauccacuugugaaauucagaagaugccagggauggcuccauguguaccuugcuuuccuaccuaguaacagugaaaacugugaaguagaacuuaacucucuuuggcuuacuugacucugcuaaaguucugagucucaaccuguuuaucuuccccccccccccuuacauguuuauuaaggcuacaagaagauauugugugagacuuguauucgccuuucauuccuacucuaaugguuaauauaccagcuuucaucauccuuuagaagucaguacaguguuguuugacauuuuuucugcaugaugcucaccaccauucccaaauacccuaaaaguaacugccuagaaggugaaaaugcucagauagucccucacgucuucccuagucaaaucuagcccuuauuugcucuucuauucuuaucugcuaauuuuugucauuucuauuuugccuuugcugggaauuuuaaagugagccacacccccacgucuccacagccaguuucuagaguaucuugcuuucuugaacaucuuugucugcugucauuuacuuucaccagaaaugagcuaaugcauugcaaucagaagacucuaagacaaacaugacuuucuaagauccguuguuuuggaaaacagcaugcaaaacauucacugauaguaaaugaauguuuuuacugugacucuuaaucugaucaugguucuagugggcaacuuuguuuugucuuucuuauagacaagaugagcgauaaaccagacuugucagaaguugaaacguuugacaaaucaaaguugaagaaaacuaauacugaaguaaaaaauacucuuccgucgaaugaaaguaagucaugggguuucuaguagggaaaguugcuguagucagucaacaaaccuauguuauguucuuuuacaguuuucaugaguaaauaauaucuuaccagacuuaauaguuuaaaauauccaguagcugauucuguuacuggggauauguaagugcuuccugcauaacaaacaucaguaguauaaagaaacaaaagcuauuuucuguugaaaauuaugaaacucacauuaaaauuaaccuugaaauaauugacaaaaaaaaaaaagccaaccaaacaacaacaaccaaaacccagggauauacacuuguaaucgugguguuugcugccuugacaagguugagugugaucuugucccccuaguggacugugccagugcuucugaccuuuuguaaauggagugacuucagaucucgaauaugcuugcugcccccagacgcagagguuugcugcuguuccccagauuuucagcuuccuggagaauaucacucacaaaugcugugccaugcuuugcccucuguuacaccaaaauuaucagacaguuccaaaaagcagacaaaacuguuugaaaauaucccuuucccuauuggagugugguagauauauuguuauggaguacuuaauuugccauuuagugucaaauaguggcagcagcauacacguaccuuaaguggaauauaaaaccuauaguugauucagauucuaauggauauuaaaaggguugcuauguacucucacauagcacuuggugaggauuugugggugcuaccuuacauaguauuuugaaauuaaagcauguaugaggccaucugaagauuuagcacagaauucuuuuuaauggugcagguuucaaauaccaggccuuaguucacaguagcuaagccuuguacaaacucuaggaagacacuagacauuagaaaaauucucugcuaaugauauauagguauauauauguauauauguauauguauauauauugguuuuuccagacaggguuucucuguguagcccuugcuguccuggaaguaacucuguagaccaaggcuggcaucaaacucagaaauccaccugucucugaucugaaugcugagauuaaaggugugugccaccaaugccaggcucccuaaugauauauucauguuucucuuuuuuacaccuagcuauccagcaagagaaagaacauaaugaaagaacauaaaaugauacucuccuuucaagagcaacaucaauauugccugacagucaugccucuaggcuuguuucuauaacccuaugcaauauauagacauguuaggcagcuccugguagauccauuuacuacccuggcugcaaaggucagcauuugcuaugaaucauuaaauuuuuuugguacugcucacugguguguaacuuccuuguccgcacucuuuuguuggccuuggugcauguagguuuuucauuugcuuugcaaggcaagacaauuuuaaccuacagugggugccucaguugcuuuaucaucuuugugacauuacauacuuucacagcgccuugggcuuauuuucauuucgacugugacauuaaaucauagucccaaacuucccaugguacacucuuuguagccuaagggauaaaauuacacaaggguacuuguuuccaauaaacaugguuggaagaaaaccucuugagcagauugcacaugugugaaaugugaggcagugauacugagugaugccuuccuuuuaaaaugaaagaauggcaacauagagccuaaauugaugacuaugggauggaaaagauuaccaugcauccuuaaaaguguuucucaacuuaguggaaacacccaaaccuggaguuggauggggagggagcagaagacacuugauaaaagauucuguaaguaaagacaacagaaucuucuacugagcgugcacugagaauguaaccucugcagaugacaaauuaguucaucucuguucugguccuugcacugaauagaguuuacugucuuuuuuuuuuauuagguauuuuccucauuuacguuuucaaugcuaucccaaagguccaccauacccaccccccccaauccccuacccacccacugccccuuuuuggcccgggcguuccccuguacuggggcauauaaaguuugcaaguccaaugggccucucuuugcagugaugaccgacuaggccaucuuuugauacauaugcagcuaaagacaagagcucccggguacugguuaguuuauauuguuguuccaccuauaggguugcaguucccuuuagcuccuuggguaauuucucuagcuccuccauuaggggccgugugacccauccaauaacugacugugaucauccacuucuguguuugcuaggccccggcauagucucacaagagagagcuauaucuggguccuuucagcaaaaucuugcuuguguaugcaauggugucagcauuuggaaacugauuaugggauagaucccugcauauggcaaucauuagaugguccauccuuucgucacagcuccaaauuuugucucuguaacuccuucuauggguguuuuguucccauuucuaagaaaggguaaaguguccacacuuuggucuucauucuucuugaauuucaugcauuuggcaauuuguaucuuauaucuuggguauccuaaguuucugggcuaauauccacuuaucagugaguacauauugugugaguuccuuugugauuggguuacuucacucaggaugauaccguccagguccauccauuugccuagaaauuucauaaauucauuuuuuaauagcuaaguaguauuccauuguguaaauguaccacauuuucuguauccauuccucuguugaggggcaucugaguucuuuccagcuucuggcuauuauaaauaaggcugcuaugaacauaguggagcauguguucuucuuaccgguugggacaucuucuggauauaugcccaggagagguauugcgggauccuccgguaguacuauguccaauuuucugaggaaccgccagacugauuuccagagugguuguacaagcuugcaaucccaccaacaauggaggaguguuccccuuucuccacauccucgucagcaucugcugucaccugaguuuuugaucuuagccauucugacuggagugaaguggaaucucaguguuguuuuuauuugcauuucccugaugauuuaggauguugaacauuuuuucaggugcuucucugccauucgguauuccucaggugagaaauuuguucagcucugagccccauuuuuuaaugggguuauuugauuuucuggaguccaccuucuugaguucuuuuuauauauuggauauuaguccccuaucugauuugggauagguaaagauccuuugccaaucuuugguggccuuuuugucuuauugacggugucuuuugcuuugcagaagcuuugcaauuuuaugaggucccauuuaucgauucuugaucauauagcacaagccauugcuguucuauucaggacuuuuuccccuguacccauaucuucaaggcuuuuccccacuuucuccucuauaaguuucagugucucugguuuuauguggaguuccuuaauccacuuagauuugaccuucguacaaggagauaguaauggaucaauucgcauucuucuacaugauaaccaccaguugugccagcaccauuuguugaaaaugcuguuuuuuuuuccacuggaugguuauagcucccuugucaaagaucaagugaccauagguguguggauucaucucugggucuucaauucuguuccauuggucuacuugucugucacuauacuaguaccaugcaguuuugaucacaaucgcucuguaguacaguuuuaggucaggcauggugauuccaccagagguucuuuuauccuuaagaagaguuuuugcuauccuugguuuuuuguuauuccagaugaaucugccuauugcccuuucuaauucuuugaagaauugaguuggaauuuugauggggauugcauugaauuuguagauugcuuuuggcaagauggccauuuuuacaauguugauccugccaauccaugagcaugggagaucuuuccaucuucugagaucuucuuuaauuuauuucuuuagagucuugaaguucuuaucauacagaucuuucacuuccuuaguuagagucacaccaagguauuuuauauuauuugugacuauugagaaggguguuguuucccuaauuucuuucucagccuguuuauccuuuuuguacagaaaagccauugacuuguuugaguuaauuuuauauccagcuacuuuauugaagcuguuuaucaggcuuaggaguucucugguggaauuuuuagggucacuuauauauacuaucauaucaucugcaaaaagugauauuuugacuucuuccuuucuaauuuguauccccuugaucuccuuuuguugucuaauugcucuggcuaauacuucaaguacaauguugaauagguagggcaagaguggacagccuugucuagucccugauuuuagugggauugcuuccagcuucucaccauuuacuuugauguuggcuauugguuuacuguagauugcuuuuaucauguuuagguaugggccuugaauuccugaucuuuccaagacuuuuaucaugaauggauguuggauuuugccaaaugcuuucucagcaucuaacgagacgaucaugugguuuuugucuuugaguuuguuuauauacuggauuacauugauggauuuccguauauugaaccaucccugcaucccugggaugaaaccuacuuggucagaauggaugauuguuuugauguguucuuggauucgguuagcaagaacuuuauugaguauuuuugcaucgauauucauaagggaaaucggugugaaguucucuaucuuuguugggucuuuuugugguuuagguaucagaguaauuguggcuucauagaaugaguuggguagaguaccuuccguuucuauuuuguggaauaguuugugaagaacuggaauuaggucuucuuugaaggucugauagaacucugcacuaaacccuucugguccugggcuuuuuuuggcugggagacuauuaaugacugcuucuauuucuuuagggguuauaggacuguugagaucauuaaccugaucuugauuuagcuuugguaccugguaucugucuagaaacuuguccauuucauccagguuuuccgguuuuguugaguauagccuuuuguagaaggaucugaugguguuuuggauuucuucaggaucuguuguuaugucucccuuuucauuucugauuuuguuaauuaggaugcuuucccugugcccucuagugagucuggcuaaggguuuaucuaucuuguugauuuucucaaagaaccagcuccgugauuggaugauucuuugaauaguucuucuuguuuccacuugguugauuucaccccugaguuugauuauuuccugccuucuacuccucuugggugaauuugcuuccuuuucuucuagaacuuuuagguguguugucaagcugcuaaugugugcucucucuaguuucuuuuuagaggcacucagagcuaugaguuuuccucuuaggaaugcuuucauugugucccauaaguuugggaauguuguggcuucauuuucauuaaaguccaaaaaguccuuaauuucuuucuuuauuccuuccuugaccaagguaucauugagaagaguguuguucaguuuccacgugaauguuggcuuucuauuauuuauuuuguuauugaagaucagccuuaguccauggugaucugauaggaugcaugggacaauuucaauauuuuuguauauguugaggcuuguuuugugaccaauuauguggucaauuuuagagaaggucccauuaggugcggagaagaagcuauauccuuuuguuuuaggauaaaauguucuguagauaucuguuaaguccauuuguuucaucacuucuguuaguuucacugugucccuguuuaguuucuguuuccaugaucuguccauuggugaaagugguguguugaagucucccacuauuauugugugaggugcaaugugugcuuugagcuuuacuaaaguuucuuuaaugaauguggcugcccuuguauuuggagcauagauauucagaauugagaguuccucuuggaggauuuuaccuuugaugaguaugaagugccccuccuugucuuuuuggauuauuuuggguuggaagucaaucuuuucagauauuaggauggcuacuccagcuuguuucuucauaccauuugcuuggaaaauuguuuuccagccuuucauucugagguagugucuaucuuuuucucugagaugaguuuccuguaagcaucaaaauguugggucuuguuuguguagccagucuguuagucuaugucucuuuauuggggaguugaguccauugauauuaagagauauuaaggaaaaguaauuguugcuuccuguuauuuuuguuguuagaguuggcauucuguucuuguggcugucuuauuuuaguuuuguugagggauuaucuucuuguuuuuucuagggcuugguucccguccuuguauugguuuuuuucuguuauuauccuuugaagggcuggauucguggagagauaaugggugaauuuaguuuugucguggaauacuuugguuucuccaucuaugguaauugagaguuuggcuggguauaguagcccgggcuggaauuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucaugggcauuucuuucuuuagauuugggaaguuuucuucaauaauuuuguggaagauguuugcugguccuuugaguugaaaaucuucauucucauccacuccuauuauccguagguuuggucuccucauuguguucuggauuuccuggauguuuugaguuaggaucuuuuugcauuuuccauuuucuuugauuguugugccaauguucucuauguucugcaccugagauucucucuuccauuucuuuuauucuguugcugaugcuggcaucuaugguuccagauuucuuuccuaggguuucuaucuccagcauugccucacuuuggguuuucuuuauugugucuacuucccuuuuuaggucuaguaugguuuuguucauuuccaucaccuguuuggauguguuuuccuguuuuucuauaaggacuucuaucuguuugguuguguuuuccuguuuuucuuuaaggacuuguaacucuuuagcaguguucuccuguauuucuuuaagugaguuauuaaaguccuucuuuauguccucuaccaucaucaugagauaugcuuuuaaauccaggucuaccuuuucagguguguuagggugcccuggccugggcgaagugggcguucuggguucugaugauggugagugguccugguuucuguuaguaggauucuuacguuuaccuuucgccaucuggcaaucucuggaguuaguuguuauaguugucuuuguuuagagauuguuccucuggugauuuuguuacccucuaucagcagaugugggagacuugcucucuccucugaguuucaguggucagagcaaucucugcaggcaaggucuccucuuucagggaagaugcacaguuaucugguguuuggaccuccuccuggcugaagaugaaggcccaaaacaggaucuuucccagaagcuguguugcuuuggccaggaagguggcugguugucuggagucgaagauggugcugccucagaagcucucuggcucuugcuugucccagaaacugcuggccucuguauuccacccccuuacccgugcagccugcccucucuggagucccggaaccaagguggcuacugcggagccugaggcagaaaccucuggggccgggcggaccccugugcucucaccaggaagguggccgguugucuggagccgaagauggcgccgccucagaagcucucucuaucuuuuuuuuaaaaggcuguauauuugcgaccugaaacguuaacuuguuuuuuccuuucuauagauuuauaagaacuuacauguuuaaauugucacaacugaaaauaaagcaucaacagaucaaauaauaacaaaccccaaggagcccuuucgcuuucuggggacugaauauucaggaagauaauuacugguucaggccaaaucacuuucaguaaauaugagcugguagccuaggggcugaagggacuuugguugcugucacgucugccacagugaugaauaguuuccaaucacaaaacuuuauguaaaaaaguauagaguacugcucaaguuauaagggucuuuggaaagccaauguauggcuucccagaauccuggaauacccaagauacaauucacaaaccacaugaaacccaagaacgaggaagaccauaguguggcuacuucuauccaucuuagaagggaggaacaaaacacccauggaaggaguuacagagacaaaguguggaguagagacugaagaaaugaccuuguagagacugacucaccugggaauccaucccauuuacaaucaccaaacccagacacuauugugaaugccaacaaguacuugcugacaggagccugcuauagcugucuccugagagguagaaguggaugcacacaguaauccauuggacugagcacaggguccccaaugaaggagcuggagaaaguaugcagggagcuaaagggguuagcagccccauaggaggaacaauaauaugaacuaaccaguaaccccgggguucccagggacuaaaccacuaaccaaagagcacacauggugggacucaugacuccagcugcauauguagcagaggauggccuagucagacaucagugggaggagaggcccuuuguccuaugaaggcuguaugccccagugugggggaaugccagggccaggaagugggagugggugagauggggaucagggagagaggauagggcuagggugcuuuugagaggggaacccaggcaaggguauaauauuugaaauguagauaaagaaaauauccaauaaaauaauaggaaaagcaaugaaaagauuggugggcaguguguaucauuauugugaagcugugggacguuuaaaagaugcagguuuguagaagucguucaggaauugagaguguguccuugccauaccagauuccugucagcaagugccucuuggcaacagcaacaguaucuggguguggugucugcagaugagauggauccccacgugaggugguccuggaauggcccuuccuacaauuucugauccauuuuauuauuuuuuuucuuucccugucuacccauuggacaggaacuguucuggguuaaaaacuuugagauggguugguggccccaucgcuugaccaggggccaugccugucuacuguagguggucuuuacagguuuuauuccucuucacuacacauuucagguaacgucgucccagguggguccugggaaacucuggcagucugggacccuccaguggcugucaucaguuccucauccaccacuucuauguauuuuuauuugauuuccugaccuucucuaucucucuccuguccccucaaguaccugauacugcccccuuaauuccucccucugcucucucccucucaggccucccucccuccaccuccugcaaucauccuguucgcuccucaaugcaggucuaaggcauccacacccuggucuucuuuccuccuaagcuccaccuggucuguggguuguaucaugggcauugugagcuuuggguuaauauccacuuaucagugaguucauaucacguguguucuuuagugucuggguuaccucacuuaggaugauauuucuguuuucauccauaggaagaauaauaucaacuaccuggacccccuaguacucccagggucuagacaaccaagcaaggaguguauaggaaggggcagguggcuccagauacauauguaguauggauggccuugccugacaucauugggagggaggcccuugguccuguggagguuugaugcccaguguagggggaugcuggaguggugaggcagaagaggaugggggagagcacucucauagagcuaaaguggagcugggagaaggcagauuugggaugggggguuauggacgaguaacugggaagcaggauaccauuuaagauguaaauaaauagaaugauuaauaaaaaaggaaaaagaaauuagaaaaaaaggaaugugcccuugaaagacacauuagcaucugggccacuccucuucacuuuuuuauucucaucuuugugcucuaagguuuaaguuagugaccacccuagaaugagcggcuuucaccauauauuccuaccaugauauauugccuugguacagccuguaagacagcagaacugagacauauuggaaaccucuacaaacccaaccaaaacaaacaacaacguuguugcaagcuauacuaugcagucagauguuaauuacguaggcuccugacaugggagcaaugccaccauguuguguccuucacuacuacuagcauugguggaggcugauccauucuucuccugacaugggagcaaugccaccauguuguguccuucacuacuacuagcauugguggaggcugauccguucuucuugccacauuuucuaaagagggucucauuucccaagagcuccugaagaugaccuggaaaacaucaaauagaagacaaggcacuucugcuacuauuguugccacugccaucccagacaaaaaaaguuuuguuucacaugucacaaaggcacugaggcuucagccuuucccaaaggacuugaaauaucacagccucauuuucgaagaguauucuuuucuuuucuugaaauaugucuuuaauugaagaagugcaucccucuuuccuccuucccucucuuuaaccccuccccagcuacggugccuugaacuucuauacauccauugggcuuauauacaugauugaacuguaggcaagccuuuaaaacauuuuuuaagugcauaaugacugaugggggagggcccaguucauugugggugguaccaucccugcacuggugguacucgguucuauaagaaagcaggcugagaauaccaguaaacagcaauucuucaugaccucugcaucagcuccugccuccagauuccugcucuguuugaguuccuguccugacuuccucugaugaugaacagugauauggaaguauaagcugaauaaacucuuucauccccaaguugcuuuggucaugguauuucaucacagcaauaauaacccuaaguaagacaaguugguuccagggaguggaaccaaggagaauauugcugugacagacaagaccaugucuugggggagaauuguggaaggacauugggauuuggaguuagaaaagcuacugaguguugagaucucagugagcuguucugugggaucuugggagauagagauguugaacugcggacaaucaaaguguggcuugugaauucuccgagggaagcaaagacuuuacucaccuuuuucuaugaggaaucuguggugcuggucaucuggagcugaagaaucagcugugauuaacaagauaacagaacuacuaaagcaaaaccuuguguuuuugggacaauugaugcugguuagcuggaacuaagaaauuaguagugauuaagaagagaccauaaucacugaggugaaauaguuugggaagugauuccugaucaucagcauacagaagcugggcuccaaaagcagccaaguuugaaccucaagcuggcagcuggacuugguaauauguaagagucacccagguggcacucauuuugaaggcaugaaggcucaugagagcagguaaggcucagcacugugagaagccaagggaugucauuguugcucaguggcagcugguggcccaggauugaaguggucaugguaaagaaguugaggcucagccucauaaaaggagccuuugagaaccuuuuggucaaaguauagcuggguugcaacagaaggcccucuccuucccucccucccucccucccuccccccucccucccuccccccucccucccucccucccuccuuccccaccucccuccaucuccuucucucauucccuccugacaggguuucacugaguugcuuaggcaucuuuuggacuuaagaucaaaugaccucuuguggagccucccaaguagcucagaccacugcucugugcugccacauguaacucuuguuucuuucuugauuguaaguuuuccuuugugucuuggcccccaaguugcaucuaauaugacuaguccaugucuuaagauuuguuaagugugugcguguggggaguggguuucucauguuuucccacuuggccuugaaccugauauugugagacccccauuuagaguuuuucucccuggaagaagaagcucuuuguucucuauagccagcaaaaagcauuuuauuucuauacuuuacaacuagagaugcgaucauuguaaaagacccagccaggcacuugccuugcuuccugugcugaggacauggagauaaaaauucagaaagaacucacuccccaauccgucugacuuuuaaauuucaccaaggacacccagaagaaaaaaacucugcccagcuccucccaacucuucccaacccucuucccaacucuucacaaucccucagcucgcuguuaaaagcccccuaauugucacugcuuggugcaaacuacccugcccugcaaggcagaaagaguucauccucagcuagcugauaauauaaccucuugcaguuugcaucaggugugguuuucucucgagucauuggggugcuggccagcucaucccgggacuugagcagaggcccagcuucgagggucuuacaauauguaguugaggauggucuugaacgccuccuugauuugucuuuauuucccaaugauggguuacauauaugcaccauuaugggcaguuuauacggugauagggcuuaaacacaggacuucaugaacacuagggaagcauucugucaacugagcuauaugcccugauggugcuguuuugaugcuuccauauguagaacaugacuugugauucuggugugcagugaguaauagccagggacccugauaaacauccuucugugucuaaaacagacaguaagaauaaagaaugaucuugugccaaaugucaguagagcacaccaugaaaaacccugccguauucuguagcuauacauauaaaagguaaaacuugaaaauugccaggugcugagcaucauggcaugagggaacguccagaaaccacuguucuucccuuccuucagucacagaggaguaggguguugugcugagaaaacuauaguuugggaaggaagcuacagagguagaugggaggaaggucucacccccaaauuuacagcuaacuuugaaacaaagcuucacgccacaacuuuuuacuaccuuaaaacaaacaaacaaaccaaaacaauaacaacaacaacaacaacaaaaaaaaaacaaauguuuugauggggagaggguugaaucaguaaagggcuuguucugcaagcaugaggauccaagcgggaauugacaacauccacauaaaaugucaggcaugguggcacaugcauguaauccuaaagcugggacagcaacagcaagaggaccucuggaacucucuggucagguauucaugccacaaucguuagcuccagguucaaugagaucccugauuuaaaaaacaaaaaaaaauuuuuuugaagagcuguagaagaagagcaguaucaauuucuaacuucuacuaguauaccuguccaugcacauguaugcacaugcccacacacaucuacaccugcacaauacacauauacacaaauacuaacaaacacauagcacacacauaccaaaaaaauuuuggguuggaggcugugaaucugauuguagacuugguuggcacacacacaaggccuagcaucaagccauagcaaggcagaacauaguuugggaaagggagaaacaacuuacuuguucaguaggaaauaagauccacagcaccagcuaagcagaagacuaagguucaguucauagccucacaucaacgugacucaacugccuguaacuccaggggaucaagugucuuucuuuuagccucuguggguggguauauuaauacaugcauacagggacauuuucaaaaugcuaaguuuuguauuuaagaauugaagauaacagauuuccuuguuucuauguuuuuuuuaagauuuauuuuacuuauuuuauguauaugaguacacuguagcuguacagaugcuagugagccauucaugugguugcugggaauugaacucaggaccucugcucauuccugcccugcuugcuuuggucggcccugcucacucuggccccacucaguccggccuacauauuuauuauaucuaaguucacuguagcugucuucagacacaccagaagagggcaucagaucucauuacagaugguucugagccaccaugugguugcugggauuugaacucgggaccucuggaagagcagucagugcucuuaaucacugagccacaucucuccagcccauaucuaugauuuuuuuuuauuuuugguguggggugguuuuuggagacaggguuucucuguauagcccuggcuguccuggaacucacuuuguuaggagaacaauggcuucccuuugguucaggccugaaagggucagagcauguuuuaagacuaauuugugguagcuguuuaaauuuaagcuaauugcuuuacacacaacuuuuaaauguuuauguugaaauguuaaguuauggaauuaugaugauuuacaaccaaagcauggcacaauguaaaucaguucacauaaaaccuaaagaauauuggaaaauuacauagaccuaccauuuuuuccucuuaaauauucugaguaaaauuaacacuacaauaauuguuuuguuaauuuaaaagucauuauuaauauuucauuuugugaucauuagucauuuuuggcauauuugaaauguuccuuucaggacuugagaucaaugaaaucaagagcuaaugaacaacuauauugguuuaaagacauaauaaaucuagaguugaauaccaucauauaaaaauagguacaaguauacacaauaugauucagccauaaagaacuacgugucuacauacaggauucuguaggauauuuuucuaagaaugcaauuacagguuuguuggguguacacacuuucaguguaacugaaugcugccuaacauuuuaugcagcacacacagaguucuucccuuccaaucuguguucaacaguuccuguugcuccaccugcaggccagcagacggcacuaccugacauuaguuuuccaacccagugccaguaaaaugaagucucaugauuugauuuuccugcuuguuaauaaugcugagcauauuuacauaugucaguuggacauuaggaucucuucuuuuguuagucauuuauucaagacauuugucagguuucuaguugaguuuugucaguuuuuaaaauuaauuaugggaguuauuuguucucacuucaauccuuuguguguucucuuuacagugucuguguguuuccugaggagcaauucuucuuugaauagauagccuuaguuuuuccuuucacauuaacuucucaaaauauauuuggaauugacuucacgugaaaugugaggaugggggcuggaggugagagugcuuucuuagcaugugcaaggccccagguucaacccuagcauguaaacacuaugaggcgagauguucacuuucaaauuuucuagauaaauauucggguauucuuauaucauuugucgacuagccuuuuucuccauauucauuuauaacaaaauacuaucaaauauggagcauuuguauauccugagucaacugucucacuguucucuaugucugggcuauguugccauugcuuaauguugcaucuucaaaauaauuccuggcucagguggggaaaggauggagggagaguguacugagaucggacgaugggcuucucugggaugagcuagagaccuagggcgauggaaacuccugggaaucuaugaggaugaccuuagcuaaaacuccuugcaaugggggauauagagccugagcugccaucuccuggaaccaggugagacuuccaauggcgagacugggacaccaacccagccacauaacuuuauaccuauaauuuguccugccuacaagaugugcagggggaaaagauggagccaguauaugcccgggaguugggcuaucugcuggaacauguguaaccucucagggaccucaccuuugaagaaaacugccucucccuuuccaaacaaccgucaacugucaguacuucucagcugcccacgcugagauauggucuuauuuuaauuuugaucagguuauguaccuguaaucacaucuguucaaaaaacacuguaguaguccagugccucuagcucuuaaaaaucguucugccccucuucugggaaaaccccuaagccuugcgaggagguaacugcaguuuccaucuucuguuucuugugcaucaaccaaaguucuaagugaaaacuagugucuguagauugccuugugcuaauucuaaaguaguucuucuccuggucaauggcacaaaaagucuaaacugucacaugauuacauaggcaauguucaggaaugcauggcccugaaccacugacucucacgucugcauuacgagcggagcagagauuagacagagguuacugagcaucuguucaaaacagcagcagcagcaacaacaacaacaacaacaacaaaagcaacaacaagaaugcaggguacaacucauucaguuuggcccccgaaguccagauauuaaaauuuaacuggguaagguauagcuguuuaaugugaggcuucuaaaucggcggaggaaugaaugcauuuguaaggaaggaauuguggaccccagggcuaaaucuguggaagagaaggggaacugacccuugccaaucauuaucucuuaggcaucaucaagccaugcuauaggugggcugcagguaaacagaacagagacagccacccagaacacuagaccugaggagggggcgugucaagccgggauuuguccaaucagagacgccuguguagggauuacauuuagaccuucuguucaaucauagaggggaugggcgggauauaggggcgguacccgcggcagaguuaaucaguuggucacugcaccccugagcacaguccugauccagagguaacuguggacauaacugcuggccugaagagagucuuggaacgggcaggugagaaucuccccuggcauuugcaaggccaagcacaguggcgacugcuagugcuugcucuauugucuuuguguuuuaaggcggaccaagcugucugcucacccucuguccagcgcugugguuacaaaguugugaaucccaguuuuucuggcuuucagcauaaaagagggccuucggguauccuugauugaaugacauuguguuuggccauguggcagcuuugaagauaacgauucuccacuauacuuuggucaacagauuguguccugccccacuggggugauacagaagauuucugccuucugaccuuuggggucuuuuccuauuguuccuuuccugauccacuugugaaauucagaagauaccagggauggcuccauguguaccuugcuuuccuaccuaguaacagugaaaacugugaaguagaacuuaacucuauuuggcuuacuucauucugcugaaguucugagucucaaccuguuuaucuuucccccuuacauguuuacuaaggcuacaagaagauauagugugaaacuuguauuugccuuucauucauacucuaaugguuaauauaccagcuuucaucauccuuuagaagucaguacaguguuguaugacaguuuuucuguaugaugcucaccaccauucccaaauacccuaaaaguaacugccuagaaggugaaaaugcucagauagucccucacgucuucccuagucaaaucuagcccuuauuugcucuucuauucuuaucugcuaauuuuugucacuucuauuuugccuuugcugggaauuuuaaagugagccacacccccacguccccacugcugguuucuagaguaucuugcuuucuccagcaucuuugucugcucucauuuacuuccaccagaaaugagcuaaugcauugcaaucagaggacucuaagacaaacacgacuuucuaagauccguuguuuuggaaaacagcaugcaaaacauucacugauaguaaaugaauguuuuuacugugacucuuaaucugaucaugguucuagugggcaacuuuguuuugucuuucuuuuagacaagaugagcgauaaaccagacuugucagaaguugaaacauuugacaaagcaaaguugaagaaaacuaauacugaaguaaaaaauacucuuccgucgaaggaaaguaagucaugggguuucuaguagggaaaguugguguagucagucaagaaaccuaugcuauguucuuuuacguuuuucacgaguaaauaauaucuuaccagacuuaauaguuucaaauauccaguagccgauucuguuacuggggauauguaagugcuuucugcauaacaaacaucaguaauauaaagaaacaaaagcuauuuucuguugaaaauuaugaaacucacguuaaaauuaaucuugaaauaauugaccaaaaaucaaaacaaacaaacaaaaaaaaaaccaaccaaacaacaacaaccaaaauccagggauauacacuuguaauugugguguuugcugccuugacaagguugagugugaucuugucccccuaguggacugugccagugcuucugaccuuuuguaaauggagugacuucagaucucgaauaugcuugcugcccccagacgcagagguuugcugcuauuccccggauuuucagcuuccuggagaauaucacucacaaaugcugugccaugcuuugcccucuguuacaccaaaauuaucagacaguuccaaaaagcagacaaaacggucugaaaauauaccuuuccuuauuggagugugguagauguauuguuauggaguacuuaauuugccauuuagugucaaauaguggcaucagcauacaccuaccuuaaguggaauauaaaacauauaguugauucagauucuaauggauauuauaaggguugcuauguacucucacauagcacuuugugaggauuugugggugcuaccuuacauaguauuuugaaauuaaagcauguaugaggccauuugaagauuuagcacagaauucuuuuuaauggugcagguuucaaacaccaggccuuaguucacaguagcuaagccuuguacaaacucuaggaagacacuagacauuagaaaaauccucugcuaaugauauauaaguauauauauguuuauguauauguauauguguauauguauauauguauauguguauguguauauguauauguauauguauauguauauguauauguauauguauauguauauucguuuuuccagacaggguuucucuuuguaucccuggcuguccuggaguaacucuguagaccaaggcuggcgucgaacucagaaauccuccugccucugaucugagugcugagauuaaagguguguccuaccaaugcccggcucucuaaugauauuuucauguuucuuuuuuuaucccuagcuauccagcaagagaaagaacacaaugaaagaacauaaaaugagacucuccuuucaagagcaacaacaacauugccuaacagucauggcucuaggcuuguuucuguaacccuaugcaauauauagacauguuaggcagcuccugguagauccauuuacuacccuggcugcaaaggucagcauuugcuaugaaucauuaaauuuuuuugguacugcucacugguguguaacuuccuuguccacacucuuuuguuggccuuggugcauauagguuuuucauuugcuuugcaaggcaagacaauuuuaaccuacaguaggugcucaguugcuuuaucaucuuugugaccuugcauaguuucacagcuccuugggccuauuuucauuucgacugugacauuaaauuauagucccaaacuucccaugguacacucuuuguagccuaagggauaaaauuacacaaggguacuuguuuccaauaaacaugguuggaagaaaac

SEQ ID NO: 9754 - RNA, 57189 nt, Mus musculus
cagaggcuucugggaucgggccccguguugcuacugccgcuacuguugccgaugcucccggaggccauacggcuggauaggucagucccagggaagaggacaaggugggaugucgcggcggggugucuccggcucaagguuagaaaccuccagcugccaaaaggcucaaagagaugggaacugaagugaggagauugggggcuggggguugggugagaacggaccgaacacccggcgacuguugaugacgccacagcagcgcgugucgcuguuuccggugugcuggccgcuggguuuguuuuguuuuauuuuagguuagggaucggcgagauacaaggauggacccuaaaagaugaagcaaagauaagaauuaggcaagaaacuguugcugcccaguccucacacauauagaucguguucguaugaaacugucugggcccuucuuugguuucagauccauucugugucuguugggaugguuguuuuguguuacaccuuaacgaauggugcucuugccuuguucaguggauucgguaguccgcugugagcugggggggggcggggggggaguagguuuaguacccuucacauucuaacaacugucauuuacauuugaauuggaacaguuagagcacaaagaguuagcgacccaggagcucuggagaaaggguuggaggagugcucucuuugaugggacugcuuucacaccuuuuggauggauaaauaaauaaauaaauaaagccaacuuuuccuccaggcauuuuuuccuggggcuguuagcucccggugcagcuauuuggcccgagugaggaguggaggcggacuuaaugccaagauaguuuauugcuggugagagaauuugcuauucaagagcaggaccccugugggaaaauuaaucuuaaccugaggccagaaucuacuccugcacuaggauccaguuuguaaucugguuaggaugucagagcacucugcauuugaaauucuugugcuacgucuuuguuuuguaagcuaagucaguugacagcgugcagucccaaacucuucaaaaccuuaagcagacuuuuaaagauucugaacggccagaaaucaagauguuuuauuaaugagagaagcaagggaugaagcaugcuacugcuucuuacauucuuccacucguucuguuucucugagggacuuguuuagacacaggcugcugguucacuuauaugaguuuuuuuuuccuucauuauuauuuuggggggaaggaaagccuccuagaauuuaaauuuuuaacaauuugcaggaagcagcaccugucacaggacuguccuuggaaaccuguugaaccagcaucccuagccaaccugugucucacaaguguaucaggauagugaugaguguggcccgguacaauuucuagaccacaacuugaagccacggugccaaacauuugcacacaguuugccacagaggugacauauaaccuugaaaguguuacuggagggcuucaguucuaauuaccaaguaauguuuuugcugaccaggauucaaaugcucccucacauuaacaagaaaaagaguuauggauacaggacugaauugcgucaccuuuucagucugucuccaccuugcccauagcaggguuacagaugauagaaaacacgaugcagauaucaggaaguguaugcccauagguugucuuuuagacucagguuacaagaacuggguaaugggucuucuaccuacccuguaccaaaucccagguaccagggccuuuggguugaucuguuccuccuacccaugugguauugugggaauccuaauuccuggggacccauacgaguggggagcuguaggaaggccagaccacucccaaauggauuuuacuuaaaugcgacgugaaaaaaaauauguguuuggucaugcauacugauaccuguguguaauaagagccaacauugugucauuccuugagcaccauccacuuuaauuuuguuuucuuguuuguuuuuuugagacagggucuuauucuguagcucugacuggucuuaaacuuaaaagaucugccugucucugccucuacuuuaagcagggacuaaaggugugcaccaccacaccccgggucaccuuguuuuugguucuugguuuuuuuuuuuuuuuuugagauagggucuucuacaggccugggauuucaccaguuaagcuaagcugacuauccaggaaguuccagggauuuauauaucuuugcccccccuucaccccgaaaagagguaggacaguucuggggguugaacucagguugucuugccuguuguggcaagcacuuacugaguagucuagcuuccuagcauaauagaaacagcuugucauugcuagagacugguaucauaugccuguaauuucagcacuugggaagcagagaaaggaagauuaauuuaaagguaaaggagaccuugccugaaacaaaaacaaacaaacaacacaaaaaaucaacuauuuauaauucuaccaacugugauaaugauaacgaaugcagagaccaccagaggacacuuuuaaaacugaauagacagucuuucuugcgaguuggugacugcacuaggaacuugcccaaaucaugcagcccugauccuuacagcccuuugucuuuuaugcacaaaaaccacauccugauugucacacuucagauauuaagaaguagaacuacagaagccaccccccccaaaaaaaaaccaaacaaaccaguguuacuacauuuuaggacuuucuuggaacuacagacuuagaucuuugauggauuaggucucuuuguucccauuucggcagguguuagggccuguuuguuggcuuugaaggucagaauggugccucuaacauggugucaguugugcuaaggucugggggccuguuagaagucuauugagguuuucuagucauuucaaaaauuguuuuuuuuuucccuacugaauauagaguugaguuccuuauacuauuaucaaaccucuuagguauauuucaacuuccuuccuuucuggauguugugucuauauucucauuugguuugcuuuguugugcagaggugccuucauuuggaauaguccuguuuauccaugguuacuuuuguugcuuugggguccaaauuuaaaaaucuuuuuagacaacgucaugcuguuuucuuccuuacuggcuaauuguuuuagaauugaggaguggggcucuaaccagauggcuuggccuaugauguagaaaggcacuguggguuugacggcaggcagggcuacauguugacuuccuaccuaaaaauaaaacaacaacaacaaaaagcacaaauauaauagaaggauauuauaauucugaggauucuauagcagaaacuaauaucaugaaacaucucugcugcuuaggaauaugaugaaauucaagcaaaaaaagcuguagcgccaagguuaauacauugaauauagcacauugaaagcagggguugauucagcagcuaaaauggcucacaauauacugaggcucacugaagaggaaaaugaauuccuccuucagugaugauagaguguaccucaaagacagauuuggggaaauauuaacaaauaaaaaugggacacaccaggcauuuuuuauguuuaagcauaaaagaugccuggguucaggaaccccacagggucaaaccaagguuggagguuggaauggggaauguaugaugugauuuccuggcuguuucuggugcaagcuucuaguugauuagcaacuuucccugaggccuuugggcggagacaaugagaccagagcuggcaguagaaaggaugugacgagccacacccagcuaccggagugcagacaccugggagccaaagggaaaggugacuacaaggacaaaggggaagggacagaaccugugaugcagucucaaaaagugacagcauaucaauguguuuguccugguguguacuggagcauuuucagguucuuauuggugagcagcuagcagggucggguggggggcagcaguggacagauuaagggaagaucagcaaaucaguaagugcuggccagaguauauguaucugcuuuguuucuagguagaaugaauuuagugccuugguuucugagugccugacuggcugcucuugugaauacucgguuugaagcucugggugagccaaaggaguaacacuuuauuuuugcucuuugcagccugccaguugccaucucuuuguaggaagacauaagaauaaugguuuguaggaugaugcauauugugucaggaagauuuaucccggaggacucugggacaggaacuuuaguguggggcauaaacauauuucaguauuaaaguacgguaaaauucuccuuucgucauauuucugacaguuagguuucuguguacuaacugggacuggcguaacucugaccuacauaauagcaggaccccugugaaagaaucuauuuuauuuggugauaggauagcauuuccuauuucauguagagccuauaaucucuaaucugaaaagcaaagcaggaacucggggaugagcuuagcgcacauucaaauuugucauucacauuuuuucaaauuugugacugugaacugugugccugccccaaacucuaaucacaauuuaaauucccuggcaaugccacuacuauucuuccgauuuacuauacacagcugacauuggggaaccugaaaguguuaguagcccacaaccauaaggccugggcuagaugagaauggucuucuacauuacauaaaugaauugcuaaaacuacauuauguguguguguguguguguguguguguguguguguguguguguauacacauacauagauacgaacaugaaauuuuuuaaagguuguuuuuaaaauuauaaguguugguguuugugucucuguguggcuaugugcacaugagcgcuagcacccuuagaggccagaggggggucggauucucuggagcuaaaguuauaggcaguugugaccccccugaugugggugcuggaaacugaacucagguccuuugggaggucagcaacuguucuuaacuacugagaauuuuaguguaccuauauuuagcuccuaugaauuuuaguguaccuauauuuagcuccuaugaauuuuaguguaccuauauuucugacagaaucugggguaccagaaguuccuaguuugucucacaucuuaguuugucuuauuuuuuccucagugguauuaaaagaggaaaaaaaauggaaauaaaauucaagaaauggguauuugugaaauaagcuguggauucacuagucagaacuaggaaauuaguauugauccucaugucaggggaaaagggcuauuggccgugguucauguucacuccgagaaugacauuuccuuuagugauccugauuccuagcuccucuuauacaggaccccuguagggaaggcuagucagauaugaaugauagcccacuagagaggaaggcauuuaaauauauuuuguuuucacagugcacagaaacguuugacuuuuucgcacuauuuucuuguacguugaaaaguugugucuguagcugaggucacaguaugauauaugcaugguauggaaugaugaaaucaagagaacgaacuuaucugacuccuaaaauacuggugguuucugauaugagcauuugaaauauuccucuagcaauuuugaaacauguagcacccugucguugguaguagucccccaugcauugcagugaucucaaacauuccucccauguaauugaagauucagccuacuuugauuacugucuuuccuuucuccuuaaucuccauucuccauacccugcagguacagcauucagcucugcucccaugaauauggcuggcuuagagaacauugaaauuuuguccuucuguguaggccuggcuguuuucacuucacacaaguuucuuguaugcuguugcaaauggaaguuuccuuccuuugguguguggcaggguaagugcauaugugcagguggguacguguccgcaugggaucccauacacuguaggcauauaugcaccuuuuguuuuauguggugguuuccuccaaaaggaaacauguccaggagggugugggacgucucgugagccgcaaaugucugagagaacaggaaauuagaagauuuuuuuuugagggccucccuagccguaugaaaaggaguacacaagucuagguguggagacugggaaagccagcuucacagcgaugagacguuuggaugaugaagcuaucugcaagccggccggcaagugccccaggguuagcaguaguagccuuuguguggaggugggcuuuggugauggagcugcucuugagucacuucugcuccuuguaagcaccuccucacucauguugcugucaguagguccgguaaaaacugguucaccaagucugacuuugguguagugguuacucuagacuguuguaaguucccuuucugaggugacuagaccugugguugugccuccuuaguaaaaaaaaccucuggcuguaaaaaaguaaaagucucaaaaaaaaaaaguaaaaagucucccacaucaaucuucaggccaucuauaccauuuuguucuuuagauagggucucucauuggccuggaacccuuccuggaagcaugaccccaagggaucugugcccaucuuuaccucaccagcccugagccaauauuacaaagacuuguuuuauguggaugaaugucccauaaguguucugugcacugucugcgugccuggacaucggggaggaggguuucagaguuaccgacaauugugagccaccaugugcucuguacuguggaagcaucucuccagccccaugggccgcauuucuguguguguguguguccauauccaagugcauguccacucuagaggugguggaaccuggaagaauggaaucaguaaacgaggcagacuaaagucccaugcaaaagcuaacuuuauucagagcaacaacuuacgcucuaaggguuaagaagggucacaugaguaaaguucucaagaguucaaaacacuuacaaucacuacuacaagccaucuguggcaaagagccaugucuuucuauagaggcauauaaaggauaguuuaaacauuuaauugacuaacagcugcaagugcuaaugaguaaucuaguguaaacucagcccuaucugcuacaccugggaggagcaagaccgcacauuccaagaacaauuuguuuucuuggaguguucucacuagcacucagaauucuccucacaugacugcauuccuggacccuguucagaaguacgugcguaugcgugugucugugugugugcaugugucugugcgugugcaugugucugugcgugcgcauguguauguaugugaaugugugccuguguguguucgcaugcaccauauggaggucagagauugauuuuggguaucuucaauaucucauuuuuuuuuuuuuuuuuugcggcagaaucgcacacugaauaaggaggucaugauucacuuagucugacuggccagugcccccuagagcuucuguuguuuugcuucuccaaggggggauuacaaguuaccccuccaagaguuuuauguggauuuuggggguugaauuuagaucaccaugcuuacuggacaagcacuuuacagauugagaccucgccauaguccucugacccagucuuuugucuuggguucuggggaagagcauuaaguuccuuguucuugcagagcaguuguuuuauggccuuuaucacuucagcagcugagcaacucagucucagaaucuacuucuuuuugaaggcuaucagguguucugguuuguguguguaauacacacgcacaauuuucuuuguccauccaucagcugacauaugauuaauuuugcccuuuuuguaaugcuuaagucaguauuggcauauaucccuucccauccaguuaccaauuucauaucauuugcauaugaaacauuucaggcuggggguauagcucagugguagaacuccuaccuggcaugugccuggauucagacucuauucauaaaaagcacaaugaaaauggaauuuacauacauauaaugcaguaauauuuuccuuuuauuuuaguuuuuuuaaauaacauaauuaguaagagaaguucuaauuuucccuauaaucugcaugaguucccuacuccauaaauucuccagcgcuuaucugugucucugaauuuuuuuuucucucaaacucuuuagcuaccccauguucaccuauccagaggagucugauggagucccauagauugaugugugcacuuaugccuucugggguaaggccaaagcaacuccuuacagugacaagggaucuauaaguuucugacucuguuuaugucuagcauuuuuacauuguuugucuuauguaacaaagugaauuuguucauguucauuauuguaugcuuuggauuguagugcuaagauggucuuucgaaauuaagaaaaagugauuuuucugccauuauggauuucuuuagugguuugugcuuaaaucgaagaacacaaaauaccugguuuguauuaaaauccccagugaguuucuauuuaccguagaacucacagucauacuuaacccauugucaagaacaaaggguguggucuacuuucugguaaucagcuguauguaaaguaagaaucagaaagacagacuaauuggccaagaaaccguauuaggagucaguauuuagaaaaccauguagggaguuuuguuuucagcccugcuaaagaucuccccaccauagaagacaaaaucgcuguaaggagucaaaagcagaucagaaguauugcuguggccaaccuucauuuaaagccuccuuuuagagacuggcucuuaauagucuuccggaaaaugacagauaauuacaucugccuuugacacccucuugccaaccugaaaauggucagaacaaauuaucagaaauuucauuaagcugccuucuuuucaggcugccuuccagaucauuguccaggcaaguuauaaaacaaagggaagcccaaaucaaacagacagacagcaaauaaaagcaaaaacaucccuggaaccaggcacaaugguacaguaaucuaagcacucggaaggagcaggccuccgugugcuaccuaacaguucccaguucagugagaagcauguggugcuaauguguaaaacuuaaaaagaaaggagacaacguaaaaagagaaaagccaguuaaucaacaaaacaauaaagccaaagcaauuaaaaagggcugcaguggcauacaccugcugucucaguacuuggacuaccugcuuugaguccagucucggauaaagagugaauuuuaggguugcuagagcuacgaagugaguugcuagauagcaaauacucuccuccucucaauucacaugcuuacguagggacagguuggccagucaguuccagaaucugugguuuaauaugucugugcuuccaagguaugcagcgaaaaucugguagugaccugaagagacuccugauuuagauagggauauugccguuuacaguguccugguugucauuucauuaaacaggcaaugggaacacaaagaggaagaauaaauauguuacuuauuauuuggaugguaauucuucuguucuaccgagaucccaaacuuggugacaaggagagugaucucaaagacugccaucuggcauuugguacuuagcaguggcugcuguggcaggugggagcaucaguucuuggcuaccuaguuugcuaacccaauaagugcuauauagcucuuaaguggucaaagaaaguaggauucuuuguuccugguuccaaagauguguguguucaggugcaugccaugguauacugguagaggucagaggucagguugcuggacuugauuuuuuuucuuucauuucgaaccuuggggauugaacuuagguugucagguugccacaucacuggccuucugcagaaucuacugcagcucuuuuguaggcccgcuauguuggguuuccuuaaccuuuaacucaggcccaugucauagcucuuaacagaggaucugauuccuuuggcuguaaguuuuucacagcccuuugaaacucuccuggugacuaggacuugccuuucuggcuuuuuagaggccuuuguguuucuucagcauuaacucuucgcccugauuucucauucugcagccuuaaguccugcucuggccacucuagagcgcuucaccuucuucaucuucagcuguuaacagccagccaucauucuuggcaugccagcuuccacguggaugcacuuguccgucacucucuguugaugcuuugugugaucagcucaggcugcgcuccuaaauauagguaagaaaagaccacuugagagaaguuguuuauugggccugauguuacaacaucauaagaaagcacaguagaacuuaucuaagcucucaaccuuccuaaugcugagccccuuuaauacaguuccucauguuguggugaccccaaucauaaaaauauuuucauggcuacuucauaacuguaauuugcuacuguuuugaauuugaauguaaauaugccgaauaucugauaugugaccacaaagguguugugacccauagauugauaacugcugauguaaaccaauucauugagaccaagcaaccucuugacacauacagagccacugagacuuguguuuuggaucauucauagcuagaacuuaaaacuagugacagaaguccucuuucuuuaucaucaagggaagggcacccccccaccccccguagucuagguagaaauaguuucagagccaucuaagguucaccauggcuuaugauagcaaaacaacugguacaguuucagacaacuuuagauacauucaagaucagggaaaugagcugggacuaucauauacuuuuuuaagggaucccuggaaugcuccaaaggucuguugcuggcauaagaguaguccagcuaggagacugacaguccuuuuguucaagauaaucaaggcagcaagagagaauugaacagcuggcaauuagagaucucauucccguaucugcuguugucuuauuuacagaaaaauuaaaaucagacaguccucacacugucaacuuaaucauuugucauuaguauugacagugacuuuuccagugauuaacauguuucucagucagggucucaggucaauucuuguuauuggccucagauauauuuccuguaagaaaaccuaguaaggaccgucagacuaccucagggacaaggucuagcacaguuccuugaaacugucauuuaacagguuuuaaaaacagaauaaagacaaaaauauccuccaggaaauuuuccuccaggccucgcguguuccuaguuuuauaccaaugugcagccccuuggaggaacugagcagcauguaaaguaguuuuuggucggucggucggucgguuggucgagaauguuuggaagaauuuuaaguaaggggcccugccuuacccggccaccaaggucucugcucaaaggugcagccugugauacugacuuaggucagcacaauacagaacucuuaaauuugcuggucugacaauuugacauauuuguguguacuucacuuuugcaaagaauucauuucacaucagggaauuguguaucuaccaaaaauuuuaauucugauuuauacagccuagugcuuuauaagccagaaaagcaguacuauugcaagcauucuaagucagugauucuaaauucuccaugcuucuacaaagccaauuaaaacauaggccacuggguucccuauagagggaaaugcgaauacuaccaaguuuaggaucauacuaaaaaauguuaucuaaaccaaccggaacuaacuuauuuauuuucuugauaucuaguuucuugaauucuuuuggauauuagcccacugucagauguggaguuggugaaaaucuuuuuucuauaggcugcuguuuugucuuaucaaagaugucauuugccuuauagagucuuuucagugucagaagguuccauuuauuaacuguugauccuaguuccuaugcuacugauguucuguucaggaaguugucuccugugccaaacuguucaaggcuauugcccacuuucucuucuaucagauuaguuuaucugguuuuauauugagaccauugaacuguuuggaggugagcuuugugcauaguauaaguauggaucuauuugcauucuucuauauguugacaucuaguuagaccagcaccuuuuguugaagaugcugucuuuuuuuuccaguauguuuuucugucaucuuuauaaaagaaagaucaggugucuauauaaguguguagauuuaugucugacucuucaauugaauucacaauggcuaucuuuaaagaauggaauuuacaacaagguuuaaagauuaaguaggucuuaaaauuaaauuaaaaguuccuuuggguuuuugaaacagggucucguguagacuaggcuggcuaguagcuccauauacagcugaaaauauccuugacuucuuauucuucugucuccaccucccaaguguuagggcuacaagcauguaccacaaguuaaaaauauauaaacuucuuuuauuauacaacauuucuguugauaaaugaauuuguaagguuguuauagugcauuauuuugauuuaaggauuauagaaaagugcuauauaguaaaacucaaggcuacaagaauuauggcccuaauaaauaccauuuauuuauuguuuuuaacagugaaucuuuauuggaugacuuuaugaaaaacuacugagagaauucucuguaggccauuuugucuuuagcaguuguguugaaauuucuugacucucauucagcaggaaaggcaaacuagauccuaggauauggccuucauucccuguaaaaaggauuuucugugcauggauguuuugucuguauguuuguauaccaugugcaugccuuauuccccuggaagcugggauagggagucagcacccuuuauaauugaaguugcagacaguugggauccaccaugugguuacuaggaauuaaacuuaaggucccuggaaggucaauaagugcucuuagccguuggcucaucucuccagccccuucuuugccuuuuuguguccccauaauuuccaugucuuuuuauccugugucaaacucaaguuaccaaacaggucuuucuccuagcaccaagcaggaggauucuugcccuggaucauuucauugacaagucuggcacuucuuggggcuccuuacuaaaggauaucucuggaugguuagguacauugccaacagucagaccugaucgaaauugucccagagaaaaaggcagauggauuuuguuguguacugcauaaaaaaaauguauuuacuuucauuuacaucucuacggaugugaacaaauuccauguuaaugagguucaauuuaauguuauguuacacguguacgauguggaauugucagugcgggcagugagcuucaucccagauacuugauuaugccccugaaaacuacuucaggaugagcuuuacuaaagcuugcuagagagcuuuugaaguagggagacugauuuagcacauacugaaaauuuaaugggggcauucaaaggagccauauaugcauaaacugcccagaggauauaauuuaugaguuccaggacuaaguaacauuuaagagcuaggcauaaaauuaaaugagaaaacaaugagcuaguuuucuuauuuuacugaaauuaauuccuuuuccaguuguaauuguuaaaguguuucaucagcuguacuaccugggguauauagcaacaagugcuugucugguuauauucacgaucacaaccagcaaggcugcagguaaccaguuccuuuguuguuuuuaccaaccuuguuugagcggucuuugggaaagagggcauuauuucugcaggcagcuuauauuucaucagugugcugagucgucucauuuauucucagguucuggggugaagugcuucuucccucaucaucuccauacuuuucucugauuuuuaagcuugucuuggaaugauucagucaagcaaauuaauauaacuauuaucugacguauuuaguuuaucagauaugaacauuagaaauagacucacagaauuuucaaagcucaauacucucuuauuaccauagugauuauacugauaugagagcucaaaaaucuuuccucuggggcuggagagauggcucagcaguuaaaacacugaaugguccugaagaggacccagguucaauuucgcagcugccauaagggaacucacaagugucuggauuccuguugcaggggguccgcugcucuccuuugaccuuugcagguaccagguacacaugcacugcgggcagccagagcacccacacacagaagaauuaggugaaacugauuuuuaaaaaucauuucucccauccaauugaaaguuuucuuauuuugaccaccaccucuccaccaccccacgcccaccuucuacuuccuagucacccuagcuucugucucugacuguaauggaauuagauuucacaaaggcaagaacauguaguauuugcauuucucuaaaagccuggcuugguucacuucauauaggaaguaucuguaaauguuguaccuugugucagguccuuuuuccuuugagacacagucccacuaugugguccugaaaugacgugaaauugacuguagagaccagguuugccuauaacucaccaguagccugcugcugcugcuucgcaagggcuaggauugaaggccugcacaaccacacccucugucucagcucuagaaguggaaacuuugaguucaaaacaaggagaaaguuuuacaccacugguucagacuuuuuaauuaauuaaauuuuuuaaauuaaaaaaaauuaaaucaauuaauuauauuuaauuuaaaaaacacaaacaagugggagaguguacuuaacaauuaccuaaauguuguuggggguuaaaugaaagauaaauguguaagcacuguuccauugucuacagccccuagauuacuucuaaucauuuauuauuuacuccaacaauauauauucugugagauaauccugucauuuuuaugaauuacaauuucuaguucagcucauugcuucuuuccucauuagcacaugagagguauauaucgcuacuaugcccacgcuucagaagaugaagcaauggaauaaauagcaggcuucagaguuuugcucacaauguccugguucugauccaaaaauaaguagagaguccaaccuagaaauucuggcccugugcuucaggcaugcagggagaguuagguaugagacacaaaagugggaaacaguagaacguuacagauucagaaauggcacguugaaagucaggauuggcccagcagcuuaaaagaaucacaauaaacuguucuuauaagaaaauucauucucacaucagaaugauugguacgcuuccaaucagcuuagacuagaaauugggggaaagguucaacagaugagaaagggacaggcccagcucuuguuuuagcagaaaaaauuccaaguacaagaacaaguuggccaaugcucuggcccuauagcaaauuccaggucauuucaaugcccugcaacucccaggguugaccccuggcuagaguuuggagauggcuggagaacugggagguggcucccucaagcugugucugaagcaaacuucuagcuacaccucuggaagggaucagaggccuuuuucuuucucucaaggccacauugagaagggaccacugaauggaggaaguaagagaugggccuaacucuuggcuucugcagaggacacaucacuguucugggggcuuggauccaaagcaucacucaguuguucuugauaagagaagggaggcacacgguugaaaggagccuugagauucuggagaagguuguugcugcccagaguccauccguacucuggggaucccauucggaugaauuuuacgcaguguucuaggccacugguugcacauuuccacuacuggugggaagauucuucugagcgccaagccugugcugaguguuguauucggggcucuggggagcagaggaaguaaagcuucauuuucucucccucuacagccugcuaguugccaucuaauuuggagcucaggaacugacaaacuuuagagggcgaucugucuucuguuaguggcgcaugccuuugaucccagcacuugggaggcagaggcaggcggauuucugaguuagagaccagcacggucuacagagugaguuccaggacagccagggcuacacagggaaacccugucucgaaaaaaaaaaaacacaaaaaacaaaaaaagaaagaaaaaaaaaagaaaaaccuacuguggacaggacaccaaacuaccccaggaaugggucugaguggacucauugauauagugcuuuaagauacuuggaggaggguuuggggaguuagcuuguuauagaaacaauaugccuucacagugagaaauaucacccugcacacuuaagagauuguuaaaggaaaaucucuuuacuggaaaagucuggccagcuguugcuagugcccaaagaagaacaggccccugauagaagauuuuacuaacuuauauacaccuuaggcuuauucauuuuauagucucuguaguccucaaauuccuuucauguccaggacccagcuuacgcuuugagcaauuuaagaggcaggagccugcaagucuggccaccugggcagaugggugauucacacagcaaggauuuugccagaguuuuaaaguaugcuaguguucuuuucagcuugcccaccuggcugaaucacacuuuuccugauaagaccgcagggagugcaauuacagcccaggacuuaagggcagcugugacccuguagcuaugcagggacagauccuaaaaauagaucccuguugaagauaccuucuuggggaugcaccuaauggccgcucaaucuugguaaacggagaugcacauccuagcacagcaauuuugcuuaucucaaacaggccugcauagaacacuacucaucucugagguauuuuggaggaauccaucgcugagcuaaguucugcucucugguuuaaugucuccugagcaaagagguuagugaggccuuuauaacauccaggcuaucaguuugaauuucuucugcaucagucucuggaauaagaaucauugguggggcuggagagauggcucagugguuaagagcacugacuguucuuccaaaggcuaugaguucaaaucccagcaacacaugguggcucacaaccaucuguaaugggaucugacgcccccuucuggugugucugaagacagcaacaauguacucacagauauaaaauaaauaaaucuuuuuuuuuuuuuaaagaauugucggugugcaaauaugaggacccuaguucaaaacccuagcacccaacaggaggauccuuggagaccugcugccagccagccuagccccagguuuagugagacucccucaucucaagggaauaauguccaaagugaagagcaggacauucaaagcccuccucuggccuccaugacagcuccccacccaaccccuacaugaauggaguuuaucuucagaaucucuuuaaaaacuuuguguugggguagaggcuaggggaggguuuugaauguccugcucuucacuuuagacauuaaucccuugagaugagggagucucacuaaaccuggggcuaggcuggcuggcagcaggucuccaaggauccuccuguugggugcuaggguuuugaacuaggguccucauauuugcuuuuuuuuuuuuuuuuuuuuuuuuuggguuuucgagacaggguuucucuguauagcccuggcuguccuggagcucacuugguagaccaggcugggcucgaacucagaaauccgccugccucugccucccgagugcugggauuaaaggcaugcgccaccacgccuggcuggguccucauauuugcacaccgacaauucuuuaaaaaaaaaauuuauuuauuuuauaucugugaguacauuguugcugucuucagacacaccagaagggggcgucagaucccauuacagaugguugugagccaccauguguugcugggauuugaacucauagccuuuggaagaacagucagugcucuuaaccacugagccaucucuccagccccaccaaugauucuuauuccagagacugaugcagaagaaauucaaacugauagccuggauguuauaaaggccucacuaaccucuuugcucaggagacauuaaaccagagagcagaacuuagcucagcgauggauuccuccaaaauaccucagagaugaguaguguucuaugcaggccuguuugagauaagcaaaauugcugugcuaggaugugcaucuccguuuaucaagauugagcggccauuaggugcauccccaagaagguaucuucaauagggaucuaucuugaggaucugucccugcauagcuacagggucacagcugccguuaagcccagcucuguaauuacguuccccguaggcaggaagaacuggguccuggaagucaggaggguggaggggcugagccggaagaaagauuaaaagcccugguugguugaagaguuccacagagcuggcaagccucaaacauucuaaggcuugaauuggaacacuggucgaugucaaggucuaaguagugccaguacaugggucugauaaaaaccugcaacacaagcugaugccaagagcuaaggaauuccuugauucccagguccaaacaaaagugcaggguaaagguccccaauacugucuuuaacacuaguccaagcagguccuagcuaggccaccagagggagcacuucucccuuauaagguagaagugguuccaagccauggagaguucacugcaaaucauaauucucccaaguuugcuuuaucuccucacauagacagucuguggaacuaggugugcauuaggcagaggacuagugcacagaggagaaacagcaccagaggaaaugggagaucacucacagugucacaggcuaacacaacagcaaaagccccgccccaccccaccccccacacuaaaacugucuugacuggggcuaugccuuccuucagaagccagagcagucaccuagaaucgcuguguaguuuccgcagugcaucgguagaaugugcaggauagcaguucugguauauagguagccuaccaggcuuaagccaucaaguuuucuguaaaggcacguggggaacacagaagaaaaaggaguucaacaacuuccagugaaaggcucgguggucuugccccugaugucuuugcuuaucgaagggaaauggaucccaggaggagugcuuauaauugggacuuacuauaaccuggugugaugacacaaaccuuucagccccgaacuccugggacggaggugauagauccaugagcucuugaacagacaggggaggcauggaauccucccuaucaguaucauuuacgagcaauucuucauguaucuauugaccauauguauguaugucuuucuucaagaaaugucuauugaagucuauauuauuaaguugagucauuguuuuauugcaacugaguucgcuguuugagacaggguuucuccgugcagcccuggcuauccuggaccgcacuugguagaccagguuggccucagacucagagaccuaccugccucugccuccugagugcugggauuaaaggcgugcgccaccacugccaccuagugcaaccaaguucuuuauagauuuuagaacuagccuuuuauuccauguggcuuguagagacuuccuugugcccccgagguugacuccuugcgcagcucucugggcuguucacucccauuuguuuaugcugcuccuugucuccucauugauuuuuuuuuuuuuuguuaaaucuccuccucaaauuaauuauacagaccagugucauuuuuuucuccacuacuuuuuuaggucuguuuuucaguuguugguguuguuugacuguacuaaaacgggaccauuccuguuguccuuuaaugcacguuucaaugggggaacaaagauacucuucuuaaauuaaacaaagaagauuuccuucaacuuugccuaaaaccauacacgcuuaaaaugauacauuaccuauuuucaaugaaacucccuagcugaguuauauacucaagugguagucauuuacaaugggacucuuguucccacuuauggcaucaauaacaugaaagggguauuucuaauuucugguaaauuaugucaauaauacaauugugacaauacuugacagagaaagauuaauuguaagauuaauuaucaucagaaguuauagucauuuuuucaaacucagggccacacagucaggaaugcaauugcagcagaucuuuguuucagguuuccuuucacagaguagccuuaaacaguuucuagaaggaagcaacccacaguuccagcaacuugugaaacccucccaccaaccgaaaaggaaguuaaggucaggacacauugauuagaggcucccaucuggcucccugcuagaucucuccccagauugcagcacaaauuaaauccagcccccaggacacaaauaacaacaggccauuccaacuggccuagguaggucuguucugccuuuguccuggaaccaggaagaugcuaagauuaaagccauucuuugagaacuaaagacccuuccagaaaggccagguuggggguggagagucucuguagaagagcucugguauuuaacacuaggaggaagacugacuuuccuguucagguaaguaggcuccugaggccuauggcuaaaucuucaaguguauaguuccugauuuuuugcuucaucuuuuuaaaauguuuuuuuuuaaagaugacuuguguuuaacuuagggucucauacaugcuagguaagcauucuaccauuaagcuguaccuccaccccuugauuauucuuuuuuguaaguuguaacauagcuaagggugaggcagaggcaucgagaauuucucuucagcuuuggccaaaauucuguauacauuaauuugccuguuuuauacagauggguuuuuguauuaauaauacaugcaagcauuuaggcccaaagccaggccuuauagcuggaggaucuauaaacuggguggacaguguguuagagguuuuagauuucuaagguguguaauaaccucauuacaagaccgucaguaggagacucucucucucucucucucucucucucucucucuugaaagguaaucaauccaaugcccgucaugagugaugucuuuuucuccucugugcacuaguccucugccuaaugcacaccuacucccauagacuggcugggugaggagggaaagcaaacuugggagaaguuuugacuuuguagcccuuucacuggaaauuggcugugaggucggaauggugcagucucaugggaagagucugggggacauaacuuacauuuucauuagucacaguguuuauuuacuagauguuacaaggcuggguuugcuuucuuuuuaaucauuacuugagagggaaauauaauauuuccaauaacauguauggacauuuuauucucuuaaugugguagaauuuagauugcaggcguguguguguauguguguguguguguguguguuggaggcaagaccuuucaguguagccagacuggccuguacucacuguaucccugauucugccucuccaaugcuagaauuauaccaccauacuugacuucaguucacuuuuaaauuauuuuauaauuugcauaugucaauagcuuuuaugggugcuucauuauuucuguuaucaagaauagauuccuaguacauuguuggauuauuuuguuagcgagcacucaaagauauuugcuauagaauacuacuaccaauagaccucgugaugauaagccacauagugucucuuguuucauuuauuguaaaaguucaugucuuaaaguucauguucuaagcuuacagagauuuauaauugugcuuucuucuuuucuagguagaugcccagugacgucaacauguaguuuccacaacguguaagguuuuucgagaguggccaggggauggaaauauuggacuaaggaaugguaaaaggcuacaaauaucaguguuuuaaccauuauuuaauugcuuucuugaucauuacaugauuguaagcuugugugugugcaugcgugugugucuguacuaucauucaguguagaaauuggccuagcccauagcaccugcuaggcaaguccgucauuaccaauauaucucuccaacucuaucauugcuguuuugggaagguuauuauuuugccauuuggaaagcaccugugcauaggcuuuauccuguuugggguacaauagauuuguauaugaaaaaauaaucuuguuauguaugggugcugagucagaacuucuuagcaguagucaggauuuaaacuaauaaaaaaugcucaaugugguuucuucuuaugucuugagaauuuagcugaggcuaaauuggaugaguaccauuggcaccaaguaagaucauguguuuugcacuuaacagauaauuucuuugucuguggauaugggaguacagcugaggcaucccauaaauccuauagauaaacaguuuccacccucaauuauaaguauuuuuuuugauccccaggaaacuagguaagauaugaggaagaaugugauuaacuuaaaugccucauuuaaaauuucacucagaggcuuugugcccuucuagaauuuucuaaguauggccagaguucucagaauaaaauguagagacaccgaaugaaauaaugccaaguagccaccagguggcgaaauugcauauggauuuaagcagcacaggcaaaccagccucgguaucuagccuagaggccauguuuaugucuguaucugguuuucugucaaggcuacaaaagaucaaguggugauuuuauuucucuuuauucccuugguuuuagaacacuuccauuccugcccaaggcuucugugggagccaugugccgcuguaccugcugugggagccaugugccgcuguaccugcugugggagccauguacugcuugcuguaccugcuggguuaccagguagaagaaagaaaugaugcacaguguacuucuaguucuucagcuguuaggauucuaguucccgcaucccugaucaucccuggauuugcuaccaugagaauggacuuaaaggaugaggaggaaagcaaaauuaacauuuuugagucaccagauacucuaguuagaaguagaguauuauaacuuaccuuaauuacuauaaaaauaugagacccugaaagauuaauuuguuguuuuaucuaucacuuuaauuuagcaauuuuuuacuaggcuuugccaguauuacuucaaguauaagugcuguagguccucagcucuguauuauuuucaggcaacuugaagguaacauucauuuuagaauacuuucuuccauaguguuagaagaugcagacauuuaaaauggcaauccugauaggaaauuuaaaauccggaauaauaauccaauaucuggccaguguucaggcuuacuugguugugucauuaaaaaaacaguuugcaguugcuguauuuaaaucacgguccagacaagguuuauauguuggauucacuugaagugugaacuacgaggcauuuucuguagaggaaagcagaguauuaaaucaguuaguccuccuguuuaggaagucauaaucuuuguccucaacgaguucuguuuugugguuuggcuaccugcuccaauagauuaaaccuauggcuuuccacaaguccucuguuacugaccuuaccuucagcccugcuuuauucuuuuuauuuuuagaaaagaucucacugacuaucauagguugacuuugaauuuguucuguaacuucagcaggccuucaacuugcuagccuccugccucaguccuccaaguagcugaaauuagugggcuaugcuuccaggucugauucgcugugggaaauaagauauuaugauuuaacaggcucagguauaaguugucagauaaccaaauuacaaugggucaaacaggaugagaauucaucucccauuucuuuuuuauuuuuaagauuuauuuauuuauucuauguaaguacacuguagcuguucucagacacaccagaagagggcaucagaucuuguuacggaugguugugagccaccauguggcugcugggauuugaacuuagaaccuuuggaagagcaguaagugcucuuaacugcggggccaucucuccagcccuuguuucucauuucuuaaggguuuacuguccuaucaucuccacaaaugugcuauuuguccucaggguacuagaaacaccuacagcguguacauucacacugaaaccaucaaaauguagcauggggaaagagaacaacaugggagauaaccagcugucucugcuguaaaaaaaaaaaaaaaaguaauucaggacucuuauauuaccuagaacauugcccggagcauguaauugccaccacuuaaagucgaaaacacaggaaaccuguuagacuuguguguacauagguagagguaggggacaacuuguggaagucaguucucccccuuuaccauuacaguguguucuccccuuccaccauguggguccuggagauugaaguccaguggucaggcuuggggucauaccuugccaccgugagcuaucgcuuggccuggaaaugaguuaaaguuccacuguuuuuuguaauagcacucuuguguccagcucugcaauuccagugguguuuuccaaucauagugucuugucucccuaaccauaguugguuaacauaugccuaugcuaucuaggucagacugucagaagucaucuuuuugauugucuuucugagguuuaauuggagaaaaauaguguguucuaguuuguauuaggcaccuaaguauucucucucucucucucucucucucucucucucucucucuuucucucucucucuuguauggcccagcuaugggguguauguuuggaaauuucugguggccuuuuuacagcuauaggaaagaaacuugucuaaaagaaugucauuuuugggcugagcaacuggagcuucccauugguguucaaaccuccagucaugcuuguacuugagucccauccaucuaugauggauaaccuaugagacauccaauagauucuuucuuuugccugaguuuaaguuguguuuuuugucacuuacaaucaacaaaguucugauuaaagcgcuauuuuacaggacaguucuggaaucaguauagcuguguuuagcauuuaugugucagaggguaauagauuuaguaacuagaagcaagaagacaauuugcagaucuauuagucuaccugaaaagugacagccccgagagccacaacaucaggggcugcuguagcucuggcugguuuguuuugucuucuucuagauaguuaaauaguuacccgcaucuucagacuggucauccuuauaugguugcaggauuacuuuuuacuauucagaugagcauauuucccucuauaccuuuuggcauuguuuacaaagcugcuuagaaauccuugucugcuaaucuggcauguuggucaucuugugaucuggcuuuuugagugccuugauuuuucaauacuagucacaguuuccaguuuccuguguaaauccaaucauucuggcuugucucauggauacgaagacuguuugaaauggauacccuuauguccauaggaagagcauugauauuuguuuauguuuuaguagggagucaaguagaccgaacuuagacacuacacuccgcuucugugaaaacaaaaacaaaaacaaaaacaaaaaaaccugcaaaugaguucacuuagcuuuaucugggcuauuuagagauguuacuaugugugcauaauucagaggucagcaagaaaccugggugguuucuaugcagcauuugggcccuccuucucaggcucccuccacuguaggauuuuaucuuccacacuucucagcuuguaugaaaacccugaacucuguccuccagucuucaggucaguaagguccaguuuaaggcaccagugaggaaugugacuuggggcuauguuguggcuaaaaugccuuaaaagagggggcauuguccaguucugaccuuuucuuugaagugccauuuuuuucugucacuuucuuacuguuuuagguuacuugacaauacuugcauguagccuuuuuaaaaaauauauauuuuucuccaaaguauacaguuguuguaucugaacaaaagucaauuucauagcagcacugaguggaaauuacaaccugugugggcuguguuauauaacuugaggcacacagcacaaauacucuggaggcacaguaaaaauguauacuagugugcugacugguauuaugucaaccugacccaaagcuagagucaucagagagaaaggagccucaauuuagaaaauauuuccauaagauacagcuguaagucauuuucuuaauuagugauugaggugggaggacccagcccugggcugguagucauuuguucuauaagaaaguaggcugagcaagccauggagaauaagccaguuaguagcacucuuccauggucucugcaucagcuccugccuccagguuccuacccaguuguagaguucuuguccugacuuccuucagugaugaacacguaagccaaauaaacccuuuucuccccacuugcuuucuuggucauaguauuuuaucacaauagccacccuaacuaagacauccgggaucuacguguuugauucagcuaaugugacuugauacagacaggguuuauaagcauguaagguaaaggugaugauauugucaguuggcauacuuggaggaaugagaagcuugguaacuguccgcuuggggguucucaugaauucagauugucucaccauaaacagguaaauuccauagcagguaaucuaauaccucuuccaugaggaccuccaaggaccaaguaucccugacccuaauauugcugaauuuuuaaaggugauguuaaguuagcuguaguaaacuguaauuucuaugcagcuguaggucagauggacagagcaagacucccauacaacccucugccagaccuggugucugagauagauagaaggaggagauaaauagauaaguuauuuaaagcuugaauagggaugagugacauagcuuauagggaaaggacuguuaaggaaacccaaaugucuccuuggggcacaccaacauaugguaaauauaggguuaaaaagauaagacaaaaacaaguuuaaggaagaagagguuacggcuuuggcccuguuugaaauaucugugaggcaucuagguaaaugcacaggaauuuggaaaacuggagagaacucuggaauagagaucuguauugaagaaugcccaguagagaagugguagaugaagcuguggcuaugaaugagauggccagauagaaugugccaagggagaggagaauugaugagagagaggggagagacuaauaaguaggucaguuugagaaauugugaaguagcuauaaaaguaaaaggggaguuagaaaagguuguauguagaaguaaaggagacguccaacccguugguguucaguagagccgaaugcuauaaaagcaagcauuguacacggaacauagcagcucuaacagcagaagguuuauuuucaucucacgguuguaguuggaguucaguguccaggagcacagccauuuugcaacagcuuauggguuucauagggugguaaacugcaucauguagccccugcuaaccauucuucccaauagccaucccccuguguugccccuugcucucaaauuugguggguucuauaaguaguuuaacugguaguaugucuggaagugaugcugcuuguuugcuuguuuacagauaaguguagcucacagcccucaucaaagagcccuguagccacguguaguggugcauuucuuuaauccagcacuugggaggcaaaggcagguggaucucuauuagauuaggccaguuaugucuaccuaccuauugaauucuaggccaacuagugcuacauaaugagacccuguauauauaggaaugugugugcacacauacacauaaacaaacaaacaaacaaacauauauaaaaagaagcuuccuuuuacaacagauaaaguuuaauauagaguuauacagaucgacaacuggucagaaugcauagaguaagugacugugggaugcccagcuccaucagauauaucuuuuuuguuuguuuguuuuuuguuuuucgagacaggguuucucugugcaguccuugcuguccuggaacucacucuguagaccaggcuggcccugaacucagaaauccaccugcuucugccucccaaguucugggauuaaaguugugugccaccaccgccgggccaacagauauaucuuaaauggaacccuauaccuaaggauaagggaacaugaagaugagguaggaaguaagaaccacaggaccaggauaucuguuguuuuauagugucccauacacauguguacacacagaggaaaauguaaccgugaacucuuagcaauauguuugccuaaacaagaucagcauaaggacagcacaguugacaugucacuaggggaaaucucacauggucccaccccuagaucacaaggugcaagugacaauggcugaugaaauagggugaaucaguuuccuuuagggacgggcuuucacagaggugguaagucauaauuaaaagagaggcugucauuuggggagggggaacagggagaggagagagagaauacccuuguaugaaguuucccccuaaacacuuaaaaaacaggaggucguaaucucccucacaacuuucacuguggccuuuuggugccuugagcaaccauauaagaagucuaucuugcuaauuaggacaagugaaggagacuugagaugacguggaaagggagcacccuggcuaagcccagaucucuagaucugaacaggcaugugaaagagaccauccgggccccuccagaccaauuaccaaccagcuggguaccauggaguggccuaguagauaggaagcagaguaaauuuacaaccuaagggaauggccuguuagcaucuggaagcucacaugcaauugugggaguauuuuuccuaauuaguaguuuggaauaauguauuuauauccuuauuuuuauuuuaauguacagguguuuugcuuaaauauauguuugggcaccacaugcaugccugguaccacuagaggccaaaagaggguguugaguccucugguacugcaauuacagauauuagugggccaucaugugguugcuaggaauagaaccuagauccucaggaagagcagucuguuuuuuuuuuuuuuuuuuuuuuuagauuuauuuauuuauuauauguaaguacacuguagcugucuucagacacuccagaagagggagucagaucucguuacggaugguugugagccaccaugugguugcugggauuugaacuccugaccuucggaagagcagucgggugcucuuacccgcugagccaucucaccagcccccgagcagucuguuuuuaacugcugagccaucuccccagccccugaggggauuuuuuagaaauaauagugauagauacuuuggaauguguacauauuaauagaggacuuuucuauaaugaugguaugugcuuggaaaugugcguguacaaauagggaaaagcuaggaggaagaagaauggagaugcaaaagagggagagauagcugacgccauaugagauaucuaagaagggaagaugagaucccaacucuggugaugaguuuuaaaucaagagacgcuugcuuuccaauggaucuuuaaaaauaugucucauguacuagagucaaaagaauauauaaauguuagguaggaauuaauugguuucccaagaaugguugacauguuccuuaucaggauugcuuagaagccaggaaguaauugguaucuguaccuguggguuaacaacuagacacccuuuuaauaaagcuguuucuguacauaagccauaccuccacagagucaagcuagucugggcucuguggguuuucagaaugguagaggcuucaaguucgguuguaguagauaacuaacauaaaaaggccuugacugauaucugcagacuuccacaugcuaaugaggaaaaaaauguaucaaggugucuuagucaggguuucuauuccugcacaaacaucaugaccaagaagcaaguuggggaggaaaggguuuauucagcuuacacuuccauaucacuguucaucaccaaggaagucaggacugaaacucaagcaggucagaaagcaggagcugaugcagaggucauggagggauguucuuuacuggcuugcuuccccuggcuugcucagccugcucucuuauagaacccaagacgaccagcccagagauggucccacccacaaggggccuuuuccccuugaucacuaauugagaaaaugccuuacagcuggaucucauggaggcauuuccucaacugaagcuccuuucucugugauaacuccagcugugucaaguugacacaaaacuagccaguacacaagggaaaguagaaaagcaacucaguauaacaauaagccucuguaaaaaacaucuauuauggaaaauuguaaucacacauaaaauuacacagaccagcacaaugaaccuacauguauuacuaauuuuguuaaaaauacaaaauaugauauggaugcuaagaucuguaaauuagcagguaaauuagggagggugaggcaggauaauugcaaugccagccugcauuacauagugaguuucagucuagcauaagacacaggaaggaucugucuauaaaaauuaaaaagaaauaauuagcaauuuuugcucauaguuuuaaugguacauauuuuauuuuauagagaguugauccucauuguuuaauaauuucauauuuauagcuuggacuauuuacuaaaauuuaucuguacuucucugguuaguacuugcagugcuuucaugguaauucauggaccugcacagagagccaggcacuagauguucccagcuaaaguugaauagagaacacacuuuuuuucccauaucuguuaucacacuguaaguguccuuuccauggucauuuuaauguuacuuuuugcuucuuuuguuggugacuucacuguuuaaagugccacuaacaauaauguuaaugccagaaaguugugguaugucuuaaggagaccguauauguuagauaagcuucauuuuggcaugagcuauaaugcuauugucuaggauauuagagguaaugaaucuugcaaaucuagaaaaagaaagaagaaaguuggcagccuauggaugcucagaaaaaugaugaaauauuuauuuugggguaugugugauguauguauguguauuucaauguguaugcaagaacaugccauuugugugugugaguaucuaagucucuuuaucucugucucugucucccccuuucucugucucucuaucucugucucuccaguguguguguguguguguguguguguguaggccuuguugacauugggugauuucuuaguuacugagguacuguuaguuacuauugcugugaagagacaccaggagcaaggcaacuuauuaaauaaaggggacuugcuuacaguuucaaaaggugagcucauagccaacauggugggagcaaggcagcaggcaggcauggcacuggagcuaagagcuuacauauuaucuacaaggugcauggggaaagaggagggaaagggaccaggcaugggcuucugaaaccucaaagcccacccucagugacacaccuccuccauuaaagccacacuuccuaauucuccccagaacucuuccacugacuaguaaucaagcauuuggauaauaugagccuguggggacuauucucauuccaaccaucauauucuucauuguaguuuuugagagaggaacucucagugagccuccuagcucugccuucacagagcucugagacuguaagcacauaccucuguacugguucuuuuauauggguuccaagggauguagcauccacuuuacugacugaaguaucaccucaaccucaauacaagucuaauuggccuuucuuucauucuaaggauaaugaacuuuuuguuuguuuuucgagacaggguuucucuguguguagcucuggcuaaccugcaacucacucuguagaccaggcuagccucagauucacagagguccacuugucucugucuccugagugcugggauauaaaaggugugugcuggcauugccuggcaagaauauugaacuuucaaauuaaugaguuuuuaaauuguguugauuaauuuauuuguauauuuguacacuauuugucugagcuuguguaugcauacauauggagauaagagaguaacuuacuggaaucaguucucuccuaauuuggguccuagacauuaaauucagaucauuagacuugguagcaagugcuuugacccgcugagccaucuugcuggccccuugauuuagguuuuuaaugaacguauaaagugauaauuuucuuuaggguguuuuagaacagcuuguuuucauugauauucccugaccaaucuucucccucauucccaccuugcacaugccauccauuauuccauuuccaacucucaugucuuacauauuuuauuauccuccucaucuuccuuucuucaaaccuuuuucucauccauggucucuuuuuaaaguguuaucaucauauauuacuuacgcauaguaauggauuucagugugaccauuuucguacauguacauagugucuuuacccuguuaccuucuuugccccacuccuacucgugcucauccccuuccuagcuagcugcuuugcuacuuucauauguaagucacuguguuucacuaggguucuuuagaggagcauccuucggcgaguguuuguuugggggucggggggccaugaauaccuugccaguagcuacaugacugagaaaaauaucuccuuccuccaucagcauuaacgacacauaaguccuuagggaggguuagagccauggcccuguucaacaaaaaugaucuuucuucuuuugguagucgucuguucaauucauuugccuuauauuucuggaauuugauuuuuggaacucuguagauucuagauaaucaaucaccucuuguacguauagcugguaacaauuuucuuucauccuaucggcugucuauacaguuuuuccuuuguucuauaacagcuuuauaauuucaugacaucucacuuguggauuuuugggauuauuuccugugacaguuuaggcccuuucaaaaaguuuucaccugugccuaaucuuagaaaacaaaaccaaaagucugagaacaguaaguacuauuauuauaugagcuacagugaugacuuacuugcuuuucugggcuuugauuuuccucaguuacaacuccagcaucucgcugaauacuacauaacuaucuccucuaccacacugagccccuccugaugaaauagaggcaaggugcuuacccugcuggaauuuauggacucuugaaauauguccccugugauuuucuguaguaccaucagaauuugauccacgcugaauucauuuuuguccagagugagagacaugaauauaguuucuuuaauuuaguuuucucagcacuaucucuuguauguguuuugcaccuuuguugaaaaucaagugguuguagcuccauggguuuauauaugguccuuucuucuaguccacaccgguguucggauauuuuuguuccugugaucuuguaacauaauuugagauuagauauugggauacuuccagcacuauucuuucugaucaagauugcuuuggcuaauucaaggucuuuggugcuuccauuggaaguuuaggauuuuuuuuucuaaaacaauuucuauagagaacauuguuggaauuuuaugggaauuguauugacucuguguggaagaauaauacuuuaaaaaaaccaauauguuguuauauauuuucaaauauguucucccauucuauagauuugguuuuuguucugagucuuuuauaaaacaaggaguuuuaaauuuggcuagguuaguucuaauuaaaaaaaaaauguaugugugcuauauggcuuuaauuugccaaugccagagaacuugaguaaagccgaauucaaaaguaauggacaaaaagugaugaacuaguuuguucagcagagggaaauuuaagacaagauggcauucaggcugggauuccaugcuagugagaaggagcaacaaguaaagcagaaagauaagaaaaauguacaguuuggcaaggagaagagagccuaaacuaagccaucacaguggcuccuugcuccagaauggaugccgggaaacauuuccucaaggucagcagugaaggcacacgaaggccuccgacacugugaucugauaggaccaggcuacauagcaagcuggaagcaggauucagcauaggcauucacugcgguucugcuuuugcagguauagaagaagcaagugggagugacgcaggaagacuuguuucaaggcuacagaaagccugugaauccaguacuggguauaauuguuggauucccuggaagaagacccagagaagccauugaauggagcuggaaagaugaagcccaaguuacaguggagggaccaggauauuggagauucuagaauuguacuuauccacugaggaaagcugcaagaacacaguggaacacgucuaagacagaagucucauguucuggagguggcagaaguggagugcuggcacuacccaaaucuagaccuuagaugaucccauccggagugcuccaugcuagccagggagcuauaggacuaggcguuaguucuaacugggcuuuuguuuuugcuuuacuccauccuuuccucgcuguucucccauuaguugccauuuaggguggggauacuucuuguuuuguauauuagaaguguucaacuuguauuuugauuucauaggugcucaaaauaaaagagaaggucugaagucucagaggagacuuuaauuuucugaagagagcuguaacuguuaaagacuaugagagcuuuuagagagagaccaaaugcauucugagauguacauagacugggaaccaggguagaauacuaaggugauauguuugguguuggguuggcaggaaguggaauuauaaugauuaauuuucguugccaauuuaacaggauuuagaaucaccuaggagacaguucugugcuuguauguaagugcagaccuagauagauuuaccuuagaagggaaaauuucccuuaaauaaauguggcaucuaugaacugggauccuagacagaguaaaaacgagaacugaaaggagcaccaauauucaucuucauuucauuccuucugcuauuuaccaaguaucaggugcguguauuucuguuugucuguuuaugggugcuccauucauuucugguuugugucuuaugcuaccccaguagcaaaccucaauagcuuuugucuguauaauaaacuuuaauaucugauagagagauuaucccuaguuuauucauuuaaagguguuuugucuauucuaauuacuuuuccuuauuuguucuagaguaagcuuguauucaucuaugagaaaucuuagcaagauuuugauaguaacuauuauuaaacuacauauacauauauaauuaugcaaaacucauuuugagaaaaaaauaacacuaacuauguuauauguucucuuuugagacauauucuaacuaagaaguaagcugucuucuuuuuuaauguuauuuuuuaacuuacucauuuuacauccuguucaugccuucuucccagucacccccccucccacaauccuuccccuaucuccccauccuauucucuucugaguggguggggggccgcuaggcauucccccucccuggcacagcaaaucucugcgaggcuaggugcauccucucccgcugaggccaaacaugacaggccagcuagaagaacauagcccacauacaggcaacagcuuuugggauaacccccuuuccaauuguucaggacccauaugaagaccaagcugcacaucggcuacauauguguggagaggacuagguccagccccuauauguucuuugguuggugguucagacucggaaagccccaaggauucagguuaguugacucuguuggucuuccuguggagugccuacccuuucgggaccugcaaucuuucuuccuauucuuccauaagagugugcaagcuccauccgcuguuuggcugugggugucugcaucugugugagucagcugcuggguggagccucucagaagacagccaugcuagacuccugucugcaaucauaacagaguaucauaaauagugucagggauuggugcuugcccaugggaugggucucagguugggcugguuauugguuaacuauucccuuaguuucuguucuuuccccugugccugcauuucuuguagacaggauacauuuugggucgaaaguuuucacaggcaguuuuuggguuuuuuuguuuuuuuguuuuuguuuuuaaaagguaucagggagaugccaaagaaucaaugggggugaccguagcugugacucagcacuggggauguggaaccugcagaggccaacuccuguaaccaggcaggaacaccaguggagugauagggacagcaacugacccacaaaacuuucaaccuaaauuuauccugucuauaagcaaugcagggacgggggauagagcacagacuugucuuugaugugcuaugugacccuggugaccuugaguucauggcaaaccugucucaguuucccgaaugcuggaauuauaggugugugccaucgugcuauacgaaagcaggguucaaguguggcaucuuugccuucauuuugcaucugucuccuuuacuuugaguuauugaguauucuaaucaauggacaguguguguaucuucaugaaaauuguugcuuauuuccuuucaucaagguuguacuaaguaucuucaucuuagaauagagcaaaugugcuuggccugggaaugcugcagccgcucuuuugcucacuugugaugauagcgcccuuauaaagucacuguggaaauucagagagaccgugcagcuuugaacccugccucugacauguuuacuuuguccuuaaccuuuucacucauauuuacuuguugggcucuugagcucuuaucugugaacccacaauaauagagggaugcauuaaaaauuauugugaagacagaaugugagaguuuaaauuaaaaaaaaaucaagcagacuagagacaucauaaacuguggcucuuacugauauuauaauguggauauaauuugguaaaaaaugauauauaccuuucagugaggagaaguguagauagaacucaaguagcuaguccaaagagccauaggcucagaacaguaagauauugcuguagguuugggacaauggagauguuaccaguguuguuagggucauugccuagguccuagcaaaccuaauaaacuaggcuaguuacccaucuucagcagacaugcuucaacuuuuucuuuccaacaaccaugagauuccuaggcaaauuucaguuccuuuagacuuaagugucucaguaguuggauaauccaaaugaggggaacaggugucucuuagaauaccuuugcuucugccagggcuacuguggaagcaauccauuccaucacaguagaaagcuuucacagaagcuaaguuagcugaggaggcuuacaucuauuuucuugaucagauguggguaaccugaaaagaauugggauucuacucaaggagagguaaguggaucucugaguucaaggccaaucuugacuacagcaugaguucuaagacaaccagggcuacacaaagaaacccuaucucagaaaaauucaauacuaacaaauuugaaugaaugaaugauuagaaauaggaacaguucuugaagcugcuugaugaguagaugaaguuucacuacacuauucccuaaacuguuguguaguugaaaaaauuccaugacaaacaaaucuuauaaucauuugaaaacuugauuuggaggauuuuaaagcugaacugagucuuacauauuacagucuguaguagcucagagguaaaaggauauuaaaggcaaguuaggaaacaaggaagcaugugaaaaugugaaguaugcuaucuaaguaguucaugcaaaggcugccuugcucuccacucugcuuucuggggacuguaguccuugguccagcaacuucacuucuuggaauauauucccagaaaauuaguuacacucacaaaccuauauaugaguaggcugauuuucucaauggacuuguaauagugcaucaauggaaacaggcauugaccaacuaacucugugguugcuccuauaaucacugugcugggccagggagauggcucagcagguaaaggcacuugccugaugaugccaguucaaucuccaugaccacaugauagaaagacagacccaacucaccuaagcuuugauggacucgaggauaucugucucuucccaauauggccacauggaauaaaucugucuccacauuuuauuauuauacaagcuguggcaugagugugugugcacacauuguaaaaacaaaacaaaacuguauuuguccuguuaccauaaagacucaaugaaaucgcuuccaaauuggaacauggauuugaggacaccuaaauccauguuucaagaccaugcucacucaaauuuggcuccaaauaagcuaucucuucaacacacaaacacuauauguguauucacacacauaauuuucauccauggcucauaccucauuauuccuucuccaugacacgccuaaaaaaaaaaccaauauucucauuuacaaauugguucguagaaguacugaccuuucccugacuuucugucuuggauagggccacgaagaagcgcucugauuaccuuuuaccuauacuagguugguuauaagacccucuucauuccaaagggauccauggugcucagagaagccaagaggaaucucaauagcacaggcauuccuggguuuucucaacaggguaggcucucuaccccuaaaacauucauuagacauguaauaauaaaauguggagacagauuuauuccauguggccauauugggaagagacagguauccucgaguccaucuuuuggguaaccccaugagcuuuagguuuaaauaguggaggacuggggcaaggggcgggagauguguaauuaaagcaggccuccucugaguguggccuaguuuaucauaucaccucagucccagcccugcaggguggucugaugaaguccuuauugcuguauguaauugcuugagagagucaaucugguucgcugauguugauuauuucccuacuagcauacagcuguacugucauagagacuugcccucaucugaaggaccggcuuucuagugagcuucugcuguuccuacaauccauggugacuguaggauuaggacacugauuuacucuaugccuuuagccauaaaaagggaugaaagaauggacagcggcauuccuugagugauuuacaugcaugccuaugugcagagguaaacagguaacaggaaggaaaaggagacgaacacagaaugaaggcagaaaugccaggcuuucuccucagacauaguucucuuuuuaguuuuuauuucuauuauuuugagacaggguuucuccaugucaccccaggauguccuggaacucacucuguagagcauguuggccuugaacucauagagauccacuugccucuugcuuccagagugcuggaauuaaagguguauaccacuguacccaguuuguacauaguucuuuauuuuuaaacauguccuuucaacuuuauucaaacaauauauuuauuaucaauaucccagaaguguuuaacauauuccaaaaauaaauuucaugugaucaaaaggugauguucacuuuaguccuguuugccuccaugccaccaugagccuucauuccaggccacauagacaaacagggccagaaccacgugaacagcaauaauugcagcauaaaaauagcugucucuauuggacauuccaacagcaucuucaaauauaagauuucauuguaaaauagccagauaggaacugugauccuuaaagcuuuaaagaacagaagugucuucaagguugaagcuaaagauaaaauuuuuucauuucuaaacucuggaggcugcagcacguuuagggcugcuuuaucaaagagcuccagggcauggccuuaagggcagcagcaagcacuagguaguuggcagggcucagcagccacuaaaagggugacagguacuagguccuaggccaguugucacacaugaagucuguacauguuucuucaauaaaggaaaacucagugucccauaaaguaaaauagaaaccaugagcuuugcaccauuuuuggugagaugaaaauucacacacccucagguuuguauaguugaaaggaugggaaaggaagacaagaggaugugcuacagaauauaaaagcuauagcuuuuuccaaucagcaguccacacuggaccuccaagguaauagcagcaagaaggauggcaguguggguauagcauauauuucuucuuaaagcuagcuacuuucuaauggaaccuguaagucuggggaaauaccccccaaauagaguaaaagaugaaaagaugagcagcccgugcagaaaugaucuuauacucuggcuauugggguagauuugauuauagagaaagguaagagcuauaaaucugaaagaagguugaggacccuguaacucuguaggccugagugaccuaggcaggaagagguaggggaggggcccauuuugacuauucaaauauggauaugacugccaagugcccagaauuauuugagaaagauguaagaaaugucccucccccuugaaccuuugacccuggcaagcucuaucucaggaacacagggccuucuacucuccuucuggcccugaaggcuuuaggacaacaugaagugcugggagcaggggaaauggucauaggcagaaaacacaaaagggugugagccaacucuaucaccaggaaaugaguguggcuucaguaaagggggaguacaaaaugauauuguggggguagggauggaacaggauaagaggccaggcaggaccacccaagaagggugauucuaggcacucgaaggccagaugugagugcagaauccccaagaaggcuguauaaccugcauguagcaccugaucucuacuucugucccugacaugccagcuaccagugcuguacacccucuucacagacagaccucugcaaacccuguuauauuguaaaaugauucagacugcagccgcagagguauuucaucagacaagagcacuuuaugcccucaaagaccuagauuuuguucacaguaccuacccauauggugacuuacaaacuccagguacacgggaucugacaucaucuucuggccucuguaggcucauaauacaugcaggcaaaaaguccuauacuucacauaaaaauuaaucuuuuacaaauguuucagauccucagauuggcauucauuuacacucugcugucagccuuauaugcagucauucuuuuuuuuuuuucucaguaaaagacuaauguacccacaagaagaaugcucaaagacagauaccagaggucagcuucagcuucugauugcaggcugagacgugagggagaaccagacagggguggcuccucuuaugggccauggucagauuucucaauaugguugaggacauugagacccuaacuaguaggugcagauggcuguaugaacuaggaggcaggccaguaauuacaacagguguugaaaagagauauagcucauuucaacuuccccuccuaucuuuaaauagaacaccccugccguaguuguuacaauuaguuucaguuuuuauuugucuucaccaaagauauaguaugcaugacauuagaugguuauauauucaucuauuuagaaguccacaauauauacugccugaugaaaaaauacauacuauagaacagcacuuauaugugaucacuuuuaucaauacauauauaccgaggcacacagguacagggaaauacgcaggacauucaccaaggggcugacaauucagggugagauuuuucagguaaugcacacuuuaguuuuuuucuuuuuaauuucauuuggaagguucaaaaagguaccacuucacggauagauuaaaaucaccagagaaagacacacagagaaacaaccauuaagcaguuaauggaaugagcaaggaaugaugugggcccaugccucucuguugcaugguaccccaguuugcuuuuucuucuccaaagaaaaagcuuguuuuaaaugaauuccuuaaugucagcagcccaccccaucccuuuuuccuccagaauuagcuucugaggagauucaaacacugaucuggggccgagggucacaccuuaguaugguacagaggguuugggucucuccaugugagucagcuccugcagagugacuaucaaauucucaaaaaccuggcccuuguugcugguauugucacagguuucuuuggcguggcccucuucaccacaaugaggacagcggauuggguacuugcgcuuucugguucuaccuagauccccaggcccguuauuccuuugcccagaaccacugcuaguggaaggagacuccucaucaaaaucaucaggggacucaauaaucagcaucucuuccugaguacuggcugugccucggagggaugaggcaccuggggaugagaguggaggguccucgggcuccaccaggaucacaucuucaucugaaucauccugggaaucaucuaucucuaucacauuacagucggcacugccuaucacuauaggcagggagccuugaaagaccacagggcuggcugcccgcuccaucacugucucagaucuucugggccgcuuauuucuaaggaaugucucaucccaauccucuuccucccuuaucauccugaucaacuccaggaagucaggaagguuuuccugcucauuaugcgcaugcauuuggagaagccccuuaagcuuggugcgcagcucccuacucagcucagccccuacaaggagcuggugcaggcgaguccuguuugccucgcucugaggaaggaccccugccuggauagcauucuguagcugcaccucuaaacggaucacauacagggaugguuucucucccugugccugcagggugcuuaaaaauuugccaugcgcuguuauacugcucucagacgcuccaaagagcagcuucauugcccgcaaaaauucugcgacauuuagauugggauugucagccuggaacaaacgcauggccucccgggcagggccccuaaggguucucaucaggcgcuugaucuuuucuucuucagacauaggccaaucuggcaggaccucauggacuuggcuuagccaguuuucaaagguuucuuccccggguccuagcucugcccucccagagaacgacuguauguuucucucugcaauguuggcaaucaaaggaccaaggcuccuccccagggcccucagcauggaaugggcaaaaggcauaaaagcugcauucugccggcgacuguuacccauccuagcaaggaggcuagccaugccugacaacaauuggauaucugaauacaagacgccuggacuuucugcaaacaaaagcaguccaaucugcagaaaccuccaaaggaacguuccccagcagucucuuccuuguguuuggguagaaacuguaaaacaaaacaagacaaaacaaaaauucaauaacgcaauagacuugggaacaagccucuaaucacauuuucuaccaucuugaauauuugcccacugcccuaaaacuacucagcaggaaacugccauuucccaaccuugaggagcaauaauuuuugugugcuaguggggccuuugucagucacaucuccucccucucuacugcgccccacccaccccacugccuguucucuaggagaggcaacaacuguugcuuggaauucuagcuacaacaaccuuuggagccccuacuaggcucucaaauaaagggcaguagaguaaaccuuacagaauuauguuaauaaguaaggccuuaaaucuauuagguagcaaguuccuccccccccccgcccucugcccccucccgcccucugcccccucccccuuuucuaggauucuuaccagagcucagaaacuggcuuccaccuuuauuucaagccuacucucugcaacaggugcuuuccgcaauagcucuuguccggguaggauugaucucugaccgcaggcucuccgauccaggugcccugggccucuagucuaaacugcgccacagcaaaaggaagggaggagaagggucugagacgucagcagucucaucauuucuucacaggcgccauugucgccaggaggaaaaacccuaccuucagaauaaaagccaauggggaccaccccucccccaauccauuucacccggggaaaacagcggccuaccagcucugcaaucagucacacagaauucacguuugaaaucggcuuugaugagcugcuauggagaaaaagaagagaaauugcaauacccucccaccuccguauuucuauucccgaagagaugagagaaaggacaaacggauugugaaucauucucauugucuuuugcuaccuuucuggaagaaaaaaaguccccucuccaaucuaggcaaauccuagguaggaaacucaccucauaccaccauauagcccaaccacuaggguguucacuuccuugccucgaagcugccaauucggaagcucaaaauauuaagguuucauccucccaucuccgcauuaugcaguugcaccucccuuuaccuucguagaugagcagaggaugcucagggucugcugcgaagagcugucucaccucguaggccuugcagaggaaaggauggcgccucagccucagagcugucuggguuaggcucucugcagggucgcccagccagggguagcagagucgcagccgcgguuuccaaggcagcuauagcugcccccgcccucaauuucagccugcagagcagcagcggcggcuuuuagucucugcccauugagacaaaagagagugacgaagguaguggcguggccaaucagcuguucgcaggggcggccucccugcaaagccugggccaggaugcuaaugccugccagaggggggaaccugcuagagggggcugcggcagacuggcgcgggagcgggcgcggcgucaagugcagcuuggacucacggaccuggcccauuuacauuucauucgugaguuugcagcuuccccucucuucccuucuuccuaucgccuucugcuuuggcuccccuccgaugcuuugcgaccagaugccuuaaacacgaggugggaccgaaaccaagugaacaaugagaguucuucaccuuuguauaggggggaaggggauagcauuugcugagcucuuuccguguguccugugcgcgugcacggacaucucacguauucuucucaucagucuugcgcuaaaacguagcagugcacccauuuaacagagaggaggauguaagcaccuaggcaguauggguaggaagcacagaauuaacaguucucaccccagcccuggcaucuagccucaaggguuacacccuuuaaacacccccuuucuagugucagauuaaggcuuaguggagagaagccaaaaugaggaugaaaggaccaguauagggcuacauaaaaauaaugaccaaaaacugguaucaacucacagaugagaaaacugagccaccaggagcuuaggcuuccuguccuguaucgcagcaaagcagcuaauaacguccgauuuugcaccucggucagcuguucuguugaugccagcgcuuuccucugugucgaugccaacacugcccugugcugggcuacccagagagagcauuuucacucguccauacauagccacaaacuaucucagcagcuuugcucauaaaaugguuguguugaugagaggaguggggaagagaugggaaagaagagaauggaauccuuuaugauaugcauucuaccaaggaggaaacugagacacguuucugcucccgauuuuacacgaaaacaaaccaccuguuuauaaaaauagcagcauuucuguaugaccccccccccccaaaggaaaucggacuuagagaugacuugccuaaaauugcgaagaagccagagcucucaaucuagaauucgugcuacaaacuaaaguaugggcacccagcaagcuaccacgcaaucauugcugagggcuuguuggaaaucacguuccuugggcuccagcucuggagauuuggcuuugcuucagauuggggaugagcaaugucauuugcauuuuaccuguugcuauaauugauucuggguuauaaaaaaaagcugugaaccaguguucuaaacaccacaccacgccgaaggcuaucaguaaauggggcugucacucaauugucuguccguagccuauuugucaugaaacuuaaucccagagcagaaguugcuacuucaaguccuuuuugaaacugcgugcaaagaauuugaccacuuuuuuuuuuucugaugccauagcucuauacauuuucagaugggccuguggccuccaaacaguuaagaaccauucacugcccuacaaucuucauaauaucuuccucuuucaacaccugcuugaggacaaagugugagaaacaaaacaccauuugaccuaacccccacaccacagcucucugccgcugauauagcucuuuuauuuccuggcuaggcuagguugcuagguugcuagguugcccuucugugagcucuucaggggacuucuccuuugcuggauuuggcaucacuagccccaggaaggagcaacuccauggaaacagcaugcaaggcuguccaaagcgaaugggcugugaagccagaggcuagaaaaccuacuccauuuuuuccugcuucugguucuuagacagcagguuacacuucucccauguagaugguggcuaggaggccccuggagggcuuacacuggacucuugaugccuggaagcaugggaaccauuugaaacccugcaauugccauuggcuuugacuucaaccugcuaagguaguucacuuauuccugccugccuucuuauuuacaacgguagugauuagaaucuuauaagcaauccaaauuuggaaggaugcaccuucucuauugaugucuuucuuuuggggguggaacaguggaagggggguaaaguagaaagcauuggaggcacauaggagacaggcaguucaccuggcagaguuagggcuggaagugggaguaccugguagguuuccuucauaucuugcucugcucucuaguaucaugucagacaacaaccucauagcagacccuuguuuuguguuuccacuagcuucaucaccaaaguagauguucuguuggaccaugugaguaagauccaggaacuaaaggagagacuugagaguucugauaagaaauaaugagaagaauggauuguguauagguucagagguugaagaaagaauguuuuagagcaaaguuacuauuagcaaaacccuucgggaugcagaacaucucuuaucucuggccacauggauaggagugugcaccaaaggaugguucuaaugaggccacauuuucugauuuggacaaaugaaccuuaaaagcuugaggguuaggagguagagcuuucagacgaaauaauaguggcuacuuuuggccgcaggcuuccucugugccaggaacuuuccauugguuaucucauuuaaacuucuuggcagccccugcugacacagacaucacacaccauuuuucagcauagaaaauugaguuucgaggaaguaaaguggcuugcauaaggcugugcuacuuggaaguggagccacugggaugcuagcccagggcugcccaacuccagaauccaugaguacuuuccaucuccauguugagggggaaauguagauguauccugcaguucuggggaugcagugcagcaggagaguaucuucuuuguauguaaaaaguaacccugauuuugaucccuaacauugaagaggaaagaaaaauaggauaaaauaaagcauucuaguagaagguccuagaacagccagcaugugugguuuuugucaucauuugaccuuugcugcuaccacuucacuuggaaaaaauguacuguacagcacaggcucuuuauaguugugauuacaugcaauuuucaugaacaucacuuuaaaaauagugauacagggggugagguggcugcugauaagggugauuguugcucagccugaugaccggagcucagucugggaaccuaugagguagaagaagagaaccgagagccccaauuguucucugaucuccacaagcacaggguaccacucuguccaucaaaauaggaaagaaauauaaauuaaaacaauaaugauauuuagguucagaaggguuggaaagaaucggccaaggucauaauagcagagcaaaauucaaagguaggauugucugacuacaauguucucuauaacauacaucagcggggaaaauaaacauggcccucuuuacgacuccuuguguuagccucugcucugucugguuuuuguuuguuuguuuguuuguuuguuuguuugugcggggguggggugguaggggaaaaggauugggcuuuuuuguuguuuugcuuuguuuuguuuuuuuaaaacccucuacgaggcuaccauaggcuguucugucuucacagaauauauguuccugaagaucagucaggaccagaugaagugccuugcaggaauacaucugguguucuuaugggagccagggaaggucuuucuucuauggaugugaaggacaagcauaauguucuaggccaguguuuuccaaccuuccuaaugcugugaccccuuaaugcaguuccucauguugugcugaccccaaaccauaaacuuauuuuuauuccugcuuuauaacggaaaguuugcuguuaugaauaguaaauaucugcuaugcauauuaucucagacaacccccugagaaaggguucuuuaacccaaaaaggggucguggcccacagguugagaaccaguguucuagaaacaccuaucccugccaacauuaguuuuuguccuuuaggucucuugcucaguguaaaccaccuauuugcacuuauccuccuaacaagaggugacuuauuuaaggcuagaguaccaccucuuuccagagaacauuuuuauuaacacauauuaagggcacauuuuaguacacgaggaagucuugaaaacuccuauggcgauaaugaacucugacuuguguagaucuuuagcauuugaaugggguucagugggcuguugccuuauacgaauacaauauucaccaucauaucgaacuauccuucuuauaccccacuaccuucccaaucccuaacaauuacuguucuacuuacaagucuacauuuuuuuuaguuuccacuuuauaagagcaugcuuuuguaaaaaaauaaaauaaaguaaaauaaaaaaguuuaaaaaaagagcaugcuauauuugaaguccuccuggucuugacuaguuacacuuugcacggcaucaucgaguuucuuccacccugauggagaugauaggguuugcucuuuuuuuuuuuuuuuugguggcagaauaauacuucauauacuaaucuacacaccucauguucauuauccauucauuuguuaauggguauuuacacugauucuguaauaaucauuguggauaauguggcaacaaacuuggacaauucagaugucucuuugguacgcccguuaaauauuguccagguauauacucaggagcggaauagcugagccaucuacuuucuuuuugacuuuuuugaggacccuuaguacugauacuuguggugucugugcuaagcugcauuuccauaaacaguauauaauggguguguugucuccacguccuugccagcauugaguuuuccuuguucugcguaaaauaaauuguucuuaaucuccuuugaccauguaauuuuuauuuuguuuuccagugugagugaguccauugcugaacugucuacccgacuaaauucccacauccuugaggacagguagcagauccaucuuuagcuccauagugauuugcccaugacuuaaaagaugaucgauaugugcuuuuuaacugaccaaaggacuggcugagaauuuccccaaaugaacagauagaugcagggcugauucauacaaugcccacccaugaucccuaucuucauuagccuagccaggaaagucuuaguucccauauguucauuggauuagguuuauagaugugggagacagaucauacgguuuagaugacgauuguuccaggcagccuccaagccccuucuccauccuaugcuuugaaacuaaugucaggaugccaggcucuccuggaggguuauguugagccuuuggauucauaaaagaaagcucaucccuggcucccauaggaauaguggauauguuccagcaugcaacuucaucuggcucuagcugguauucgggaacauguacucuaugaagacagauaaugauguugggaauaauuuuuuuggauacuuuuaaaacauaaagucgccaagucauagguuuucagcaacuuuaucucauguuguuacuaauuuuuauaucagcguuuugugauauagaccuuauuguuaccacuuuagagcugaagaaugugagacaauauuccuacccuucucccagaucacacagcuacguaagcggugaaggcagaauucaguucuggaucuauuuguuccccaaaguaucuuauuuguuccccaaaguaucuuaagggaaaaauucacaagagaaacaugaccuuucuucccuggguaaaauacaaguaauugaacuuauaaagugauguaugagacauuuaaaguauggugcuucuuaauuacuguucacuuuuaaccccccaaaauuauugacauaaaugguagaaggaauuugugguacaaaagugcaaugccauuaucaaccacagguacagaaucucccacaucugagcccuugugacagaauacagauugagggaugccaacagaacagcuuuccuuaccugauaauuuuauaacuaaaguaaaagaggcuccaagaggucauuaaauuucuaaaguccuauaaaauguucauaacagaaucagagcuuacaguguggguguacaccaaaccacuuuccuccuacuaugucagacugccuuuuggagugauguacacaucuuuauaaagagcacgaacuggaauguuacugaaggcaggguuagaugaagugaaaaccuuuuaucucacaacuuauccucauuaaggccaaggugauuuagaagggagagcuauggaauauuccaggcuccuguugcuuuagaggucugauugacccgggcaggaagagguagggaaggggccccauuugucuccugagauauggaagugacugccaggugcccagaauuaauuauucuacacaaauguaaaacaugcccuccagaaacuucggcccuggcaaguucucagccaaaggaucccuguagcauggggccuucuacucccuuucuuguccuugaaggugaaggagacugagucuuuaggacaacaagaaguucugggagcaggggagauggucauggguagaacacagaagggugagccuccucaaccacaaaaaaaaaaaaaaugaguguggcuucaguaaagggagggaugauauugugggguuagggauggaagggaacaagaggccagggccaggcagggccaggcagggccauccaagaagggugauucuaggaaaagcacucuaaggccaguugugagugcagaaucccagggaaggcuguauaaccugcauguagcaccugaccucuacuccucagucaggucucagccugguuggccccuugucuuuuugagugagccauaaccacagaccacaguguucuagguucugugugaaacuugcuguccacaguuguggcuagacuuccuguuucugccuucagaucagcaugugcucucuucuuccuuguuuauaccugaccagccauguguauccuuucccugaagggacagcugccacugcugcacacucucuucucagaacuucccucccucccucccucccucuuucccucccucccucccucccuccuucccucccucuccuuccuucccuuccuccccuccccccucccucuccauccaucccucccgcccucccuccugacaggguuucacugaguugcucaggcagcuuuuggaauucagauucaaaugaccucuuauggagccucccaaguagcucagaccacuggucugugcuaccacauuuagcucuuguuucucucuugauuguaaguuuuccuuugugucuuggcccccaaauuguaucuaauacgacuacuccgugucuuaagauuucuuaagugugggggugugggugucucauguuuuccuacuuggccuugaaccugauauguuguuaaggauggucuugaacgccuccucgauugucuuuauuucccaaugaccgguuacauauaugcaccauuaugggcaguuuauauggugauagggcuuaaacacaggacuucaugaacacuagggaagcagucugucaacugagcuacauggccugauggugcuguuuugaugcuuccauauguagaacgugacuugugauucuggugugcagugaguaauagccagggacccugauaaacauccuucugugucuaaaacagacaguagaauaaagaaugaucuugugccaaaugucaguagagcacaccaugaaaaacccugcccuauucuguagcuauacauauaaaagguaaaacuugaaaauugccaggugcugagcaucauggcaugagggagcguccagaaaccacuguucuucccuuccuucagucacagaggaguaggguguugugcugagaaaacuauaguuugggcaggaagcuacagagguagaugggaggaaggucucacccccaaauuuacaaccgacuuugaaacaaagcuucacacaacaacuuuuuacuaccguuaaaaaaaaauguuuugauggguagagggcugaaucaguaaagggcuuguucugcaagcaugaggauccaagcuggaauugacaacauccacauaaaaugucaggcacaguggcacaugcauguaaucauagaacugggacagcaauaacaagaggaccucugcaacucucugcucagcuauucaugccacauucguuagcuccagguucaaugagauccccgauuucaaaaaaaaaaaaaaaaaaaaguugaagagcuguagaagaagagcaguaucaauuucuaacuucuacuaguauacgcauccaugcacauguaugcacaugcccacacacaucuacaccugcacacacacacacacacacacauauacacaaacacuaacaaacauauaccacacacauaccaaaaaaaauuuggguuggaggcugugaaucugauuguagacuugguuggcacacacacaaggccuagcaucaagccauagcaaggcagaacauaguuugggaaagggagaaacaacuuccuuguucaguaggaaauaagauccacagcaccagcuaagcagaagacuaagguucaguucauagccucacaucaacgugacucaacugccuguaacuccaggggaucaaguguuuuucuuuuagccucugugggugggaauauucguacaugcauacagggacauuuucaaaaugcugaguuuuguagguaagaauugaagauaacugauuuccuuguuucuauguuuuuuaagauuuauuuuauucauuguauguauagguguacacuguagcuguacagaugcuagugagccauucaugugguugcugggaauugaauucaggaccucugcucauuccugcccugcuugcucuggucagcccugcucacucuggccccacucagucuggccuaaauauguauuauuauaucuaaguacacuguugcugucuucagacauacaagaagagggcaucagaucucauuacggaugguucugagccaccaugugguugcuaggauuugaacucggggccucuggaagagcagucagugcucuuaaccgcuaagccacaucucuccagcccguuucuaugauucuuccuuuuuugggggggggguguugguuuuuggagacaggguuuuucuguauagcccggacuguccuggaacucacucuguagaccaggcuggccucgaacucagaaaucugccugccucugccuuccuagugcugggaugaaaggcaugggccaccaugcccagucauuucuaugauucuuaaucaugauucuuugaaaguuugaauauuaccaugucaucaaaguacuccaaauuaucaaaggcaguaaacuuuuuuucauuuaagguucaugaauuauuaauucccuaggaguguguuguuucuagaaacugauaacaguguuucaugacccccaaguuucucauccuuggaugucugaccaaagcaggaaaaccuuuguccagaccuuuaaaagguucuccuaacuucuugucuccucuugcuagcuucuuccaucuguguccaucuguguuccgcauggaggagcaggacaacacugcugggaagaagcugcagcaccagacccgagcagaagcuccaggaacgaaaagcuggcagucacaggccuacacccuuggggcgauuuccaacuuuaugucuacuuuccugaccuuuccuaucuauaagguuguguuccggcagcagauccaugcuguggcccugucagaggcugugaaacagcuuuggcaugaaggcccucaguacuucuaccggggcaucuacccuccucuucucuccaagacccuccaagggacucuguuguuuggcacuuaugauaguuugcugugcuuucuuuccccgguugggccacacucccuuggacagcgcuggacugcagggcucaugucagguguaguagaagcuguagcacucagccccuuugaaagaguacagaaugugcuucaagaugcucgaaagcaagcuugcuucccuagcaccuucagcauucucaaggaauucaauucuuacgggcucuggggcaggcugucacugggcuauuaucgggguuucuggccaguccuugucagaaacagccugggaagugcucucuauuucuccuucaaagauccuauccaggauggcuuggcaaggcaaggccugccccauuggguuccugcuuuggugucugguagugucaauggaacaaucaccugccugauucuguauccucugauggugcuaguugccaauaugcagucucauauuggauggcagagaaugccaagccugugggccucugcccaagaugugugggacacucgagguagaaaaauccugcugauuuauagaggaggaucccugaucguccucagguccagugugacauggggccucacuacugcuauccaugacuucuugcagagaaaggcucacaccaagaaagagaugacagacugacuaaaggaaguguggcuauggugucuucuaaaucuuucuguguuggucguguuuaguauauuucuuuggcuugguuaccugaaacaagcacuaucuguaaacugucacugcaugggagaagcgccuaacuuuccaccuguuagucacagacaaagccuaccaggaugccuuggucaaagaaagucucccuagucuauacgcagcauaaguagccucagaaccugaagccuuuaaguaagacuuuaaaaaagcuguagcccagauuaaaggucaugccuucaaggauuuuuuuuuuuaauaagaggaaacuuuaaaagaggacucugcucaguacuguaaaccugggguccuucuguguguccuucugaccaaacugaguggaacuccaagcucaaggaacuacacuaggcuuugaggacaacuucagagaugccuauauuuuacugacauuuaucacugccucuaccacagccauucucacuuccaaguuauagguuccauugucaggguaucugcucugauuagaagcccuagauuaggcucacuuccacccgucagaugccacaagaacugaugaugcugaauauggggcugagaaaacaauuggugccuggauagaaggaaaaaugcuuugaauaaagaaauuuaauuaauuuaauuauaugccaaauagagaaaauauuauuauagguaguuugacacaaucauauauacauauauauauauauauauauauauacauauauauauauauauauauauauauaugauuauguuaccuuuaaguuucuacaagaaaccuggaacuagcaugaacauaucucuucauaauuaauugcuaauucuguugauauggacagcuauauaguauaaugaucauagccugucauucagagccauugucaauauggaccccauauaacuuuaugcauaucauuaccccauaagcaugggcagcuuaauccagccaaaugcaguguuuuucacuccccaaacauuccaugaauuuacucaaggccauacucugccccacaccguuuuuuccacuugcacugcccucccccaauaaaaggccuccaauuuacuaaaguccaucuccaaugccacugucuguauggacccccuucucuaccccccucaaaagugaaugugacauuaguuuugugauaauucuuuuuagcaccucaucaacaugcacugaucccauuaugucacuggucccaugugguccuaauguuuuuucuguucuucaauaccucuacuagucuguaaacuucuugaaagcagggaugcuuguaugcauuuuuuaauccuccauugugccuaggugcucaauaaaguuggugaauuaugaaauugauuaucaagcugugauauggucucuauccucagggugcuaucccuaucacaugaagauaaaguuacugacucauugucaacaagacacaugccguugggguguguuuguuuucuuuuaauaguggauuuaguuuugugcuaauuaugaugccaaugauaauaacaaugauaauaaaaugauguucaagcacaauau

SEQ ID NO: 9755 - RNA, 32912 nt, Mus musculus
cagugggcggggcggccgggccgggcggcggcgccgcagugacucgucgggcuuggcggcgguggcggcggcuucugagguuucagaggagcggacuguguggccggugggcugcugcggccucgcagcaaccuuugugcagagcccuccccuccucgggcggcugcggugggcacacucgggggcggaggccaccgcggccagguuagcgugggggaaggggcgagugccagaguagcccaucugcagccagugagaccaagccggcccaucucccaccauguccgacgaggcgucggccaccacuuccuaugagaaguuuuuaaccccagaggagcccuucccuuuccuaggagcuccucgcggggugggcaccugccccagcgaggaaccuggcugccuggacaucagcgacuucggcugccagcucuccuccugccaucgcacggauccgcuccaccgguuucacaccaacagguaaaggagcucuucccagaacagggguggacuucccacugccaggcggggcaagaggacgccagguugcacuccugcaggguuccuccuggucccucgugcaagccugagcugcgggcugcccccucccccaucuuccuuugaccaaggcucuucccagcuccucccuguuuucacccacugcccccugauuuuucugaagaccagcuucccugcaccuucuuucuucucccccuuuccuuuuugcacucuaguaauucuucccauccagaucuuccccuuuuaccucuucgugacccccgcccccauccauacgcagagacuccuaaaccccaacucuugauuuuuagauucaucugcaaaaguuuaaccccuuucguuuccgguacacuacagaguaaauuugagagagccaaaucgaucaguggaucuuaugaaagcaccuuucaagcucgagccuccucuuucucaauuuuaaccucacccuaaaccaaauuguaccgggaaauuagucuuuuuuuuuccccauuguugcuuugagaccaguauuucucauagguuagaccaucagcaaaacugcuuaugccuggaagaugaccuuggacuccugguccucaaaccugccucccaagugcugggauuacagacauuugugauguccaacuaagcuuaguguguuuuaaucaguucaaauuuauauuuuuuucaguacuauggcuugaaaccugaaccucaugcgugcuagauaagcuuucuaccaacugagcuauaugcuugcccuauaaacuagucauuucccccuuccuuacuuccuuacuuccauugccuuacuucuguuggguauccccaaagguaaacucuggaagaguccuauagcauaccacccgccuugcaucccugaugagggaaguagagcaaguuuagggugggcugauuuauacaaauaauuucuuaaagguguucauguaaauuauuuuaucagaaggcaguguuuuggagaauucucucaugcaagcauuuaaauguuauaccuaacauuggugaugcgacagggcuuuucaauauaggcucaacuuuuaaaaauaauuuacuuucaauugugugcaaaucaagagugggcaugggcaugagacugcagguguguauggaggccaaagacagcagaacuugaguuacagguggcggggaacaggcugaaugugaugcugggaacagaauuugggucaacugcaagacaucauaugcucuuaaccauggugccacauuucuaaccucuuauacacgcacgcacacgcacacacacacacacacacacacacacacacagagguagaauauggauaagaggggagggaaagggucccucuaaggauaauagaaagaaggaauccaguucugguuucugacccaaguuugcuaugugaguuugaucaucuccuucccuauuuuugcauaucuuccuccccuaaccuuaaaacagucucucuuuacuguguaacaugugcauuuacauauauaaugucacuuggaaaaguaaauuuauaguuuuggaaauaaaauguuauagcuaaauaauuauuccgaauacuagagcaacacauuuuacaaugaaguggcagugaguuucuuacaaaaauuucaacuauucaucgcaaacugaagaaacuggggcccagagagaaagaccaaguaugaaauucauaauaucuagccagguaaaggccaugcagacauagauugcucucuugaagccagagauaaaacuuggauuagagcucaaggcucuaauguuaucaguggucacagcacuuucuuaaacuaagagaagcauccuuagcccaugaaguaaugaacaugccugcaaaauuggcaacauuugaagugugcuuaagguauuugacuuuugaaacaggagacaaaguuacauagccaguaaauugagauaaguucaguauuuugccaucuccugugcuugauugucaucaccugggugugagguuggggguaaagcacugccaaaaucuuuuaaggucuacgcugacuuuucagguuucugaauucaaacauuauuucuccuaccuacugucugguuaguuaguuaguuaguuaguuaguuuuguuuacuucagucagggucucauuuuguaguccaggcuugucuugucugaaacucacuguauaacccaggcugggcuguuaccuugagacaauucuauccuggucuucccagugcuaggauugcagccagggccaccaaaccuggauuggcucuuucauuucaaaccucccuuuccaucaaaaaguaaaggaagaagaguugguaauagaugugcaauugaugauguuuuugucuuagaccauuuuguuuuaaauuuguuguuguuguugaugaugauuuucuuugagaaaagguuucucuguguaacagaccuggcugucuuggaccucucuguagaccaggguggccuggaauucacagggauccaccugccucugccucccaaaagcuggaauuaaaggcgugcaccuccaugcucugcuauuauuauuuuuaauguguguuuggccagagguuugagauagcgucucauguagccaagaguggccuuuacuuugugguccuccuaucuuugucucuaccccaaaucuagaccgcuggcaugguaaccuaugucacaggugagauucauccugagaggacauuaguacuuguccuguggcuccuuuaguuaaugagauuauagauacagccugguaucuacagguguugagauuacaggcauauaucucuaaaaaaaaucuuuucuuucuuucuuucuuucuuucuuucuuucuuucuuucuuucuuucugguguugagauuacaggcauaucucacuaaaagaaaaccuuuuucuucucuuucuucuuuucucuucuccuuucuuucuuucuuucuuucuuucuuucuuucuuucuuucuuucuuuuagaaagguuuauuagucuguagccccaggcuggccuggacuucacuauacaacauagucuggccccucgauucauugagauucuacuuccccagugugagccaucauaccuggcuugucucuguuuuuaaaucuuuuuaccuucuguaauguucugccuucuuguccuucugcaagaugguguuugggagaucaugggcuugcugcagauucuuuucagggggaaaucauauauucugacacaguuuaauuuggggaguccuuuuauuuuggagcuguauguaucacuucuuuucuucacaucauuugccaagucaugcagcagucuguagaucacauaugaauaguuaagauguagucaucaugaaggaaacuuuauugcaucuggaaaguuugccagugguuagaucuuugguuuaucuuuauuuugcuuccugguuguuacuggauaaggaaauggccagacuguuuaaauaaugcccuugauaaggugauaagggccuggugaggaugacaguuuuguaccuuuacauuuaucagauaccgggcuguaucuacauucucauuaacuugggagucacagcagcaguacuaauguccucucaggcugaaucucauuggugacauagguuaccaugccaacagucuagauuugggggaaaaaauuaaaaguccaucacaaguaaauacccuuauuaaagaauucacugucuagauaguugcagcagcauacacauauggucuauauuacuuggggugccaaaguagaucgcgagagcccaggagcuugauucacuccauuuuagaaacauuuauccuuuccugugaguucauuggaugaugugauuaggcuugucuggaauuuuggaaaaguagaauauauuuuaguaugucaaaaugaguagacuuuuaagcaaaaugucaguguuaauacauauguguauuuaagacauuuucuuuuggugagguuuuuuuuuuuuuuuccauuguaaauaauagagguuuuguugaccuaccuuucuaucucuugcuuccuuccuaacaauauugguaagucuuauaacuaaaauaugagaugaaagaggauaauauagauuaccagauaguuggucuuuucaucuuucaagaaaaaaagugcaccaacauaaaccauugugaaaaguguagaggugaggacauuaccuugccuuucauaccuuuuuggcaggaugugaaaugagcuauuggaaacaucaguuacucgguugggugaucuguuuuuacagaacuagaaauuguucuagagugucaugacugccaaacaagugcucuacuauuacugaauagcccuugucauauuuuuauuuugaucuuacaggagcuugcuaaguuagcccaggcuagccacgaaguuguacucuuuucuacagcuuccgagcaauuggaauuacaaauacguaacacugagcccacgcuggguucaguuaugagauuuuauaaccacacauguucaugacugcaaaaauuucauuaucuauuuuguaucuucuguuucucuuuccacugcaggggauaaagauauuuagggaauauacuccaccacugacuuacagcaccaacuccaauucugugcuuuuuguaccacuugcagauuuccuaugguaggcauggaacuggagguuccucgggcuuguacaucaagcgcuuuaaucaugggaccaucucaguaaccucauagguuuuuguuguuguuguuguuguugguugguugguugguugguugguuuggguuuuuuguuuuguuuuguuuuuaaaaaaaaaaguuggauuauaugauccuaacuggccuggaacucacugugaagaccaagcuggucugggacuucuguugauccuccuaucucugcuuccugacuacaaccugcacuacagaucuauagcacuuuucugaauuugaacauuuuuguauuuuuuuuaauauauauauauauugguuuuuugagacaggguuucucuguauaguccuggcuguccuggaacucacuuuguagaccaggcugaccucgaacucagaaauccgccugccucugccucccgagugcugggauucaaggugugcaccaccaugcccggcgaacauuuuuguaauuuuauauuugacauaguguuuugugcuauagcccaagcuggccuggaacccacuguguagcuuaugaaaauaacuuaaguccucaguccauauauacucuggaacagccuuaggaagaaaugcuaguggcuuuauuauuauuuuuaacuaacauuugaacaacaauuguuaaauuguuaaagucaaucaccauaaauauugagacuuuuaucaacauuuuucucucaaaguuuuggggaaagucucugugaguaauuuuauggcuguaguuagaauuuugauguuugccagccuuaguggacuaaaauguaagggcuggggcuggagagauggcucugcaguuaagugcacuggcugcucuuccagaggaccagaauuccaaaauuccaucuccaguacucacauggcagcucacaauuaucugugacuucauuccucccucuucgggccuccaugggcaccagacaaacacauggugcccagacacacaugccaggaaaacaaauauacauaauuuuuuaaaguguaaaggcuuguaaaguugaauuauucaaugcuaaacacaaacugaacauucacugacaguucaaaaccaucagaaaagucuuaaauaauauuacuuacauuuuuauuacaaaagcuucuuauugaaaauugaagguacuuuuaaaagccacagagaucacucaucucuuuucucagagagaacacaguuaacacuuuguuuuugguuugguucaguuugguuuuuccauguuuuuuuuuuuccuauguaggaauacaguaugaggauugcuuaucugaaauacuuggaaucaaaugucuuucagauuuuauauauuuuugauugcaguauucacauacacauaaugagaugagaaccaagucuaaauccuaaauuuauguuucacauacauauuguagauauagcuuggaguacauuuuauauaacauuuuuaguacaccuguaucuuggcuguauucuguccuucaaggucaggguagaauuuuguacucauuguauaaagcuugccugcaauaaguuuuggauuugaggacacuguaaauucuggauuuuuagaugagagcuguucaaccuauaaaaugaaacagggucagacuauauguauuacuugcaaaccauuuauuauaauuauguuguucuucacuuuccuguuauuuuucucaugagcauguguguaaguucuuauucauguaugugaguaccugucuguguggguagggcccaagugauguugcugguuguuuuguucgcuuuccaccuuguucauucaggcagaaccucucagcugaagccaggauuugccugcuccgcuaguuuugucuacccagcuuguccuagggaucuccugucucagcuuccagaauuuuggaguuucaggugggcagugaugcucacuugcauaguuucauggguucugggauucggauucugccccuuggguuuguguugcaaaugcuuuaacuauugagccaccuccccagcccugcucuuucauuuuugauaagugguuugaaaauaccauuauugacaucuauugguuauucuuuaugcuuugggacauuuacuuucauuuacuuuuaucuuuuaaaaauaauauuauuuguacauauuucaauauuuuauuaguuucaaaauuucuauuugaggaaggaaguagauuccuagaaggaugaacuuaguaccacaugcuagaaauggagaaaaguaucuuuauccguuuguuucugcauugguuaaagauaauaagaaguguguuugugccaggcagugguggcgcacgccuuuaaucccagcacuugggaggcagaggcaggcagauuucugaguucgaggccaaccuggucuacagagugaguuccaggacagccagggcuauagagagaaacccugucucgaaaauaaaaaagaagaagaagaagaaguguguaaguuagacuacauauauguacauagaauuuaaaaaucuuugacaggaaaagguacuauuuuucuguuuugccaaguuuuuguuucagcugugaauucuguucgcuugcugcugagaaaaaaaaaaaggcagcugcaucugagaguauccaagccuugcuauacacucacagaucugaaaaccugaggaacaucgagagagagagagagagagagagagagagagagcgcucacgagagugcucucgaaaguacacaaaugccugacucuugucagugauugacuaguuagguucguaagagggacaggcaguuugugaagaaugucauuauuucacagggaggcaaacaugguuccacaggaguuuugcaaccugaaagccaauucuaauuuaaaaaguuaguuguagcuucucccagcacugaagauauaguauuuggaaccuaaauguuacuaagaauaauuguuaaauggcuaaugaauaaagauagaaagugauauggagucacauggaauuugaagacaagaaaaaaguaguuugcccagucuacugcugcauccaggacacaguuucugauugcuauuacaaaccuuuauugcaaaaauaauuugguuauuugguuaauucugcuggguuguuuacuauauuagucuguauuuguucauguauguguguacaugcucaaguguacacaaggauucaugucaagggucuuccucaauuauuuccccaccuuauuuuuaaauuuaaaauuuuuuauuuauuuucuguguauguguuuugccuacauguaugucugugccacguacauguaguacucgugauauccaaaagaaaguuccagaaccccuggaacuggaguuauagaugguugugagcugccauaugggugcugggaacugagccugggucuucuguaagagccaucucuccagucccuaacuuaguauuuuguauuuugagacaggaucucucauugagccuagagcauacugaucugguuagaccaccugaccagcaagacaggauccuccugucucuacuugcccaucacaggaaguauuuccucacaguguuuuaugucagucuuucuuacaugggugcuagagcuaaaacuugucacuccaggcaccuauguccccaucccuaguauuuuuuuucuaaugaguauauuaucuaccuaguaaccauaugauaaaacuaaauaucagaaaauguuuuagggucuggggaaauagcuuaguuggguaaggacuggcagaguucacuccucagaauugguaauacagcauguacuuguaaccccagugcuaggaagugggacauguauagauuccugggacucucuggcuagucaaccuagccuacuagguaaguucuagccagugagagccugucucaaaccaaaguggauaguacccgagaaaugacacaagguaauauucugguguaaacacagauaugcacgugcaugaauccccucccccaaacauacacauaugcaagaaacaacaaauagcaaaguguucuagaauucuuagaugaguucuauauuuaugaaacuuuauugacaucugcucuuuuauuuguggaacuaaauuagcauuuguuugucagugcuuuaaaauacuucaccuucaguucaaaggauaauauaccaugcaguuuuuauuuccuauguuuuguaagucaugggcuguuuguuauauuuaaggauagcuguacaaaacagacgaggaauuguucaaaguuacauaauucaagaaaagcuggauuuaaugaaagauguggaacaaccuaauagacuuuucuucagaaagucauuauuccaaaagcuuauuaguauuagaaauacuaauuauuauuuuaaggauuaauuuccuauaucaagacaaccugaguuuaugugggaucuuaaugaucaaugauauaaaacuaguagaaacuuacaaaagaaaaaagauaaaagaucacuagacuguaagauacucuuacucccccagaccccucuuguaacguauacauacuauugacaaaauguuauagauccuugaaugucugaaauacacacaaaacaguaaugaaacauuagcacaaauaauagaaaaauagccaauacauauuuuuucuugguuuuuuuuuucugaagcagggucucauauguaguccuggcuggccuagaaacuguuuuguagaccaggcuaggcuggaauccacagagauccacuuguuucugcuuccccagugcuagauuuaaaguugugcuccaccauaccuggccagaugcacauuuuuaaacaaauuaagcaaaaacuauuuuuaaaguuuauuuauucacuauuaguguguauauauguauauauucucucucuggguauguguguauguguguuuacaaauggacauagaugccaugaaggucacaggaaaccuuuguggaguuagcucucucguuccaccuuuauaugagugccagagauggugaacucagaucaucagacuugcuuuacccucugagucauccuacccaucccagaaaucaguuugacgaaauguguagcauggacuuaaaaacuggacauacucuuugauccaguaguuaucuuucaagcagccuauccuaggaguccuuaucuuuggcuagauaauuacaaacaaaagggcuaauuucagcuagagccguggcacaggacuagaggugaagcagagacugcaagcuuaagaucuuccugggcuacagugggaguucucuccaggcugugcaacuuagugaaauccauccuugaaauaaacauguaaaaagacagucaggaguauaacucagugauagauucuuuuucuggcuucugugagucucuagguucaagugcuuguucuacugccaaacgcgcacacacacacacacacacacacacacacacacacacacacacacggagggagggagggagggagcucaucuaaguacuauaaaaacaaugaaggcagccuauuauugagauaauauggcaacuaaaucaugauguauucagucaauugacuacuauaugaaauugaaaugccuucauacaguaaacagguugaaccuaauuuauggaacaguccaaaaucuagaauuuuuuugaacaccaucaucccucauguggaaaauuccauucugacuuuaugugauaagaugucaaaauacggguacauuaaaaauacuuuauauucugcgggguggugguggcggcggcucaugccuuuaaucuuagcacuuggaagcugaagcagguggauaucugaauucaaggccauccuggucuacagacucucagaagggcaagagcuacacagagaaacccugucuuuaaaaacaaaccaaaccaaaaacgaaacuccuuuauauggcuccacagauagaggcacguaccaccgccaacucugaugaccugaguucugucccaggcacccacaugguggaaggagagaaccaacuccugcagguuguccugugacuuaaacacaagcacacacacuaaacauaauauguaguucauaggauggcauucagguuauguguauagggugcauguaaaaauaaauuaguuuauuuuuauguaugcagguguuuuguuuugcauucauguauguauguguaccaugggcaugccucaaugccugcaaaggacaaaagauugugcuggauucucuggaaggaguuacagaugauuaugaacugccauguggguguuggcaauugaagcuaguccacugcaagagcagucucauauaaauugguuuuauauuuaggcuuauauuucaucucuaacauacauacacacaaauaugcauauauauguauguauguauauacacacacauauauauauguguguauauaugcaugugugcauauacauacacauguauauacacacacacauauauauacacacacuaauauacuauauauauuccugaaauucaaaaucguuaaaauguuaaaacauaugcuguccccaaacaugucagauaagauacuuaucuuuuauuuaaaauguucaguauauagcgagugauaaguggaaacaggauacuaaaauauauaugcacaugcaaaaagguaccaagaagcuauguaguagggauugcaagauaguggacuuauuacuauguuaaucuuccucacucauuucuuuauuuuuuuagauugauuuaucauguauagaguguucugcuugcauguaugccuguaggacagaagcggacaccagaucucauuacggaugguugugagccaccaugcaguugcugggaauugaacucaggaccucuggaagagcagccagugcucuuaaccccugagucaucucuuuagcccuucauucuuuucuuaucccuacauuuuuacagugagcuuauuuaacauugauaaaaguuauuuaaagggccagagaaaugggucagugcuuaugaaaacuugcugcucuuccagagaaccugaggucagcucccaggacccauaucaguuagcucagguggcucacaauggccuguaacucugauuccaggugucugccaccauuccgacauccguggacaccugcacacacaaggcacacacagaaaaagaaggaauuauuuaaauuaagaggcaccuuucucuuuucugaagagaaauggaagaugaguagauggggagacagcuacaguagaaauguaauauaaauaaauauuaacuaaguuuuaaaaauuaagaagcacuugaacuuauguccacuuuguauuccuuuuaucuggccugaaauggaucaugucauuuuuaguaauaguaauuacugcuguguacuaagagguuuuuuuuucaagcuuauucuuuuuuuuccauuuuuauuagguauuuagcucauuuacauuuccaaugccauaccaaaagucccccauacccacccacccccacuccccuacccacccacucccccuuuuuggcccuggcguuccccuguacuggggcauauaaaguuugcaaguccaaugggccucucuuuccagugauggcugacuaggccaucuuuugauacauaugcagcuagagucaagagcuccgggguacugguuaguucauaauguuguuccaccuauaggguugcagaucccuuuagcuccuuggguacuuucucuagcuccuccauugggagcccugugauccauccaauagcugacugugagcauccacuucuguguuugcuaggccccggcauagucucacaagagacagcuacaucuggguccuuucaauaaaaucuugcuaguguaugcaauggugucagcguuuuuauaugugcuaaauuuuccauaugggucgucaugcaauccucacaguaauggagccauuucuccaucccuuaguauauuucuuuaaguaaaguuucuaagacauaacuccacuguccucauacggcaaaagaccuuugucgcuaguaaguguauuuucuuaauguuuuuacauucugugaguucugcgauuccuuaugugauuucucuggugguuuugaagguggaaccucacuucgugugguacaagugucgcaagcucugaauguagugaggagcuguucucauccguuucuguuggagaucaagaugacugcuacucccuguuagaugaucaagacuucacuucuuuugacuuguuccccgaggggagugucugcagugaugucuccucaucuaucagcacguacugggauuggucagauagugaauuugaguggcagguaagguuccuuccacacacaccugaccaccuucccccccccccgccccccaccaucgacaucacuaaguggcagguaaguuuuccuugcuucuuauuaacaucauuauauaaguaaagguauaaagucauguucaaauguuucacuucuaccucugaguauuuaauuuuuuuucuuuacauagaccacucaccucuuauugggcauugguucuucaguuaggcuaugaaaagaaucagucugaauugaauucuucaugguugggaaguaggcaggaagucauguuaggaagugcagagugccuucuauccugguuccuuuucaguggcacuuguuuuaucacuauuugaguucauuguuauauaaguuguuagcucaaggcagugggaacauagguaaguaagccauucgcaccaggccaagcccagcgaugcuuccuuggcuuauguugaacuuucuuugugugguacugcucauaaccgaucuggaaugugucggcagugauguuggggaugaaaucccgcaucacuauucagcuuggcagcucucccagcuucguauccacggccgccgccuucucuuuuggugguaugacugaugccagcuuggagucaugaggaacuaaaguuuucuuuuuauaguuuuugaaagcauauuguacaguuaggaaauaaguagauggacuaugcauucuguauuuuugucaauaugccuuuuaggcuucugaugcuacaguuauccuuuuguagauuuucauguaagaaguaaccacuauuuccuauguaaguuuuuacuccauacuucauaaucgauagcauucauucaugugcuuagaagauacauaucagaauuagguuagaaaucaaauaugauaaaugauuucuaccauaguuauguaauuuuugguucuuaucagggauauacgguagugugucguuugauauuuuuauauguagguguuuuucuccccacaguaauuuuuuuucuucuugcagcauauauaauauguaaaauauguucagggcaaguuguuuguaaaggcugcaucauaaugaguauaguauaucagaaaaugcugcuucaucguaccauccauuuuaugauuguagaagaagaugacauuaaaagaagcuucccuugcauagaccauauguuuuauucaacacauaaacuugaauccuugcuauuuugaaagucaucuacauaugugaacuuguauuuucaaaaggggcucgcaauagcauuuauuugauuuaaaucuuuuuaugaaacuaucaaauaacagaggaugauauaaauuugaagucucagucccacuccaguuaccccuaugaaaugcuuuuacagauauagguguguguucguauacaaauaggaccauauuucauucaauaguugccuguauaauuuuuuuuucagauaauguaauaucucauucuucagagcugcauccauccuaacauuuuucaguuggcuacaguuuuguguauauaugugcuaucaagagugcuaggagaggauaugccuaauccugcagagacuugaugugccaggaugggggauacccaggggagggccucacucucucagaggaggagaggggggaugcaggggagggacuccaugagguggggaauggaggaauaguguuuggggugcaaacuaauuaauuaaaaacaaaugaaaaaagaaugcuacacugaauuaagagguuuuacagaagaaaaauauaguucaccaucuccauuuuuauuuuugugcuccauauagaugucaauaugcuuugcguaaaaguuuauuuuucaacuuuaaaaaguauuaaauucaccauuuaaauaauguaaaaacauauaauuucauguucauuaauauacccacaguuuuguaugggcaucaccacuaauuccaggguauuuuuguaaucccccaaaagaaacuguguaccuguuaaacacacagugucccacuucuuuucugucuuuaucacccagaaaauaccaaucuguucuauagauuuaucuuuaaaauguuuuuuauuaauuuaguguuugugugugugcaggugcacguuauacuguucacacggaggucacaaugcaacuuguuaaaaguguguucucuucuuuaaguauguguagccccgggagcaaaccuaaguuauugggccugacugaacuauuuugucaacuuucaguuugccuuucuuuguguaugaaugggcuuauauaauuauauauggcucuugugucuggccucuuaguuguugcacuuuuuucaagguucauucauauuccuuccuguagcugauuucagcuucuccuuugucuauacuugauguuucugcuuuuuacuucacccaucauggugaggugguaugauugauaguucgguuuugcuuuacauuucucugaugacuaauguuuaacaucuugucauuacuucugucauucuuguauacuuucuuuagagaaaaaccuaucuaaauccuuugcccauuuuuacugaugucugaguaauuguagauccuuguucuauauuuuucucacuaaauaaacaguuuguuaaauuucccuuucaucggcugucuuuucacuuaauugugucuuuuaauuugacaauacccuuugauagaauuauugauuuagacaggaucuuuccacauagcacaggcugaccuucaucucaggaccuuccugacucaguucuaguguuucaggcuucuacuacuaugugccauaaaugauuuucaacguagacaaguccuaugcauguuuuucuuuauuguguuuaugauaguguauuuuuaaaaguggcuuuauuuguuuaccuguuucuucuuagaguuuuagagauuuaguucuuauaagcaggucuuggaugaauuuugguuuuuuucuuuuucuuuuuucuuuauuucuuuuuugcauauggucccccugcuucaaaaagugaaacugggaaaagccuaucuuuuuuccuaauuggagaagaaagaucucagucuuuuccauagagcguaacguuaguaguuucucaauaaaugcccuguauuauacaaauuccucccucugaauauauugacuuucaggauuuuuaaaaaaauuuuuaugugcauuaguguuuucccugcaauguaugucugugugagggugucagauccccuggaacuggaauuagagacaguugugagccgccaugugggugcugggaauugaaccugaguccuuuggaagaacagccaguguucuaacugcugagccaucuuuucagucccaguuuccagguguuuaaaauuuagcaucauuugucuguuguguuucucauggcaugguguuuguuuauuuuggacucacaauucuauucgcuuaaugucaaucacugucuguucuugugcuugcagaacacuuuuaauugugguuucauaguguguuuugaaauugggaaguguguguucuuccauguuauuguucuuuguucuguuuuguuuugguuuuaugauuuuucagacaggaucucucuauguaguccuggcugacauagaacucacuauguagcucaggcuggcuuugaacuagauccaccuaccucugccucccaauugcuggaauuugaggcuuauaucuuaacacccaaccaguguuguugcucuuuauuaagauugguuggauuuugggagucccuuguaauccauacacauuuuaggaucgccuuuuacauuucuacaagaugggacaguugaaauuuuaauagagauuacacugagccuguaggucacugucuuaauuuaaauauugcaguucaagaaagugggacuguuuuaauucauuuuucucaaugauguuuugcaguaucuacaucuuaaauguuuugguucaauuuguuauaaauccuuuauuuugcuuugaacuugauauucuuaauuucauuuucagcuuucucacugcuauguauaaagcaauauacaaugcaaucuuuuugauacaguuuguaucuugaagcuuugcauuucccuuccuguguggagucaucuguguuuuccauuauuuaaggucacgugagcagugaauggguuuuuucccuuuauuuccagccuguuuauuucuugcuuguucauucuacccagaucauuaaaauguuuuaaucaugaaaauuuugaaguggccuaguaaugaugaugcaugccuauaaccccaucacucaggacacugaggcagcuggaagccagccugggguagacagugggauccuggguauccuccuaccugaaaaaaaguaaaaaaggugauaacacuggggaaagcuuaucuuuuuuaaucccuguucuuaggcacaguacuuucagucuuuuuccacuuaauauaaugauaaaaguagaugguuuucuuuucaguaaaauguguauaucaaauaggaguuuucauucuauugcuaguuuagucaauauuuuuuuaucacgaaaguaguucugucaaauguuuuuccuauguuuguugaaauguuagauaauuucuucauucucuuaauagaaugauuaaaguugaucuauuaauagacuugauacuacuacuaugauugcuuuucaugguuaaucaccuuuauauuucugaaacaaccccuaauguuuauguaguauuuagucccuuuaaauugauugugaguauaguuuuauaguauuuuguuaaggaauuguacguuuauauuuauaauuguaagggacacuagucucuaauuuucuuguaucuauguuuuaguuaggguuuucuggaagaacagaacuaauagaauaaauacauauuaaauggugacuaauuagauuggcuuacaugauguagucuagguagcccaacaagucaccucacaaugggguuucagccucaguuucaaucuaguucugcaggucuggagaguuuguggagagccacuacucuccagcccauguuggaagcccaaaacuggcuucuaauaucagcaauggaacagagcaaauaaaguugccaguaaaagugaaguccagaggguaaagagaaagcuuuuacuucuuuuaucugggcugucauccauauuuagagugggucuuccaacuuuaaaugguccaauagcugggcgugguggcgcaugccuuuaaucccagcacuugggaggcagaggcaagcggauuucugaguuccaggacagccagggcuauacagagaaacccugucucgaaaaaccaaaaaaagaaaaaaaaagaaaaaaaaagguccaauaaagaaauucucucacaacagugccuagaagcuugccuuuaacuugauuccuuacaauuuaacacaaaagauucacagccuguuaggcuuaguuauuagaguuauacgggucucuuaagaagacuuagccauaguggcacauguauuuaaucccagcacuuaggauacgaagguagguaaguggaucucugugaguucaagaucagccugcucuccacagugaguuucauagcagccaggaauacauaguaagaccuuguccaccgcaacagaucaaagaaagaaagaaagaaagaaagaaagaaagaaagaaagaaagaaagaaagaaagaaagaaagaaagaaagcaagcaagcaagcaggcaaagugaacaagauaagcacuugcacaagcuguagcccaucucauaccagggauguauguaaucguaaagguguuauguagaugaugaaagguuuuauauguccaaugagacaauacugugaaauguucucuaagagaaguguuuccugacuuauuacuuaaugauuaaagcacugaaaaugcuaagaugcuacuccauccaaagaaucagaucuugccuuuuacaguagcuacugguuuggguuuuuuuucuuccuagaaauccacuugcaagaacaaguugagccaucuuuacagacagauuuccuacuuguguuggaguauagauauucuguuuccauggauauuuaacauuuaaauauguuaggaaguuuaaaacgcuuccuucucuuugugagauauuauuaauuaauauuaaguauuaucaaguaguaacuaguguuaaauaaaucaugcaagauaaugauugcagcuuauuguuaugauuaacagagcaaaaucauugcaguuauagguuaaacaucaucaacuggcaggguuaaaaucugcgucuauuuaaacuuuugagcaaaugucuuagugcuacuauaguuaacauaagugauucauucaccuuuucuuuggaaaguucuauuugacuagucauacuuuaagaaaccaucucuguuguugagcaggaacacuuagagaaugcaaagggugaggaauucugcuuucucacuuuaaaucuagaagugcaaucugaaauuacacaucagcuguuacagaaaugagguuacucacagaauucugcuguaucuugcagaaaauaugacagagguuugauuuaauucccuccaugugucacagcuacugaugaugguagaaagauauugaauauagucuacaaaaauauaggacucuuuaagcauuuuuuauucugaaauacucuauugauuauagagugagaaauugcuggccuaauauauaggagcaaauacaauuaauuggacuguacaacugcuguuauauccucuuauguucaauugacuacauuuucaccugaaugacccuguuauuccaugguaacccauuaucugaugcugaguccuugaucugugauguuacuucaaauuauagugguucgauggacaaaguauguuagccuuugugacauaucuuauagcauaguaaauaaugacucuugucuauucaaagaauauuuguacaccccauuucccugcuguccauauccagauugcaguuuuauuucauacuacauuaaagaucugauugccuggcauauuugaaaacacuguacuuguguuuugaacuugguauuuucaguguaguguguuuguguguauguguguguuuucauguuacuuugaguggggugggggcaugauguagaauucagaggccagucucaggaauaccauccaccucuuuugagaaagggucccuuauugaccugaaguucuucaguuaaacaacagucuggcuggccagugagccccaagaaucagccuguuucugguuguuuugugcguuuuuuuuccugauuuauuuuuugauuagauguuuucuucauuuacguuucgaaugcuauccccuuucccaguuuccucuccaaaaauccccuauacccucccugcuccccaacccacccacucccacucucucuguucuuuacaucuggcacaugcuaccuugugcaguuguacauggaugguacuguguuaccuuccaaaguauaacauuuucauguaacgaucgugauuuccacucuguugaguccccauaccuauuacauugcuauguauauauuagaauucaaaugcauacgaaagcaauggugcuuaguacuaaaacucugcuuguuuuggaaauuuucaaagcuucgaaaucaucaagucaaauauaguugcaaauucuagagaaccaaaaaagacaguugguguagcuugucaucaugaaaauugcuuagaaaagauuuuaccccuuucuugauguguaucuuaaaaauacuacauuuacauaaacaauuuuuagaagauauuuaugugccuaucaccuugaugugacugucuugguuucauggguguauguaugugcauauucaaauauaucaaauuauacauuaauuguguaguuuuguuuauuaaguauacauuaauaaagcuguguaaaccacucuuuuuuuuagaggcaauauauucuugauaucucucacuuucugauuugaucuuauuuuucuguguuuuagaugaaguuuuuuuccuccuuugucuauacauugucuucuauuuucucauuuccuuuucuaguauuucuguuuugaguguuugcuuuaaauauaaagcaaauaaauauaaacagcacauuuuaaaugacuucaguuguucuuauaucguuacugugcacuggagaagaauucauggaauucuaugucuugaauaacgcucauaaguggcagaucauucgggucuccuguaauagagaucacuaacuccugcuuauucuucuauggccugaugauacugcagccauagaaguaaauuaaagaccuuaguggucauugaaacuuagauaaguauuuuagaaauucuuaguuacgauucauguuuuuuagaaaguacauuuucaugggaaagcuucaaagagaauauccugacauugguguuuuuguauaaaauugguguuuuguaugguuuuugguguuuuguaugaaagagccucugauuagauauuuauuugcccuuagucuuguauugaaguaaauuuuauuuucuuuuugacacaugaucuucuauaacugagagugaccugaggcuggcuguuuaacucugucuaguagugugccuuagacugcuggucauccucacucuacuuucugaguauuacagcaugugcaccaaccaugccugguugaaguaacauuuaauugauguaugaaauguguuaccauauuuaaaaugcaguuugucauguuuaauuuucuuaacccuugccuuuccuucuuuuauaaguuaccaggcagugacauugccaguggaagcgaugugcuuucugacgucauacccaguauuccaaguucaccuugccugguuucuaaaaagaaaaacaaacaccggaaucuagaugagcuugcuuggagugcgaugacaaaugaugagcagguaaacguguugacagucuuggauguugacguccuuaauuaaaaguguauguggaaaagaacucacauguagagaggaugggaagcccccuuuauucucuuuguagccacugaauuaugugaauugguuaauacaucuacaauugaguuucaacuuuucuuuucccaguaaacaagugaaaucaugacaucuuaguaacgcuccuaaggaccaccggucagcuccuaagguccagacagucauuggcucuucauuggagcccugggcaaaacaauucuucuaaugucuauaaugugucacaauucacauagcaaaggucagguuuuuaacacuggcauuguuugcuguacuucuucuucacacagguggaauauauugaguaucugagccguaaagucaguacugagaugggccuccgggagcaacuugacauuauuaaaaucauugauccuucugcucagaucuccccuacagacagugaguucauuauugaacuuaacugucucacagaugaaaaacugaagcagguauguaaaguaaauauagauuguuuaucuacugacgaugccaccaucuuauaaaguguaggcuuauguaaucauauguauauucauaggcuaucagggccagaaucacugcugugaaauguaacauuagaaagaaaaugauguugagguaagaauuguagcucagggguacgcuauagcgugcacagaacccugaauucaaccccugguucugccaagaaaaaaaugacaauaguugagaggauaugguuuuaagauguuuuaugugucucaaauaguaauaccuuucuggccagugaagaucuagacucuacuuuuaguuaucuagacguugaaacuuauuucaccauuuaaagguccagucagauuagugcucaguuuaaaacagaugaauugucagacucaauuggagugaugacaaacaccuguaauccuagcacuugggaugcagagcuggaaugaugagaaguuccucgacuaguuagggacuucaaggccagccuagagugugugagauccuacaggaaacucucaagugcuacucaacaagagcccugguggaauaacugagccugggcaggggcuuugagaugugcauuuccaaucacuuccaaauaacauuuuugcuacaccuuugcucuggcacaugcucugaauauuuuucaauucucucuuuuugcugucuuguguuuagcacuugugaaaauuuucucauuucacacaacgguaauauuuuuuuucuaccuuucagcuaguuuucucuaguaugguaaguugaugaguugcauuuaaagucggguaccauuguggccuucacuaaaauuaagggggaaauucacacuuguuagagacagaaucauuacuuaaaucuuugguagacgccugugaaaauguauaaucacaucuguguuuguuguuuucacuucaguguucuuaaaauucaaauucugaaagccauagcauuugcuacauaaauauuuuauauuuuuaaaauauagaucuaugugcuugcuagaguuuuaaacacugcuguuuuuuauucuaguccuucuuucuucccuuccuucgugcuguuccucuccugcucaucucuugguaucuuagucaggguuucuauccuugcacaaacaucaugaccaagaagcaaguuggggaggaaaggguuuauucggcuuacacuuccacauugcuguucaucaccaaaggaagucaggacugaaacuaagcaggucaggaagcaggagcugaugcagaggccauggagggauguuacuggcuugcuugcuuauagaacccaagauuaccagcccagggauggcaccacccacaauggacccucccugccccccuugaucacuaauugagaaaaugccuuccaguuggaucucauggaggcauuuucucaacugaagcuccuuucucugugauaacuccagcugugucgaguugacagaaaaccagccaggaaacuuggguaauuguuuucaaacauucucagucuguagcccagacuggacuugaaucuaauauuaagcgcaagccgggcagaauuaauguaccugacuugguauuuauuucuguauuuagguauuucuuauggccuuuuauccccccucuuuuagacauuuaaagcacuuugggcauaugcuccggcaucucgaggguagaacaucaaggugcaauacucaccagugcuugccugugugucccaaggucagaaacuauaucaaggagcauagccuucgucagcggccuacaagggaggccuggaagagaagcaacuucagcugugcaagcaccaguggagugagcggugccagcgccagugccagcagcagcagugccagcauggucagcucugcaagcagcaguggcuccaguguuggaaacucugcuucaaacuccagugccaacaugagccgagcacacagugacagcaaccugucugcaagugcggcagagcggauucgggauucaaaaguaaaauaucugauuaauacccaacguuaccuuucgauaguaacauuaguacucuuuugcuuaaauuucuuggcaacuaagagucgucucguccacuguguagaugccugcggguuuugguuuugauuggauagguagaacgcuguccuguugagcaaagcauucuaagcgagggcuuucaaauacucuuaacccgcaaccaugucaccuucaacugucucugguguuuacguucauuuucauuaagcaauaugggaaauaagauugcaacucacuccuaagcaaaucucgcuauguugcugauguuacugucaauuagauccuaaaacuguuguauagguuuuugauauguguguguguguguguguguguguguguguguguguuuaguguuuucuugguguuucaaccuuaacugcuccucgacuaaucaaaaacuauaauaagacuuuccauaauucuguucucuucuuccauaguugaaacuuauuuguggagcacuuguaaaagaaaguugaaguguacauggaaugguuauguggcuuagcaugggaguaugcaugguuccuugcaguggcacagacuagagcaauucaaacaugaaaggagaauuucuuugggaagauacaccaugauuccuuccucauuuugcuuuguuuugcuuguuuauuuuuguuuuguuuuguuuuugucaaaguggaagaaacaaaggcaucccuuauuauuugccaaggaaugucacuggacauguggcagcucucuugguuuugguuuacuagcgaugaggguugaauauccacgggguuccuuacaggcuuuuaagauagcauuugccuaauaugaaggcaugaucuuuucauagccacuggaaacuuuuuaguccucuggggguaaaauguaccuuaaaagauaagcauuagggauuuaggcaauguucucugcauuuuauauucaguuuuguguccuaguauuuuauuuuugcuguguugauaccaguacacccuauuuugacuuaaaaauacaauuuuucagaguaucuuauuauccguagcuagcccaaaugauuaaauuauacuagcucuuccuagccaaaagggucaccagugaaaugccacaaaaauagaaucuuaaaguuuuuuguuuuguuuuguuuuguuuuuuaacauuuaagccaguggcuuacuuauugguuuucgaaucaccaauuucuguagagaaauuugaacaacuuaauauuucgaaaguagagaauuagauccaccaacccugggcugcauacagcagugucuaaacuuuccugaccuuuuaucucccucuuuaacagaagcgauccaagcagcgaaagcuccagcagaaggccuuccgcaagaggcagcugaaggagcagaggcaggcgcggaaggagaggcucagugggcucuuccucaacgaagaggugcucuccuugaaagugacugaggaagaccaugaagcagauguugauguuuugauguaauagggugaauccgucagugucccuuugaagcguuauucucucuucauuaguuuacauucaucuugaccaaacuuuugguuaggguugugcugauguaauuaauaauuuaggccggugguuuucagagaguagccccagcacccucagcuuucagcaucccgaaaagaccuuagaauuguguuugggccccauuccagagccacaggcaguguggguuuggagcagcacuguguuuuaacuaacgccagacuauucucgugcacauucucauuuaaggaccacugggaagugucuuaacuacuuuaacuuuauggugauuaaguaggcuuuucaaagacuacuguauuuacaguuugggaaacuucaaaguacugauaucaaggaguuaauuuugucaguauacauuuaggguccguaauucaguucucuucuuaaugguaagauuuuuuuuaaguuuacuuuuucaaaagggccauaguauaauucuuaguuccuaggggcaaaucuuuuuugaggugagggugcacauaaggaaugcauugcuguuuacaauagugccuucauuagguuuaguucuguuuucacuaauuauuaaugcaaagguauaaaaaagggcccuagucuuuuccaauuagaugugaguuucuuuguuuuucucuacuuuaugucaagugagaaucauuuccgcaagugauaacuacugagaaguaaugcuacauuagugaaauuuuagacuuaacguuguguuucaaguggggauuaaguuucaaguggagauuccaguuaggcaaugauaccaaucaaauuuuccuguuguagccuuaaaguuaaggcugucaaagaaucucuaaacuagaacguuuaucuguuucucucuaucaaaaaauuuuaauguaguauaucucaauuuuauauguuugacguguggacagguugauguuucaaauuaacugacagaccacuuggaguucaacaaacuuuagagacugcuguggguauauaaagcaguaugcaguagaaaacaccuuuguuggugccuaguaggacucuuauaucuaaaugugaaaucauggaguuuuugaaaucauguuuucaaagaauucauuaucaugaccuuagaaauagccuggcuccuuuucuuguaugugucuuugagcauuggcaugggcuagagaagauacaaacugagacuacugacaaucaauuuguuuucugacuuucaggauuuucacuuuuacucuugcaucuaucuagaaagcaaccuauaaucuuuugaaaaggccacggaguucagagguuaauagaguuucaacaucuuuaacuuuaguucuucaaagagauuaacaacuuaaaauucuuaauuuuuacuugcuauaaaggcuuagauuuuacugaauuaaaaacugaaguuuuuguccuggucuguugacagacaccuuuaauccuagcguucaggaggcugaggugaggauuuguaaguucaaaacaagccuaggcuacauagugcuacgaaaauuuucuauaccuuuaaaauuuuuuauuuuuuuuuugguuucuuugaaggcuauagaauugaaacugaggguaaaaauuaguaccuugcagcauugcugaggccugugguugggcuuuaacuuucgaaugccuacuaagaucagaauuuaaaaugcuacgaagauaaaagugugaauaugugugcuuucaguuacaguaguauuucugacuuuccuccuaccuccuuugguacuccaucuuaguuuaaaggaaccaaagagaucuuggggucagauccuagaauacuuaauaaagaauguacgcaguuuucccuguaaguacagaaauagaaaaagaagagaagcaaaugcaucuaaacugucugccuucccuuagucauagcaaaaucccacagaggagauaaucugcaugcucuuccuauucucuaaggaagguggggccacauugagauacagggcaacauuuauccaucacccacuugcaaacuauuuguuuguugaugcucaguaaaagaaaauccaaaacugguucaggauauaacuuaagacuagugucucuauucucccaaaaaucaccaagucuucuuaacuuagauuuaacuuaagucaccauugaguaaguuuaccaaagugccaugggcagauuuuaaaugucuauaaagguuugaguauuuauagaagguaugucaugaaauuuucuguaaguccagcuucacucucuaugguagaacuggaauguaaagugucgauuugguggagauugaaaauacugcuuucauuuuaaaaacagaaacaaaaacuguggaacuccuagaguuguuuaugaucugagagagaggaagggagagagagagagagggagagauuaaaaucuuucuccuucccucuaaaacaaacuaucgcaaaagggcaaaagucucuuugagucuuuguuaucagugcuccguuaucuguuaggauguuucauguagauaauccagagagaauuguugaaauagguaguaauuuauuaaaucugguaucuccacgagguauauuuaaaacaacuucaagucagcaucuuuuuuuccuuuucaguggaaaaccuacuuaaucaguuaauuaaaaggaaaaaucagggaaaugcucaucaaaaguguugagucuguucuacuccagucacaauggcuaucugucaucaagaaaggcaaaaaaacuuacuggugagaagagaggauagaaggaaucuguauguacugcuagcgauagaaacugucuguagcaguggauaccuguaugggaguucuuuuuuuuuuuuaaaaauuacaauuaugauggagcuauaucauccuuugguauaugcugaaaguaaacgaacucagcauaugacagggauuuguaugugugcuuccaugucuauuacaguacugcucccaauagccaauaaaugaauacccaucagcagguggauagauaaauaaaauguaacauagauacauagcagagcuguauucagccauaaugaagacuggaauuuugucacuagcaagaaaagagauggaacuagacggagaucauguuaagcaaagcaggccagauucagaaacacaaacauugcauuuuuuuuuacaaguggacucuagauuuaauaaaaugaaacacaugaaacuagaauaggauacuaucugggaagaggaaaggcucuggugaaaaggggagcaaaaaugguggguguauaugauggaaguauaaauauguauggauaaauaaauggaagaauagaaguccagauuuuguuccaguguugguuaucuucuguccacaacugacaguggagugaauaagucuccuuuucauagauuuauccagagacauuuuauuagagaucuuguaagagugugucaguccuuauugcagcuuuuaaaagugugaacaaugaauuaagcaaaauggcauguauuuuuauacaguuuugcaaauguuuaaaggaagguguuguuuuagaauguaguaaguuguaaagggcuaguucauucuaucuuuccaaguacuuaaagucaaaugacacuuuuucuucauucuuugguagauagugacaguuuaguugacuucuguuguuuggguaaguuagacauuucugaauuaagucccagaagcugauuuauaaaaaaaaaaaaaaaaaaaaaaugaccuauagaguggguagaugucucauuuuuucccuagguuuuaaaaagugguaaauucccucaaaaaggaaaaauuauaugaaacuauuguauaaagguauccugauucugaugagcuuuaaacauuguaaaaucuauuauauaucuuuauauuuaagccaaaaauguuacaacauaaacucuauagcagucuuuuuguuuuagguucucuuagcaggcuuuuuuguucauggcuucucuguagccucaugugccuuaacgguggugaacguugccauuugcaucuauauaaggcuuucucaaaaucaaauaaucagaauguuaucauuugguucauauaaugcucaugguguuuggauauuaguaaaacuuaucaaucaguaguaauaguauaaaacaaaauaaaaaccuucagaucuuggacucauuugcuuaaaacuaguuuugauccaccacauuaaugaagggccuugcauuuacauaaaauuugcuuaauauauuuuuucccacugaaaaaauaccugagucaaggauacucuuuuacuucguuuuucuuuuugaaacaaggucucccuauacauucuaggcuagccuugaacuuguuuuguugcccaggcugaucuggaacuuguaaucuuucuccuuagcuuccuggguuuuggggacccagacgugccuggggaauauaucuuuuuaaacuaggugaguuuuaucaggaaagaaaauuuuuagggucuguacagaaacacuugaagagccaagauuauauagaaagguguuucuucuguuaacuuuaaggauucuucggauucguuuuguaaucguuggggcacccuauucugcuugguuuaacaaauuaccucuuagcacugucuucaagaauucuucucgggaauugauggaggguaaaguuaguuuggguugcugauaguauaguucguuuguguucaauaguaguauugauguugaaugcacuggcauuugacuuauuuaaguuagagauaaauuccaucuuuaaagagacuauuaggaaauaaaucauugagcaaaaaucuaauaugauagcuuugcaguagauuuaagcuucguaaagugagaugaauuuaucucagauuugaauguuauuaaguaggaagccuuugaggcauuuugagcuagacguuucugucaguauauaauuuggaagauaguccuugaaauauuugaauuuggucccugaaaaauaauuuauauucucuaugagacuuagaaggaacucuggcaauuccuguaacuggcuguuaagaaugaggaagcuguacagcauagcucaaaauccaagcuggcucacuacaauuaaauuuccauuucuuaaauacuaaaauuugcuugcggcucacugcccaaauauuguuugaauugagcuuauugauauuuuagcuuaaaccagacaauggcaaauugcauuuuaauuugacauucauugccaaacucagaaaaaccagugugaucuuuucugaugucaauauguaguaauuuuucucuauugucagcuuucuucaauuacaucuugguggugaauggaacuuguggaaaucuguguucuuuuuuguggggauggaugggauggaaaggggaagaauugcuuaauuaaugaauauccguuuugacuaugucaauguaaauguggaauuaccgugugccaaugacagguacacacuuaaguuggcugaauuguucagaaggacagccauggcuuguucugugcaguugcuuguucuuaaauugaagcugaucucuuguguucguuuacguugagauuucaaggcuuuuggaaaauggggcugauagugucucuuccuguaguaggugaauuuaauuuccuguuuuccuguuuagauuuuaaaaaauacauaaaucuuuguguuggcaauuuaauaguacuguuaccaaaagaaguuacuaauaaucacaaacacacaugaaacaccucauagaugguuaagaguugcaaauugugggacuuucugcuccccuucuuuucaaaaaguaguucuguagaaucaauauaaccaaagcaaguaggaaguugacugguuuggaggaucuacaaguagucuuagauacuguaaaguaucagauugucaaccaggacuuuuuuccuguauuccugcgaaauguauucugaauuacugcacuuuuguauauacgacaguccccuguacauucucuauuuccuacaguguauauaaaaccuggcugguuuuucuggaagcugugugaggggauaacaauaguuauaauacaauugguuucuauuuuugaguuccuuuuugcacaugaaaauauuuuagcagguauaucuaaaugaguuugggugguuguaacggaagcuggcuaugugauggagcugcuuuuugaaccuagugucagaauuaagagucacuuuaguuauuaaggauuuugguacucauacuauccuaaguauaucucuuucccugcuccuuauaacuuuauacucuaaaucagcuucuuucaaaguuucaucccagaauaauuacuacuaacagagaauugccauuuucuuugguucacaguuugauuagacucuauaaacuuguuuugugagggucucaguuucccagaagucaugaacaaaacuaacuuucugaagagaucagauuucuagagagauuaucauucacacaguaagugaaaauuaggucaaaguuuuguugacagaaaugaucuauuuuccuuaaaagauucugcuguagaaucuuuuaaaguuaaguuucuagaaaugaaaugucuaugauugguuguauguauagauucaggugcuguuuuggguuuuguguguaggguuguuuuuuuguuuugguauuuuuucuuucuuuuguuuuuuguuuuucuuggguuuugggguuuuuugaucaccaauguuguuuuugccgcuagagggacauuagugauucuucuuggaaaaaucuuagccguuuuuuguuuuuuguuuuuguuuuuuaguuucauagauuggcaggacuuauucucaaaauguuuugugugaguaaauauguucauuuauuagucaacgguagauuaauuaagcuuguuuaaugaagaaggcagucauucuugcugucuguaaccuuuuguuuuuaauaaaugugaguuaaauacuaaguaaaac

SEQ ID NO: 9756 - RNA, 1627 nt, Mus musculus
auuucuuccagauacugcuaaaauguccacuuuauauuuauuuaccuuauaugccauacugccuuacagguagguuuccguuucugucuuccccgcuaguccucauuuucuuguuucuauacacauggugcgaagaacacuggugauuugauauuaauuaaaccuuguuaauuugagcaucgucacuauauuuucucuuguuugggggauauauuuccuuuuuguuuuucaaauacaaguuaguauuauaugacacauuuucuuuguuuuucuuuuuuuuuuaacauuuauuuaauuuauuuuauguguacacugugacugucuucagacacaccagaagacaggaucagaucccauuauagaugguuguaagcugccaugugguuucugggauuugaacucaggaugucuggaagagcagucagugcucuuaaccucggagccaucucuccagccuggggaaauauuucuuaaugccauaaacacauuuacuuuuuguaucacuguuccuuucuaaaguauuuggacuauaauaaugauaccuaauaaauuuguaaguccuaauuaucacaacauaaagcaauaauuauugauauucuacacuaauuuucuuagaacauuauucaaaauuuauacaagauauucuuuuagguuugcauaauacuuuauaaaaaugugccaaaauauaaagacagcaaaaauggagcauaaaauguugugcaguuaaugauuacuuaaggcaagaaugaacuuauaagcuuauaaauguagagcuguguauguaccugacaagggaaaaaauggucucuuugugagucuuuaauuugagauuaaucaguuuucuuggugacucaucuugaucaaguguguccagcaguauuuauuuaguguguagcaauaacuaugagaaacaccuaaaggagacagaccucagguauuucuuccccugcagucacuuaaaaagcuagaaaauuugagauugcugcuaucacacuuauaagaaaaagauguagccagacauagucaaacugauuuccuuaauuucuuaaauaguuuuagcuaaaaauucaaauuaacuguguaucuuuccuuuguuagcacacauguuuccuaaaauauuuaguacuaucuucagcgaguggcuagucagaucuaagacuuccaguccuuuugccguuagcuuccugaaugacugggguuaccagcuugugccaccaggcccagcuuauccucaguuuuaaauuuuuuacuuguucuaauuuguauguguguguguguuugugugugagucuuuuucuuuucuuucuguugcuauuuugauacaguaucuugugucauccagacuugccucaaacucccugugcagcugagaauugacuugaucguccuaucuccacuuccugaguauuggcauuauagacauguauuaacauaucuaucuuaauuuguguuugagaaugauaaaugcaucccucuauucccuuuccuauucuucccauacaugccucccccacuuuccccuucaauuucgugaguucuuuuuacagaacccauagaaaagaaaaaccacccuuaaauugugguuucaacucuucuugaaaauaaaaacaguaaaugagaaacagua

SEQ ID NO: 9757 - RNA, 5990 nt, Mus musculus
ugaaugguguugcuaucugagagaugcaaguggcuucuugggcaugugcuguaaguaguuuuucuccuugggaacauugaacauugcuaacaagucagaggcccaaauaccugugauuuuguuuaggaggcaagagugcucaucugauaauugacccucuaaccagccuuaaugacuuugauaggaagaguacucuggugaugaaguagagauuugaccuaagaguggacgaaggaagguuggagaggauaagaggcccucuguccugcuaggagcugauaaauucauuaaggccuuaagcuuaggcaauggcaagugacuguagagauggagugaaaagaaauucauauguauuuaggcaguauccauuggucaucaugaccauuagaggugaugaacaaaaacaaagcaagcccuuuugaucugggucugucuauaaacagugguggaguauauugagauauggauugaaaaugaaggaguagguucguggaguuaagagagagaagguguuuacauuuggaaacauauauuccaaaggaggcugaaguccuaguggauaaauagcaacuggguagaugaguaaggauuuuguaagacaguauggauuaggaggauuucuauauuauagcaguuuauaccuaggacaaggcuacucauaaagaacaugacagucuuaggaaggggucuuauacuggccccauggaucucuucuuuuaaacuacugguguaugauuauugugucucuacaucuggcucuuuguuucuuuguacuguuuuaugcuuagaaaacuaauaauuccaagaagauaugcauacucagaagaauaagaucuguuagaagugagaaaugacucuucaguugguacuaaaagaaugaagucucuaaaacaugaauguuauacuuucauuuuccucuuguuugaaaaauacucuuguggcucccauacauugcacaggugcaugaguguugguuuguuauguuguacaugacuugauaaacuauuguucuuccagcccaacuagucauuucuuguagggguuguucucauuuugucauuucagaaauguuaccuuaagaaaacauccauuuaaaauugacauacacacuaaccagacuuuuaaugugcauguaacauaaauagagggagugcuuguucugccuaaugauucgucacacucauaaacugccuuuaguucaaaugacaagcaauuuguuuuccaggaauguaaauuaguaucaguauuuucacguguuguuacuacaugguaaugaauucaugacaucguauaucuguugcccaggcaaucuauuucuccuacucuuucuuccuaguagacaugucacuggucuuuagugaggagagagacuacugcuccuuauuucuugcugaacacaccaucaaauacuugcuuuaguuuuauaaaucaaggugggugacuuauguuucucugaaucagaaacuguuucauaugucuacacccccucccaacgguuaucucacuucauguuuuguagaucaucuucauuccagaaugucaguguucuucuaucuguuugucuugguauuugggcuucaggcuacaauccauugugcaccacauaacagcucugaaggcaaaguaacgaccugucauuugccccaacaaaaugccacucucuauaagaugccaucuaucaaugcugacuuugcauucagucuguaucggaggcucucuguggagaacccagauuugaacaucuucuucuccccugugagcauaucuguugcuuuagccaugcuuucuuuuggaucuggcucuagcacccaaacacagauucuggagguguugggguuuaaccucacagauacucccgugacagaauuacaacagggcuuccaacauuugaucuguucauugaauuucccaaagaaugaacuggaauugcagaugggaaaugcaguuuucauuggacagcagcugaaaccauuggcaaaguuuuuggaugaugucaagacccucuaugaaacugaagucuuuucuacugacuucuccaauguuucugcagcccagcacaagaucaacaguuauguggagaagcaaaccaaagggaaaauuguaggcuuaauucaaggccucaaacugaauauuaucaugauucuggugaacuauauucauuucagagguaaggugucaagaguugucccauguaucacagugauuuuucacuauuggccccuaucugugcauuguauuggauuauuccaggaugacacacagcucuacauaugaauucaggaaauuucuagggagauaaaacuuuuagagaugugguugacaauguuaugaauguccugauccuaucaggcuacauaauuacaguuuguaauauauuuaaugagaugggaaaaaccugugcuugggaagucaacugaauuucuauguaagaauaauaugauccuuauuuccuguguacauuuggauacacugcaaaaauaccuuguaacauauauuaaguaccuacuaugugcuaaagauuaugcuacaaaaacaugccauuaauaauuuucagugcuuauccuuccaagcaagacugccuaaaccuaaagcugaagcucuaagcaucaugguuccucuugauuguauagauccugauuuuuuuaaguuuggaugaguggacuuuuuggcauuagucacauaccuauauauacuuaaaauggcagaauaguguuuucuaauuucacccauuuuucuggacacucauauaucuuuucauggaaggagauucucuuucagguggguguagaaaguauaguguuucuaaaacugacucugagguccagcagcauugaaaaggacuucugguuuucccauauuguagccagaugaauacgucagcugacuuuuuuucucugauacucagugagucacuuguaguuucuugggaaacugguuaagaguagguaguauuaauuauuagcugaaugacuaaugguuucaaagaaacaucucuccucuuucuguguuuuaagcccagugggcaaauccuuuccguguaucuaaaacugaagagaguuccaacuucucaguggacaagagcaccacaguacaagugcccaugaugcaccagcuagaacaauacuaucauuacguggauauggagcugaauuguacaguacuucaaauggacuauagugagaacgcccuggcacuuuuuguccuuccaaaagagggacacauggaauggguagaagcagccaugucaucuaagacacugaagaaguggaacuauuuacugcagaaaggguaaauaauuuagaugauauggggaucuaaauguaggcuuaaagguguaguugaggaugaguuaaggggaaaccuagaaguaggaacauugcccagaagcagcuggcuguggcauuaugauuguuaaaauagguccacaauauauagugugccugauacuuuccugaauacauccauaguguuucaucuaagcauucugggaaaacuccaaagcuuguaguauuauggauauuuguaaaauuagaaauugucauaguuccccaaagugaguacacuaggaaacugauacuuuuuagggaacaacuaaaacuuugggaugcauuagauaugauguuggaggugaagugcacuuaugaugagcuagaacagcaagauggaaaaucaugaaguuccuacacacuacccuuugaucuucacaccacuagaccccuguccuugcucaauaacauggagcuauauuuuucugauaauaagagucaggacacuguguguuguagcccaauauuuucugagucugagaccacuucuuccauacuacuuuuuguguuucuagugccauguuaaugauugucaauguuuuccuuacuccacacagauggguugaauuguuuguuccaaaguuuucuauuucugccacauaugaccuuggaagcacacuucagaagauggguaugagggaugccuuugcugaaagugcugacuuuccuggaauaacagaagacaguggucuaaaacuuuccuauguaaguugauggauuaguuguuuaccauaggaucuaggaagggcauugaggaucaagugacuuacucaucucauuuggucaauuaggaaucuugugucuacagaagcagcaugauuccguuaggucauuaucauaagucauucuugaaucaauuuugaauaauuacuuaaaauaagucauuuuggaaguaauuucuggggcuacauugaugaugguuuagcagauaagagcacugcuugcucuuccagaagacccaaguucaauuucuaacagcaucauggcaccucauaauugucuguaacuucaaucccaugagauuuugauacccucuuaagugguuuccacggguaccaggcaugcaugugauauaaagacauauuugcaugcaggccaaauacauauauaaaugaagaaauauaauuuccaccccuaacuuucauguacaaagaugacucuaauauaauggaaagucuuaacgaagugauuauuauaagauacagugauagaggaugugagaaggacacuaaagagauggaaggugauuguuaaugagauucuacccaaacaauuuguacuaaaaucacagaaaauuauucacuauacaauggaauguucauauucaaggacaaucaccauaaugugcuguauuucuuuuuguacuaccaacuuacacaaagacuauuucaguagaucuucacugucuguucuucucccacaggcuuuucacaaggcugugcuacacauuggugaagagggaacuaaagagggagcuucuccugaaguugggucucuggaucagcaggaaguaccuccucuucacccuguuauccgauuggauagagcauucuuacugaugauuuuggagaaaagaaccagaaguguucucuuuuuagggaaacuuguuaacccaacaaaacaguaauugacgaagaguccauugaguauguacauauuauaauaggaaauaaauggauagcauaacuuaauguacuugcuauggacuuggacuuuauuucauuugugcaagugauaaaaguggaccuccucagaaguccauuggcuguagaagaagcuaauccugugaccaaacaugcagauagucaaugagugauuguuauccaaaacuacaaaaaggaucgauguugguaggucuuuguaaagcuggccaugaguuagcuaaguguagaauuuuugacuggggguacaaaugcuuuuggauguaucuuuuggacaauaguugcaauacaggucaagucuuugcauuacacuauuccaauaguaugaucaaugaacacacaaaugagguggcuuguauauaucaccuucaaaauaaccucugcucuuucuaccugugauuuuggcuauugcuaaauuuuucuuuuuaaaaaaauaaaacuucucuuacuauacuaucaagucauaaacugaguacuuucaacuaguguugcagcuuuugugaccuaacauguauucaacaacaaaccagggugaaauaaauucuucacacaagcccacaucaucacuagcagaugccauugugcuaauucauaagcuauugaugaaagagggacagaucauuugcaucauaugcuauauucauuauuuuuauauuccuuuuaaaauaucuuucuccuuucucucauggaaauuuccugguuauccugguuucuuuuuugucuguaguccucaauaaaauaugauauuuugugucaccagaacauccucugccuagguaugccauacuaucuucaccuaccgaaguagauuuaaucucaaauuuauguauucaaguaccuuguauuagaauuuggaacacaaauaacaaauugagaauuaauuaugaaguagccaaauucuaucccacaauauuucacuuacagaaaaugagcaacaaacauguaaguacuauguagguuugacuccauaugaauauaaauaaaauauguuugcaaaauaaau

SEQ ID NO: 9758 - RNA, 117515 nt, Mus musculus
acaguucaacaaagauguuuuuauguauuuuaaaaaaugugauacauaaaucauuuaacaauggagauaugcucuugaaaauguuaucaggcacauucaucauuuugaaaaugacagcgugggcuuacagaaacuuagaugcuccagcucugcuacauaccaagguugaaugauguauuauucuauagcucucaggucauaaauuucuacagcaugcuacuuuacugaauacagugggaaacuguaauaaaauggcaaguguucguguaccugaacauagaaaagauagagcaaagccacaagguggaugguuaaauaaauagugugucuguuaaguaauaccaagaaugaggcuuuaaggacuagaaauugcccuggaugagggaaugagucacugguaagggaaugugaagaccucagauauuauagugcacuucuguaauauuuuuaaacacauauaugcuuaagcuagaugacauucauauaaucuauuuucuugccuuaaaaauaacuaaugcuaauauaaguuucauuuuaaauuucaauucuuuaaauuuugugaccuuauuauuaauacuuaucuagcuaucucuaaucucuuaguacccuucccaacaauuauucacugcugacuaucauuuauaauauuggcacaaaaucaaaauacagaguagacugaugguaagagccagagauaguagacauaugcugugaaaaacuauuugccaguuaugauagcaccauugcacacacgaacucucagugguuguggccacaugcacgagcccugcauaagaucaaacaugucauccucgcuguuucugaaguuccacucuggcugagaagcuauugaaauugauggcuacuuggggagaaagaaacaguuuucuucaaggauacugcuccggagagccuagucaugcccuuguaggugguucugcaucgauguccauacaggcaguaguaagugaagucaguguauuaaaaauaagagcguaugaaauucagagggaaaguggugaggaggaugggggcggggaagggagggaauuugaucaauacacauugcgugcuuguaugaaacccuggaacaaaaguguacagggcuggagagagcucaguguguaacagcaguugcucuucuuguagaagaccugagcuugguucccagcauccacaucagaaggcucucaacuggcugcaauaccauguccagggugugugauaccucuguccuccucaagcacuugcccucauguucacauaccuagaagcagacacacaacccuacauauaauuaaaaguaauaaaaacacacuaaaaauaaacaaauaaaauuuaaagagauccauaaacauccuuaucacacuguuugccccaaggcucugaaaucaucuuagaagaagaggagaaaugacuguaagagacagaggugacaaaugacuauaugaaaacaguguuuuccagacacauaagagauguuacacacacacacucaaaguauuauaguagcaugcacaacaccuucacaagcucaaaccacacaaaaaucccauugcaaaauuuuaaucacuaggcaugaauuuucgccucuaguuaaggaacuauuggcaucuagucauugccaggaagaggaaaaucaggguuuuggguguuguuauuguuguuguuuguuuuguuuugaggguuugaccucugauaggucaaucacacuccagggccagccccauagccaagaguauuugggcugcacaaauuggacuccaggaguuaacaaaaaacaaaguaaccucccccucaaaauaggaaguuggaugaguagggagguaguggggaggucugagaggaguuggauaugguuaugacuaaaauacauugcaugaaauucugaaaguaacaauaaagauauuuaaaaccaggcgugguggcacacgccuuuaaucccagcacucgggaggcagaggcaggcagauuucugagcucgaggcuagccuggucuacaaagugaguuccaggacagccagggcuauacagagaaacccugucucaaaaaacaaaaacaaacaaacaaacaaaaagaauaaaaguauauguuuuaucacagcaagugucuuaucacagcaguuaacuaagaaguugguaugagaaguagacuuuugcuacugcugugucagucccgaccauauuauuuagaggaauuugaaacacuugggcccucuagaguagaaaagggguuaccccuacuauaaaauuacugauagccuuaccuuccuaucucuaauucuauaccucuuaaauugaucguaucuaggggauccaaauaacuauguacccacagauuuucacagucuaucuccccauguuaagucagaaugcuauuuccuguaccuuagacuaucuuauaaucuaucccuaugaaauaagggguguauuagucaaacuuauacucucagucuucaugcagucauuccuacacaauaguuaucuaaucugaauacaauaaaguauauuccucuccaguaagcccauaguuagucugaauucuuguagcugauaugacauuuaaaugaauuagaagccaaccauggcacccuucauuagucauggacaaauuuugugucccuauuguuaucauucuuacaccacucacgagcccauuugaaaauaaucuaaugaaaugaagagcacuugugguuaauacuuuggucuuagaaaugaaaaaaaaaaugagcaagacaugaucuccacaggagucaaagaagcuaaaaacuuuaucaucagcaucuaaaagcugaaauuaugcuuaagcuaugaccugauucuucuauaugaaguacacgauuuguuuucaaguacuauguaaguauuaauaaauuauaauguaauccuguguauaauaaguacuucauucuuaacuuacuaguaguggacuaguaauccaggugugguauugcaaaccuauagcccuaacauugcaguucuaagcuagccuauguuacauaguaaaaacacuaguauuguacauguuuaacaauauauuuuacacauauuuaacuagacacuaaaauguauuccuggaguuggagagauggcucagugguuaagagcacuugcugcuuuuucaggggauccaaguucgguugccaacacccauuuuuggcagcucacagccuacuguaacuccagcuucaaguuauauaauguaaucuuuuggucuccacagguacuuaaacauauauggcauacacgcaugcacgugacuaaaaauaaaaugaagauucacuucucauccaucuaagcauauacacaaaccuuuauaaagugcauaauucgcuaauuuuuaaucacagaggauccuuuucuaugugaacauuaaccaaucacuuuuaguuaaucaauaaggcauaaaugguauugauuguacaugguacauuaaaucaaaacaacucuagccaacaagcuuaucaucucaaauggggacacucauaaucuaccaaccagugugaaaucagaaacucuuuuaaguguuucuauacugaaauuguaaguggaacuuuuguuuguuuguuugguugguugguugguugguugguugguugguugguugguugguugguuuuuugagacaggguuucucuguauagcccuggcuguccuggaacccacuuugcagaccaggcuggccucgaacucagaaauccaccugccucugccucccgagugcugagauuaaaggugugcgccaccaugccaggcucguaaguggaacuuuugaagaccguuuaguuaaaacucauaaaauguuuccccuaaauguaaacaaccaacuaucccaugaucaugcauuugcuguuuuaguuuuuguuuuuuuguuuguuuguuuauuuuaauugaaggauuauaagacucagaacagccaucaaaccuuugacauagucuuaucaccucauagcugaacuugaaugaauauucuauauaaaccauaaagcacuaacucauccauauuuaauggacaauacagcuuuacaguccacacuaacacaagggcaccucauacacauacaaauauaacauuuucugguuaauuuuugucagcuucaaacacaggaagcugaccaaaaauuaaccuuuccaauugaagguauugccucugccagacuguucugcaggcaagucucuauaaugaauugauuuggaaaggcucaucccaauacgggcagugccacuccuaggcagguagguauuccugggauauagaagaaagcagacugagcaaacccuggagacaaacccuguaagcagcauuuccucaugguuccuaccacugauccaacaugggugcaugcccugacuucccucaauaaugaacugugacauggaaauauaaaccaaguuuuuggucaugaugucuaaucacaggaacacauaaacucacagucuacagauugcuauuacacagguaaaauuaaucuuuuaacccccucagaccuauucccucaaaucucuaaauucauuaaugcauucuuauauuaacaucauacaaacaucucaaauaaguaaccgucugaaacaguccaagaauagagucauggaaggggaauucuaagcgcuuaugagaaaacuccaagaaaucaauacaauagugaccucaguuucuucaacagaaaaagcagguuuguucuuggauuguguuuucguguuauuucagcuguuguuauucaugugucucuacagaaaaauaaguuuuugucaugugugguuuauccuugugaucgaacaucuuacucaugugauucuucuuaacccucagaguauaaacuguuugauacacugaauaaacuuggcuauugcaugagaccagucuaccucauuaucagggcccuacucucccacguucacacugccaacaagagcaguaaacaagaaauaucauauauucauuaauugaugauaauccuauaacuaccacauuuaauuaugacauuaauaagcaaguuuuaacccaauucuuauaagcauuuuauuuuuguuuuguuuuguuuuuuguuuuugagcaaguguaguucuugcuguccuggaacucacuauguagacccggcugcucucaaacuagccugagucugucagcugaguacugggauuaaagguaugcaccaucacaacugacuuacaaaguauuuuaacuuuaucuagacagugaauauaucgaaauauguaauccaaagcaugaaaauagccacaugccuuuuucuagcuccauaaacauauagguuugugcuuguucuuuuaaauuaguuucuugugagauugcacauggaagcagucauauuccagugaaaauucucucuaguccagugcuucucaaauuuccuaaugcugcaacccuuuaauacaguuccucauauuguggugacccccaucauaaaguuauuucauugcuguaacuuugcugcuguuauaaaugauaguaacugauaugcagaauaucugauaugcagaauaucugauaugcagaauaucugauaugcagaauaucugauaugcaacccccaaaaaggguugagaaccacagguuaagaaucacugcucuagccaggcagugguggcggaugccuuuaaucccagcacuugggaggcagaggcaggcagauuucugaguucgaggccagccuggccuacagagugaguuccaggacagccagggcuacacagagaaacccugucucaaaaaaccaaaaacaacaacaaaaaagaaucacugcucuaaaccauauuguucaaaaggaacaggcauugagcucauagcaguuugcucaaccacacccccauagaccaaagcaguguuaagaacuaagcauuucagaaagacuguuuuagaaaguuugacuaaaguauaaaaaacuacauauaaaguaaaaguaacuuaauguaauuuuaguauaccugaguaugcaaugaccaaaauacaaauuaugcuuucggcaaaacacacauaguauauauacaucuucucucuuuggauuuuuccagcuuaaauauuuaauuuuuuuaaaccuuuaaauauuuuugauaagacaggaggcucaaucacacauuagccuugucuacacagcguuaggaucaucacuucgucuucuaccuccacuuguuucaaggaaguucccaggacaauaguaaaauccaaggacccgcuuacgcggguaacacaaugacuucugaaaucucuccugaaguacuugucugaaaccauucagcacuuaacuuuuuaauaaguacaaggaauauacucuaaaauaacacugaaaaauauuaccuacauacaauagaacauuguucaaacuuaaaaagaagacccccugccacaugcuaaaaaagaaugauggauuucaagacgagguaaagcagaggaaugauucugcccauauaugaacaaucaaaaggauucauccucguaggugaaaaguagaguaaaagugagaugggaauugaaacacaagguuguuucuuugauuuucuguugggucugggggugggggguuguggggacaguccgcgcugaugugucacagaauguguguggaggucagaagacaaggugcuggauucaguuggcuccuuccacuauguggaaccugacaaugcaacugaggucaccaggccuggagcaaguaccuucacugacugacacaagccauauuuauuaauagguacagaauuacacuugagccagauuaaauuuuucuggagauguguuucagagcaugaauguacuucacaauaaggaacucuacauuugaaaaugguuaagguggccauuuuguggcuuuaaaaaaacauaauuaauagauaugcagcaucuauauauugccacgaagggaguccauaaagaaaacaagaagaugcuauuauuacuuacuugucagagcugagcuugagaugucagugcacaugccugauaacacuagaagaaugccauuaacauugcuauucuuucugugagagcgagguaagguuauucucugugguaaauccaugacggauuugcuuuugauuuccucagagcuuuaagauucaauaggcccccuagugacauguccagcagcauuaaacacacaaacaacucaccgauugguggaaaaaaauggaaugaggcugaagacagagcuaaggguuaagagccccuguugcacuuggagaggacccaggauuaggucucuggcagacacaaugcuuuacaaccauguguaacuuguuccacggcaucuggcacccucuuguggcuuuugagggcacuacacacaugugguacauagacuuacguacaggcaaaucaccaauacaaauaaaaaaucacuauaagauaucccaacagacuaaguaccagacccuccucugaaaggagauagggcaaagaacauggcagaggaggaggaggagcaacugaagacugagaaaguaaagugcuuucacuaguuauaucugagacccuagaagaugucucuuuacaugaggccaacaucucucucucucucucucucucucucucucucucucacacacacacacacacacacacacacacacacacacacacacauacacacacagaaagagcagacucgagucuuuaccucugcuugaucaucagguugcagguauucaaguagcaaaaccuaagcuugaguucuugagaagaaauggagaagugacgcuuagagccaguggacacugccuacaagacgaauccuuauccaccuuuucuuuucuaucuuuucauugccuuugaaugguuuuuuaaaaauugucaaaucaccagccucccuuaaaaggcuuguagaaaagacuucaaugacaucaagacagaaaacauaaugcauuaccucuuaucaaacuaaacacuaaaaagccauucaaauacaaauacaaucaaauacaguucacaacagcaacccuggggagggaaaggcaagagaucuggacuaccuacauuagcuuucuuuguuguuguuuuguuuuguuuuguuauuuuaaugaggacaagaggcaaaacuaauggaaugcaaucaagaacacacaauagguuacuagcaaggaacacacgguaaaacugugguuacagaggauagaagaaggaacugggagauaacaugaaauacaaaagcagauacauaggauacaaagguuuaaaaucucauguccaccaugaagccuacaauuaauaauagagcauucaguauuuuucgugaaauggauaaacuuuuccuuauuguccuugcuacagugaggaaaaauagguaauuaaaugagauguguauauuaauuugucucacuagaguaaccauauguagcgaugcuucacugagagugauggaguuauuguccuguuaaaacuaguggaaccuggacuauuguaauucagauguacauuucaugucccuuauuuaccacacaucauagcuuagcgacacaagucuguagcauaccagcuguuuccugucguaucagguacguaagagcuaugguucaccgcuacuuuccagcacugagaggauuuugccuuauaacacuauccuaggagaagauaaaaauucaaaauauaaaguauaauuucuaugaguauauauuauucaugcacuguccaaaaaaaaaaaaauaacccaaagccaauuguaaggcaggagccauaugcauccuaucaucuuauacucuuuaagaauauauagggugcuggugagauggcucaggaguuaaggacgcggacugcucuuccaagguccugaguucaaaucccaacaaccacaugauggcucacaaugaucuauaaugugacccaaugcccucuucuggugugucugaagacagcaacaguauacucauaugcauacaauaaauaaaucuuuuaauauguacauaaauuaaaaagugcuuuuuaaaaauaguaagauuugucuuuuuccaguugcugauuuuauaaauauuauuuaucaaaaagaaaauucuucauuacacaugcaaugaggccauugucacugcaaucuuaaagccaaaaaaaauuacaaaugaaaaugauaaaccaguccucugucuaugugaaaauucucaagauacauaaaaacuguauaagauuauguuuggauaugugauuuuucuaaaauauauuaaaaacauaggcccuaucuuggaaugguuaggagaugguggaaagcuaggaacaguguacauauuaaaaggugcucaagucauuggacacaugccuuugaaggcuauaauaggacccagcacuuccucuacuuuuuauguccugguaaugaugggaacagguuugcuccaccacauucuuccuauuacgaggugccaaugcaugaaaaauauaaacugcaagucaaaacagccucagacucuuuguaacuuaauucucaauaucaagacaagcuagacuuauccuaggaauucaaggucuuucgacuaaauaaauaaaauaauuaauuuaaaaacgaauuuuaaaaaggcaaugcaauaauacacccauuaauggacuagaagguaaaaaaacacagagugggaaaaaaaucauccaaugauuuucagcauccuuuagagauuaaaaccaaauacaccacaauccaauaauacacaccaauaggaauaaucaaaagaguucugcuaaggguuaguauuaaaaacauaaaaagagcuaaaggaacuugaucagagugccuguauauguauuucucaaaaagagacaacuggcacacacacacauauauacauauacauauauauacacauauauauguguguauauauauauauauauauauauguauauauauauauauauauauauacacacacacaacacacauguggcucaucaucauuaagucgaugacaacuuaaaacaaaccuuuagcaucauauagcauagguuaguuacaaaacaaaagaaaagagauaauaugugcugaugugaguaugaaggaaagaaaaccuuuagcaugucuacuuugaaaacauuuaugaggauccuaaauaacuggaaacagguuaccauaugaucuagcaaaccuaggucugaguguauaaccaaggaaaauaaaaucaccaucucaaggagauagauaucuacaugccuauauucacugaaguaugauuuauuauagcaaacaauaaaauucagugcaucucaaaggagggugaaagaauggcucagcuguuuagagcacugguugcucuugcagaggaaccagauuugauuuccaguauccacauaauggcuuacaaccacccauagcucuaguuucaggggaucugaugcccucuuguggcuucugcaggcaccagacacgggggaugcacaugcagcgcauacagacaugcaagcaaaacaugcauacaaaauaaaauaaucauucuaaaauauauuuuuaaaaaggagucucucgaaaaaugaguagauaguagaaaugugaugugguguguuugagugugugugugugugugugugugugugucugugucugugugugucugugugucugugagagagagagagagagagagagagagagagagagagagagaaagggagagagagaaagagagaaaaugaguguucgugagagagugaguaugugugagagugaguguguguuauaugagaaagagugugagagagggugugugagugagagagggugugugagagagaaagucugugagagauugugugugugugagugagagaggagaggagaggagaggagagagagagggauuguguguuuuguaucauuauggccaucagucauaacaaaaaaaugauacuauucauccuuuuaaaaaggaagaaaaucuuuuaaaguaacauagaugaauuuguuggcuuggccagcacacuauguaaaauaagcaaaauguggcaaaguaaauacagcaugaucuuagcaauauaugcagugaggagucuuguuuguuuuaaaggcugaacccauagcaaaagagaauguuaguugucaaggcuggaggcaagguaugcagguguaauuucuuugucacacgucacaacuuuuuagauauauaggauuuaugcauucuggagauucgcugauaacacaguaacaacaguuauaucauuuauuacaugcuuuaaaaccaucaaaugcccagauuuuaacaugaagauuagugaauauuagaugccauagccauaaauaggugacuauucguuuaaucauguauauguauauagugaaauaugucccauguuuacuuccccacuggauguuaauaaaucugagacaaaaaguuuaaaagaugaaagaggagguuggagugguacaauguaagaaagagucaccuguuauuacuggcuugaaaaugaaggaaggagaagcuaaguaagaauucaggaaaugucaggaaacugauuuuccaucuagucuacagaagagaaugaaauacuguaacaacuuuauucaauacacauaucagacacauaucauacuuuugagauacagaacuguaauaugauuaauucauuuugcuuuuuuuuaaaaaaagcaaugugagaguugaaaauaauuuccucguugcgauaaggacucuaaggaaaaccuguaaguaacagcacaucacagagugaugaaaggcugaaagauuucuaagaucagaaaccagucaggagugggcaagauagcucacucugcaaaaacccuugcuguaaaagccuuaugaauccauuuuuccccauauuccacugcagaaagagguaaaggaguugugaaaguuauauacugaccucuacaugcauaccauggaacaugugugccccgccccauacucaugauaacaauaaacaaaauaauuugccugccuucacuggcucuacaaaauauuuuauuggaauguuuauccaaauuagccaaaggaaaauaagguaauacguugauaaauaggucuucuuaacuaauccacggauguuugcauaauacggcuccauaauggacccauggaaaugaaauuuuuccccucuaguguucacaauugcacauuacaucuuugguaauagugaagcuaaaguucuguucaugcacccucugcauuacaugcuauauguugcucugccaaaauucuugagaaaagcaauggaaggaaggucuacuuuugcucuuaguucaagggugcagucuaucuuggcagagagguuaaggcaaugugagcuugaggcagcuugaggcagcuugaggcagcuagucacacugugucuacugugaggaagcaaagaggugaauucugaugcucagaccucauuguucuuuuaauuaaaucuggacuccacacccuagaaaugguguugcccauaguaaggguggcucuucaguucacuuaauauagauaacuguucacaggcauauccagagguuugucucuuaacugauucucaguguguccaaggugacuaguuaaacaucacaucuucuuucaucaaauaccauacaauuguuacuaugggcuuugccaacauuuucuauuguguucugagauaauagcuugacacaggacaauugucuuaaaaucuauacauuuauuuucgaaaacauacccaguacacauuuguuaaauaaauugaaugaacgaauacuaucuaaaccaaaucucuuaaguccugaucuuuacuugccugugagaaagacauuuugagaaaguugccuaugaucucugagccauugaaaucaguauaccaacucuaguaaaauguuauccagaauguagcaucugaauuaaauugauggaauccaagaauuuggagugcuuuggaaacauuagagaaagcaaguaaacaugaugugugcuuuuaggguuuuaauuaaauuuggaacaggagcaaaauuggguuuuauuacuuuccuuggaaucgauuccuucauuuggaauauauauaaaggggacagagaugucacccauauuuggggcaucuccauauuguugccauuuuaagugaucuaauauuuuuagaaucucugucacaugauguugagcaacauagauaaacuuuggaugauaaaaaucaaaacucacagcaaacacaugguguaauauucgaucuagagagcacaagucucugcuugugaauggacaucuggcucacauggaaccuagcuuacaaaagaacacagaggccaaauaguucacucaauucauaacuuuacugccagaaaaaaaaaggauucaaaaaagcaagguaaaaaguucaaacaugcugaaagaaagcuaccuccaauaagauccagugacagaauauaacuauacucuugcuuuuccaucaguuuaauuagaggauaagucacguauguucaaagagcaaaggccuagaggaguauuggaauggaaaauaugagaugcagauacuuacauccaaccaauggagucaagcuggggaccccuguaguugcauuagggaaaaggcuggaagaagcugaggaggagggugaccccauaggaagaucagagucucaacugaccuggaccccugagaucucucagacccugagccaccaaccaggcagcauacaccagcugcuaugaggccccgacacacauacagcagaggacugucuggucuggcuucagugagagaagcaucuaacucuugagagagacaugaagccccagggaguggggaguccuggcaggggugaggacauccucuuggagagggggcagaggaaugggaugaggaacugucagaagguguacugggagagggauaaugacuagacuguaaauaugauuaaauauaauaaaauaauaauaauaauaauaauaauaauaauaauaauaauaaauaaucaacuaguuucccaacuccauggaagaaaaguuugacuugagaguaacacucugaucucaucucucucgcucacuuucccuuuccucugaagaaggauuggcgggcuuuauaaacucuggcuuuuucuaggccauaaauuaauguagaccuguccugugcugaaacuuggugaaggcacugauuuuccagcaaacucagaggcuguucuuguaaaucugucuaguuuuuagguaggagucaaguauuuuaaaagguuuugguucuagauuaccagggauaaauccaaucucacugucauucacaucuuauuuuucaauuaguucugagcauagaaauauauauauauauauauauauauauauauauauauauauauaacaaaucuuuuauauuaaucucacaaagacaacaaaaguuaaaauuaaauacaaauauaaacacacucgaugagaaauacaagaaauaauuuuauggguuauuccauuucugacaauauuucaaauuuugaaaauuaaaaauuacuucuaccagaucauguuggggaacaugaccauggugaggaacuccggaaacugaaacaggaggauggugagucugagaucagccugggcuauauagcagaauggugucucaaacaaacacacaauacccuaagacuacauugucacuucugugucauuucccuugagaggcuguugucaauuuuguuccuuggugaacaauagcagaaaaacagcucugggggccaagggguugggacaacauuccauuaguaaagaaccugcaaugaaugugccauacaaguaugaagaccugaguuugguccccagucuccauauaaaauugcugugugcuggugaauaccugugauaccaggacuggggaggcacagacaaguggacuuggaggcuaguuaucuacccaaagccacgaguuuuagguuuuaugagagacccaguaucaaaacuaaagguggcaaaaauuuaaaaaaaaauaaugaagaagacaaccuaauuuuaccucugguuuccaaaaguacuaaccuucauuccacccccacccccacaaacaaaugcucacaaauacacauaagagugaauaaugaaugaguucacucauauauauaguagaacaaucauugaacucacagaaguagagaagagaauaguagcuccagagguuuuaucuuucuagcagagaagccagaaagauguuaagcaaaacauacguuguucuuguggaacuccuaacaguggggguguuuguuagucacaauaaaguggugucucuccuucuuuuaucugcucuugggacccuuuuccucuuacugggcugucucagccaguuuuacuauaaggguuuuacuccuagucuuauugaacuuuguuaugccauauucaguugauaucacugggaagacugaucuuuccugaacagguagacaggaggagcaguggaucugggguugaaaacaggagcagggaggggcugggaggaggggaucuaggagaaacugugaugaagguauuugagagaauaaauaauaggaaaaauaagauuagcaauacagcaacaauaaccacaaucaaaagauaaucagaucucaaaagaccaaaaaacguuguacaugaauucauaagaggauagauaguaaacgagaagaaacaggugacugacuauaauuggcucugaaauuuuauuuuuuuacuuaaaaauugauaguagugguuugugcaacucugugaguaaauuaaaaauuacagcauugacuacuucaaagggaugaaauacacauuaauaagccucauuugacagugauugcuuucagaugcauguauaugucauuuuuaaauaaauuugccaauauauuauaaggaagcugucuuagugcuuccacugcugugauaaaacaccauggccaaaagcaacuuggagaagaaaggguuuuauuucauauuacacuucguacucuaucaucuaaggaagccugggcagcaacucaagacagaaaccuugaggcacgaacugauguagagccauggagggaugcugcuuaauagcuuccuccccuggcuugcucagucagcuuuccuauaguaugcaggaccaccugcccugggcugauaccacccacaaugggcuaggcccacccacaugaaucccuaaauaagaaaaugcacaacaggcuugcccaugggccacucuguucgaaauuuuuuucucaacugaagacacccucuucuagcuugugucaaguagaccuaaaccuagccaacacggaagcacuucauguuauuuuuuaguuuuaagguacucuccuacuuugcuucucuauuccugaaauaaaauccaugaccaaaaguaacuuggagaagaaaggauuuguuuugcuuacacuuccacaucacugucuaucaugugaggaaacaaaacaggaaaucaaggcaggcaccuggagcgagaaacugcuacagagacgagcaugagugcagcuuacuaugugagccuccauggucugucugaucagcuugcuuucucucucuuuuuacacaaaaauuucauuauguggcccuggcuggccuagaacuaacuauguagaccagacuggccuugaacucacaaggcauucacuuuccacugccucuuaagucugagauuaaaggcacguacuacugcccuggccaucucucuuucuuuucuuuuucuuuuucuuuucuuuuccuuucuuuucuucucuuuucuucuccuuuucuuucuuuucuuuucuuuuccuuucuuuuccuuuccuuuccuuuccuuuccuuuucuuuuuucuuuaucugcgcuuauuuuaugcugaacuuauucccgugccaugaguuuuuguuucuucagucucuucugggauaucuuuuucaucugugcagccuccucuucuggcuuuggaacggucuguuccuucucagugaggaucaucucacuauggcagggagaacucauguauggguuaaucuggccaugagcucuguagguucgucagcgcaucuuagguucaccuggauauguucaacgacuagagaauccaugucuaaacccuuaaauucagcauuacucucugcauuuuuaagcaucugcagcaaaaagucagcacucuuuuuuggccaccguccauguccagccguacuauuuggccggugcacaaguaccauuauaccaccggguggcacacacugcuucuucuuccuuuuuuuuuuuuuuuuuuuuuuuuuugcaauuuuuuauuagauauuuucuucauuuucauuucaaaugcuaucccgaaaguccccucuaccccccccccgcccugcuccccuaccuacccacucucacuucuuggcccuggcguuccccuguacuggggcauacauccuucagauacuugguggcuuugcgaauaugcauacccuugaugaccugggcaguuucccggguguucuuaaagugaacacaaagguuugauccucuugauuugcauacuuuugugggguuuucugggucaagagaguagcgaaccaucuucacaggucaccucuggccacuuacaggaagagccccuucuugcauucuuuuuuuuuuuauuacguauuuucuucaauuacauuuccaaugcuaucccaaaagucccccacccccucuccccccacuccccuacccacccauucccauuuuuggcccugguguuccccuguacuggggcauauaaaguuugccugaccaaugggccucucuuuccagugauggccgacuaggucaucucccuucuugcauucuuauauaaacuaggaccaccuucucaggauggcacugcccauaguugggagcaccauuccacaucaaccaaagauuaagaaaaugcccccaacacacaagcuuauagaccaaucugauggaagccguuccucaaucaagauucccuccucccaggugacucuagaaaguugacaaaauuaacgagcacaagcacaaagauauaucaugcaaaauaaugcuuuuaaauccuauuuuaaaguuagaauuugaaaugguuauuugcauagaauuacaugaaauauaauuauuuagcucaucuggucagagaguccagcagacaaauacauaaaugaacuaugugguacaguaaaugcgaggguauuuauuuucauacaaaugagaauauggcacggcaaguuugggagaagcugaauucguccacucuauuauuagaagauuagcaugaauugugcaaccacacagugguucccugaauaaugaauaauauuuuauacaucuguacuuagcacaauuuuuggcaucuuguggcagccaugguuauuuguuuccagguaugaacacagaaauucaguucuagugcaauggagguggucugugggcuguuuguaauguuuguaauguucugggaaauaugaaguaagaacauuuuccccaacucggccucugacuguaaaaguugagcaaaauucauagggcagcuacauaagggcugagauauaaauuaugggcaaauugagaaauuuuuuaacuuauaccagguguaugauuucaaaauagcuuuucuaucccuugguuuuccauucucuuagcacuguuccuugaggaagacagauguaauuuugacaaugugaaucuauuucuuguuauggccaaugcuuuuauuaucagauccuagaaaacuuggucacagauauggccuccaaguuauuucuaggugugcuauucuuuuaaagucaacauuuaauuucauaaugcuuuuuaauaaaaucuugugugugacaugaagaauagcaaaaagaaaaagagaaauguuuguguucucuuggaauauugggcauccccuucuucuugagccacaacuugaggaucaagcuugaaaaaaaaaauccugaguuagguaacucagacucaaaaagacagauaugguauguuuuauguacuuauaugugaaugucaauuguuaugucuucuauaagcaggauacaguucauauaaccucagagguuagcuaugguuagugacuaggggaaugauuaacucaaacuaggugucugaaccaggcagagguggcgcacgccuuuaaucucagcacuugggaggcagaggcaggaggauuucugaguucgaggccagccuggucuacagagugaguuucaggacagccagagcuacacagugaaacccugccucaaaaaaaaaaaaaaaaaaaaaaaaaaaaaaaaaaaaaaaagaaagaaagaaaaaagaaacaaaagaaaaaagaaaagaaaaaccaucaaacuaggugucugagaaauaaaauauggauggauggauggauggauagaugggggaacagacuggaaugaaaggaucaaaugaguaggggcacagagaggguagugaggaagggaauaugggaagggauggcuaaaacuaagggccauuuggggguauauggaaaccuaacacagaaaaagcuuccuaaaauauauacauauaaugaugauccauauagaaccacaaaauaccuggggucauggugcccaaacugaacaguucuugucaccaaaugaagacucugaaaaugguuuacguuuauuugaauuuugggucaaagaaggcucauggguacucccuuggcuauuuccaaggcuauuguuugcuugauaacacccacacaacucauugaacacggagaaaacaagcuugugccucccaagagccuucaccucuacugacuagugaucaugguacuggagggaacuccgcaugcuaccaaaggagaaagguaucuaucucaccaacccagcuacaaaaucuccaaucuacaauugucaccagcauauaagauauguuguugcaauaguagcacaaagcuugugggacuaaccaaccaauacuugaguguguuuaacccccauuccaugagauggaaccaaauauuauuguuuccuaaggacauuauucucauagaucugugucuugcucagccaucaucagaaaaagauuccuucuguaacagauaggaauauaugcuggggacagcauaaaaugacagggacugccugcaguagggcaggauggagacagcacaaaugaacuauauacagccaauguccagggcuaagguuaggagaaaugggaacaacugcuacaaagagcugccgcaaacuacugagaugucuccauccuggccuacuacaggcaguaccugucauuguaugcuauccccagcaaauauauacagagauucacagcugggcaauguacagaaagugagagaucuuggaacacuugguccuaaauuggaagucuccaucaaaucccucuccucagggcucagggaacccuucagaagaagaggcagcaggguuauaauauccagaggugauagaagacagcauguaaacaaggccuucugaguauaguagaaccaaugcacuuaugaacucacagagacaguggcagcauauaaaaggccuccaggccaguugggguuccacugcuaagaggagagauagauacaagccuccauggcuaaccuagacauuauguccaauugacaaccacuccuugaaaaagaaaaauuacuuuuaucuaacaaagugucacuggguauacaaaccauucuuuuggccaggcucuguagccagcaguagauggcuaacacaaaaugaacuuagaauauguucuguuaugcuuccaguauguuugccuggagacaaauuagcagggcaguuucuugauuaauauaauugaucuaagaggauccagcccuuuucggguagagccaauccuggggagguuauccugggugcuauaagaaaggagguugaguacaugaggaggagcaaaccagaaagcagugucccccugugguuucugcuuuaguuccugccuccauguuccuacucugacuucccuuagugauugugaucagagaguuguaaaguguaauaaauccuuuuuccaaaguucaaaaaaaaaaaagaauauguuuuguuauuguugcuauccuacaggucucuugcuuaugguuccaaauuuuauguuuuuaaugggauuucuguguuugccaaugugagugucucuguguccauauguguaucuuaaacuuugauuucuaaucacuuuuuguuuuguuuuguccuauucuguuuugucuauuuuuauuuucucuuuuuuuuauuuucuucuuuuguuuuuuagaugccaaggaaguaugugaauuugggugggcagggagcuggggacaaucuuguaggacuuuggggaggaggaacuacaauaagaauauauuauaugaaaacaauauauauuuuuuaaaaauuaguauuuuguuuguaauauguugugguucuagaauaucaauuucguuauauccauuauaccacuucauaucuccaaacacauacugaaaaguaauauugagaugccuauaugaacacaauuauuuauauaaaauauaauaauaaggaaaagauaauuuucauuacaacauccaugguuccacaguauuucauuguuucucauaacauacacaaagaaaggcagacagaaagguagcaagacagacagacagacagacagagagaaauauguuuaggaauacaauaaauaagcucaugacaaaaauuugacaacagcauagagaucuuaauagaugaugaaacaaucauacagccaguuuauauaccuacaagugugucacuagaaaggauauuugucgucaaagaugugucauuagauucuggacuccagaccucauuucuuagucauuuaaagucacagggguuucaugcacucuccagucuuucagguaugaaagcauggaugaaagagaauaauaaaagacuuuuuugccuauugaauagaugaaagagaauaauaaaauuguguuggccuguagaauuguugagugauugugaguuuuauagagaagacaguuuaaagugccuguuaaauugaaaagauucucuaugaaauauuaaaaaaaaaaaaaccuguaagugaaacaacaaagaacaagaaacacuggagauucucuggaauaaugcagcuccuaaaugguaaagcugggauuucaggcugcgcacauauuccuaacuaucuuucugauuaauaugcauuaauauggaugaccccaaugaaagaaaaaauauaagauacccaacuaaaauuuaauuucagacacaccuuuuuuuuaguuucuuuuauugauaauuucuuuuauugacauauccucuccuccuuccuccucaauucauuccauguccccauacuccgcucuuaaaccccaaauucccauccucuuccucuaaguugcaugcgagcacacauauacaugcauacacauuauguauuauauauuaauuauauuuuauaugcuauaguauauaguauguauuaauuauauccuguacuagguccaauuaguaccguccauauguauuuaaguauagguaucacaaugaggggucaugucucugaagaaaacugagucuuccucccucagcagccauggacugccuauagcuucaacucaggauggaacauuguccuuccccaguucauacuagaauguauauugguauauucuuaugcagguaacuauaucauugggaguucauacaugccaccuccuuguuguauccaaaagacauuauuucacaucagccucccuaguuuucuaaucauucuuucccugcuuucaacacauucccugaugcuugggggaaaagauuaacacaucuuaauguaagaauaucuuaucaaaugacuuuguguguuuaaaauugaaauucaacuggaauucuguaauuuuaguuacuaaauccagggcuauuaccaauaacuaucucuugucauaaaauacaaagaaugcaguguguauuuugguuuucuuccccauuuuauccucaaggaaaggaauaucaagguaguuuuuuuuucagugaguaaaagugcuuucauugcauauaagaguaccugauuuucaaccucagauccuaugugaaauagccaagcaugguagccuguacuuguacuggggagacagagccagguggguucuugggcucacuggucagucaaccuagcuugcuugguaaagucccuaccaaugagauccugucucaaaaaacaaggugaaugaucccugaggaauaaaugacucuuaagguugaccacuagccacuacaugcacauauuugcaaguauauguacaaaccugccuccaauacccuguggauuaaagaauguuuaagguagguucuugcugcuuuuuuuguuucuuauaagagugucuuuuauuuguuucuaagaaauaaaacuauauuauaacuugaauaauuauguaguaauaaaaacaaugaguguuugcauaaugcacaguaaguuucuauagucauaauacaugugccuaaauuucauuguauaaaagaaauucuagaaagaaauuaaagaagaucucagaagauggaaagaucucacaugcucauagauuggcaggaucaauauaguaaaaauggcuaucuugccaaaagcaaucuacagauucaaugcaauccccaucaaaauuccaacucaguucuucaacgaauuagaaagggcaaucugcagauucaucuggaauaacaaaaaaaccuaggauagcaaaaacucuucucaagauaaaagaaccucugguggaaucaccaugccugaccuaaagcuguacuacagagcaauugugauuacaaacugcaugcuacugguauagugacagacaaguagaccaauggaauagaauugaagacccagaaaugaacccacauaccuauggucacuugaucuuugacaagggagcaaaaaacauccaguggaaaaaagacagcauauucaacaaauggugcaggcacaacuggcgguuaucauguagaagaaugugaauugauccauuccuaucuccuuguacuaaggucaaaucuaaguggauuaaggaacuccacguaaaaccagagacagugaaaguuauagaggagaaaguagggaaaagccucgaagauauggguacaggggaaaaauuccugaauagaacagcaauggcuugugcuguaagauugagaauugacaaaugggaccucauaaaauugcaaagcuucugcaaggcaaaagacaccgucaauaagacaaaaagggcaccaacagauugggaaaggaucuuuaccuaucugaaaucaggggacuaauacccaauauauauaaagaacucaagaagguggacuccagaaaaucaaauaaccccauuaaaaaauggagcucagagcuaaacaaagaauucucaccugaggaauaccaaauggcugagaagcaccugaaaaacuguucaacauccuuaaucaucagggaaaugcaaaucaaaacaagccugagauucuaccucacaccagucagaauggcuaagaucaaaaauucaggugacaguagaugcuggcaaggauguggagaaagaagaacacuccuccauuguuggugggauugcaagcuuguacaaucacucuggaaaucagucuggcggugucuuaguuaggguuuuacugcugugaacagacaccaugaccaaggcaagucuuauaaaaaaaaacaacauuuaauuggggcuggcuuacagguucagagguucaguccauuaucauuaaggugggagcauggcaguauccaggcaggcauggcacaggaggagcugagaguucuaugucuucauccaaaggcugcuaguggaagacugacuuccaggcaacuagggugaggauuuuauacccacacccacagugacacacccauuccaaccagguuacaccuauuccaacaaggccaaaccuucagauggugccacucccugguccaaggauauacaaaccaucacaggcgguuccucagaaaauuggacaugguacuaccagaggauccugaaauaccucuccugggaauauauccagaagauguuccaaccgggaagaaggacacaugcuccacuauguucauagcagccuuauuuauaauagccagaagcuggaaagaacccagaugccccucaacagaggaauggauacagaacaugugguacauuuacacaauggaguacuacucagcuauuaaaaagaaugaauuuaugaaauuccuaggcaaauggauggaccuggagggcaucauucugagugagguaacacaaucacaaaagaacucacacaauauauacucacugauaaguggauauuagcccagaaacuuagaauacccaagauauaagauacaauuugcuaaacgcaugaaacucaagaacgaaaaccaaaguguggacacuuugccccuucuuagaauugggaacaaaacacccauggaaggaguuacagagacaaaguuuggagcugagaccaucuagagacuaccauauccagggauccaucccauaaucagcuuccaaacgcugacacuauugcauacacuagcacgauuuugcugaaagaacccagauauagcugucucuugugagacuaugcuggggucuagcaaacauagaaguggaugcucacagucagcuauuggauggaucacagggaccccaauggaggagcuagagaaaguacccaaggagcuaaagggaucugcaauccuauagguggaacaacgauaugaacuaaccaguaccccucuggagcuccugucucuagcugaauaugaaucagauguccuagucggccaucaguggaaagagaggcccauuggucgugcaaacucuauaugacucaauacaggggaccaccagggccaagaagugggagugggugggugggugagugggugggggagcaugugggggacuuuugagauagcauuggaaauguaaaugaaauaaauaccaaaaaaauucuagcauaucauugauauuaaguacuugcccauggaaagauaaucuauaguacauauagauuucauuauuguugagggacuggcauagcuccuaaaauuauaagcucauauuuaacuuucauaugcucuuguaucaaagcacagugauaugccuuauccauuuuuugugacaaaauauugaauugaaaaaaaauuuuuaaaauuguagacauucaagguacaaauaugcaucaauuaaaaauuacuacagauuaacacacccaucaccacccacacuacccguaagauccccagaacaucuucauagcauaauuugauguuuuucacccuuuggccaauauuuuuuuuucuguuaucucagcccuuaucccuugauaaccacacuacuaacuguuucuaugagaagaacuuuguuauaaaagugagaucguauaauauuuaacuuuuugucuguggcuuauuucacuuagcuuaucguuccgauuguuuguuauggaucuugguaugaaagugauuuuuuuguuguuguuguuucuauuuugagacagaaccucacuaaaaguaucucaauaugaccucaaaugugugccacuccuaccaaguauaccaaguucagagacaauaguuauguacuaccauucuugucuuccagggugauucuugagucaagccuagacauuuggaacaucauguuaagagagucuuuaaccuauuuaguuucaguaggcagucacucuauuugggccuaccuggaaguucucaggcaauguuugugaccucaauccucaaugucagauuaagugcugagaacucuggccagaguuagccugcucacuguguucugucucagcuagauucccacuggucuuuagaaggugccucccaucuguccaaugccauuggaucagaguacaucuccccacuaugucuuuguuguguuuccugucugugcagugccuuuuggccaaaacgauggagcuuccuuugcuuauucauuugucuucuauacccauugguacuuccuggcuauaggaauuucuacaaccuaggcaggaaugaauacacaucagauaaaaagaaauucugaggaacucacagugguguugucuugauuucccugaaaugacaacuucauccuuccauuuuuggaguccuuugaugauugauucuugaaauguuccugugauauuuagaaggagggggaggagaagaaagaaaaaagugaacuuacaccauuuugucauauacuuggaagucaguuuaucuuuucuaaagucauuguaaucauaccauuuucauuaauauuuaucuaacaauaaauacaucaguaugcuuagcccagacaagucuucagcaguuagugacccaauacaaagcuuucucuucuuuauuguuccuugauuaccaaauaucccuaaauaugacaucauuauauaaacaaaugguccauuaucaacaaagauaugggaagagagaaaaucucauucucauuauuaaacaaaacacauauuaaaacuaucacaaaugcccaaauucuaauguuguaagcuucuaccuuauuaguuucuuuagcuuugccaucacauggcaucacauggcaucacaugugcaucacaugugaaucacugaguugugauggaaauucacaugcaauagaaagaacguguuaaucagagccuucuuacaugguugcgaauggguuagggcggggucugaaauagauggacuaauuuugagauucuuuucaacaccaaaaucagugccuucagauucuaccaugauccuaaacagacagcgacugaguucagguuuggagugacugaaaggaugguuaaccagccuuucuuucccccuagucccauuguuuauaaauccuuuuauuucauuccaagaaauguuuugaguaaugauaacaugaccuguucuaauauucugaggaugacuuuguacuucuuaauuucaguggaaagcuaauguaaaacugguuuuuuuaaugcucucugguugcuaugacaacuagguuaugcucuaaugucaagagguaaaaucaguuugcaagaauauuaaguaucuaaagcaacuauuuugguaucuaugaucacuaugagagacagacagacagucauaaagagaaagacaaacacacaaacacaaagaaagacagagagagggggaaaagaaagacagagagagggagagagggggagagagagagagggagggagagggaagaggggggaagagagaaagaaggaggggagagagagagagagagagagagagagagagagagagagagagagagagagaaucuguauccacauuuacuuuuuuuuuccuuguuugagucagugaaauauuguguuggcaaaucugguuuugaugucuucccucaugucccaagcccuguucuagccgaguaacuugagaaacacuggccauucaugagaagagauggauguaagcagccaaguugucaguuacuuagccacuuccccugcuuuuauguccuaaaauaaucccacaccugugcagggcgugccuaauuagccuuagacucucaacacuagacucugcugcuggacaaggaagacaguuuuggaaaguguaaaagguguuaggugaaacgucuaauuuuaaaaaugcuuggaauaaauuuuacuguuggcauuauguuuuuaaaauacccccaacaaaacggguacuacugagggaaauaaaaugauaauguaggccuauauucucccuaaacugucuuauaaauccaaugccaaaaucauuaucaaaaguuucauaaacaaagacucaaggaagugaccaaaaaaaaaaaaaaaaccuguuuuuauauuugaacagagagcaacaauucuggaaagauaaguagaacaugggcuggaugaaggaagauaaggcucauuucaauagggucuguuuguacagaauucucucagcugugacuccccaaugaagaauguucguuuugaugguggaaagagucuaucucucacaugaaagguuaaauuuucugauugcagaaagaaacugccagcuucaaaugcuccuguagcugcauauuucucaagugccuuucacuuauccugaagugggcacagucuugcggugucaugguuuacauauuucucagucacgugauaucauaaggaacuguguguuaguuacaauaaagaaauuuacuuguugaccugaagcaaaaacuucacucagcaauucuuaacuuuucaaagauuacauaguaaaaauaacgauuuaaaagaugugaauuauuaaaaaaauggcaaaaauaaacuugucuguggacaugacuguuaauaugggccccauucugcuuuaaugucauucucgccuguguuccauuagucuuucuuucuuucuaucucuuugccuucucccuuaagaucacuaccuccucaggaucuucuuccacuuuugcagcccacaauacacauacaaacaaauuaagaaagagggggagagaggagaaucuuuuuuaagauuuacaaaaaaaaaaaaaaaauggaauuauaccugaaucuguugccugcuugccuucuugccugccugccugcugcccgcccgccugcccgccugcccgccugcccgccugccugccugcggaucccauuccucugacugggccaccuugucgggguucaguuggagaagaugcaccuagccuugcagagacuugaugugaugggggggugggggagcugugaggaggaaggaaugggggaggauuugcaagagagguuacugggaggagaggggcaucugauaauugguauguaacgugaacaaauaaugaaugaauuuuaaagaauggaacaguccugucauuccauggguauauuucccuucucauccagcuguguacaaaaauaccuugaguuauauguucuuuauuuauaccucugcauauucauguagauaauaacuuaguaaaauaugacauauaauaggauagcaggcauucauaugucuacacuucaaaauaugccuaacaaaauuaauuugcaauuuaugcaaugaaugaaguaaaggccaaauguacaaacaagaaaaugaaagaauaaaagauaguaaauaaucucaugucaggaauaaaaugacauuaaaagaagaaucucauuaagcucaaaaacucuguaucugcgaccaagugucuuauccagugcugugaaaaugucaugaucacagaaacucauauaaaggaaagcauuuaauugggcuugcuuauacuuucagagguuuaguccauuaucaucagguaucagggagcaagguggcacacaggaagacacuguggaaaaguacuagcuugaaagucuuacauccagaucugcaggcaucaggaaauaaagacagacacaggacauggccuugggcuuuugaaaucucaaagcccaccucuagugacgugcuuccuccaacaaggccacacccacuccaaaaggccaaaucuccuaagacaauucaagaaugccacucucugaugacuaaauauucaaaaauaagagccuagggggagggcauuuucaugcaaaauacagcaauaauauagauuuuucuauguacacaauaaggguacauagagaauguucagugguuguaggucuaugauugauuugaaaguucuagcuuuaauuuuuaucauguuuuauuuuucagaagaaaauaggaauuuaaaaagauuaaguaauaauuuacaaauaaaacaaugagauauuagaagacaaaguuucaaaaguaugaauggauaaugaauuuuuaagaaaugugaguaccugauuuaguuacguaaacaaaauagugauuggaguucucaauucugacauauaauaaacuugaagccuggcaaguucuuucccaaaagggauucucaaagcucuaggcaaacauuacugcacagguuucagauguuucagauguuucagcauugcacuauggaaaauacagaaugguauccaacuugugaucauugguuaucaccagugaagcuauuguuuucuauguucacuggccauugauuuguuauuucccuauuuggaaguaaggaggcacaaacaguccaaauuguguuccccaagcagacuuugacggauguuacauaugcauguaauuaucugcaggcaaauuaaaugcucacaauuacaggcucugauguuccugcacaccagauguggcuccucugagcaggaauugccuucaguuuuugauccagauacuuauuucuacaucucaggugaaccaagguguccuuuuugucgccaaaccaaagcuagcauggaggcaauguuaauauccugugugucuuagagaaguggacugagagacagagcagcugaggaaaagacuuaccuccauucuccccugcaguagcagagccaugcuucauccccaacugccauucuaaauuguucucuggaggaaaagguuacccagggaguugcacaacuauuaagcacucaggagaagcugauagccagaaugggguugggguacccacuucguuuucucuuuacaaaggcuggcaagugcuccacacaaguauauacacaugaugggaaaguacuguagacuguuuacacacaaggugcuguccaggguuggcuuuucuguguaacccgcgaagagcaugguggagccuccuguguaguagauacuuuucucagugaugugagcauauacuugacaaacugaaagcauuggcaacugagauaucucuccagcaguuaguaaaaaggagagaccaggauuugaggagaauggggagggaaacacuggagguugugaggaggaaagggcagggacaauuauagucauuaaauuauaaucucaagaauaaaagauuagccuaagggaggaaagagauucauccucccugagaguacagcagaauucuacacauuauggcaaugaggucacagcagaaggggcagcgagguccauguugcagcauggaaacaaagaaaugugcacagcugccuuuucucuccuccuccuccucccccauuccuccuuguccucauucuucuccuuaaacuuacacccuuuuuucuccaucuguauuuuuugguacauuuuggcguuacuagacagggucuuaaucuguagccccggcuggccuagaacucacuaugaaccuuuggcuagccuugaacucacagcaauccuccccucgacuugauggcugauagaguuacaagugugagccaccaagcauucacacagggcauguuugcuccucucuuguuuuuaaugggaagggguaauaaaguaucuugugucagccagguaggcaacaaagugucuauguagcaaaggcuggccuagaacucuccauucuucugcuuucuuucccccaaucuuuaggauuaccacaugcuucaagaggucaaccuaauucccccuaaucauucagacuugggcuacacccaacauuuggugccuuucacacucaagaguugcucuccugucccccagcccccaguuaaacaucucucaaaauauucuccagauugacucacuaaugccagagacaacuuauaauucaaacugacaaaguuauccaucauagucaagaaaggaauaucaggacaauugucucugcauuuuaaaucugggagaagugguucuuaacuauacacuggauauauuuguggacacagaugcaugucuacgugaguacuauuauuguaaggguaaaauuaauacaccucgggaaggaguuuucugucuugugacucaggcuaugacaauuuguccauccacugcugcaccgauuuaugcacagcccaacaguaagcagaguaaacuugaucuguuguguuugauaggucacugacaugcuuccccugacaaguuagucaggggggaguuuagguucugguuggccaguggugacaaacaacagaagucucuugucccaguaaucacugaggcacauuccucaaugucauacauuauauuuuauauuucuuuggcaucauugagucuagauguaggcuaugucaacuaaucagcacaaagauggagcauacaaauggugauauagguuuacuaccaaucagagaguauguuggaagcaaauccuucccaagaaugaguuugaagggcaauaggagccuaugggcaauccuaaacuucuguuuuauauacugucugaaaaaucauaucucauaaaaggccacaacagaaauauuaccacuuuauuccucuguguggugccucauauccugacuuggcacugcuccuaugacugacagcucaguaaugauucugacccugagaaggaauagcauagaucccccaacuuauacucaagcugcccuaauggaggaaacacacagccaguugguguuuaugucagcucuuuaugaggcugugcucugagaacuggaucagauguauuuagaggagcaaaguuuuaaacaacgaaucaauuacagaccuacacggagucagugauguuauugugucugugugaggcucuguuuggcaauugacuuauuaguuuuaggaugcaggugcuugcuucuucuugugugggagagagauucuggcagcuccugcugaaagcagccugaaaaggcugagucacccaucaguguuuuccuuugcucgauuuucugaguuaaggugagaggaccgcaaugcucaggagccucugagggucugcuuucauaaaucagaagucucugagcaaauauuuaaagaugugucaugaggcuguuguggaugcaguggugcacuauuugccuagcaugugugugacccuugauucauuccucauuaaugaauaauacaacuaaacugaaucauaagucacagauauuacuguaggcauaauaauccuuauggcaaguuaugaaacacauuuuaauuagugguagaaaccagaagcuggcacacuuuccaguuuugcagcagguaggacuuauucuuugcuuugaaaaugauauagucucuucccuauuugcucagcuuugccauaauaccugaugcaacagccaaagccguuaagaaaaaagauuaaaaaaaauuauugucacugggcuccaauacacuuggcuaggaaaaaacacgcggaagccagacaacacucuguuuaucauuuauugagcauuauuguaaaauauuaugugcccaaauauuuggaaaauucuuguguuaacagucuguuucccaauacguuaugauuuaucaguuugaaaaccuaaguucuuauaaaaaagacaucaugcugugauuuuuuuucaggcuuaauugaguucugugugugacuuuccuaagcucgugguauagagcacagguuuccuagcagauguuccuccaggucagcagauauucucguugaugguguuaagaacucauuguucccuugucuauguaaaaaguaugcuuaaugagaaccagaugguucucugaagaaaaaggucaucugauggaucaacucagcauugcucagauguauugcugcuauggcugccccccacaucacccucucuacuugaccccuggcucuuucaguuugcucaaugauaaugucacugggcaauugagcccuaacagagaaagagacuacaguuccguaucugcuuuuccuuacuggcaccaccccaccucugacaaaaguauuuuucaugguggugcccauaagaacaggaaagaugggaggaugcugagacagaacuuagccucucagauaaucccguaugagaucccaaggcucacuaacagccaaucaugcuucgucagggagaagguggugagagcaucuauccucaucccuuuauauguugcuucaggucuagcagaccccuugucuguuguuuguuucuaggacuuuggaucucuucuuucucuggagagucacuguaaaccccaggccuucccucuaccuuucucauucaaaugcaauccauuccuucauggaccucuucucuaaguaaauggauuaugucacuucacugaaguuuggaaauuuuccccaagaguuuuuauccauuuccuucaacugcaucuaaguuguccaagacuugguguuucauugaacagacaccuaacgucaaccuccccagcacauguguguuucugacuccaucagccuuugcuguuuacuacgaugacuucuguggucugugacaggcagcucccauaguucugaggaauauuacuguaccacccuguccucugauaucuccuucuucuauucucucccuuuccauuucuugggauccaauuucacaucuuuaccuuucuguugugccagcaggucuuuggggccugucuccgagaacuuucucuuagagaagcacugccguugccuuucuuuccugucucugagccacacaacaauagaguucauuucagccaauggagccaugugguuacuguagguaugcuuugauuuucuaaaaaaaaaaaucuuuguuuguaaaaucuaugaugugccagguuggggugaucccaggggcaucucccccuucucagaggacaaggguagggggaagggguugugugagggggagacuuggacaggagagcuaugauagguauguaaagugaauaaauaaguuuucuaaacaaaauacaugggauuuuauaacaucucugcauguguuuuagaaacuugugcuuaauuggucuacuaucaccgaagcucugcuuguauauuuuccugguguuauaacccagcuuaccuuggcuuauguccauguguuuuuacauugggaacucgggcagccacuguagaaaccaguuuggaggauucaaauaaaagggagggggauaggcauccuacuccacagauguuuccuuggcuacauuuguugccacucauaaccuauagaaaaugcaaacauccuaauccucuuuuaacugaauaagggauaaugaaaauauugcacauaugcaaaaaggaauucuauuugacuguaaauaaaaaaaugaaagcauucaauuuucacauaaauggguggaacuagaauacauucauacuaagugaauuaaaacagacacagaaagaaaaaugucaccuuuucucccuuauuuguagagucaugaaaguagaaagggaccauggaaggagguguguuuaaggagcucuucagaaagagauagugcaacacaggcuuuauaaaagaagacauggggaaaguggagaggacauaaacuagagagacgggaggaaggcaauaugaagggaaauggagaaaagaaaaauauacgacacuaaggauguuuuuuaaaaaauauagaaaacauauuauuuuguaauacauagauguaguuuaauuagagauaugcccccacaggaugauaaugcccuccaaagacucauagauuaucuaaaagaacauccccggggcuagacauaagaaacauacuuuccuucuaguucuugcucagcagaguccaagaaacucccaacaugauauaagcugcuggugccucccagaaccugaaaaucagaaccuauugcugaggacacccgguacuucagacacagcaagagucaagcuggaauugacuagaaggcuccuuucuacagaccagcucucccaguauccaaagauacuauguaaguugcaaacggaaaagcaagcaacuuaauauucccacacagcuguaacaccuauaaacuacaagaaggaugaugagcccagcaagauauccugaauggugccaucaugauauauugacuuuguguguaagcaaaagcugcuaaauugaauuuaaggccuauuugauaggagaaaaauucaugcuugggauuguaaaucuugccagcuacccaagagcaguaaggucauagaucuugaaggagaacuacuguuagcauuuuccuaagccaauauaauuucuagcuguauucuaaauacucaccuuuauacaacaaauaaauggaauucucgcuccucaccaaacaagcaucuuuuugugucgggaaaagagaccauugcagagaccuugucuagaacuuguucaaauggaaccaacugaccaaacuggaacuugucaaaaaugcaagaauaagugauuguggggugcucagcaccccauaacacaacucugacaucuaaagcuccaggaaaauggcaggccucaucuguccuagguaagcucucugccacagaguuacauaucuagucccauuuuauaauuuuauuauuuauuugaucauuuuauuaauuuuuuuuuaaaaaugauauagagucucaaggauggaccaucuagagacugccauauccagggauccaucccauaaucagccuccaaaugcugacaccauugcauacacuagcaagauuuugcugaaaggacccugauauagcugucucuugugagacuaggccggugccuagcaaacacagaaguggaugcucacagucagcuauuggauggaucacagggcccccaauggaggagcuagagaaaguacccaaggagcugaagggaucugcaauccuauagauggaacaacaauaugaacuaaccaguaccccggagcucuugacucuagcugcauauguaucagaagauggccuagucggccaucacuggaaagagaggcccauuggacuugcaaacuuuauaugccccaguacaggggaaccccagggccaagaagugggaguggguggguaggggagugggggggggaggguaugggggacuuuugggauagcauuugaaauguaaaugaggaaaauaccuaauaaaaaauauauuuaaaaaauugagauagagucucaccaaguugucgaaacuggccccaacuuugcuauccuccaucagccucugguacagcuugcauuucauaugagcaccaucauuccugguuaaacaugagauccaacacuggugacuauauucuaugacuauugcuuauuuacaauucuuuuaaaguuucuauuuccaguauaaaugguguuuucaucuuuaguaauuuacuuauuuaaugauuaaguaaaaauguaaaacuauguuuaauauuuuuauuaaaaaauaacuucauuaaucauuguaagcucagaaaucaaagagauucccuauaaauaauugagucuacaugucuccagauuucaauucuaaguguuuacacaaaaauaucagaggcaccaaaaauuguacaugauauuuaauauuugcuaauauuaacauuuaauuucauuuuccccaguaaguuuaauauauaugcauauuaugguuauagccugauuuuuaaaagcaacguguguuugaaacacaaagaaaguaugcuaaacaauauaauuuugcuauucacucacaauaguaaauauaauuuuacagauaguuuugcuuuuauauucuguacuaguaggaauaccucuuugccuccucuaaauaagcagagaaauagauauugaugauagaaagugaccuaaagauauacagauacuuaucauauuuccacaauauuaucaauacuauguuaaucaacacuguauuaaauauuacuauauuaaucaauacuauauuagcuaauaucaauaguauauuaacaacaccauguguccuaauuuuguuuugcauugcugcaauaaaauucccugggacaaaagcaauguaguauauaguccauuacgucagcaaagucgcagcaacaaaagauugagggaaauggucacaugaaauuauauccucaguauagagaaaagagcaacugaugcaugugugcucacuuucuuccuucuguacaguccaggacccaaacccaaggaaugauauaggauuuuaggcuucuuagguuuuaggcugaaacuucucauaucaauugaaguauuuaagacggucccuugaagacauacccacaggccaaccuguucacagagacuuucuuccaaggcacuucuacauucugucagguucauaaaacuaucauuuuccagccuccacagucccuuugacuuuauugcuuucaauaccuaugcaggguuuuauacuuacacuugaaauuuuggaauuaggagccacagaugagagcaaaugugauccuugucuuucugaaucuggauuaucucacucaaugugaucucuucuaauuccacccauuuaucuaaaaauucaaaacauuauucuuaaauaaaggaagcguaagaauaaaaaaaaacuaacaauaaccauaagacauucaauugcuccaaagaucauguucauaaaaacacuuugaauaugcgucuagaaucaacucaaacaguaucuauaaaauggaauuauuguccacccugaaauccagagcaucauaaucaauaguagaccauaaagcaauagauucaaaucauguguaguaguucacgucuauaagccuggcacuugggaaccugacaaggagcacuuacuaucuugaguucaaggccaaccugcauaacauagugaauucuaggccagccuaggacacacugagacauuaucucaaaacaccaaaaguauuuauuaauaccucuuucaaauuaaguacuuuucagguuaaaguucuugcuuaacuucugguauaugacauuuacucacuaauugaagaaugaaaaagucagguaauuauguagaaaguauuuuguuuuuccagguaucagccacaguuucuggagaaaugguuuuagcucaaaguugugagccccuuucccaagugaugacuuccauuacuccccaguuguggaagguaaauccccauugcucaagacaccaugaaacagcguccacaagcgucaaagcuggaacugaccugaauuccaccugccugagaacuagacuucaugauaccagaagguuccaugcaaguuuccaaaggaaggaagaacucaucaguccuucccagcuaugacgccuaugaacuaaaucaacgaccagcauggcacaaaggauacaguccuggcaguagccaacagcucccuaauuugacuuaagacccacuuaauaagagagccaucaugccugggacuggaaaccuagcuaacuacucgaggcuagugaaaccaugguuauuggaggagaaucuaccacuucuaauuuacuaaaccugcaacaaccuauaaacauguguccuuaugcccacaaccaaucaaaaugcacaaaugugcagcacagucccuauaggaagaaaagaagggaagacuguaagagcuacguggucacagaguuugcuaugagacugugucuccuaguaaugucagaaacuauacccauaaacucuuaucaacgcaauuguccagaaaugaggugaacacagacagcaccaauggacaugccaaacugaaugcggaaaaagccaccaggccucagccuuacacaaagaacuauaagcaguagaggaaugcugggaaaaggacuuuugcuuuuccucagagaagagcacaccaauugguuguucacuuccaaaugaucagcccugaaacacacacacacacacacacacacacacacacacacacacacacacacacacacauauaaacaauacgugaaguguacaaguagcuauacuuuggaauagauauagacagacaaaugaacagacagacagaugacagagagacagacagaugauagacaaacagaaauacauccacuaacaguuuuuuuaaaagccaugaauuuuaaggacaauaaaaagaaguauaugggaggguuuggagagaggaaagaugagggagaaguauuauaauuauauaagcucaaaaguaaaaaaacuuuuaaaauaucauauuuuuuauauaaaccuugucacaacauccuccugaaaaaaaaauuucauuuuuccaccuuuaaccccaauacacuuucucuacaauuacuagcuuuuuauuacagcuucuuuuaagcucuuggcuuuaugacuucaaaaucucuaaaagguauuuuuaaaaugagucagaaguauccuuuauuaaaauaaaauugguuuacaaaauugcuuuuauaaagaaaauacaucuuuaauuauucuugcacaauugcaucuccagauucauuuuagcauaaaucuucaugaucuuaagacugacuaguuuagccaugaauuugucaaaaaauuggguaguaauaugcauuacacauauaauacacacacacacacacacacacacacacacacacacacacacacacauauauauaguuuuauuuaugucccugauaaaagauauaucuucagagaagucuuuccuacuauugaagcaaugcuucuguacagaguauuuaagugacaauucauagaacuggcaucagcuuuauaacugagaauuacuuuaaaaauuuguuucauuccugagaaucucugaagucucuuacuucugccagaucucuggugcauuuuggagggucccucccaaccuccuauuuccugaaauugccuguuuccauuuuuuuuucugcuggcccucagggcuucaguucuuuucccucacccaauaccagaucagguuccccucucaccccuacuccccccccccccacacacagaguccacuuucccucccagguucuucccucccuccccacuugugauuguuuucuucucucucccaaguaggacugaggcauccucccuugggcacuucagcuuguugaccuuuuugaguucuguggacuacaucuuggguauuccguacagguuuuguuuuguuuuguuuuguuuuguuuuguuuuuuguuuuggcuaauauccacuuauuagugaguacauaccaugcauguccuuuugggucugaguuaccucacucaggaugauauuuucuaguuccauccauuuccugcaaaacuccggauguccucauacauaauagcugaguaguauuccauuguguaaaugaaccacauuuucuguauccauucuucugucgugggacaucuggguuguuuccagcuucuggcuaucacagauaaggcugcuaugaacauaguggagcacaugcuccuguggcaugguggggcaucuuuuggguauaugcccaagaguaguauagcuggguauucaaguagaucuauuuccaauugucugaggaaccaccagauugauuuccagagugguaguaccaguuugcaaucccaccagcaauagaggcauguuccucuuuuuccaaauccucacuaacaugugcugucaccugagugaacaaaaaaugcccuaccauauaccaccggggcacguguuccacuauguucaucgcagccuuaucugugauagccagaagcuggaaacaacccagaugucccacaaaggaagaaugaauacacaauggauacacuacucggcuauuaagaaagaggauaucauaaguuuugcaugcaaauggauagaaccagaaaauaucauccuguuugagguaacucaggccuaaaacauacaugguauauacuaacuaauaaguggauauuagucaaaaaagaacagaauacccaggauacuaucuacagaacucaggaagguuaacaaucagaaggguccgagugaagaugccucaaucccucuugggaaguagaagaaagcaaucauggggucagagggagggaggaaccuggguaggagaggggacagggaguauaaagggggaauguaaucagguaaugggaaggggaaacaggacugaagcccugugggccagcagaaagaaugaaaacaggcaaccuugggagguaguagguggggggacccucuagaguguaccagagaccugggagguuagagacucucaggacucaaagggagggaccuuagauggaaggcccuacaguggggagagggaacuuguagaguccaccuccaguaagaagacagggcaucaguuggagagaugggguuugucaugguuugacuaugcuuggcccagggaguggcaguauuuggagguguugccuuguuggacaaggcgugucacugugggcaugggcuuuaagaccuucauccuagcugucuggaagucaauauugugcuagcagccuucagaugaagacauagaacucucagcuccuccugcaccaugccugccuggaugcugccauguucccaccuugaugauaauggacugaaacucugaaccuguaagccagccccaauuaaaugcuguccuuauaagaguugcuuuggucaugacaucuguucacagcaguaaaacucuaauuaagauaggguugccaccccacagucaaaacucugacccaaaauuguuccagucuaaaagaacugcaggaacaaaaauggagaagagacugagagaaaggagguccagugacaaguucaaagugggauccugcuggaggggagaccccaaggccugacacuauuacugaugccaugguguguuuacagacaggagcuuagcauggcugcccguugagaagcccaaaaagcagcugaaagagucagaugcagauacuuacacacaaccaaugaacagaagcugcugaccccugugauugaauuagggaaaagcucgaagaagcugaggaggagggcaaucccauaggaagaccagcagucucaauuaaccuggaccccuaagaucucucagaugcugagccaccaaccaggcagcauagauuagcugauaugagaccccugacacauauacugcagaggauuuccgggucuggacucagucagagaagaugcaucuaacccuugagagaccugagggcucagggaguuagaagaucaagugggguggggcuaggggguggagacauucucuuggagaugggggaggaguuaugggaugagaaacagagggaagaccaggaggggaauaaggacugugcuguaaaaagaaaagauuagagaauaaaaauaaaaguuuguuucucacuuucccaaauuauaucauauaaccauaaaaguacauuuucaaaugaccaaauucucaguacucaguugcuaaauuguacaauuuuucuaaacugguugaguccuaaaaccuguucuuugaguggacaauugcaaagacugucucugacuuagaaaaggaaaggcagaguacuucggaccacuauuucacaauuuaccuuuaggccguuuguuuuuuugaauuauacuggauaaucuccauuucacaggccaauacucuaucacacuuggacuuauuuauccagucuuaaaggccaacauucuuucaaagguauucuuaccuucugauccuaaguacuuugugagaguggcaguauccaauaucacuuguaacuguaauaauuacacaggcaggggcuuagcaguuaagagcugcucuucucgaggacccaaauuucauucuuagcaacaccaacagaagcuuacaacugccuguaacuccagcucaaggggagcuagccucuucuucuggauuuugagucaucugcacaaacauagacaccugcacauaaauaaaaauaaaauuaaaucuuguuuuaaaagcacacacaguacuuuggauuaaaagguaauagugacugauauuuccaguagugagaucucuacaguuacuaacauucaggugacuaacguuaagacagaaacggcauguuucuuguuacuuggguuacuugugcuguugugauaaacucuaauuuaauaaaucguuguauuguaauuuaucauaagaacaauggauuagauacaacaaccuguuaugcacaagacggacugaacugucucuauucuaaaccaacaugaaguuauuuauccauuucaaagacuaaugugguucuuaguauacugaaagagaaaaaugacgcuuuaaaaacucaaaaacucaaguuaggcuacaauguaauacacacaaugcagauuauauacuggucagcucugaaaucauacacauucaagcaacaucauauggacugaccacauauuuauauaggauauauauauauauaucuccuauaugcauguguguacuuauaaaaacaauuaaaaagaaagagaugaaaucaaggggauacaugugagggauugaaggaagggaaagaagaaaauucugauauaauaugcuaggcaugggguacaugccuuuaaucccagcacuagugagacagagucaggcagaucucugugaauuccagguuugcuugaucugcauagggagauccuguuguauaauaaaagacacauaugaaaaacaaugguauauaugguuaauucaacauaaaaaugucaguguccugaagaguacagaaauaugaucgcauagaugcauaguaagcaugaagagagcaaauauggaaguggauggugaaacaggcaugauuuaacccucaauauuaugaagggaaaugcauuugcauauguguaugcauuuauuauaagauacuuucaggaaauauaaaacgccagauguaaauuuauaaagguagaguuauggaaaaaagauaucacacaaaagggcauauuugaaaaguuguuauauuaauaauucacauugaucacagauugugcaccuaauuacacaaguaauaugcaaauuagugccaggagagagccuagagaagcagaacuuuaaaggaaggcaguaaugcacaauagaacguggacuauuccagaugugcuaaccaaauuuguaaccaauuguaacuuucacucacauaaaagacgaaauacaugccuccuacauauacauaccuguaaacacaagagaaaaacuccuacaaaucaaagucugaugaaaaaccuggacaaauucaaaaucagacaugauuacacaucuuccuuuuuuggaaaaagucauuaaaagcuaaauauuauuauuuugagucuuuugaaaccucaaagccuguucccaguggcacacuuccuccaacauggccacaccuccuaauccuuuuauguaugugccauaugcauauaauuucauauauauauauauauauauauauauacacauauauauacacacacacauacacacacacauauauauauauacauauauaccuauauaugcauuauauauaaucuuagguacaucuaauauaaaagugguacccuaugucauuuucaaccaucuuuagcuguuacuaaucccuccucucucacucuuuuucuguuuugccagccuucuuccuuccccaguuagagcucuacucccuccucacucccuaguuaaagcucuccucuauacuccauccccacuuaaagcccccauauacuacaucuuguccuacucuacauguucauugaccuacucagcuacguucauugguacucuagucaaaauagcuagaaaagaauaacaauuuaaaugcccuucaauuggugggagaauaaugaaacugcggaauucuacucaacuguaaagaacacugaaauaaugaaguuuucagguaaauagauggaaaucaaacauauauauaacacuaagagagguagcucagacugagaaagaacaaugccacauauucucucuuuuuuuggaauuuuagcuuuuauagauguuaguauguaagcgugagcaacagcagaaaccggcaaacuaaaaauggaccacagggaguagagagcucuagaguuggggaaacagcaggacauaggaacuuugagauuucuuaaggaauucacaaaauaauacucucauaugguaggaguuaucugaggacauagaaacacaaaagaugacaggugacucauaacuucagacucucugcaguauaaacuugccuuccauauagacauaaacacacacacacauacagagagagagagagagcacucauuaggucauauuuuuguuguuuauccuuucuagccuauaaacagcuuuguuaaaccuuucugucuugaguauaaaguuggcauauccuaguugccauagaaaccagaauuucauuaaaauuucucccuuugguguuaccuuuccaaggacagcaggaaaugcacauaaauccucaucuuacuggaguccuaagcacaaggucggccccugaguucaaacgcucgccugcuuuuauaaaaaaggacaauauagagaaagaaacaggaaaaacagauuuuuguucuagaguuuugaaagaacuggggacagagacauuuucagucuuacuauaccuugccugaagcaguguuaaauuugcuauaauuuauagaaaaaccaaggacaugaaauacgcaccuauagcuuuagcuuaccagagagaaauggcaagucuuucuccagggagaacagguaccucucuggcaccaagcuggaggaccuggguaucagacaagggaccuacauggugggaagauagaaaccuaccgcaucauguugacuucuggcuuucacacgcucaccugugcacacaaagaaacaaaaaauaugaagauuaaauguguggaccucagaagaagaaaaaacaacaacuacuuuugccagggccagagaaaguugagcgugcaauacaacagaugucccucugaagguuugugaggacaaaaugguugcugagaacauaaacaagcccgacaaaguacauggugcucuugaguaauaaagaggugaaacugagcauaucauacuuggaaaucuguucaacuaguuauauugaaaacaugccaucauugaaucauguuuuuagaacuuguauuucuaaaacuacauuaaaaucuucaggaaaaaaaacucaguaggucugcagagauacagaguacacagcacagagaauuuguuauacacagucacucacguuagggacauacugugaugcagccccuucugcuacauaggagcuaagacgccauuccuaugugggcaguccuauacaggaauaggaaaauaaacgguuuucgagagcaguggcacacaguucuguuuuggacuguuuaccugcguuaacaacucccuguuuguauuuuagcuacaaagauaaugccacuagacccugacauggaaaguuaaacagaaaaucaacucucauaugauuuucucugaaccaacucuaacacaguauucuucccaccaacgggcaugugaauuacgaagcacagcaagcuucacauggaugccaccgaaggucauauuggaauagauauauagcuauaugaaaucaauaggaaugggugguucuuagagcaaaucacaugaaucaacaugaguuuuuccaguuuaaggaagguauaguuauccucuccauauucaagagaucaagagcuucuggacaaaaauaugcaggucugagucugucaagugcugcucauaagcucugugauuuuaaauggcugagaaaaugucauaauccaauaagcuaaacugagucacaauggcaugaaugaaugaaugaaugaauauuaaccauaaguacuuuuucugaaaacauaauuuuuuuggauugaauuauauagauuuaaguuauuaaguuauuauucugagugaaauaacauuaucuuaaaauauaugcagauaggaguuaccuaaguaaaaacuguugggauucuucacaucaaaauacuuuaaaacaaacaaaaaaacugauacagaauucaggaagguagccacaaggcugugucaaaguguacaugagcugaucuuccaaagagcaacuacugcuuaacauuucuuuugggaaaaauacaguaauagaucggacauuucuguacaauaauaauacacauaauccacacaguaauaaaucaaagugagaaguacaggcagagcuuccaggugacaaaagccaccaccaaggacaguucacagucacauccuugagacuuggaggaucuauacugcucaccuaaacagacuaaugcagguauauguaucaccauaucuguguggugauuuuccuagacauaagaguuugaacuauauucuauacuugaauuacuuugcucaugaagcuucacaucauugaaggucacugcauagugcucuauuucguguguuagaggcuguacucccuuccauuguuugcaugcauauguguauguucccgcuauauaccccauauuguauugugagcauccuuuuaaaaaccugcuuucugaggguuugcaggaauauauaaaagggccacuuauuuaacuugaaagcagagauaaaucauggaauauucuacagacagauguucuguaauaaccaauggauuacaaggcuggucugugucugugugcgccuauguugauguuugaacauaaaauguucccaaaacucagauauguuaaggacuuugccucacuugguggaacuacuuuuggaagguguugaauauuuuaaagaugaggccuaccugaaggggaugggucucuugugggcaugcuuguagaaaaauauuuuguccuuccuaaaaugucuucauucuucaugaggcuaucagcuguguguuccauguuccagugccaggaaaguaggagggucauaggagguuggaggccgaagagauugugaggagcuacaugaagauaggacacaauuuauuuccuagaaugggaugcuaggcagacaagggccugcagguacccacacauauggccaacacacauggggcgcacccaugcuagcacagaugcacaugcagacugacacacacacgcuggcauagaugcacaugcagacuggcacacaggcuuacaaacagacauacagacaagcucugagggcaaagguuaaaacuaaaguucagacuaagcaucauauuuuugaggccaagcaucauauuuuugaggcuuacauuuauacaaaacaucucaagguuacauuuauacaaaacccacguagagguagcauucugacagaaacaguuauauggcaguuauauaucacuguuuaccuugggguucccagaacaucugcugccaaccacuuuguaaugaccaagagccuucucuccaagacguuccacuucagccauuuugucucauaucaggucuccaaccugcccaaacauaaacuguuuccccaaagcaccaucagccacaugcuuuccuucccaugggauuagccuugccucauuuccauagugauagaucugaaguaaccucaugugaaaccucugaaaaaugagccaaaagaaaucguucucccuuucaaacuguuuuacucaagugucugccacaaugaugaaaagguuugauugauacagcuccccucaaaaguuauauaaaaacauaaucaucccuucauuuuccacaguauggaagaaugaaaucccuucaacauuuuaacauuugcuuuacagggucagaguaaacaaaacuucuaucuuccagucuucugcccaugcuauuuuaugaagucuaugaaucaucauguaaauucagcccauaccauguuuaccuacccuaaagaauucucauuugucuuuauuuagugugagucacuacaacaagguauacucaggagcuguggaaaagguaacuugaggaauggguauguuuuucaauaaaagagauuaauccauuucaaagaugaacaaagaguaggagguucucucaaacuaucccaugaagcugcccuaucaccucauuaagcaauuccuuucuagcuucaguacaagaugauacauuuuuagaacacuggacaugacucaaacaguuuaaaucaacuccaaguuucuuagagguccuugaguuuacaaaacuacccaacacuuuaaaaauguuuuuaaaauaucaacuacaacaauccaaaaaugaauaguaaggucagaauucacuccaagcaugucuucgguuucaaauucacaggcuagugaggaucaucaauggaauaagagucccaagaaauuccauaauauuacuaagauauucuuaugacauuggaguucccuauuuuacuuuuagucaugguaaaagcaugcuuauauauuauuaacauauguaacacuuggacaccagagauuggcagcccaguuucuaagagggggcugugagcauuuaugaaaacaaacuucuguguguaaaauucccuuucacauuggccaaauuucauaaaaauauauuuauguaaccuauggaagacuugguaaauggguacaugggauuagggagcugaggguaggugugggugaguugguaagcucaggucaagggccccuacugggauucuuuauguguagauaauucucucauuguaauugaucaggugacuuuacuggccugauaggauggaagcuuacuugugcaaagcugccaauaucaccaauauuucuuguuguuucuucacuaaacgguuucuguucuuagcaaugaauacuuuugguccuguagcaaggaaugucagcuuaaaucucauuguacaaagcuauaaggaguguguguguguguguguguguguguguguguguguaugacuuauauuuuuauuaauuuuucuguucaaauucuuauuuuuuauuuuuacauacuuauuaagaacuccauauaugacuacucuacuuacaccauuucugcuccuuccucccuauuguucccuuauugccccacacuggcucccaaauucauggucuauccuuuuaaauuauuauccuaacauggauauauaaaguuaaccuagugagucuaugcaguguuuuuuguauguaaauauguuuagggcugacuauuuggggauggauaaucuuuccagggaaaaagccgauucuucccccucuuaacagccauugauuucuuacggaucuucaacuagacaugagacuuugugagaguucuccuauccacaucaauguggcaacugguauugucacugugcaggccguguuuagauuaccauagugguaagauuucaugagugcaacucauguuagaagauguuauguugcaaaugcccugguccucuagcuuuuaucuuuuucuccuacuuccucaauguuucuugagcuuuagugguggauggaucaagugggguugguaccccauggucucugguucucuguauuuugaccaguuauggauuuuguaaguuucuaacugcuauaaaacaaaguuucuuugaugagggauaaaagauauacuuaucuguauagauaagaacagguauuuagaagucaguuuucaauuauguuagcuuaggagagggacagugguagguucuaugaccucacaagccaaggguagauuuacaguagaagacaugaauuacaugcaauuaaauguuccuuaaacagcuuagacagcuguuugccacccuuugugguauugaacucauguuuuugccaugcuauucauuguuaugggucauagguuguacagcuuugugaaacucuugauuauucuucucccauggcacauuacaaagcaccuuuguauaguaugagagcuugucuucagggcuggaucuuccagguuaauuucauuuugacuccucugaguccuuugucugaaguauaugguauauuaaguaauacaucuuaccuucagguccugauaggcagccaaggacaaugcaauagucuauuuuggggagcaucucuuugacuuccaaaaucaaaaugauugaauucuguaaaucuaugaagaaaaauaaaaucaugaaguuuacagacagauagauaggccuagaaaauaccacaaugagggguggagagauggcucagcaguuaagagcacugacucuuccagagguccuaaguucaauucccagcaaccacaugguggcucccaaccaucuguaaugggauccaaugccuucuucuagugugucugaagacagcuacaguguacucauauaaaugaaauaaauaaauaaguaaaucuuuagaaaaagaagaagaaaaaaaccauacugagaggaaacccagacccagaagaacaaagccuggaggugguuucuauuuguguauucuagcucugaaacuuuagguguaauuuuauaacccaaaguaaccacagaaaccaggaaguaaaaaugggaccgggggagagaucacuaagauagauagugggauaguaggacacagcuguuacaggaaaggaaaugggaaaagugggggaaauuguaggggugggguugaugccaagguccuauuccccaauugguucuugaucugucacuaaagaagccaggagccaauugcugggaagaagaaauagaugggacuuccaggucccuggaggcaagcagauagacacaaggaaaggagagcaaaguucaccaugcuucugauggagagaagaaaaaggugacuagccaugugguaucucaaauggaguggccacacagguugcuccuacaggcaggcaggcaaggguguuuagcagggacuagauuguaacucagaaacuacaguuuagggcagguagagaggugcagagauaagaauauugauaagugccugcuuuuccaggugggagauaaauagcacccagcaauugugucaaagggcaaguugaaauugaacaacugugcgugacugugucuuuuauccauggagucaaaggaagcuggguggggacuuguaguguggccuguuuccggaguaagguagcaaagcuacaugcaacagggaacucugaggaggcagaaaaaauagaaggggaaagagcacaaaaagugauugaaaauuccacaaggaaacauuauuuuaguuacauauauauuuaauauguauaauauauuuaaguacauguauauguauguguauauaaauacuuuaaaugaaauaagcuguuuggagaaauagugcucccacuaaaugucauaaacuaccaaaagccauagaaaucucccuuugaguucauauaugguuuuaauaguuuuuuuuuuaauuuuugagauuauacuauaacuacauuucuccuuuccccuuccucccuccuugcucucuuucaaaaucauggccucuuuuuuuucauuauuacugcaugcauauauguguuaacauauauuccuaaauguaaacugucaugccuguaugcuacucauauguauguuuucagagauuuccauuuagcacuggacaaccaauggugugcuccuuccuagggaaacccaccucuccugauucuagcuuuucucaauugccuguaguucuuuguaaagaguugagaccuugaggacuuuucccauucuacucugucauguccauuggugucauccuugucuaccuuauauuugggcaguuacguuggugagaucuuaugaguggagcuucugacaguacuggaagacauacuuucacaguaaacuccuauauuuaaacuauuaaagaggcaucaaauaucaacaucuugguuuggucuuacaagggaaguuuagagucugucaccacuuacaaugagguaauggacuacuguuuuuggaaauuccauuuacuaaaucuaggaaaauacauuuucuauuuucucugaagcugcuaccuauuguauuaaagcaguauuucucaaccuuccuaaugcugugaccuuuugauauaguuccucagguugcagugaccauaaaauuaguuaauugcgacuucauaacuguaauuuugcuacuguuaugaaccauaauauaaauaucuaauuuacaggaugucugguacgugauccccaaagggaacacuagucacagguugagaauaauguauuaaagaauaagguagaauuauuaggacuuacauggagagaaugugcuagguguaaaauaucugauucaagucaaguucauuccacuuugcugaacugauaugaaacccauauauacauauauguguguguaugcauguguguauguauguauauguguauguauauguauauauauguguguguguguguguguguguguguguguguguguguguguauguauauacgugcaugugcaugugcguguguguguaaagccauucuucauuuucgggauaaagaugacuauccaugagaccccuggcacauaccagcagcauaaauauuuucucccgguuuugaugaugugagaaugacaucgcaucugcauaugcacaguucuugccuuuguuccauucuucaaaaccaaacuguaacucucucaugaauaugucaggggugagugagaaguucucucuccuuguuccuaaaaaaaaaaaaaauugcacaaauucaguuacugauuucuuuccacauauuacucuauuuugucuuaaaucagaaugcauucaaaugggaagccagaguuuuuguuaaaauguacaccuagaagaccauucucuacauugucuucucaaaauaaaaugacauaugaauccacaggaaagaagaauacuaacucuaauuuccaaaauaguuaaaaugcaauucauggguucauugucagacucuuaucuaauagugaagaacaacucucuauuucaguacagaguccauugaacuauucaaaguguguuuguuuuguuaaguuuuuuuugguuuuguauuuguuuguuuuuuguuuuguuuuguuuuuugucaacccggacacaccugugaagaggaaaucuccaugaaagaauggucuccaugagauuggccugugggcauguccacagggcauuuaauugacuacuaauugauauaggagagccagcccucugugggaagugccaacccuggacuguaggccaggccucuauaaaaaggguaguugugcaaaagaagugggaggaggccauuaagcagccucacuguuccuuucugcuucauagucaugccuugaauuuuucccuuggcuuccuccagugaugggcuuauagccaaauaaacucaucauccacacacaggcugguuuugguuaauauuuuaucagagccacaaaaguaaacuggggaacgugaauaaguuuaccaaugccuugaaaccuaauuuccagaaaccauauggauguaugccaaaaauuuggagucacaauggaaacaaaauacauagguggagauacaaugauggcagauaaauuaaaauuuaaagcauaaacauauaaaaccuauagagauguuaacauuuuguacugcucuuuauauagauauuuuuaauugcagcaaauaccacugaagucagaagaaaugcuuuugaucuuucuuucaggucccuaauuaaacaguauuguccugguucagagagcaccuugguugagauagcaacaauagcaaaauaaauaaauaaauacaugcauacauacauacauacauacauacauacagaugcaggaagggaccuguuaucugcuccuuucuuccuugcaggaaucccuuucccuauaacauugucccugaucaaacugaggcagcagucaggagacaaaggaaaaauggugaugugagaagccaagauccagcaucagaacaugugagaaauauccaaauaccuugucgcuaauaccugauugucauuagcauaguuuauguacagaccacaagggacagugagucuuaauccuaucacuaagaacagcugguggcauucaugaaaacuaagacaaaagauccuuucccaagaaaccuauaauucuucaagcacagaaaugccauagaaaggucugauucagugacuagaaaacaaacagaacucuacuuuccaaagucauacucuacaauggcggaguaaauaaauuaaaugauugaaauauucuaagaaagagggcuaacagcaaaacuuacaaguguuuuaagcauccagucuuuuauaacauaagucaacaaaugaaugaacugagagugcguuuuggauugucacuuuuuuucuuccuaguaaaaguguauuggagcucagugauccucaaauuuuauuuuuauacaguagugguauuauggcaaaguugagaaauugggggaaaauguauggcuuuaaaaaaaaaacaauaagcaaguuaggaacauaacgugaauaauaguguuugaaaggaaguacccuccguguguaguuaauauugcucucagaagcucuauguuaaaaaacaaaaauuccaaugccaaguacacuauauggccauauguauuucaagaaggaguucugugaaauaauauauucaagcuaugacgaaacuauugugcccaugaacacacaguaauagugguuagcuguggaaccaccaucgcuccaucauagcuaagggagaugcucaugaugccuuaagcaucccugaagaacaacaggcaguuaauggcuacugaggugaggagaauccuauuccuuggcgauaauagucaccuuuaaguuuauguuuauccaccuaugcucaugcaauugaaagcaaaugcagcaggccccccaaaaaagacaugcaaauagaagaggaaugcuuuaguaagaaggguuuugugguuguagaagcagaauaagaguauaauagggaacuuguaaucaaaguacauuacauacuacaggugaaaugauaauuucuauuguuugagaaauuaauacuccaauacagcuagcuuuagcaaaucuucacuccauucacuuucaccaaauuccuccaaagcaccgccacauucgacucaaacaucuaugugcuguucuuaaaccuaacgaauccccacaguauaauuuuuaaauuaauuuuuaucauauuuuggucauauucuccccuaccccaacuccucccagacacugcccacaucgcuaucuaccaaacuucauguucuuucucuguguuguucaaaaauaaauaaauaaaaauacuaacacccuuaaaaagaauuuuaguacgacaaaacccaucaaaacaaaucuaaaaguacauaaaaaaaaucaugaagucccuuuuguguuagcuaacuaugccuuaggcaagaguauuugauauaugcagugacacaccauuggggaaacugauuuuuccuauccaagaagguaauaauuauaaauauguaauuuuaaaguaguguuuuaaaguuuauauuuuaaaaagauaggaauaaguccuaucugguucaccauuaaaaaguguacaaucuucuccagucuaacauuaaugugaugcauguguuucuuaaccugcuauaaggauuauuaugccgacuguaauuucagugacaugaugccauuugguagucuucuucauuaaugaagaaugaaucuagggacucacacacccuaggcaagcacucugcuacuggauacagcacauccuugugauguuuuuaaaaagcuacaggaaaagaaaaaaacccuugugaggauaaaggaugcuuacauuuuaaugucuagagacgucugauuuaugaaagcagacccucagaggcuccugagcauugcgguccucucaccuuaacucagaaaaucgagcaaaggaaaacacugaugggugacucagccuuuucaggcugcuuucagcaggagcugccagaaucucucucccacacaagaagaagcaagcaccugcauccuaaaacuaauaagucaauugccaaacagagccucacacagacacaauaacaucacugacuccguguaggucuguaauugauucguuguuuaaaacuuugcuccucuaaauacaucugauccaguucucagagcacagccucauaaagagcugacauaaacaccaacuggcuguguguuuccuccauuagggcagcuugaguauaaguugggggaucuaugcuauuccuucucagggucagaaucaucacugagcugucagucauaugagcagugccaagucaggauaugaggcaccacauagaggaauaaaguaguaauauuucuguuguggccuuuuaugagauaugauuuuucagacaguauauaaaacagaaguuuaggauugcccauaggcuccauuugcccuucugaaucuguauuggcugguuuuguaugucaacuugacacaaacuagagucauuagacaggaaggagccuugguugaggaaaugucucuauaagauuuggcuguagggcauuuucuccguuagugcucaauaggggauggcccagcccauggaacacaagcuuaguaagcagcaccucuccauaguuucugcaucagcuccuccccccaagaucuuguccuguuugacuucccauucugacauccuucaauaaugaacaacaauaugcaauaugaaaguaacuauucuucauuuuaucgaaguaauagaaacccuaacuaaggcagacuuaaucuugguuauuacuugcuuccaccauuuccccugauuaucugggaaagaauaucacuauugguaaguuccuaaccuugcccugauaguugguuacauagccaacacgcagacucaagggugacaaggaaagauaaaauacaaugcaugacauucccuuuauuugugccucagugauuccugggacaagagacuucuguuguuugucaccacuggacaaccagaacauaacugacuaacuugucagaggaagugcggcaguggccuaucaaacacaggagaucaaguuugcucuauucacugcugggaugugcauaaauuggugcagcaguggauggacaaauugacauagccugagucacaaggugaaaaacucuuuccugugguguauuaauuuuacccuuacaauaguagcacuaaggcagacucaaaguucucucuuaugacuuauuuagcucuagggaggugaagguaggagcagagaaagugucagaaucugaacuuaagcagaugaugcacaucacagggccaugagggaaaggaguuuguccucugaguaucacauuaaaagggggaugacauaaucuuuuaacagcuggccccaggguugucacacagguguuuuguuuuguguguguguaugugugugugugugugugugugugugugugugugugugugugugugugugugugugugagagagagagagagagagagagagagagaucaggccucauaggauaucuuagaccaaaaucaugaugucagaaguuagaguugucaaagucuccauguaccuaggaagcagccacaugcugaguucugccuuuaccaggacaauuaacacagaucugucaaugacucacugacagauucacuccaaagucucaauguuagagaauuccuuucagcucaggcaaugcugaagucuccacagcaccaagagagacaaauauacaaucuuauggauuugacacacacaagagauguuuugagaagcaacuuuauggcuuaacaccagccauauucagcauagaguuaagaacagcuucuuccagacucaaagagcagugacaauuguccuguuauuccuuucuugacuaugauggauaacuuugucaguuugauuggauuauaagcugccucuggcauuagugagucacuagguauaugcagaguguuuugagagauguuuaacuggggggugggggacaggagaacaacucuugagugugaaaggcaccaaauguuggguguagcccaagucugaaugauuagggggaauuagguugaccucuugaagcaugugguaauccuaaagauugggggaaagaaagcagaaggauggagaguucuaggccagccuuugcuacauagacacuuuguugccuaccuggcugacacgagauacuuuaucaccccuucccauuaaaaacaagagaggagcaaacaugcccugugugaaugcuugguggcucacaccuguaacucuaucagccaucaagucgaggggaggauugcugugaguucaaggcuagccaaagguucauagugaguucuaggccagccggggcuacagauuaagacccugucuaguaacgccaaaauguaccaaaaaauacagauggagaaaaaaggguguaaguuuaaggagaagaaugaggacaaggagaaggggggaggaggaggaggaggagagaaaaggcagcugugcacauuucuuuguuuccaugcugcaacacggaccucgcugccccuucugcugugaccucauugccauaauguguagaauucugcuguacucucagggaggaugaaucucuuuccucccuuaggcuaaucuuuuauucuugagauuauaauuuaaugacuauaauugucccugcccuuuccuccucacaaccuccaguguuucccuccccauucuccucaaauccuggucucuccuuuucacuaacugcuggagagauaucucaguugccaaugcuuucaguuugucaaguauaugcucacaucacugagaaaaguaucuacuacacaggaggcuccaccaugcucuucguggguuacacagaaaagccaacccuggacagcaccuuguguguaaacagucuacaguacuuucccaucauguguauauacuuguguggagcacuugccagccuuuguaaagagaaaacgaaguggguaccccaaccccauucuggcuaucagcuucuccugagugcuuaauaguugugcaacucccuggguaaccuuuuccuccagagaacaauuuagaauggcaguuggggaugaagcauggcucugcuacugcaggggagaauggagguaagucuuuuccucagcugcucugucucucaguccacuucucuaagacacacaggauauuaacauugccuccaugcuagcuuugguuuggcgacaaaaaggacaccuugguucaccugagauguagaaauaaguaucuggaucaaaaacugaaggcaauuccugcucagaggagccacaucuggugugcaggaacaucagagccuguaauugugagcauuuaauuugccugcagauaauuacaugcauauguaacauccgucacagucugcauggggaacacaauuuagacuguuugugccuccuuacuuccaaauagggaaauaacaaaucaauggccagugagcauagaaaacaauagcuucacuggugauaaccaaugaucacaaguuagauaccauucuguauuuuuaaaaaaacauaucauaauggucaaaugaaacugcaggcuucagcaauggcuccauugguaagaacacuguggucaccuggaguuccugguacaauucccagcaagcaucuggaagacccguuccaggauauccuaugcucccuuuagccugcauuggcaauaggcacacaauguaucacaugcauagucguacauacaggcaaaacacugcauacauauuuuuuaaaguuuuaauuaagaacaaaaaagugugcuguuuuuuggccaagaaucuauguguacacgauagugaaaaugaucauaacacauuguacaaaaugcucaaaggauuaguaagaacauacauuaaaaauaaaagcacaaaugaauaaauacagaugucucaauaaaaagacuacacaaucauguuuuccuagacucugaaguauuauuacugagagcaacauccaaacacucauguuuaguauauaaucuuauaagacagcaacaacauuaauacauguauuauuaacacuuggaauagaaauagaaaagaagucuuuaauuucuuuauuucuuccuugaccaagguauaauugaggagaguguuguucaguuuccacgugaauguucgcuuucucuuauuuauguuguuauugaagaucagccuuaguccauggugaucugauaggaugcgugggacaauuucaauacuuuuguaucuguugaggccuguuuugugaccaauuauauggucaauuuuggagaaggugccaugagguacugagaagaagguauauccuuuuguuuuaggauaaaauguucugaagauaucuguuaaauccauuuguuucauaacuucuguuaguuucacugugucccuguuuaguuucuguuuccaugaucuguccauagaugaaagugagguguugaaggcucccacuauuauugugugaggugcaaugugugcuuugagccuuacuaaagucuguuuaaugaauguugcugcccuugcauuuggagcauagauauucagaauugagaguucgucuuggaagacuuuaccuuugaugaguaugaagugccccucuuugucuuuuuugauaacuuugggugggaagucgauuuuauucgacauuagaaaggcuacucuagcuuguuucuucagauaguuugcuuuaaaaauuguuuuccagccuuucacucugagguagugucuuagucaggguuucuauuccugcacaaacaucaugaccaagaagcaaguuggggaggaaaggguuuauucggcuuacauuuccauacugcuguugaucacaaggggccuuucccccuugaucacuaauugagaaaaugccuuacaguuggaucucauggaggcauuuccucaacugaagcuccuuucucugugauaacuccaacugugucaaguugacacaaaacuagccaguacaauugaccccuugucaacuugacacacaaaaacaucacuaguaagccucaacccuuacaaucuuauucauccccaagaucuaaauaacuuuaaaagucccacagccuuuacauauucuuaaaauuucaaucucuuuaaaauauccaucuuuuuuaaaauccaaagucuuuuuacaauuaaaagucucuuaacugugggcuccacuaaaacaguuucuuccuucaagagggaaaauaucagggcacagucacaaucaaaagcaaaagucagucuccagcuguccaaugucugggauccaacucacgaucuucugggcuccuccaagggcuugggucacuucuccagccaugcccuuuguagcacacgcaucauccucuaggcuccagaugccuguaccccacugcugcugcugcucuuaguggucaucucaugguacuggcaucuccaaaacacugcaugaccccuucaguccugggccuucaauugcaacugaggcugcaccuucaccaauggccuuccauggccucucacaguaccgagccucagcugcuuugugugaccacuucaugcuuucaaaaccaguaccaccugggugacccuuacauauuaccaagucccgcugcagcaggaguacaaccuuggccaucucuggaacacagccucuuugugcuuucagaaaacacuucccagaagaugucaccucaaugaugcuggucucuucuuaaucaccgcuaauuucuuagcuccagcuaaccagcaucaauagucccaguaaggcaaaguuuuugcuuugguaguucugguaucuuguuaaucacagcugauucuucagccccagcuaaccagaacuacagaaucuucacaaucaaaacagcaauggcccugaaaagagucuuuaauuuucccucugaaauuucacaaaccagagcuccaucuucugcgguguucucaacauuaucuuccaagcuccuauacgacauccaacagagcucuuaacaauggauggaucuucaagcccaaaguuccaaaguccuuccacaguccuccccaaaacauggucagauugucacaggaauaccccacucugcugguaccaauuugucuuagucaggguuucuauuccugcacaaacaucaugaccaagaagcaaguuggggaggaaaggguuuauucggcuuacacuucuauacugcuguucaucaccaaggaagccaggucuggaacucaagcaggucaggaagcaggagcugaugcagaggccauggagggauguucuuuuuuggcuugcucagccugaucucuuauaaaacccaagacuaccagcccagagauggucccaccuacaaggggccuuucccccuugaucacuaauugagaaaaugccuuacaguuggaucucauggaggcauuuccucaacugaagcuccuuucucugugauaacuccagcugugucaaguugacacaaaacuagccaguacagguaaugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcuuccuauuauuuuuguuguuagaauuggcauucuguucuugugucugucuucuuuuagguuuguugaaggauuacuuucuugcuuuuucuaggguguaguuucuguccuuguauugguuuuuuucuguuauuaaccuuugaagggcuggauucauggaaagauauugugugaauuugguuuugucguggaauacuuugguuucuccaucuaugguaauugagaguuuggcuggguauaguugcuugggcuagagacuagacagugagagaaauaaugaagccaagacaauuuuucucugaucgaggccuggaaguuuaauaagagacugugcuuaaaaggggaaaggcccaaccccaccccccuaccccaccccuguccauccuuggugcuuugucgccaugcugucagcacuugguugccaggcuguugcuuauuuaggaaugucucaggaagacagguucagccucuuggcagguagcagcaucucugagaagagcagggcaguguccuucaaaaggagccagccaagucagaaagcugcaccgcagguggccccaccucaauggagacaaagucugcacaagccagcuucaggcugggggaagcuacauucuguuacaacucccaccccacccccaaaauguaacaaucuagacagaaggccauugaugagaacucauaaaaauuguaaugaggaugcugaaauauagcucuccacacuagaaggcuacagguggaagucaggcuggagaagaacucacuuuccuguaagggacuagccaccagaaguucaaccaugcuccagugaguauauggacaacacaaauuggacuuguuuuuuuuuuuuuucuuaaucauuuuugggagaggccacaaguguggaggugcuaaccuggaaagagagggaaguaagggcaaccagggugcauuauguguaauuccuaaauaaucaauauguuaaaagaaaucuucacaucacuaguguucuacucaguuauuaaccuuaggcauaauucauugccauuuugugcggccacaggacacaaaucagguuugcauguuuuccuuugaaaaagauguuaauuucagccauugugcugguccaguuucucuagcaaauccuaucagcaguuaauagagaagcaacucaauuaauucuuucauauaaacuaaaaacacuaggugaagggagaaccagugggcauuuuaaaaugcauaguaaaugcagcuguauucugccacauucaauuuugacagaaggaauguaggggaaaacuaucucaugaagucuuaacaauacuggcauagaguuauaaaggucauuagaguuacuaucuugcugagggaugccccugguacuggcaagugcaauugaaaccuugguucuagaccauggagacagauauagauugggaugaaaacacacacacaugcccaugugugcgcaugcacacacacauacacauacagauacacauauacacagacaaacacaaacacauacacacauauagacaagcacacauacagacacacauacacacauauacaaauauacacacacagagacacacacauacacacauacaaacacauacacacauagagacacacauacacacacacacauauacauacagacacauacagauguauacacagagagagagagagagagaccuguauccuuuccaaaaucuuccagaaauacaaugaaaucaacauaauuuagacccaccuauacaucugcaaacaugaauacacacauguguguaugugcauguguacauguguauguaaaggugucauuuuucacaugugucucuucauuccuuuuagaaaacuuucuuugcccauucaaauaugcuaugaaaucacuuuucuaaaggcaauaaagauaugauaugacgccgggcguaguggcacacgccuuuaaucccagcacucaggaggcagaggcagguggaucucugaguucgaggccagccuggucuacaaagugaguuccaggacagucagggcuauacagagaaacccugucucgaaaaaacaaaaaacaaaacacaacaacaacaacaacaaaaaaaaaaaacaaaaaaaaaagauaugauaugacuuguugaugugcucuuuuugacuacuguugagauguaugguuuauaaagacugaucauuggccugaagaauuauaacucaguguucuaaaucacuguagcaucuucugcucugauuuuuaacuuaauaaaagggcacgucuauuucuguuuacaaacacuuuucagaacaaagggaaaauauguauauuuccacuuauuaaccuuuuucaaaaugccaacaacacucacacugucugaaggucucuaaggauguauuagaaaaaucaauauagcauuuuuagaacuugccuuucuuauugaguaugcaagacauggcccacaguaagugcuccugucaggaacuauuuauagccucccagagauaccgauaauugucugaauaugguuauugugccaucucuauacgggacauuccccucuggguauucugagcauauuaguaagcuagcuuuucauuacuauaauaaaauacuggaugcaggcaaauuuaugaguaaaagagaguucacuauacuuuuagacaauaagauucauuaguucuagugauagccuucuuguuggcagaauccuaaugaaggaaaaaaauuaugaaaaaugucuauguauuucauauuugugcucucugccucuauuuuaaaaaaaucuacuagcauccucucauggaugcuuuacuugacuuuauuugaauuauguuaaucaguguucuauugauguaaccaacaccucagauaaaucaacuuuuuuuuuuuaaaaaagagcuuuaugauaguuuuagaagguccaaaugauaucauauuuggcucuauuacuaugagccuaucagagugacaguaugcagcgaaggaaacccaucucccucaucaccagaacuaagaaagagaugaagagacaauggcccaacaauccccuuagaaagcacauaaccucuaugaucuaaaacuuugcagugagccucacuacuuaaaggcucugcuaccucuuaguugauuuuacuguucaccugagauuaagccuuuaagccacuggucucugggggacauuccaagcuauaggguaaguguaauaacuuuccagaauucccaccucuuaauaucacagaugacuuaaauucccauuuucuuuuuauaaaaagaucuguaugguuuuuguguauauuaauauguguauauauauauauauauauacauauauauauauauacacaucuuauucuaauuaacugaaauaaaacuaauaaaccuucuggagucaauuuuuccaucaguaauuauaguucaucauucuuccaaauagaauguccccccaucuacuuuagaaauauaauucauaauccaagguuguauuuauuaggcaguuaagagcuuggcacagagaaacauccaugugacaauagaguauggcauaugaccagguaauuuuaaaguuaaacuaauagggaaaggacacaugucuaaucgugaauauaauacguccuugcauuauuccuauagaaugagucuguauaaauuagcauauauuauggagaucuucugaacaugccuuccuuauaagacauaguucacaauauuuuaaauaacgcuuucaagauuauguuauuucccagucuuaguggaagcuuuaauaaguacuaauuaugaacaauuuucucucaacaauacaucauagacugcugugucuguaaacauuuugguuccaaaauucuauccgucuuugcuaggcaguguuccuuggccuuugcuauuagcccuggccugcaauuaaugcaagcuagggguacuuuccaaaccaugacuguggaucauaggaauccaaaaauaauugcuugaacaaccaagcauugugaaucagauucagguuaguauuacuggucaggccuccauucaaauacgaccuucuuguggugcauuaggguuagaguuaacagaauucucacauaggcuuuuauacagucuccaaagccuagaagagcaagcugucauugcucagaguaggcaacaauagcauucuaauuuuaguugcaggugcaauguauuaucagugcuugccauccacguuaguccuaacguaccauguaggcaugcucuuuaauuuuuacuggcuauuucagccaggcuuuguuaaucauucacgucaccagcucacuuagauaaguucagguacuuugcuuuuccucuacugauaggauuuugacauccucaaaauaacauaucauuacaguucauacuuacauccacuccaaaucauucuuaagcagguucugaguaagcuaaugaaucuggauagccuugaagaaggaggaggaggaaggaggaggaagaggaggaggaggaggaggaggaggaagaagaagaagaagaagaagaagaagaagaagaagaagaagaagaagaagaagaagaagaagaagaagaagaagaagaagauucauuguaaacugagaucuuuuccacaugaaggaaaaaaugauagcuauuguuuuaugauuggugacaaacaaaaauaauugcccagaucccuaacuggugaaagugcugacaauccaugacgauugacuguucaucccaccgagaaucgaugucaccccuucaaggcacaguuaacaucauggaagaggggucagacgagauaaggaacucggucugggaaauggaaauaguucaggacacaacauaguggcugcacccaugaccucacagcaacagaggcuaccugcacaaaggcagacucaaggaaggagagaggcauuucugccaugcuuugaagggagaacccagcaaccuugugagauaucagggaagcuugggcugugguagucaggguguuugaaggacuagaugggaccagccauggaaguuuagggcaggcggaaagacugauaaugcauugguaaagacaccaguuuccaggugucuggcaauugugccaggaaggcaaguuguaaaggaacugugugagugcaugcgugcgugcaugggugugugucugcguguguguaugcgcgugccugaguacgugcaugagugugugugugugugagugucugugugugcaugcgcgugugaguacaugugugcaugcaugcauguguugugugugugcgagcacgaacgugcgugaguaugugucugugugagugugugugugcaguguguguguguguguguuuuguccaaagauucaagggaagcggguagaggcugguaguguggucaccuccccgagcagagcaaaagggaagcugggugggggcagguagugcugcggcugguccagaagcaaaggcgguagcauaaaacuacaugcaacagaugcacaacauugguuccaugaacauuccaucacagauggggaggaucuguagggaaagggcuaauaggcaauucacuguugcuaggguagacaaagucauauuccucagugguguauccacuauuaaguuacccuugcucaaagaaucccccacucaugcuucugcaagcaccggucuaauuaaacagugggucacaaaaacaugaaaguaguuagggaccugcuggaaagaaaaauaauucagcaggaaggcaagacggguaaggaguaguuguuggucauggaagauauauacauauguguacacauaauaauguagauuuguuuguuguuagccuccacgagccuugucacuauucccacaggacuaguacaccaagaauuuacuggcggcagugcucucacaucauuaaugaaagcaacuaucuauuuuucuccaccaggaaggauauucguuaccgcuuuaaauugaaaucccaagucgacuccauagguucccacuuaacauauuuuguuacugagccaggguuugcucaugaaggcuuuggguauuucuacacuggauagauaaaaguauuccacucuagaugugagacucacuucaguaauacauacagacaaagaagauacagccacuucacgucaaaaccugcucaaacauuucaauuuucgucaaaacauuaacccuaauuucaacaguaauuacauccucauaugcucccaauauaauagugucaauccgaucacugcuauuuuauucaauccauuccuuaauaacuauuucaagauucccacuucacugggguaaaucucuugacaauuccauuuuauuuuuaucuauuuuuagagcaaaucauuaucauuuuuguagcaucugugagaccccuggaggaaacugaauugaaaauuuugauucugcuucuuaaagcccugcuugauuuugcaagauugaagggaguaagcaugcaaaaugugucccuaaaugacagcauuuacucugaacuugcugagagguauaaauuggguaaacauuuagccuuuguaaagccaaucuagcauagauucuauauuccacacagcagccgcuacaagcugaugggcauuuccaguuaacugcuuuaggacuuauuuauuuguuguuuaucaguguuuggucugcauguaagccuguggaccacaugcaugccuugugcccauggaacuuagaaaagguuaucagaucccuuuaaacuggagucacaguuguuguaagcugccgcgugggugcuuggaacucaaucauccucugcaagagcaacaagugcuuagaacugcuaagucuucucuucagugucucuaggcggcuuuuaaaguaggugaaaaacucauuccuauuuucagggcaaaugaacuauaaagugucuuucauucagucuucgagauuggcuagucccucaagaagaauuucgauguguguugagaucguauaccacaacguuaaacgcuggaucuauaauauuuaaaaccaaggagacuguucauccucacgauccgcuuguauuugggguucuucgggaagcaacuccuuaacaucguaucauuucgcuuccaugacucccugauuugcuuccaccuaccacauggaguaccuucuuggugaccacaggcauacagugucauccauuuuccaguauaauuuuuguuuuuggugucaauucugaucagacugggugaagucuugaguuaagugaaauacuaggaucugcaucagcacuccccuuugcuuuaucuagcagggauaaaaauaacuaagagcuuguauauugagacuguuuugaauuuccuuuuguauccagaucaucaacuaccgaggaucaauuuguaauugauuccauaaucauguaacuuuuaccuccaucaaccgaucacauaacaaccucugucacauaccugaguggcccaguagcucuccaggccucagaggcuugucauuacacuuugccauuauugucagaucauucucuuuccacuucucaacaaagaacucaucauguuuugcugauuuuuaauuuuuaaaaauuuaaaauauaauuacaccauuucccucccucuacuauguccuacccuaccuauguucaacccucugucccauacaaagucauggccacuucuuccuuaaccauuccuguuacacauauacauauacgaugcauaaauacuuaguacaaccugcugaaucuguucagugcugccuggauauguaugugucuaggaaaacaguaguccucccucucucagcuguugcuaauugcccaucuucuagucaucuaaagaugguguccugggagacuuccccuguguaugcugggauggcaacugguacuggaacuguuuauaucuuauuguugaaauguugcggguguauauagcuuugcuuuugcugcaagaaggcacaaucucacaggcauguuuagggacauucugacaaaucccaguccugaucuacaaucaguaucaucaagacaauacuuaaguucagggauguaucugaagaaaccaaagaccuccaaggagcuuucauacuauucaaaguuaugauucauuauauuaaacaaaugcaaaucauuaucaccaaggaggaguuaugaaugacguuaaguucaagagaaaccgguucaagcuuccaagaaucccagagaagucgcauaugaacacaucucauuuuacuagaaaugauguauaccagccagggaaagucaucuguuccuugaagcucagggauauuacugugugucacuccugaggcaugcagcacacuuaugacugaaauucuagucccuuuuccaggacagaaacugccacucauaccaagucccauuguuagaauuaguguaaccaaucaaacaaaacuggaaugguucaaaggcuaagacauacaaaaacaaacuuaucagacagaauauuugaggaguuaagagguuaucuaccaagaaccagccaagcaucaacaauagagacaggcccuucuuugaaaaggauauggcuuaagcaacucaaacuuucuaagugaaccccucuuaucccucaauacacuacaaacaaugacuauucaucuguccaaauucaggaguaauaaauuaaaaguuuucuaaacuuuuuucaucaaaaaccaaaauguacaaauggugaguuuuacauacccauguuucuaacaaaaauaaggaucuauucuuuacaauuucucuuacgugaaaaaagaauaacugccgggcaugguggguauuuaaucccaacacuugggaggcagaggcaggcggauuucuggguucgaggccaaccuggucuacaaagugaguuccaggacagccagggcuauacagagaaaccccgccuugaaaaaccaaaaaaagaaaaaaaaaaaaaagaaaaaaagaaagaaaagagaauaacuaaagaaagcauaguuuuaauuuaugugauauacauaccuuauaacaaguguucauuuggauggcauauuuugauguucucuacccagguguuaguuaaccugugccuagaaaaaaaauaaaaagaaaugcuaacuauggaguucucccaaaauaagaacaugauucuuaaaaauauuuacauguaaauguuuuucucaauuuauccuugaccuccaauagauacuucaaaccucuaucuugagguuucuugugauaugacuuguaaaaauauaaauuccccuaaaauuuguaaaggaagauaacuuuuaauaauaaaaggacaauucacaguaggcuugaauaauaaaauuauuuuggccauuuaggaaccuuacugauacaacccuguauauuaagaggaaaauuuaauagauauuuauauagauauuucauguaaaagacaauuuuuaggucucugaaaauguuuccauuuuaucccaacaaguaauagucaaauuagaggaggaaucugaguauuuacuguuaaaacuauucuaagcauuuauagauauuuaguauauuuauugaauaaagcuaauucauuuaauaaaaugaaauaacauuaaaauaaaauccguauagacuguucucuuauuucugaaaagaaagaacuucaauguucuuucugauuucaauuacaaauuuuauucuguaucuaucaauugaauccaauugaaaaaugucacagccuaaauagcuuuccacgcucaaaugccuggcuauuuuaagucacacaaacaagagaaaugaaugaguagcuggugacucaaccacuucaagcuuuacccauggggagcuaacggucucucugaagcaaaggaggucaucaacacaauuucuucaacaaaauauaaacucuucaaacacacccacacacauacaugcagucaaagcaaccguaggcuuucaggaggacugcuauagaauuaggcacacuauagcauuucccgguuaucaugaaaccagaaugucagaauaauaaugaccuugacauaaaagugcuuugcugugcaaacauagggaccucauuuugcauuugcagaaccaacauuaaaauguagacauggcgacaaguauuuguaucucgguauucggaagguagggauacuuugggcuugcuggcuauccaguuuagccacguggaaggcccugaguucaguaggagacuguguuacaaaaacauaagguaaagagugaucaaggaugaaauccaaagcugaacucuaacuuuuacauauauccauacacacacgugaacguucauauacacaugcacuuacacacagagauggggggagugggguaugaauaugauguguuaaauagacaaaguagauaaucaaucauucugaauuuuuucuugcacaaacuaacaguuucugccuuuguucaagaacuagaaaauaauacguacauauaccaaaagagaccccaaauuccauauagcccccccaaacccuuuguaaauacucaauagcaacagaugauuuuuuuucugcaagauuaacacacucuuccccugacaacuuaaauguaucauaagcuugcaucauagcuaauuggcucacacaugacucacaaugcuacaacuaaugaauggauaagugaggcagaacagaauacauuaagcacuuagucuugggcaugacucuaaugaggacaucgaaucuagguaguaugugagaauaguaucuuuccucugagaucuccuguugacucuuagaauaccacagcugcauaaaaucaucauucauaagauauaauuuuagcauauauauugaauuaaaauuaaugacauuucccuuuaauuauagucuuauuaaaguuacauacucaugcaaauaucacacucuacccaauuuuauaacaguucugauaucucaaaauuaccucuugugcccaauuucaaucccuuggccaagcguuuucccuaacuauacacacucauuacuucuuaauauuucucauaaauaaaaacauaacauauguagcuuaucucugugugugguauauguccaaugccaugcaaggacauauuaacuuuucaaagcugauucaauaagucgauugcuuguucuuuaguggauauacauugaguuguuugauacauuuauuccuaaguauuuuauucauuuuuuuaauuuauuagguauuuuauucauuuacauuuccaaugcuaucccaaaagucccccauacuucccuaccccuacccacccacuuccacuucuuggccguggcguuucccuguacugaggcauauaaaguuugcaagaccaaggggucucucuucccagugauggcagacuaggccaucuucugauacauaugcagcuagagacaggugcuugggggagggggguuaguucauauuguuguucuaccuauaggguugcagauccccucagcuccuuggguacuuucucuagcuccuccauugggggcccugugauccauccaauagcugacugugagcauccacuucuguguuugcuaggccccggaauagccucacaagagauagcuauaucuggguccuuucagcaaaaucuugcuaguguuugcaaugguguaaguguuuggaggcugauuaugggauguauccucagguauggcagucucuagaugguccauauuuuauucauuuugauguucuccauggagaauugauuuuuuuuuuuuagcuuuaguguuguucauggauaauguaaacccaauuucugucugaauucucuagguaagaaucauuaucuguccauucaaccuucaggcuuuuaauuuccuuuuaaguaauuuaucauuaaacaaaaauaaaaguauguuuuuaucauguauaauauaauacuuugaaauggguaugcacuggccaaauacagcuaauuaacauauuaauuaaauuuaaaaccucacuuuuuauuuuggaaaaucuuaaaaucuacucuuagcaauuucuagggaugaagcauuauuguuaacuguagucauuauguuguacaauaaaguucuugaguauauuccuccuguuuagccaguaauggcauauccuugaauaauccuuccccaaauccuucccccgaguaaccucuauuuccuucuuuguuuucuuaauauucucucucuuucucucccucccccucccucccuuccucccuccccccuccccccccuuuguguguguauguguuuguaaauguguacaugcuauaugcauacguagacgucagcggacaauaugugggaguuaauauucuccuuccaucacaagaaucccaaugaucagauuuaaguuuucagacuuuguggcaauugucuuugccaacuaaggcauuuuucuggcuucacaauucuauuuucuccuuuucugaagucauuuguuuuggguuuuuugcuuauuuggcuuuguuuuuuuguagauuauaccuuguuuuuauagauuuuuauaugaucaugcaaugugucuuuuucacuagauggcuuauuucauguaacauauuaucuuccagauccauaaauuaacacaaaugaaaggaucccaccccccuucugcccaaauuauauuaugcuguauuuuucaucucuucuucucauuaacauuuagacuaaagcugaaacaaaaacuucccuagggguuaaauaauauaugugucugguaauauaauacuggaaaguuuagagcauauucuuaagauauauauuauuugguauauagggaaguaggaaaugucaguaauucccacuuggaaaggcaaucaacagaauuaaacauuguaauguagccucccgcagccuugaagcacauugauuccgacuuugcugccacuaaauaugagaucaccugggguguagccuuccgacuuagauggcuauauuguuaugucaacuacugcugcucuucucugagacucugcuaccugcugagagacucuugagacauuccgggagacacguccuauccuacaggcuggcuccagccaccaagaauggacugguggggggugggggggugggggggggaugggccuucccccuuauaagcacagucucuuaguaaacuugcugucuaaucucucuuucagccccagccugccuuccagaaauaccugguucauguaggcugugugggcuggccuccuacuacagauuggcgccugaaccaggggccugaaaacggcaggaagacacugagugaacgcugucuucuguggagcuccaugagaagggaagaaucagaagaucauaucgggcacagugagcaacagguauuuaugccagcgcuggauuuaaacuucauuuuuaaaaguguugcuggaggauacaggcuaaguuggaacagugcugacccggugcugauuccacuuaggguuugacagcaaaauauggaacuagggccaagaagugggaguggguggguaggagagugggggguaugggagacuuuugggauagcauuggaaauguaaaugaagaaaaugccuaauaauaauaauaauaauaauaauaauaauaauaauaaaaagaaacucccaagcaggcguuugucugcaguuuucaagagcugcuucaggcaagaggagugggguuugaaaaacaauuguuagaaaauuuuuuagauaagauagauucuuguugcccaugguucagggaagaaaaaacuuuaaauaacagaaccugggagagaguuggagaagcuuugaaaaacacccaggcagauaauuucacccuuugccucugggcgcucguaaaagaugcuauugaaaaagagaucucaaaggggucagauaguacccaggcagaucuugaagaaucucaggaagagcaccugucagagaggacuuucucagaaagggacccucucaacccuaaauuagaaagauauagagacucugaugaugagcuaacuuuagacaaggaagaucauucagaaagaggagccgccaaauauuuugaugaggauuggccucauggccuccacuauaggagaugcuacugaaauggacaugcaacuaaguaaauuagaguuugaaauuaaguugcagaaauugacuaaugagcuuccagagcuaaaaagggugucagauacagggaagagcaacucuucugaaauguaccaagcgccacuagaaagagcuaugagccaggcuugugagaggagacaggauacgucugaugugcuagucuuuccuguaguugagauaauugaccagcaaaauaauagaaucagauaauaccagacuuuggauuucaaggugauaaaggaguuaaaaacagcuguugcacaauauggcccuauagcucccuuuacacaagcauuauuggauacugucauggagucacacuuagccccccaaauuggaagacucuauguaaggcuacucuauuaggaggaguuucuuucuuugggauucugaacggugagaaaccaguaagaaaacugccgcuuuaaaugcucagacagguaauccugacugagaugccaaaagcaugggagaaggucgauaugaagacaaugcuaaucagauugguuuuccuguuggaguguaugcucagguugccauggcugcccgcagcgcuuggaaacaguugccagcuaaaggggaucuugguggaaauuuagccagcauugggcaggguccugaugagcuuuaccagaucuuuguggauaggcagcuaguaggauucuuggagauucugacccgggaaguccuuucauuaugcaacuggcuuaugagaaugcuaacgcaaaugugucgcaccauuauccaaccacacaaaggacagauggaacuagcgggauaugucccucuuugugcagagauugggcugucagguaaucaggguuuggcuuuugcugccaccauacaagcaaugcuuucacagaaacgagggaauaaugcauguuuuaaguguggaaguuuaggucauuuuaaaagugauuguccaaagaauaaaggugcuaagaguaggcaagccagccaagggcaacgauuggacuaggguguguaaauccaagucagacauuagggccguccguugccaggaaacgagaggaggggccagccccaggccccaaaauacccauggcaggcagcuuauggagccaugaagcuguugcccagccaaagaaaucccuuuuugaacuuaucaggggaaccccaggaagugcaggauuggaccucuuuuccaccacccacgcaauauuaaccccagaaaugggaguucagacucuaccuacaggaguuuuuguaccucuaccugcagaaacuuguggauuuuuuuuuuaggaugaagcgguucuauuguaaaaguucugcagauuuauccagguguuauagauaauaacuaugagggagaaauuaaaaucauggcugcuuccccucaugguguuauaacuguaccugcccaccagagaauugcucaacuugucuuaacuccuuuguauccgcuaccguccagauuuguuaagaaugagagaggacaagguggcuuugauuccucuggugugcauuggguucaaucuauuacuaaucagagaccuaaccuuaaauugacaauugaaggaaaaagcuuugaaggauuaauagauacuggagcugauguaacaauuacuagaagacaagauuguccuucagcuuggccuuugucugauacgcuuacucaccuucaaggaauugguuaugccaauaacucaaaacgaagcuccaaauugcuaaccuagagggaugaggaaggcaaaucaggacaaauucagccauauguuaugucaaauuugccuguuaaccuauggggaagagaucucuugucacagaugggcauuauaaaaugcaguccuaaugagguggugaccaagcagaugcucagacaagaauuuuugccuggucaugggcuaggaaagaaaggacgagguauuaagacuuuugaagguccuaaaccucacucuaacacaagagguuugggguauuuucaguaauggccacuaucuugccugcaucccaugcggauaaaauucaauggcuuaaugauauuccaguguggguugaucaguggucuuuaccuaaagagaaaauaggagccaccucuucacuaguacaggagcaauuagaggcaggacauuuaguagaaucucagucuccuuggaauacuccaguuuuuguuaucaagaaaaaaaucugguaaauggagauuguuacaaaucuaagaaugguuaaugugaccaugaaaucuaugggaacuuuacaacccgggcuugcgucuccaguagccauuccuaaaggauauuauaaaauugugguauauuugaaggauuguuucuuuacuauuccuuugcauccugaugauugugaaagauuugcuuuuaguguuccuucuauuaauuuuaaggaaccuaugaagagauaucaagggagaguucucccacagggcaugacuaauaguccuaccuuaugucaaaaguuuguggcacaagccauucggccugugagacaacaauggccuaugauuuacaucauccauuacacagaugaugucuugauggcgguaaaagacccccaggauuugcuuuuauguuauagagauuuacaacaggcauuagcuaauaaaggacuacaaauagcuccugagaagauacaaacucagaauucuuauaauuauuuggguuuuagacuuacuaaucaagcuguuuucccccagaaaauaguuauuugcagggacaacuuaaaaacuuuaaauuauuuucaaaaauuauuaggugauguuaauugccuucgccccuauuuaaagcuuacuacaggggaauugaaaccuuuauuugauauucuuaaagggaguucugauccuaccuucccuagaucuuuaaccucagaaggacuguuguggcaaaaggcucuucuaauguggauacauuugaggauuucuccuaagcguaauauccugccauauuaugaagcaguagcucagaugaucauacuuggaaggaaacaggcacuaacuuauuuuggcaaagagccagauaucauuguucagccuuauagcguagaccaagauacuuggcugaagaagcacaguacggauugguugcuugcucaaauaggauuuauaggaacuauagauaaucauuauccucaagauagguugauaaaauuuuuagauguacaugaggugauauuuccuaaaaugacuucuuuacagccuuuauauaaugcucuauugauuuuuacugacagcuccucuaaggcaaacuggauaucuuaugaauaaucaacaaguagucauagagacuccuggccucucuccuggccucucagcucaguuagcagaacugacaguaguacugaaugacuuucagucuauaaaugaugcuuuuaauauuuuuaaugauaguuuauauguugcacaaucaauucccuuauuggagacuugugguacuuuuaacuuuaauaugacaguaggaucucuguuuucacaauugcaaaacaucauucuugccagaaaacauccguuuuauauuggucauauaugagcucauucaggucuuccugcgccuuuagcuacaggcaaugauuacaucaacagggcucugauaggagaggccuuaauuucagauccuguugcuuugucuagaugugaucaugauaaauuucaucucucuagccauaccuuaaggcuccaacacaagaucacuaaagaacaggcaagaaugauuguaaaacaauguucuaaauguauuacauuaucuccagugccacauuuaggaguuaauccacgaggucuuaugccuaaucauauuuggcaaauggauguaacucauguggaauuuggaaaauuaaaauauauacauguuucuauugacccuuguucaggauuucuuuuugcuucuccacauaccggagaggccucuagaaauguaauugaucauuguuuacaagccuuuaaugccaugggaaugccuaaacucauuaagacagauaaugggccauccuauacuggcaacaauuuuacuucauuuuguaaggaauuugguaucaaacauaaaaugggaauucuuauaaccacaugggacaaggaauuguugaacgugcucaucgcacccugaaaaaauuggcuuuuaaaaugaaacaggggcaguuauacccuccaaagacaccaaaagcacaucuugcuuuugucuuguuuguuuuaaauuuuuugcaaacugauauuaaaggucagucugcagcugaucgccaauggcauccaguuacuuccaguucuuaugccaugguuaaaugacggaacccauuaacuaauauguggaaugguccagaccccguuuuaaucugaggaagagguucugucuguauuuuuucacaaaaagaagacggagcacgauggcugccugaaagacugguucgucaaguggacacagauccugaaucuucuaggaaguaugauucuaaccacugauggcuaaaaauccuuuuuagccgaaaaaguuaauuuggagcacagccuccacuuucagagaauuuucagcuuuucuguuaauucucaaaguuaccucccccacacugagaggucagagucugagcuuccccacacugagaggucagagucugagcuugaucguugcuaauuugcaacugaauaaaguaccuggacuuccccaaagaagcuuuuauccuguuacuuuucaacuaucucaagcaggucagucucuccuuacagccugauuucagcaagcgugcagccucaccuccagcaagcacagguggcagaaauuaaucaauaugaagaagcauauuaaguauauauuguggcuuuggucugauuugggaauaaggugugcuaugagggccgaucagucaaugacaugcaaccagauuucggagccauaucaaucuaagacagagguacaugccaagaggccaugguuuguuaauaauacaccacagagccauguuuguguaaaauaaacacaaagaagcugcauguaugcuucuugauagauaagaauggcucgggagaaucugaguccccaagccaggcccggcugccagcuaccauaacucccaggcaggaugauggagcauaaauaaauuuuauguucucgguccagcuaauuuuauuauauaaucaggggggaaacuguagccucccccagccuugaagcaggcugauucagacuuugcagccacugaauaugagaccaccugggguguagccuuccaacuuagauggcuauauuguuaugucaacuacugcugcucuucucugagacucugcuaccuacugagagaaccuugagacauuccagagucauauccuauccugccuacaggcuggcuccaggcaccaagaauggacuggugggguggaugggccuucccccuuauaagcacagucuuaguaaacucgagggccuugaucagagaaaaauuugucuuggcuucauucuuuucucgcugucuagucucucuuucagccccagccugucuuccagaaauaaccgguuccuguaggccacgggccagccuccuacaacauuguaaugacacagcaaacuuaaacaggcccauuacaagugaugagauaaaagcuauuauuaaaaaccuuccaucaaagaaaauccuaggaccagauagauuccuugcuauagucuauuaauuuugaaggaguacaugauagcaauucuucuucuguucugagucuuuaggaauauuugagacauaucucaaaauaauuaaggaaauauagaaaaacuauauccaacauuguauuaaauggagauuaagagaacaauuaccuuuaacaucaaaaaugucuauucaucccucuuguauauuauauagugcacaaaguuuuaccuauuauaucaauuacaaaauuaaaaaaacauaaagggacuaacaaccaaaagggaagaagucaaacuaccuuuauuugcagaugacaugaucuuucccuuaagauaaccuauuaaauuugcuagaaagcuuuuguaccuaauauuuaccguaaaguugaaggauacuagacacauccaguugucuucauuuauacuaugucuaacucuccaagaaagaaguuaggaaaaauauuccauucagaauaacuugcccuaaauuaaguauuuaaguauauaucuaaccauagaagugaaagacauccacuacaaucaaaauuuuaagauagugaaaaggggaaccacaagaugauagaaaaucuuacaugugccugaauagacauaauuaagauugcaaaaaugccuagacuaccaaaauuuauuuacaaaguuauugaaauuacuaucaaaaugcauauacuauauacacagguaugaaaagauaacaaauaaacaagaaaucacauggcaccacaaaagaugaugaauagccaaugcaaucuuaaugaguaaggacaaucaauacuggagguauuauaauuccagauaaagacaggcuaauauugacauaaaaauaaccauguagaccaauggaauuaaauagugcacucagaacuaaagcaacaaagcucugcccacuuaauuuuuggcaaaggagggaaaaaauaaacacuggggaaaacauauggacuauuuaaaaaguggugcgggcaaaaccagaguuccacuugcagaagaaucagauuagagucauagcuuucaguuuggucaaacccaauucaaaauggauccaagaccuuauuuuaaagaauaaaauacugaaacauuuagaagauacaucguggauauacuucaaagauauugagccaggcaauaacuuuaaaaauagaacacugaagaacuaacccuaagaaucaaaguauaggacuacaugaaaauaaaguuucuguacaacaaagguacaguagcacuuacagagaguccacaaauagaagaaaaccuuuaccagcuccaccucagacaauagacacaauccagacucuacaaagaauugcagaaauuaaaugccaagggaauaaaugugacaaucagccaauggacaagugagcuaaguggauauuuuuuaaaauagcaauggaaauagccaguaacuauuuuuaaaguguucaauaucccuauacauuagggaaguacaaauuaaaauuacuuucagguacuguaccuuaccacagucugaauaaguagcauaaaaacaaaaaaaaacauaucuaaacaaacaaaaguaucuaaaaucaaauguuggagaggaugugaauugaagggaaccccuuuucacuguugguaggaaaaacaaauuaauacagccauuguggaaucuguuuggagaguccucaacauuuuagaguagaacugccuaugacccagcucuuucucuccuggguauauccauagauaauuccuuuucucaccauugagauauuugcauccccagguuuauugcugcuuuauucacuauagcagagaacuagaaucaaucaaguuguccaccaacagaugaauggauaauuaaaauuauauauaagauucuaaagaaaaaugaaguuaaaauuuuucaggaaaauggugaacuuaaaauguauaauauuaagagaugucaagcagucucagaaagggauuaaaugucauguuuuauuuuauaugcagaaucuaggcaauaauauauacauccauguauacaaaagaacaugugcauacagcauaacaugaaugaaagagaauaugaaagguuagauauaagggggugaggaaagauugaauagaggucauggauacaaaaaaaugaagcuaauuguuuuucuagcucuauuucugucaugacuuuugggggauuuggugauagauaagugcagaaacuacauccaacccugaaaagaagaauacaauuccacacaaagcuccgcaucugcuccaaaugcugauucuaacuggguugaaguucauuaaauuuugcagacuuugguguacaguguuuuuuauuuauuugcaaggauauauuaauaauaaagcuuaaaaaugaaaaauauuuaaagaugucacagugcuagacuuagcaagaagagguuuuaaagcagccugguucauaauguaauggcuggaaauaacaggaauaaucccugauuuugcuaggcuaugccagugaggcccacagaauuaccuguuucugcuucacagagcugagauuaaaagugugugucacuuuuaauaugucuguauuuuacuuaucccaggaagucugcugggagagcacacucaaaccaugccucuuuaucagucuagcuaaagguuuguagcuauuuuuauuuauuuuuauuaauucuauuuuuaguuuuauaugcaauuuuauauaaaauuccuccuagaaaugacugcauaaacaagacuggcacauuggcgauaucaauagacaugccaacacgaaagggagggggaaucuuauggggucccagcccaaggaaaagaacuaaaaaacaacugacuaaugacuacaaagaaagggagaauuagucuuucccaggaaugagccuucuaauugguuguccaauaaaaaguguuuaacugugaaaucauguacacacaaacaaacucaacagguuguauuuagauaugagugcaucauguacauacauauguacauauauacauguauauauucauauauacagauauauauuauauauauucauauauacacacuucauauguauguauauaugcauaauaauaacaaaaaagaaguuaucuauuugagaaugagggagggacacaaaaaaaguuggagggagacaugguaggggcuagagucaucaaagcauuagggaagugauauaauuauauuuuauauaaaauauuuacauaaaauugcauauaaaacuaaaaauagaauacauaaaaauaaauaaaaauaccuacauaccuuuagcuagacugauaaagaggcaugguuugaccgugcucucccaauuucauguacugugauuuuuaucuucaaugcaggaggacugggaggugaaacuuaugaugugcucauuaggucauaaauacucugacuuuuauggaugggccaauaucucuaugaugggagcuggguacuuguaagagugauuguuugcccauccugaggcacuggcucuagucagcagcaccaaaaccauuaauugauuaaaccaaaaaauguaaaggaauauauuacaauacuuugacugacugacugcaugccaauaaauauauaacaugugaaauauacaccacgauaguggccagacagaagguaccagaucaacuaaaagagacauggaaaaucuaaacugcacuauaacaaaucuucucagaaagagcaacccagagggccuggcugcuuaucucuguagagauaaaacaaaaccucccuagccgguugugguggcgcacgccuuuauucccagcacucgggaggcagaggcaggcagauuucugaguuugaggccagccuggucuacagagugaguuccaagacagccagagauacacagagaaacccugucuccaaaaacaaaacaaaacaaaaaaaccucccaaaagugguaacaagaaauguuucccaacacacacuccauuauacugauagaaacacagacaaaaaguaugacaggaaaagaaaugcagaugaaaaucuacuauaaacggaaacacuuuuagagcaaaacauuaccaaaaguaaucugagacacuaacagaugauuauacacuacccagaaaaguagaaugucaggccuggagagacagauccauaguuaaugaccuguacugcucuagcagaggacccgacuucauuuuccaggacuaaugucaggucacuuacgagccuccguagcugcagcuccaagggauuccccuucugaacuccugacacccucaggcaugugcgcauacccagacacaaggcaggcucgaucacaacuuaauaaaucuuuucuaaaagguguaauuugggcaaaagagauggauccgugggcaaggugcuaccuuuauaagcacgacaaccuaagauuuauccagagaggccccaugaaacagcaaagugugcuucugugcacccuucguugcugcacugggcaauucagaccagugagagacugucucaaauaacaagguauauggcuccugaggaaugccaucagauguagaucucucgucuccaaaagcaugcccguuuacacacacacaucuacacacacucacaaacauguagaaaacccugugaauuaaggucacugucuaccauguccagauaaguccucugagcuugguacaaaaucaaugacucucuuuaccaucagggcuuccccuucucugaccuuaucuaaggagccaggccauccacacccucuaccuggggaaggucauguagaccuuggcaaaccuagaaguucaauuuccucuuucccacuaagaaccugcccagcaaguaccugggauuacuggaaugccucgccauacaagugagacauuaacaguacuuuaaacuccagccaaugauuccauucacccugaaaacuccuuuccacuccucgaguuucauauaaugcucuugaccaccccgaauaagguauacgcauacaagcccauuccaaauaaagguaugcacacaagcuaagauccucugagaguuccauuaaaaucauuggagaaggccuuacccccacacucacucccacccuaccucccccuaccccaucacucccaccucaucccuccacccccacugcucaccccuucacccccacccccaucucauaccccucaccccaccggacccccggucugaauucauuuccaacugaaccagaauacugcagaccccaccuguuccauacucuccuucauccuuccagucugcugugcauucaaugccuggacacccugaggaaggaaacagaagauaaggaaccauagcuggaucccaacaccaugcauaacacacacacacacacucacacacacacacucaagcaugaacacauacaggcauucaagcaugcacccagucacccaugcaggcaugcaggcagguacacugacaauaagugguuuuuauccuaggaauguaacauuagugaucaugggaaaaaucuguccauauaaauucgugacaaagcucauagacucacaaucuguagggcuauacauaacaccacgaaagugugcuuugggccuggaccauuuccuugucuagugauacagaguucucauaauguguuuuagguuuaugcucucaucuuaucccacuguuaucuuuguauguaucauuuucuucagaguaagaguaugucucaagugcucgaaaacauguauuugguccuuagcguuucugacauuacaguucaggauccuuuucugguagaauuugguacaugcaggcuuucugacugaggucugcgucaaacacaucugugauccuggcaaaauuagcaugucacaaggagcuggaucuuuugaacaugcucacacuacuuuugauguauauaaaaacugaacuguuagauaaauauggauguugcuacucucagaaaccacagucugauccaugcaccccuuuuuauuuuaucuuauuuuuuuuccugguuguuuauccuggagcacagccugaccaacaaauggccaauaaaauacaagguaugauagucaugaauagagaaaaucuucaauaaugaaggauaaugagguggcuuagucaauauuauucuucccuugcaagcaugacauuugaaguucaauuccuaaaaucgaccuuuaaaaaguuaggcaugaugggccaugcuuguacuaccacugaaggguaaucagagacucacugggguucauggaccacagacccuauccaauuuuacacguuccaggccaguaagagacccugggugggaggaaagguaaauguccccuguggaaugaugcuuaaaguucuguaaggcugacuuccauauacagguacguguacacacacacacacacacacacagaggcaugugcacacaugugcacagguacacacaugcaugcaauaccuccauauguauuaucuguucaccauuaauacacacagaaaaaucacauaauuaucucaaaaaaucaaaauaauacagaucaaaccacguuuuuaaaaugaaccuaugcaacagacuaaauauugaagagcaguagucuaagaugacagacuauccauaauauuugaauacuauucacagucaugcuauagaccaccugcagggccaggccauuuguaguggauacaccugcacaugguuuugcucuuuggaccuguauaggccugacuuacuuucgggcugaagccuacaucuuacucaucagguagguacgugggaccccagagucuugccagauccagugguuacagacacuuagugcucaauacagcacugucagguuucugacccugggcucuaggucaaugccagaggucaguuuacagagacucaugcuucaggcucaccccuaaugccagguuuguuucuguggcuucagacacaaacucguauaaauuaauuggcaguggguaaaagaugcaaggaacauaaaauuuaauaaucuauugauuaugaagaauaaaaaaaaauacaacauauucccauuuguggcagucagaaggaaacuaauaacucuuaaguaaccaaacuucaaaagugaaaaacuuaauaacgguccugcauacaaaagauaugauauuuggagcaacguguaaauauacucuuccucugcuuugacaaauucuauuuuuaaaauuuaccccacuugugauaacauaauaaaugcauuuauacauuuaaaaagucaacaagucuagccuuggaaagugugcaugcuuguaauuccaacaguugggaggggggaggaggaggagaacagcugagcuuaaaauaugcaaaggaaaacucagaaugcuauuagcauaauggagauaaauaaaagagacaacaauuuaagugcaaacucagaugugggucccuccaaguaucaaaucuccucagagauugucugguaagcaacauuccaggauuacccuggcauccggcucucuucucugcacuuuuuccccugaaagauaugccaagcaacuccaaguacuguuuuccuggcuuucacuuuacauuauuguugcuguuguuguuauuauuaauuucuuuuccugagacagguuuaucuguguagccucaggaguccuggaacucccucuauagaccagguugcccuagugcucagagauucacaugccucugccuccugcgcuccgggauuaaaggacuacaccaccaccacucuuuuaucuuagguuugaaaugaaguacauuaaguguuuuccauucauccuuugaccauauuggucuuccucccugacuuuacacccccgaggccccauuuaccuucuucuaugcccucccuauuucuucacuugcccacuucuguuuucaugucauacagauucucacuuuccccuguuuaagauuuugacacccacaugggaguuggggauagggcaugccuuuaaucccaacacuugggaguaagaggcaagcagauaugugugaguucaagacacacauguucuaccgacuucaguuucagaagagucaacgcuguucuaagaaacccuguuccaaaaaaaacaaagcgacauaaaaaaaaaaaaaaaaagauuuugucagccgggcagugguggcgcacgccuuuaaaucccagcacucgggaggcagaggcaggcggauuucugaguucgaggccagccugaucuacagagugaguuccaggacaaccagagcuacacagagaaagccugucucgaaaaaccaaaaaaaaaaaaaaaaaaaaaaagucaaccaugucauguuucccuuucugguuucaggauucuccuaaaaagacacacacacacacacacacacacacacacacacacacacacacacacacacaaacacacacaaucuagaccauguaaaacauguacauauguaccauacuaaacauaguacgucauuaauaauguacaguaaaaacaaacucucaaauucaaggcuauuugugucccggaagaaaaauaguccauaauuauacauuugacuuuggcuuuuuuaguguucuuauuugaaacuggagcccuuaaauagagcucccuucaaccaaaguuaaaacauagcaugcgcgcgcacacacugcaaugguggcaagccuuucugucacaguccccuggagacuacuucuguacagacuuuugccaccccucucgcgccuccugcaauccccugaccuguggguuucuccugcuuuguccacuauuacgguucuauccuauguggcuugugugccgaaacugauggaggugaaggaugaaacuggaccacaaaucacuugcagcagcccugguuccucuggaguagcagacuagcguauuagucuucaugauuuuugcagaaugguggccacgaacaguuuuuuuguuuguuugguuuuguuuguuugguuuuguuuguuuguuuguuuguuuguuuguuuuucgagacaggguuucucuguauaucccuggcuguccuggaacucacucuguagaccaggcuggccucgaacucagaaauccaccugccucugccucccgagugcugggauuaagugcgccaccacgccuggcucccacgaacaguuuuaguacuguuaauccuuacgaauggccauucucucucgggugugaaguuuggagaucgcuuauaacauauugcuauguuucucauguuaaaagccuguguacgguuuguuacaaguugucccuaagaaacuaugcaaaacacgccgaucucuguaccaaauaaucggcuaugcuguaacacuguacacuguaagacaguuccguuaccacaggagaaugaaaagaacccgggacucccaaagacgcuagaugugugaagauccugaucacucauugggugucugaguucugcgauauucaucccucagccaaugagcuuacuguucucgugggggguuugugagccuuggguaggaaguuuugcaaguuccgccuacagcucuagcuugugaauuuguacccuuucacguaaaaaaguaguccagaguuuacuacacccucccuccccccucccaccucgugcugugcugaguuuagaagucuuccuuauagaagucuuccguauagaacucuuccggaggaaggagggaggacccccccccuuugcucucccagcaugcauugugucaacgccauugcacugagcuggucgaagaaguaagccgcuagcuugcgacucuacucuuaucuuaacuuagcucggcuuccugcugguacccuuugugccaugucugauaacaagaagccagacaaagcccacaguggcucagguggugacggugaugggaauaggugcaauuuauugcaccgguacucccuggaagaaauucugccuuaucuaggguggcuggucuucgcuguugucacaacaaguuuucuggcgcuccagauguucauagacgcccuuuaugaggagcaguaugaaagggauguggccuggauagccaggcaaagcaagcgcauguccucugucgaugaggaugaagacgaugaggaugaugaggaugacuacuacgacgacgaggacgacgacgacgaugccuucuaugaugaugaggaugaugaggaagaagaauuggagaaccugauggaugaugaaucagaagaugaggccgaagaagagaugagcguggaaaugggugccggagcugaggaaaugggugcuggcgcuaacugugccugugaguaacccguggucuuuacucuagauucagguggggugcauucuuuacucuugcccacaucuguaguaaagaccacauuuugguugggggucauugcuggagccauuccuggcucuccuguccacgccuauccccgcuccucccaucccccaguccuugcuccgcucucuucccuuuucccaccuugccucuggagcuucaguccauccugcucugcucccuuuccccuuugcucuccuugcuccccucccccucggcucaacuuuucgugccuucugcucucugauccccacccucuucaggcuuccccauuugcuccucucccgaaacccuccccuuccuguuccccuuuucgcgccuuuucuuuccugcuccccucccccucccuauuuaccuuucaccagcuuugcucucccugcuccccucccccuuuugcaccuuuucuuuuccugcuccccucccccuccccucccuguuuacccuucaccgcuuuuccucuaccugcuucccucccccuugcugcucccucccuauuugcauuuucgggugcuccccccucccccucccucccuauuugcauuuucgggugcuccucccucccccuccccaggccuuuuuuuuuuugguuuuucgagacaggguuucucuuuguaucccuggcuguccuggcacucacucuguagaccaggcuggccucaaacucagaaaucugccugccucugccucccaaaugcugggauuaaaggcuugcaccaggacugccccagugcaggccuuucuuuuuucuccucucuggucucccuaaucccuuuucugcauguuaacuccccuuuuggcaccuuuccuuuacaggacccccucccccucccuguuucccuuccagcacccuuccuagcccugcucuguucccucucccugcuccccucccccucuuugcucgacuuuuagcagccuuaccucucccugcuuucugccccguuccccuuuuuugugccuuuccuccuggcuccccuccaccuuccagcucaccuuuuuguuuguuugguuguuugguuugcuuuuuuuuuuuuuuuuuuuuuuuugcaccuuguuuuccaagaucccccucccccuccggcuuccccucugugugccuuuccuguucccucccccucgcuggcucccccucccuuucugccuuuccugucccugcucccuucucugcuaaccuuuuaaugccuuucuuuucuagacuccccccuccaggcuugcuguuugcuucugugcacuuuuccugacccugcuccccuuccccucccagcuccccccucuuuucccaccucccuuucuccagccugucaccccuccuucucuccucucuguuucucccacuuccugcuuccuuuaccccuucccucucccuacucuccucccugccugcuggacuuccucuccagccgcccaguucccugcaguccuggagucuuuccugccucucuguccaucacuucccccuaguuucacuucccuuucacucuccccuaugugucucucuuccuaucuaucccuuccuuucuguccccucuccucuguccaucaccucucuccucccuucccuuuccucucucuuccauuuucuuccaccugcuucuuuacccugccucucccauugcccucuuaccuuuaugcccauuccauguccccucucaauucccugucccauugugcucccucacaucuuccauuucccucuuucucccuuagccucuucuuccucuucucuuguaucucccuucccuuugcuucucccuccuccuuuccccuuccccuaugcccucuacucuacuugaucuucucuccucuccacauacccuuuuuccuuuccacccugcccuuuguccccagacccuacaguauccugugcacaggaagugggaggugccaucaacaacaaggaggcaagaaacagagcaaaaucccaaaaucagcaggaaaggcuggaugaaaauaaggccagguucugaggacagcuggaaucuagccaaguggcuccuauaacccuaaguaccaagggagaaagugauggugaaguucuugauccuugcugcuucuuuuacauauguuggcacaucuuucucaaaugcaggccaugcuccaugcuuggcgcuugcucagcgugguuaaguaaugggagaaucugaaaacuaggggccagugguuuguuuuggggacaaauuagcacguagugauauuucccccuaaaaauuauaacaaacagauucaugauuugagauccuucuacaggugagaaguggaaaaauugucacuaugaaguucuuuuuaggcuaaagauacuugggaccauagaagcguuguuaaaauacugcuuucuuuugcuaaaauauucuuucucacauauucauauucuccagguguuccuggccaucauuuaaggaagaaugaagugaaguguaggaugauuuauuucuuccacgacccuaauuuccuggugucuauaccagugaacccuaaggaacaaauggaguguaggugugaaaaugcugaugaagagguugcaauggaagaggaagaagaagaagaggaggaggaggaggaagaggaaaugggaaacccggauggcuucucaccuuaggcaugcagguacuggcuucacuaaccaaccauuccuaacauaugccuguagcuaagagcaucuuuuuaaaaaauauuauugguaaacuaaacaauuguuaucuuuuuacauuaauaaguauuaaauuaauccaguauacaguuuuaagaacccuaaguuaaacagaagucaaugaugucuagaugccuguucuuuagauuguagugagacuacuuacuacagaugagaaguuguuagacucgggaguagagaccaguaaaagaucaugcagugaaauguggccauggaaaucgcauauuguucuuauaguaccuuugagacagcugauaacagcugacaaaaauaaguguuucaagaaagaucacacgccaugguucacaugcaaauuauuauuuugucguucugauuuuuuucauuucuagaccugugguuuuaaagagaugaaaaucucuuaaaauuuccuucaucuuuaauuuuccuuaacuuuaguuuuuuucacuuagaauucaauucaaauucuuaauucaaucuuaauuuuuagauuucuuaaaauguuuuuaaaaaaaaaaugcaaaucucauuuuuaagagaugaaagcagaguaacuggggggcuuagggaaucuguaggguugcgguauagcaauagggaguucuggucucugagaagcagucagagagaauggaaaaccaggcccuugccaguagguuagugagguugauaugaucagauuauggacacucuccaaaucauaaauacucuaacagcuaaggaucucugagggaaacacaacagggaaauauuuuaguuucuccuugagaaacaaugacaagacauaaaauuggcaagaaagucaggaguguauucuaauaaguguugcuuaucucuuauuuucuucuacaguugcaaagcccagaagaaagaaauggacagcggaagaagugguuguuuuuuuuuccccuucauuaauuuucuaguuuuuaguaauccagaaaauuugauuuuguucuaaaguucauuaugcaaagaugucaccaacagacuucugacugcauggugaacuuucauaugauacauaggauuacacuuguaccuguuaaaaauaaaaguuugacuugcauacacuacaguuguuucacguuaacgucaauccccauuuuuaaaaaucuuuuugguuucgccucaucuagaaaaagaaaagcaccuagcuuaccaggacacuaaacaaaaugcuguuggguaagugugaaccagcaacagcagcagcagcuggaaauuugcuagaaguguauauucucagacucuacuccagaccuuuugaguccgagauucuuaagguggaccuucaguagagauuucuaagugcucugaauacuuaaaccuuggagcaccauugguuugcagcaacaggggggaaaggcuauguagagacagccuucauuaacuugguaggugguauguuuaugguuugaauaucagccaagggcaaagaugcugagguuuguugcacagugaggaggugauggcggugggguauuuugggaaagauguuagugcauugaggcugaguccuugaaggaguuaucaaaacccuaccuacuucuuacucuuuugcuuccugcugccauaagccaagacaguucaauccaucacaucuuccuucccugguugaagggcuugucaccagcaaacacagaccugcugaaaggaugcgcuuauuucccagggcagcuguaauaaaagcaugaacuggauagcuucaaacaauagauguucauucauuugcucgcaguucuaaaaguuguaaaucugcaaugauguugcuggcagaguucauucuuucuggagguggugagaggaaauccugucuuuucgccuaugcugacucccauauuggcaacaguaggguuacaaauguaacauuuuaaucauuuucuccauccucacauaguguucuucuuuauuagagugccagucagugaaugaaggcuucaccuuaauccucuacuacuuuauuuuuuuaauauuuuuaauuagauauuuucuuuauuuacauuauaaauguuauucccuuuccuaguuucuccucugaaaauccccuauccccucccccugcuccccaacccacccacuccaauuccaggucaggguauuccccauauacuggggcauacauagcaccuucccaggaccuagggccucuccucccauugaugaccaacuaggccauccucugcuacauaugcagcuggagccaugaguuccaccauguauacucuuugguuggugguuuaguuccugggagcuuugggaguacugguuaguucauauuguuguuccuccuauugggcugcaaaccccuugggcuccuuggguacuuucucuagcuccuccacuggggaccuugugcuccuguaaauggucuuugaucauaucuagggagccuaauaguugucccuauagcaucuaucugugauaaaccauuaaauucauuaagguguuaaggggagccacccagagaugacuauuaggacaugguuuacagacacuuggaagucuuaauucuaggcaguagugguuauauucaaggacccaaguguagccacaagcauuuagaguaagaggcuuuugaaggcaaaagccauauccucaguaucucauuauauagcuacagugggagguuugugcacaagcuagcagucuaacaaaagcuaagauaagcaguuaucuggagaggguucugcucaagcaggcagcuuacuagaagcuguuaccuggggugucuugaccucagguuccuagaauagaguuagauguuuuccccaagaauucuccagcaaggccgggugugguggcgcacgccuuuaaucccagcacucgggaggcagaggcagguggauuucugaguucgaggccagccuggucuacaaagugaguuccaggacagccagggauauacagagaaacccugucucggaaaaaaaaaaaaaaaaaaaaagaaagaaagaaaaaggaaaaagaauucuccaucaaggagauaaaauucuaguuaaaacugaaguagucacaacaagauuacaaguuggaggaacuucugcacugacuagaagaacaucuacacugucuugcaaagguacaaagauuccgugaugacuaugaaauacagagaaagggaaaacugggaaaacuaaaacaaucuauuacauuuguaaugaaaggcauagacacacuuaaacacauacauacuugugugugucauuuauauauuguuuuaucuuuuucacaauuccuucugaauacuguuuguaucauuuuauguguacauaaauauguaugcauucaugcaaacaucauucagaaagaauuaugagaaggauaaaacaccagaugaaagacagugguuaacauuuguggaacaaaggguagaauucaccuggggaugugcacagugaauuuuaauucucuuuauaagugcauuaucgggauggauaacgacccgaugguuauaauaugcuccauaccuuuuuacaggcucugaacuuuuucugaauuaaagagaaaauguaaaagaagaaaucugcuuaagucugccuaaagaaaaugagaguugaccagaguaaaggguuagagaagguaaggaucguguauuuaaauagaaaucuacccucuacauguaguuaaggcugccuggauuccuacauacugguucaauaacauuucauauguuacauagcaguacauuucauaucuuaguuuauacuauuuuuuauauaugauuaucucuucaccccauagaagguaaacuacuaaaggguucagauuauacaugaauuuauguguaucuucuucuccagcugcacuucaauuuuuuuaggaaguauuugaagugcuuauaaugguuugauuuuuguauagauguuccuuaacuuuaacauccuuuggugucuguagagacaggaacuuuuagaaucccugacaucuuuuuccuuuuugauuauacuaaaauccaucuuauaguaaccagaaaaauuuaaaucuagguaggguaauaagggaguagcgaaucuaccaaaccggccaauccauggguaggaagaagauuuuuauuagagauaugagacagacaauugccagaggcuuuugggaaaguacagagcagcuauggaucccucucuggagcagaggggcacacuggccagggcagagagaaaggagugggaaaaaaaaacacacaaacuggugagaggaacugggauagccuggaagcguaggguagugagggaggggcuuacagcccagaggcuuugguauguugcggucaauaaggaaguggcucuuccuggcagauagaauccuguuuuacagauuccugaggaaugauaagacugucacaagacugucauuuugagguucccuuuagacaugacaggcagcacuuccuuugcaauguuauugacuucacuacugcauuuuuccauccuguugcuauaauuugagccugaaauguauaccaaaggccuaaguuuuaaguuuaauccuuagucuuuaauguuuugggggaaaugaugaaauuuuuaggaaguuggcccuauuggcagguuuuagauuauuggcucugggagagaugggagcuugaucucuuugccuucauauuaugcuuuguuguuuucucaguaccuaaaugaacacauagguccagucuuaaauaacagagcauguucuuggagguugcuaucuuagcauuugaacugaaucaaugaagaggacccuauugguaccuggggcuuugggcuacaaggacagcauacauaggccccagauacagagacuacauuugagugcaaggaucucucuauguaugacuauccccuuaacugucacccuuuuaaauuucacagucuuuaaagcuagagaaauggcucaacauuuaagaguacuugcuucuccugcaaaggaccuggguucacuucccaccaaccauguggcauuggucuuccuucucugcaguaaccaggcuguagaaaagccuggugcacauaacacacacgugagccacuggacuuuggugccgagaauugaacucaggucuucuggaaggacuuuaccaagugcucuuaacuacugagccuuuucucucacauaaaauaaaauaaaauaaaauaaaauaaaauaaaucuuuuaaaagcccuucauuaguaaaggagauccuguuacauaugucaagcaaugcugggauaccuaggaaagacauuaaaguugucaacaagcaaaagacaggaaggaaagugcucuuagguuaagaauuuaacucaaguuuuuuacaagaaaagcagcggauggagguugaaaaguucuggguuguuuauuuucaguaguuuugcauuuaucugguaccuggcuccgggaugacuggggcagaggaguauuuccucuuaggauguaagucaaagaaaagcagagagaacguauugcuugguuaauuuauguauuaaaaggcaugcuuugguugggccuuuauuaacuuugagaauugccuaccccagggaagaaccacuuugucucuuccaggcagugagguguauaacuagcauuagugguuaaaaaaaaaaacugaaaauguuuauaauaaaauuuauucucucgugcuuggcaucauaauggagagucuuagagaguagggcaaaaguuucacuaggauuccaaauauuuuuaaaaggcaacauaaguaaaagggaucucugcaggccaauuccuaaccacauucccguuuuacacuuagcaaaguaaaacagguaggcagcuuuugggaacuguacuaccuugguagaaguguaggguguguuagaaaguaaucaggcaaggcagccaggucugucaguuagguugcuauggauaugaaaucacaagguaggaauguacauguaaauguuaaugauguuuauggauauuguuggaguuauaaaccgagaugcaugaugggaaucuaggggcgagaagugaggguagagugagggcuccucuauggaaggagaugggguggcauuuuuuuuuaacagucccgaaauuuggaugucaggcuucauuuaugccaggcauguguucuucuguugagcuucaucagggucucacuguuuccacacuggccuggaacucacacuagccagcugaccuaaaacaugccauccuccagccucagccauuggaguaguuaugaguagacuugguaccaucagguccaguagagguacagguuguaacaaauugaauagauuugccuucaugcauaggagauguaggaagaaaagaugucucagcaaacguuagcuucaugacugacaaacacacucacaacacuuagauuaucaaaagaaacguauacaaauuaguguaaauuuuauaugguguaagaaucuccagaagucaagacucagagcuuuagugaaacuuguguaaauuugcacuuaaauuuugucaagaguggacacuaauauagaagaauaaucagacagaaggagcuugauccauagguacuaugccuagggaaauuuagcaaggcuugcuaauuuuuuuuucugauuaaacuaagagccuuacacuugcuagauaaaugcucuaccacugagauacauacucagccuguauuuucuguuuugauacaaaguuuuguuaaguugguuaggauguccuugagcucacucugaagaccagacgacucuuaaaugagugauucucuugccucagagcugucagaauagccagaaaaacagaauugugacacuauaucuggugugccuuggcuucuagugguaauuuguagcuauuuauuugaucuuccuagguuuguggacuuuauaauuuuacagcuuuagaaaaacuauauuucauaaaaggagcuagaagcucuuucauacaaaggaacauuuuaugaaauuacuuuuuaguaauuuaguaaauguuccuauuacuguguuugagcauuucgggggaauuuuagcauuaauaaauguuaugcacacuuuaaagaaauguauugauuuuuauguguaugaguguuuugucugcauauauguuugugcaccacagaccugcuuagugggugugggguucagaaguggccuuuugauccccugguacuagaguuacagaagguugguugggagcccauuuaggggugcugaaaauccagccuggguucccugcaagaccaguguguguucuuaacuguucagccauagucucuccugccccaacccauuugcaaaaugcuuucaggacuaguagugaauuuguaucuucaguauguuuuauccuguuucacucgcauauauuucuuccuaaagguuauuucucauuuaggguagaucauuuuauaggugauauugcuuaaauaguuacuugaaacugaaaauucaugaaauugaucucauaugaaauuaaucucauucuucuaccagcaauaaguaaauuagacuugauuuuuugcuaugcaaacucuguuuuagguacacauauucaaauuaccacauggaccauaaaaccagucgaaauagcucuucucccaagaacacaucuuuaccuuaaaagggacauaggagcaccugagaaagagaacacagugccucccugucucagagcaaaugaaacaaaaccaagcaguguuuucucaugaaaacaugcucccugcaaauccucauucauuccacaaaaucaaaaauccauguugcuccuccagcagagugggccauuuuauguucaaaaguucucuuagaacucuccagugcaaaguacaguauagauuuaaauauguuaccauuauuuuauuuuauuaagaauuauuuauuuauuuauuucaugcauaugagugcacugucuucagccacaccagaagaaggcaucggaucccauuacagaugguuguaagccaccaugugauuggugggaauuugcuaugcacacuccagugaagucugcuuggcaggccaggaggccuagaaguacucaggaggcaaagaguuucacugaaacucaaccuccuggaaccuuggcguucucauaaccaguauacucauacccuauccccguguuagucugguguauggauccacgugcucucuuuuaguauuauuuuauuauaagugccuuuaaagauugaauucugacauagcuaagccuucgccaguguuccaacaucccagaaaauccuugaagcugagaaacuuggaauucaguaggaauucagugagaagguuaucuauucaguaacauucaaauuuacuucucauagagacagugaaacuaauuaggcauuacaaagaacagagcuagaauagcucaggucuggucugcagaguuauuacuuaggacaguagccagucucacccaaacaagggaauacacaauggccuagcuaauagguggauuuaccaugaaagaguuggggaaucccacugagacaggaaucuucacugcagccaaguauagcaggcuacauugcaaauuagaagcaaguuggugaauucuucugacaaauggagauucuccacagauacuuaaaaaacagccaaguuacacacauacaagaauuuaucagggccuaggaaauagggggguugcgguauugcauuauucaugagaaggugugcuagagcagaacccccuggugcuagcuuucacaaggcucaaaggaguagcacaaauugugacuagggugugaaauccuuaccugucauuagcugacccuaggcaggacuacuuuaucuuuacuguaaauauuaccugguuccuguaaguuccuuugaagucauuccuuuguuuuaugucagguaacugcaauguacuuugccugcugugacuuccuacccccuuuauuuucuguauuauauaagacugguguucacuuugugacaauacauucagauucuacacaaucuccugugugcaucugucugucauucaccgacuccuuguccaucugcaaccagagacccguucuacgcagacaagggacccagagggucugcugcaggaauuuaacucaggaccucuggaagagcagucagugcucuuaacugcugagccaucucuucagcccaacauguaauuuuaaaauucagguaaaaaucaaaauaagagaccuccaaaguacaauuucgucuguauguaaagcauucauauauaaacaguaguauauguucuagaguuuuauuuuuauuuucuuucuuuccuuaauuuuuuuaacacagugucccucuauguaucucagaacugccuaaaacucacuagcccaggcugggcucaaauuuauggucuuccugcuucacccucccaaaugcuaggaugacaggcaugcacauugaagccuggcuugauaaugguauguaugucauuuguguuucauuuuugagacaaggucuugcagaucaggcaggccuuaaaucucugcucauaccacugggugacuggguugacaggcaaguacagacacaguuuccugugucucccuggcuggccacuuccuucuuagguagagauucuguacaguccguagaaugaucuacaguagacauucuuuguuuugaaugagugaguuuguuaaguauauaaccagccaacauaaacuacucgauagaaggagaucaaaauauaaucaaacaugaaccucaaaacaucuagcagggauccagugaaaagcucccuuaaagaugaccagcaaaaguacucaauggagggauugauuccgugucugcguagaccauagugucccuccugugaaguuccuaaguaaaacaacaaauaaaauaacaucaaaaaaagucaagcccucacaucacccagaagaaacugaguagggaaauuucaggcagcuggaaguccugccucaaauuuugcuuccuggcugaagcucagcuucuuuuucccaccccgcugcaggcacuuucccaucccaggauaacuacuaguagcaucugugggaaagaguuugcucuucucagaggcacagugucuucacauuuaggcuggucugcucuucucucucuuccuugucacagacccggaggugccagccccaucuccagacaccaggcuucagaagacauuugacauaaacaagcuuguguaugaacuagagagccauggucccacucucaaggccagugucucagugagcucaaacaacagaacaacuuaccagcaaaagcaaacguaccuccaggcuggccuuaagguugaggcaguucuucugccuuagccuccuacguucuccaaacuggaauuuuuuuuuuuuuuuuagguuuucugagacaggguuucucuguauagcccuggcuguccuggaacucacucuguagaccaggcuggccucgaacucagaaauccaccugccucugccucccgagugcugggauuaaaggcgugcgccaccacgcccagcucaaacuggaauuuuugaguugugguuuuuauuuuaauaguccugagagauuugcuuccuuauaccccguguacagacucuagguaaaaagagaucguuccuuuuacuuucugcaugucacaaaaggcagaccguuugggaggagggcuuaauacguucagcauaauagcagaguccaugcauguuuccucauguaauugugacagucaauuagggcugaguucucuucgaucuaguagauaucauuuccauuuuaaugaagaagccucugcuguuaauguaaaugaauggggaacucuuccauggcuugggcuguaauagaaguaucaguccacagggccacuggaucuucccagguaaggacuucaguuguaguaagugcccagcauaucucccgagguuggagguugguuacccuagaaaaaaaagugucaucuggcugagucugaggguuguuuacacccaaguguguggguaaaacuguuuacuugccuauuugguccagaggauccaggcaggcagucuuggagucguggcacugauuguugcugggguauuauugggauaggcaaagugagagcuagagugguuuaucugcagcaguucucaacaugugggucacaaccccuuugggagauguagaucagauaauuaaauuucaaugcauaacaguagcaaaauuuuacagcuaugaaaauaauuucauggaggggggucaccacaucuguauuaaaagagucuuuucauuaggagguuugagaacaagugagcuaguuagugccucuuauugcuuugguacccacugaaaaguggaagacccaguauauagggccaaugaagauuagaggugaguaacgguguuugcuguugcaggccauguuuauagauuuaaccagaagccuuugauuugauuggucuuccauaagucugcuaaauccagggcacugugauuucuugacuuguuuuagcauuaggcaucacugccaguaagaagggauuauagauguuaggaagcccccgagaaacaacugaguggacucagcucaauucagcauucuccauacuugccaacucaccaugcuguauagcaucuauugaccaaugagcccaucccaauaucccagcugauggcaagguagcagucucuguugucuaucugagagcuguuaggaggccuaacauaguaugugaaaccugcuuagccauaaaaauucacacacacgcacucgugugugugugugucgguguccaaauccuguuacuccuacuuucccuauuguguggaaucguuuaggaaugauaucacuuuccauaucauaugauacagugcacuacuccauuuuuagucucuguuaggugaagcuuacaucccagcagguaccuucuauauagcucauaagccaggaagcucaucagggguuagagcuagguccuuaaggaaagaccuggucuccgugaaagaaagaaaaucuauuuucuccuccacuagagauacggucucacauucuugacuguucacauuugcauguucuguuuaaggggcccaagaaaguugagggcaaauuguucucauccauaccauagugauacuuuacugcccuugcuucugaagggcaucaagagaccuugccacugucauaacaccuucagacucuuggcuuccuaccucccaccuggcaacacuuuaguuaacuaccacacugagcaaagcccagaaugggucuggugauuuagaguaccuguucaguaggguaaaccacuuaauucagaagguugagaggaacagaaacaaaaacuuucuuuuacuuagucacuggcuuagcccaaggaucuggggaaggaugcccuuugacagaugauuucaaaugaugccuucuugccacagcaaaucccaguuagagaacaauaaggugacacuaaucguuuauacaguucucucuccaaacuaugauuaagagagaagccuuggccugacaaagugacuuguuaucuuauuuacaugcuacagcaauccccaggaacaaagaaaugucuucucuacaaauguccagggagucaagaaugaccuacugucagaucagagguucaccgccccgccuuucucuauuugggcccacagggcaggcugacauuuucaugaagcuccaugucucuggcucccaaucaguugcagaagcauugcuucacuaaaaugccaauguugcugccucauuaggcuaaugaggcacaggaggaggccauaacaaauacaaaguugcuaguauggagcgaugcugcacugaccugggagcauaccaaauuuugauucccaaccauaaaacaccgccuaggagaaaucggucaauugauuguucugcuggcugauuaauuuccugauuaacacccaaauucucuccuuuccucagcaccacuugugcugacuuuaagggauuuuagggcugauggaggcaaaagauaggcucuccaagguggcaauagcacacaaggagauuuacuuagaguacacuuugaccgguuuacacgagauggauagcccacauaaucagagaccuuccaggaaaagaaaaagcccaagaugauagggagaucagagaguggaccuauaugucuccuugauggaauuuggcaacagggugagaagucuuugggucaaggaaugcacacagcgguguaauugggggcuuuuauaaugauaaccuuuaacuccucuauggguaacagcuguccggugcaguuuuguggggaaugcaaaucaggcagucgguggcuaaaaucugcuuauuuugaauauauugaaaacaacugaguguguaaaauucgaguuuggugccagccagcuuuugcacuaaugcuuucuagcuugccgugaaaaagaaaacgacauagagucaguaugcagaaguccuuuguaucuuuuauauaccaaugucuauguuguaaauaagugggucugcuccaguacgagugcuuguaguugugugacuauauagguaugcauauucauguauaugagugaauauauaaacauauauuuggcuauuuuuugucucugaguaugcauuacauguuuuguguguuguuaauaugugagcaucugugagucaguuucuaaaucauguguacugauccuaguauguguuuauuuguggauaaauguguaagcuuguucgugugcagauauauuaguaacuaaauguaagcauauaauaugugcaugugugugaauaugugaacguaacuuuguauauucucaugugacuauaaaugucuauuuguauaaacauaacagcagaaggaugucugguugugugcaaguggaagggaauaagcauagaagugaugugaauauguuuaugaugaaugauuaugugaaugacuccuacuguguuaauauacagucaggaucauguuucugagugaaugugcauuguaguuauaaacaaaaucuuguguagaugaaaacuuucauccacaaaguauccucugcauguggauauauucuugauuuggaaagaauuaugguggcaaauauagaugugaaugugugccugugaguaaacaguaaauauuuggguggguacguguccaaauuacugauauauuuguauguuuaaccagcuuaucugugugaaggaguacacaaaaauguaucaguguaagucugauaauaaugugaaugaaaaugcaggcaaguauccuuaagagauugcaugaggauuuucauguucuucuauauuaauauuuaguauguuuauguguuggugaucaguuuugugugagcacaaguauguguggauaaaaguugagcauucauguuuugcuuauguagcguguguuucuaugaauugacuuauaagcauaguuauaugggugauuuaaacuaaaaugaacauucauuugaaaaucaguauggaaugacuucugcaaauuuguguguauguucguucaucucaggcaugccuauauauucuaaguguauuuauauguguugauguauaaacaagcucaaagcugagaguugagucagugguuaaaggaaccuguugccuuugcagaugaccugaguucaauuccuggcauucacaugguuagcccacagucaccucuaauucuaguucuaaugccuccugucuuaccucuacaggcacucuauaaaugugguucacagacauauaguuacaaaaauccauacacauaaaauaaauauaaguaaaguacuuucaaaacuguauacagcucauguguaugagugugacaauaaauaauuuuaagugaaaugaagguaucagauuaaguguacauuugugugaguuaauuugcaaauauguaaguauguuauaccuucaagugcaugugaguaucuugaguuaugugugugaaugaagaaauuggguauuuguaugggcauuuucacauaacuauaauuuuuauguguauguuaaauuaaaauauauugagcaaaauaucugugcauauagaaaauaagcuuauuaguauauguaucuugauauguaguccuauauuuaaacuaaaaugaacauucauuugaaaaucaguauggaaugacuugugcaaauuugugaauauauguguucauauguaagugaaucuaugacuacuucuguguguuguaguuucaaugugagagugugauugaauaucuaggaauggaaucuaagugauucuuccuuuugaaguuguucuuccagccucuguguuauugccuuucagcgauaggacucaaaauaugaccacagauuuuaaaaugcauaaagccauaaagcgaauucacagcgcauguuuauuauuuuuugacaguucaaaguggcuaucacugggucuaaagccaagccauucuuccguguguauuacaucauacugcuguuauggaaauaugcgugacccucaucacucugccugcuggcuucacuguaggcugacugcccagaagcugagcugcagaaacaaauggguuauuucaaguccagugcuucagaaagcaagugcaauuggacaugagugucuaaaugacuccugugaagugaaugcuuccccaugugaggggaaaagccagauuucaguauucagggguauuguaaacaaaugcuugagaagugcuaucuaguuauaagggcuuccuacagcacaguucuugagaauaacuuuugaggccccuugcauggcuguauggaauuguagcuguguuuggcaguuaguaagugagauuaaauugccagcucuguccucccaaucccaaggucagacuucuuaucauagaucauuuugugucauuuaagaagaagaaaaaaaaucuguggucccuuuugguggaacucugggugaccuuaaaguucaaacacagagcccuggcuaagggcucuuggaugaaggagcaaauggaagccgaaaugacaugugcuucuccagaccauguagauguaggccauaaaaauauuuccuuaacaagaguggacaccuucugugcuagcaaauaacucaaguauucccacaucucuaaugggauaauugaauggaaaccuccagauaaauuaccuaaauguuucuuuggaaggauggcuucagccuaauagugcaguccuccccaaggaacuuaagagggcaauacaagaacaauuucuucccagugcugaaaggguaggugcacgaagcaucccucacucuacaacauuguagugucucugccauaccaagaacuaaaaaugaagccucggggagcugcuuuucagagcucugugacaauccaguuugauuucuuaucugcuccugucccuccacccauugcuccagccccucuucucaagaaaacaauaaaccuccuacuugaaaaugacaaggacagagucaccuaggcauuugccuguggacucugagcaaagugaaagaauucuggguaggaauucaauauaggaaccuggaggcaggagcugaugcagaagccacggagaaaugcugcucacuggcuuguuccccacagcuugcucagccugcuuucuuauagcacccaggaccaccagcccgggaguggcaccagccacagugaacugagucgucccacaucaaucaagacaggacaccacaggcugauguggugggaacauuuuucucaauugaggugcucuauuacaaaacgacucaagcuccugucaaguagacaaaaacuagccaggacacuuaauccauuuucauauuucaacuugacauacaaaugcauuucuaauuagcuuugaacuuuccuuccuugaucaccccuaaagucucuuaguaguaguaauaauaucacaauaagaagcauugcaacuuuuaaaagggcuccagucuuuacacauuugagcggguuagaaguucaaucucuuuaaagcauccaaagucucuuucaaaguuugccucucuaaaauagucaaaguaucuuuaaaaacaauacccaucgucucuccaaaauuccaaagugucuuuuauugugcucucuuauaaaaucaaaauaaaaguaaauacucuguuauuccaaguggaaaugaaaugaaaugaagacaugacugucccuggguaugguugaagaggugguuuuuguuaucaauaugaguuaagaauaccaccagaggcaucuggaagaguccagagcauggagaggggaguagacuguaucaggucaggagaggggagagcaagagaggaagauuaauaaggagggggagggaacaaaaagggaggaaggagcaaaggggaaagccaagggaaccaagagauauuuuuguguggcaaaaguggcagucagaagcucaggaaagggaaccaaagcccaugggcuggagaggguuaggucagugugaacggaacuucggggagucauggguacugagcaagccuuguaugcuaauagguaccauaguuagccaucuguccccagguucuuuaggaucugacagaaauaaccaaggcacgaugauuguuauuggggaguccgccagaguuggccacucagacacuguuugcagucaauuuaaauucuuuauuccagcugguugggacuacacucagauacucagaaccuaaguuauaagccugaaugucuagagcauggggauuuuaaaggcaaaaaccacauccuggcaucuggcucgggagcugcaagggguuuuacagaagcaaacagugcaacagaagcuaagauaagcaguuagccagaggagguaccacccaggcaggcaguuuaacaagcuaaaauauacaauucucuugagaggaugguuugcacaaacaggcaaguuaacagaagcuaaguuaaucaugguaucuugaccuccgguuccuagaauagaauuggguaauuuuccauuggauuuucuguuaaaccugaaauggcuucaguaggaauauaagauggagaaacgacuguauugucuugcccugucacaucauaaagcaaaacuaaagcccaacaguauuaaaaacaacucaaugucagacacccaggauucacuuaugaauuuucuggacuccaaacggcuuacccccuuacgcucauugucucccaggcucagguuagcuccacuccacagcugcugcuguucuuguuggugaucucuugguacuggcauaaugugcuauucuguuugagaaaauaaaagcagcuaauaacaccugcaacugggucacaccuucauuacuaacuucuccuggacucucuuuggggacugugaacuugcugcuugaugccacgcccugucuccccucuccccccuucucucccucucucuccuucaauucugaaaucgaacuuuggcugccaccaugagauacagccuaaccacccuacacacccuccauacauaaguuucuaugugcugacacucuggaaauccuucaagacuauugcagcccccaaugaugcuggucucuuucaccacugcuaauucuucagcucuagcuaaccagcauugauugacucuguauagccaggguuucacuuuaauggaucuggucucucauugaccacagcaaauucuuaagcccuguuugauccgaaacacagauucuuaaugcucaaaacaucagacauagcugauaguauuuaaggaacucuuacacuucccucugaaacuucacagaccuugccuccaucaucuguacuacucccagcaucuucuaaguucccaccaaauagcagcucauuaaacauugagcagucagagguuuuucuagggucgaaagaaugugugcccaagugccuguccuauagugcauaacaaguagagaagaaaacucuggcuugagaauguacccuacguaucuagaucugcauguuauguuccuuuuacacacaaacuuuuggcuugguaccuucacaaggagcagagaaaggacuaaaaaccuguacauaugaaagcggagggaugggugaagcaaaaagccuaaagacuggaugucucuggguugcuccacucacucugcaggugcggaggcaccuggggaguguggccggucagguuauugagugaaauauuuuacauuguuagcucaauggccucaaaaggcucuggcuaauagaagaguugaaaucugcucucagauggaaaccacauccugucagcaccugucuagaccccgugaaccacagccucauuugcagccuugauuuuacuugaacgugggagcugccaaucaucaggaaaugcccuaugcucagaacauagcaaugucucaagcagcagacagcaucucaggcaucaacuuccaggggccuccugcagacauguagcccagcccagucugucagaagcacauacacccuucuuaccucucccacugcugaagcaaguagaagcagcagcaaucgggcagaauggauguucccacacauguuuuuuuuuucccccagaggcuggaaaacagugauucggugcaugcauguuaccagacaggauacgguguuaaaggauacacauucuaaaaaguaaacagggaggaagcagccaggugggagccucagagaaacgcacugauucaacucccuaaagagcauaacaugaagucaaaaggagcaaauucuccagaguggugggcucuuccuuccagggguacccgauucauuuaagaaaagcagccuacucacagugaccuucugagcugagccacacuguuuauguucucugcucaaagccacaucgccuuaucuugaugguaugaagugccaauuccaccuaagccuuguucuugcacaucuguucccagggcugaauauguggcacaaggugcagaaagagcaucuuacucacauugcagaaauggaugauguuuauucaguaaaagcgaucucagauucuuaagggggcagggcugucuucgcaaagaccuguuuucagugaauuagcauuuuacuaaucaaugguuucuagucuggaaaugucgaagauaaugucauaugugcauacucagugauagugcgagggagcuggcuuuuucccgaguucccugauuuaugcacuccaaauauccaagauuauuaugaguaccguuuucuuccaaagagcagcuugugagaucacuaagagccugcacugugugaaaaucugcuguacccuuguccaucuaccuauuuuguuauugguucauguucacuuugggugagccuuauacgaacauguucuucauuauuuuuaacauaaaauuuuauuuuuaauaauuccaaagugaggaggcugggaagauggcucaguggguaaaaggacuuacaguacgaaugugaagaccugaguuugauccccgucaugcaugcaaaauccaggcaugguuauauaugccuguaaucccaguguugggaccuugaagccaagugaaucugagagauugcuggccagcuagcuuggccaaauccauaaaccaaagguucagugagagacugucugucaagaaauagaacagaggaugguaaggcaggacaccuaacauucuccucuggcuuccacacacaggugggaacaagccggcgcgcggacacacacacacacacacacacacacacacacaaacauguaagcaucacacacacacaaauauucuaaagugaguacuugaaggccuugguucaguauccucuugcuauuauaaaauacuugcccugaccguggggaaacucccucgcagauaccaugacuggauggcucuucccagcuuuucauaaaauggaggacucccuuuugcagcagagagucccuugucuggggagccuaaccccacacagccucucc

SEQ ID NO: 9759 - RNA, 20455 nt, Mus musculus
ugucuaaucucucuuucagccccagccugccuuccagaaauaccugguucauguaggcugugugggcuggccuccuacuacagauuggcgccugaaccaggggccugaaaacggcaggaagacacugagugaacgcugucuucuguggagcuccaugagaagggaagaaucagaagaucauaucgggcacagugagcaacagguauuuaugccagcgcuggauuuaaacuucauuuuuaaaaguguugcuggaggauacaggcuaaguuggaacagugcugacccggugcugauuccacuuaggguuugacagcaaaauauggaacuagggccaagaagugggaguggguggguaggagagugggggguaugggagacuuuugggauagcauuggaaauguaaaugaagaaaaugccuaauaauaauaauaauaauaauaauaauaauaauaauaaaaagaaacucccaagcaggcguuugucugcaguuuucaagagcugcuucaggcaagaggagugggguuugaaaaacaauuguuagaaaauuuuuuagauaagauagauucuuguugcccaugguucagggaagaaaaaacuuuaaauaacagaaccugggagagaguuggagaagcuuugaaaaacacccaggcagauaauuucacccuuugccucugggcgcucguaaaagaugcuauugaaaaagagaucucaaaggggucagauaguacccaggcagaucuugaagaaucucaggaagagcaccugucagagaggacuuucucagaaagggacccucucaacccuaaauuagaaagauauagagacucugaugaugagcuaacuuuagacaaggaagaucauucagaaagaggagccgccaaauauuuugaugaggauuggccucauggccuccacuauaggagaugcuacugaaauggacaugcaacuaaguaaauuagaguuugaaauuaaguugcagaaauugacuaaugagcuuccagagcuaaaaagggugucagauacagggaagagcaacucuucugaaauguaccaagcgccacuagaaagagcuaugagccaggcuugugagaggagacaggauacgucugaugugcuagucuuuccuguaguugagauaauugaccagcaaaauaauagaaucagauaauaccagacuuuggauuucaaggugauaaaggaguuaaaaacagcuguugcacaauauggcccuauagcucccuuuacacaagcauuauuggauacugucauggagucacacuuagccccccaaauuggaagacucuauguaaggcuacucuauuaggaggaguuucuuucuuugggauucugaacggugagaaaccaguaagaaaacugccgcuuuaaaugcucagacagguaauccugacugagaugccaaaagcaugggagaaggucgauaugaagacaaugcuaaucagauugguuuuccuguuggaguguaugcucagguugccauggcugcccgcagcgcuuggaaacaguugccagcuaaaggggaucuugguggaaauuuagccagcauugggcaggguccugaugagcuuuaccagaucuuuguggauaggcagcuaguaggauucuuggagauucugacccgggaaguccuuucauuaugcaacuggcuuaugagaaugcuaacgcaaaugugucgcaccauuauccaaccacacaaaggacagauggaacuagcgggauaugucccucuuugugcagagauugggcugucagguaaucaggguuuggcuuuugcugccaccauacaagcaaugcuuucacagaaacgagggaauaaugcauguuuuaaguguggaaguuuaggucauuuuaaaagugauuguccaaagaauaaaggugcuaagaguaggcaagccagccaagggcaacgauuggacuaggguguguaaauccaagucagacauuagggccguccguugccaggaaacgagaggaggggccagccccaggccccaaaauacccauggcaggcagcuuauggagccaugaagcuguugcccagccaaagaaaucccuuuuugaacuuaucaggggaaccccaggaagugcaggauuggaccucuuuuccaccacccacgcaauauuaaccccagaaaugggaguucagacucuaccuacaggaguuuuuguaccucuaccugcagaaacuuguggauuuuuuuuuuaggaugaagcgguucuauuguaaaaguucugcagauuuauccagguguuauagauaauaacuaugagggagaaauuaaaaucauggcugcuuccccucaugguguuauaacuguaccugcccaccagagaauugcucaacuugucuuaacuccuuuguauccgcuaccguccagauuuguuaagaaugagagaggacaagguggcuuugauuccucuggugugcauuggguucaaucuauuacuaaucagagaccuaaccuuaaauugacaauugaaggaaaaagcuuugaaggauuaauagauacuggagcugauguaacaauuacuagaagacaagauuguccuucagcuuggccuuugucugauacgcuuacucaccuucaaggaauugguuaugccaauaacucaaaacgaagcuccaaauugcuaaccuagagggaugaggaaggcaaaucaggacaaauucagccauauguuaugucaaauuugccuguuaaccuauggggaagagaucucuugucacagaugggcauuauaaaaugcaguccuaaugagguggugaccaagcagaugcucagacaagaauuuuugccuggucaugggcuaggaaagaaaggacgagguauuaagacuuuugaagguccuaaaccucacucuaacacaagagguuugggguauuuucaguaauggccacuaucuugccugcaucccaugcggauaaaauucaauggcuuaaugauauuccaguguggguugaucaguggucuuuaccuaaagagaaaauaggagccaccucuucacuaguacaggagcaauuagaggcaggacauuuaguagaaucucagucuccuuggaauacuccaguuuuuguuaucaagaaaaaaaucugguaaauggagauuguuacaaaucuaagaaugguuaaugugaccaugaaaucuaugggaacuuuacaacccgggcuugcgucuccaguagccauuccuaaaggauauuauaaaauugugguauauuugaaggauuguuucuuuacuauuccuuugcauccugaugauugugaaagauuugcuuuuaguguuccuucuauuaauuuuaaggaaccuaugaagagauaucaagggagaguucucccacagggcaugacuaauaguccuaccuuaugucaaaaguuuguggcacaagccauucggccugugagacaacaauggccuaugauuuacaucauccauuacacagaugaugucuugauggcgguaaaagacccccaggauuugcuuuuauguuauagagauuuacaacaggcauuagcuaauaaaggacuacaaauagcuccugagaagauacaaacucagaauucuuauaauuauuuggguuuuagacuuacuaaucaagcuguuuucccccagaaaauaguuauuugcagggacaacuuaaaaacuuuaaauuauuuucaaaaauuauuaggugauguuaauugccuucgccccuauuuaaagcuuacuacaggggaauugaaaccuuuauuugauauucuuaaagggaguucugauccuaccuucccuagaucuuuaaccucagaaggacuguuguggcaaaaggcucuucuaauguggauacauuugaggauuucuccuaagcguaauauccugccauauuaugaagcaguagcucagaugaucauacuuggaaggaaacaggcacuaacuuauuuuggcaaagagccagauaucauuguucagccuuauagcguagaccaagauacuuggcugaagaagcacaguacggauugguugcuugcucaaauaggauuuauaggaacuauagauaaucauuauccucaagauagguugauaaaauuuuuagauguacaugaggugauauuuccuaaaaugacuucuuuacagccuuuauauaaugcucuauugauuuuuacugacagcuccucuaaggcaaacuggauaucuuaugaauaaucaacaaguagucauagagacuccuggccucucuccuggccucucagcucaguuagcagaacugacaguaguacugaaugacuuucagucuauaaaugaugcuuuuaauauuuuuaaugauaguuuauauguugcacaaucaauucccuuauuggagacuugugguacuuuuaacuuuaauaugacaguaggaucucuguuuucacaauugcaaaacaucauucuugccagaaaacauccguuuuauauuggucauauaugagcucauucaggucuuccugcgccuuuagcuacaggcaaugauuacaucaacagggcucugauaggagaggccuuaauuucagauccuguugcuuugucuagaugugaucaugauaaauuucaucucucuagccauaccuuaaggcuccaacacaagaucacuaaagaacaggcaagaaugauuguaaaacaauguucuaaauguauuacauuaucuccagugccacauuuaggaguuaauccacgaggucuuaugccuaaucauauuuggcaaauggauguaacucauguggaauuuggaaaauuaaaauauauacauguuucuauugacccuuguucaggauuucuuuuugcuucuccacauaccggagaggccucuagaaauguaauugaucauuguuuacaagccuuuaaugccaugggaaugccuaaacucauuaagacagauaaugggccauccuauacuggcaacaauuuuacuucauuuuguaaggaauuugguaucaaacauaaaaugggaauucuuauaaccacaugggacaaggaauuguugaacgugcucaucgcacccugaaaaaauuggcuuuuaaaaugaaacaggggcaguuauacccuccaaagacaccaaaagcacaucuugcuuuugucuuguuuguuuuaaauuuuuugcaaacugauauuaaaggucagucugcagcugaucgccaauggcauccaguuacuuccaguucuuaugccaugguuaaaugacggaacccauuaacuaauauguggaaugguccagaccccguuuuaaucugaggaagagguucugucuguauuuuuucacaaaaagaagacggagcacgauggcugccugaaagacugguucgucaaguggacacagauccugaaucuucuaggaaguaugauucuaaccacugauggcuaaaaauccuuuuuagccgaaaaaguuaauuuggagcacagccuccacuuucagagaauuuucagcuuuucuguuaauucucaaaguuaccucccccacacugagaggucagagucugagcuuccccacacugagaggucagagucugagcuugaucguugcuaauuugcaacugaauaaaguaccuggacuuccccaaagaagcuuuuauccuguuacuuuucaacuaucucaagcaggucagucucuccuuacagccugauuucagcaagcgugcagccucaccuccagcaagcacagguggcagaaauuaaucaauaugaagaagcauauuaaguauauauuguggcuuuggucugauuugggaauaaggugugcuaugagggccgaucagucaaugacaugcaaccagauuucggagccauaucaaucuaagacagagguacaugccaagaggccaugguuuguuaauaauacaccacagagccauguuuguguaaaauaaacacaaagaagcugcauguaugcuucuugauagauaagaauggcucgggagaaucugaguccccaagccaggcccggcugccagcuaccauaacucccaggcaggaugauggagcauaaauaaauuuuauguucucgguccagcuaauuuuauuauauaaucaggggggaaacuguagccucccccagccuugaagcaggcugauucagacuuugcagccacugaauaugagaccaccugggguguagccuuccaacuuagauggcuauauuguuaugucaacuacugcugcucuucucugagacucugcuaccuacugagagaaccuugagacauuccagagucauauccuauccugccuacaggcuggcuccaggcaccaagaauggacuggugggguggaugggccuucccccuuauaagcacagucuuaguaaacucgagggccuugaucagagaaaaauuugucuuggcuucauucuuuucucgcugucuagucucucuuucagccccagccugucuuccagaaauaaccgguuccuguaggccacgggccagccuccuacaacauuguaaugacacagcaaacuuaaacaggcccauuacaagugaugagauaaaagcuauuauuaaaaaccuuccaucaaagaaaauccuaggaccagauagauuccuugcuauagucuauuaauuuugaaggaguacaugauagcaauucuucuucuguucugagucuuuaggaauauuugagacauaucucaaaauaauuaaggaaauauagaaaaacuauauccaacauuguauuaaauggagauuaagagaacaauuaccuuuaacaucaaaaaugucuauucaucccucuuguauauuauauagugcacaaaguuuuaccuauuauaucaauuacaaaauuaaaaaaacauaaagggacuaacaaccaaaagggaagaagucaaacuaccuuuauuugcagaugacaugaucuuucccuuaagauaaccuauuaaauuugcuagaaagcuuuuguaccuaauauuuaccguaaaguugaaggauacuagacacauccaguugucuucauuuauacuaugucuaacucuccaagaaagaaguuaggaaaaauauuccauucagaauaacuugcccuaaauuaaguauuuaaguauauaucuaaccauagaagugaaagacauccacuacaaucaaaauuuuaagauagugaaaaggggaaccacaagaugauagaaaaucuuacaugugccugaauagacauaauuaagauugcaaaaaugccuagacuaccaaaauuuauuuacaaaguuauugaaauuacuaucaaaaugcauauacuauauacacagguaugaaaagauaacaaauaaacaagaaaucacauggcaccacaaaagaugaugaauagccaaugcaaucuuaaugaguaaggacaaucaauacuggagguauuauaauuccagauaaagacaggcuaauauugacauaaaaauaaccauguagaccaauggaauuaaauagugcacucagaacuaaagcaacaaagcucugcccacuuaauuuuuggcaaaggagggaaaaaauaaacacuggggaaaacauauggacuauuuaaaaaguggugcgggcaaaaccagaguuccacuugcagaagaaucagauuagagucauagcuuucaguuuggucaaacccaauucaaaauggauccaagaccuuauuuuaaagaauaaaauacugaaacauuuagaagauacaucguggauauacuucaaagauauugagccaggcaauaacuuuaaaaauagaacacugaagaacuaacccuaagaaucaaaguauaggacuacaugaaaauaaaguuucuguacaacaaagguacaguagcacuuacagagaguccacaaauagaagaaaaccuuuaccagcuccaccucagacaauagacacaauccagacucuacaaagaauugcagaaauuaaaugccaagggaauaaaugugacaaucagccaauggacaagugagcuaaguggauauuuuuuaaaauagcaauggaaauagccaguaacuauuuuuaaaguguucaauaucccuauacauuagggaaguacaaauuaaaauuacuuucagguacuguaccuuaccacagucugaauaaguagcauaaaaacaaaaaaaaacauaucuaaacaaacaaaaguaucuaaaaucaaauguuggagaggaugugaauugaagggaaccccuuuucacuguugguaggaaaaacaaauuaauacagccauuguggaaucuguuuggagaguccucaacauuuuagaguagaacugccuaugacccagcucuuucucuccuggguauauccauagauaauuccuuuucucaccauugagauauuugcauccccagguuuauugcugcuuuauucacuauagcagagaacuagaaucaaucaaguuguccaccaacagaugaauggauaauuaaaauuauauauaagauucuaaagaaaaaugaaguuaaaauuuuucaggaaaauggugaacuuaaaauguauaauauuaagagaugucaagcagucucagaaagggauuaaaugucauguuuuauuuuauaugcagaaucuaggcaauaauauauacauccauguauacaaaagaacaugugcauacagcauaacaugaaugaaagagaauaugaaagguuagauauaagggggugaggaaagauugaauagaggucauggauacaaaaaaaugaagcuaauuguuuuucuagcucuauuucugucaugacuuuugggggauuuggugauagauaagugcagaaacuacauccaacccugaaaagaagaauacaauuccacacaaagcuccgcaucugcuccaaaugcugauucuaacuggguugaaguucauuaaauuuugcagacuuugguguacaguguuuuuuauuuauuugcaaggauauauuaauaauaaagcuuaaaaaugaaaaauauuuaaagaugucacagugcuagacuuagcaagaagagguuuuaaagcagccugguucauaauguaauggcuggaaauaacaggaauaaucccugauuuugcuaggcuaugccagugaggcccacagaauuaccuguuucugcuucacagagcugagauuaaaagugugugucacuuuuaauaugucuguauuuuacuuaucccaggaagucugcugggagagcacacucaaaccaugccucuuuaucagucuagcuaaagguuuguagcuauuuuuauuuauuuuuauuaauucuauuuuuaguuuuauaugcaauuuuauauaaaauuccuccuagaaaugacugcauaaacaagacuggcacauuggcgauaucaauagacaugccaacacgaaagggagggggaaucuuauggggucccagcccaaggaaaagaacuaaaaaacaacugacuaaugacuacaaagaaagggagaauuagucuuucccaggaaugagccuucuaauugguuguccaauaaaaaguguuuaacugugaaaucauguacacacaaacaaacucaacagguuguauuuagauaugagugcaucauguacauacauauguacauauauacauguauauauucauauauacagauauauauuauauauauucauauauacacacuucauauguauguauauaugcauaauaauaacaaaaaagaaguuaucuauuugagaaugagggagggacacaaaaaaaguuggagggagacaugguaggggcuagagucaucaaagcauuagggaagugauauaauuauauuuuauauaaaauauuuacauaaaauugcauauaaaacuaaaaauagaauacauaaaaauaaauaaaaauaccuacauaccuuuagcuagacugauaaagaggcaugguuugaccgugcucucccaauuucauguacugugauuuuuaucuucaaugcaggaggacugggaggugaaacuuaugaugugcucauuaggucauaaauacucugacuuuuauggaugggccaauaucucuaugaugggagcuggguacuuguaagagugauuguuugcccauccugaggcacuggcucuagucagcagcaccaaaaccauuaauugauuaaaccaaaaaauguaaaggaauauauuacaauacuuugacugacugacugcaugccaauaaauauauaacaugugaaauauacaccacgauaguggccagacagaagguaccagaucaacuaaaagagacauggaaaaucuaaacugcacuauaacaaaucuucucagaaagagcaacccagagggccuggcugcuuaucucuguagagauaaaacaaaaccucccuagccgguugugguggcgcacgccuuuauucccagcacucgggaggcagaggcaggcagauuucugaguuugaggccagccuggucuacagagugaguuccaagacagccagagauacacagagaaacccugucuccaaaaacaaaacaaaacaaaaaaaccucccaaaagugguaacaagaaauguuucccaacacacacuccauuauacugauagaaacacagacaaaaaguaugacaggaaaagaaaugcagaugaaaaucuacuauaaacggaaacacuuuuagagcaaaacauuaccaaaaguaaucugagacacuaacagaugauuauacacuacccagaaaaguagaaugucaggccuggagagacagauccauaguuaaugaccuguacugcucuagcagaggacccgacuucauuuuccaggacuaaugucaggucacuuacgagccuccguagcugcagcuccaagggauuccccuucugaacuccugacacccucaggcaugugcgcauacccagacacaaggcaggcucgaucacaacuuaauaaaucuuuucuaaaagguguaauuugggcaaaagagauggauccgugggcaaggugcuaccuuuauaagcacgacaaccuaagauuuauccagagaggccccaugaaacagcaaagugugcuucugugcacccuucguugcugcacugggcaauucagaccagugagagacugucucaaauaacaagguauauggcuccugaggaaugccaucagauguagaucucucgucuccaaaagcaugcccguuuacacacacacaucuacacacacucacaaacauguagaaaacccugugaauuaaggucacugucuaccauguccagauaaguccucugagcuugguacaaaaucaaugacucucuuuaccaucagggcuuccccuucucugaccuuaucuaaggagccaggccauccacacccucuaccuggggaaggucauguagaccuuggcaaaccuagaaguucaauuuccucuuucccacuaagaaccugcccagcaaguaccugggauuacuggaaugccucgccauacaagugagacauuaacaguacuuuaaacuccagccaaugauuccauucacccugaaaacuccuuuccacuccucgaguuucauauaaugcucuugaccaccccgaauaagguauacgcauacaagcccauuccaaauaaagguaugcacacaagcuaagauccucugagaguuccauuaaaaucauuggagaaggccuuacccccacacucacucccacccuaccucccccuaccccaucacucccaccucaucccuccacccccacugcucaccccuucacccccacccccaucucauaccccucaccccaccggacccccggucugaauucauuuccaacugaaccagaauacugcagaccccaccuguuccauacucuccuucauccuuccagucugcugugcauucaaugccuggacacccugaggaaggaaacagaagauaaggaaccauagcuggaucccaacaccaugcauaacacacacacacacacucacacacacacacucaagcaugaacacauacaggcauucaagcaugcacccagucacccaugcaggcaugcaggcagguacacugacaauaagugguuuuuauccuaggaauguaacauuagugaucaugggaaaaaucuguccauauaaauucgugacaaagcucauagacucacaaucuguagggcuauacauaacaccacgaaagugugcuuugggccuggaccauuuccuugucuagugauacagaguucucauaauguguuuuagguuuaugcucucaucuuaucccacuguuaucuuuguauguaucauuuucuucagaguaagaguaugucucaagugcucgaaaacauguauuugguccuuagcguuucugacauuacaguucaggauccuuuucugguagaauuugguacaugcaggcuuucugacugaggucugcgucaaacacaucugugauccuggcaaaauuagcaugucacaaggagcuggaucuuuugaacaugcucacacuacuuuugauguauauaaaaacugaacuguuagauaaauauggauguugcuacucucagaaaccacagucugauccaugcaccccuuuuuauuuuaucuuauuuuuuuuccugguuguuuauccuggagcacagccugaccaacaaauggccaauaaaauacaagguaugauagucaugaauagagaaaaucuucaauaaugaaggauaaugagguggcuuagucaauauuauucuucccuugcaagcaugacauuugaaguucaauuccuaaaaucgaccuuuaaaaaguuaggcaugaugggccaugcuuguacuaccacugaaggguaaucagagacucacugggguucauggaccacagacccuauccaauuuuacacguuccaggccaguaagagacccugggugggaggaaagguaaauguccccuguggaaugaugcuuaaaguucuguaaggcugacuuccauauacagguacguguacacacacacacacacacacacagaggcaugugcacacaugugcacagguacacacaugcaugcaauaccuccauauguauuaucuguucaccauuaauacacacagaaaaaucacauaauuaucucaaaaaaucaaaauaauacagaucaaaccacguuuuuaaaaugaaccuaugcaacagacuaaauauugaagagcaguagucuaagaugacagacuauccauaauauuugaauacuauucacagucaugcuauagaccaccugcagggccaggccauuuguaguggauacaccugcacaugguuuugcucuuuggaccuguauaggccugacuuacuuucgggcugaagccuacaucuuacucaucagguagguacgugggaccccagagucuugccagauccagugguuacagacacuuagugcucaauacagcacugucagguuucugacccugggcucuaggucaaugccagaggucaguuuacagagacucaugcuucaggcucaccccuaaugccagguuuguuucuguggcuucagacacaaacucguauaaauuaauuggcaguggguaaaagaugcaaggaacauaaaauuuaauaaucuauugauuaugaagaauaaaaaaaaauacaacauauucccauuuguggcagucagaaggaaacuaauaacucuuaaguaaccaaacuucaaaagugaaaaacuuaauaacgguccugcauacaaaagauaugauauuuggagcaacguguaaauauacucuuccucugcuuugacaaauucuauuuuuaaaauuuaccccacuugugauaacauaauaaaugcauuuauacauuuaaaaagucaacaagucuagccuuggaaagugugcaugcuuguaauuccaacaguugggaggggggaggaggaggagaacagcugagcuuaaaauaugcaaaggaaaacucagaaugcuauuagcauaauggagauaaauaaaagagacaacaauuuaagugcaaacucagaugugggucccuccaaguaucaaaucuccucagagauugucugguaagcaacauuccaggauuacccuggcauccggcucucuucucugcacuuuuuccccugaaagauaugccaagcaacuccaaguacuguuuuccuggcuuucacuuuacauuauuguugcuguuguuguuauuauuaauuucuuuuccugagacagguuuaucuguguagccucaggaguccuggaacucccucuauagaccagguugcccuagugcucagagauucacaugccucugccuccugcgcuccgggauuaaaggacuacaccaccaccacucuuuuaucuuagguuugaaaugaaguacauuaaguguuuuccauucauccuuugaccauauuggucuuccucccugacuuuacacccccgaggccccauuuaccuucuucuaugcccucccuauuucuucacuugcccacuucuguuuucaugucauacagauucucacuuuccccuguuuaagauuuugacacccacaugggaguuggggauagggcaugccuuuaaucccaacacuugggaguaagaggcaagcagauaugugugaguucaagacacacauguucuaccgacuucaguuucagaagagucaacgcuguucuaagaaacccuguuccaaaaaaaacaaagcgacauaaaaaaaaaaaaaaaaagauuuugucagccgggcagugguggcgcacgccuuuaaaucccagcacucgggaggcagaggcaggcggauuucugaguucgaggccagccugaucuacagagugaguuccaggacaaccagagcuacacagagaaagccugucucgaaaaaccaaaaaaaaaaaaaaaaaaaaaaagucaaccaugucauguuucccuuucugguuucaggauucuccuaaaaagacacacacacacacacacacacacacacacacacacacacacacacacacacaaacacacacaaucuagaccauguaaaacauguacauauguaccauacuaaacauaguacgucauuaauaauguacaguaaaaacaaacucucaaauucaaggcuauuugugucccggaagaaaaauaguccauaauuauacauuugacuuuggcuuuuuuaguguucuuauuugaaacuggagcccuuaaauagagcucccuucaaccaaaguuaaaacauagcaugcgcgcgcacacacugcaaugguggcaagccuuucugucacaguccccuggagacuacuucuguacagacuuuugccaccccucucgcgccuccugcaauccccugaccuguggguuucuccugcuuuguccacuauuacgguucuauccuauguggcuugugugccgaaacugauggaggugaaggaugaaacuggaccacaaaucacuugcagcagcccugguuccucuggaguagcagacuagcguauuagucuucaugauuuuugcagaaugguggccacgaacaguuuuuuuguuuguuugguuuuguuuguuugguuuuguuuguuuguuuguuuguuuguuuguuuuucgagacaggguuucucuguauaucccuggcuguccuggaacucacucuguagaccaggcuggccucgaacucagaaauccaccugccucugccucccgagugcugggauuaagugcgccaccacgccuggcucccacgaacaguuuuaguacuguuaauccuuacgaauggccauucucucucgggugugaaguuuggagaucgcuuauaacauauugcuauguuucucauguuaaaagccuguguacgguuuguuacaaguugucccuaagaaacuaugcaaaacacgccgaucucuguaccaaauaaucggcuaugcuguaacacuguacacuguaagacaguuccguuaccacaggagaaugaaaagaacccgggacucccaaagacgcuagaugugugaagauccugaucacucauugggugucugaguucugcgauauucaucccucagccaaugagcuuacuguucucgugggggguuugugagccuuggguaggaaguuuugcaaguuccgccuacagcucuagcuugugaauuuguacccuuucacguaaaaaaguaguccagaguuuacuacacccucccuccccccucccaccucgugcugugcugaguuuagaagucuuccuuauagaagucuuccguauagaacucuuccggaggaaggagggaggacccccccccuuugcucucccagcaugcauugugucaacgccauugcacugagcuggucgaagaaguaagccgcuagcuugcgacucuacucuuaucuuaacuuagcucggcuuccugcugguacccuuugugccaugucugauaacaagaagccagacaaagcccacaguggcucagguggugacggugaugggaauaggugcaauuuauugcaccgguacucccuggaagaaauucugccuuaucuaggguggcuggucuucgcuguugucacaacaaguuuucuggcgcuccagauguucauagacgcccuuuaugaggagcaguaugaaagggauguggccuggauagccaggcaaagcaagcgcauguccucugucgaugaggaugaagacgaugaggaugaugaggaugacuacuacgacgacgaggacgacgacgacgaugccuucuaugaugaugaggaugaugaggaagaagaauuggagaaccugauggaugaugaaucagaagaugaggccgaagaagagaugagcguggaaaugggugccggagcugaggaaaugggugcuggcgcuaacugugccugugaguaacccguggucuuuacucuagauucagguggggugcauucuuuacucuugcccacaucuguaguaaagaccacauuuugguugggggucauugcuggagccauuccuggcucuccuguccacgccuauccccgcuccucccaucccccaguccuugcuccgcucucuucccuuuucccaccuugccucuggagcuucaguccauccugcucugcucccuuuccccuuugcucuccuugcuccccucccccucggcucaacuuuucgugccuucugcucucugauccccacccucuucaggcuuccccauuugcuccucucccgaaacccuccccuuccuguuccccuuuucgcgccuuuucuuuccugcuccccucccccucccuauuuaccuuucaccagcuuugcucucccugcuccccucccccuuuugcaccuuuucuuuuccugcuccccucccccuccccucccuguuuacccuucaccgcuuuuccucuaccugcuucccucccccuugcugcucccucccuauuugcauuuucgggugcuccccccucccccucccucccuauuugcauuuucgggugcuccucccucccccuccccaggccuuuuuuuuuuugguuuuucgagacaggguuucucuuuguaucccuggcuguccuggcacucacucuguagaccaggcuggccucaaacucagaaaucugccugccucugccucccaaaugcugggauuaaaggcuugcaccaggacugccccagugcaggccuuucuuuuuucuccucucuggucucccuaaucccuuuucugcauguuaacuccccuuuuggcaccuuuccuuuacaggacccccucccccucccuguuucccuuccagcacccuuccuagcccugcucuguucccucucccugcuccccucccccucuuugcucgacuuuuagcagccuuaccucucccugcuuucugccccguuccccuuuuuugugccuuuccuccuggcuccccuccaccuuccagcucaccuuuuuguuuguuugguuguuugguuugcuuuuuuuuuuuuuuuuuuuuuuuugcaccuuguuuuccaagaucccccucccccuccggcuuccccucugugugccuuuccuguucccucccccucgcuggcucccccucccuuucugccuuuccugucccugcucccuucucugcuaaccuuuuaaugccuuucuuuucuagacuccccccuccaggcuugcuguuugcuucugugcacuuuuccugacccugcuccccuuccccucccagcuccccccucuuuucccaccucccuuucuccagccugucaccccuccuucucuccucucuguuucucccacuuccugcuuccuuuaccccuucccucucccuacucuccucccugccugcuggacuuccucuccagccgcccaguucccugcaguccuggagucuuuccugccucucuguccaucacuucccccuaguuucacuucccuuucacucuccccuaugugucucucuuccuaucuaucccuuccuuucuguccccucuccucuguccaucaccucucuccucccuucccuuuccucucucuuccauuuucuuccaccugcuucuuuacccugccucucccauugcccucuuaccuuuaugcccauuccauguccccucucaauucccugucccauugugcucccucacaucuuccauuucccucuuucucccuuagccucuucuuccucuucucuuguaucucccuucccuuugcuucucccuccuccuuuccccuuccccuaugcccucuacucuacuugaucuucucuccucuccacauacccuuuuuccuuuccacccugcccuuuguccccagacccuacaguauccugugcacaggaagugggaggugccaucaacaacaaggaggcaagaaacagagcaaaaucccaaaaucagcaggaaaggcuggaugaaaauaaggccagguucugaggacagcuggaaucuagccaaguggcuccuauaacccuaaguaccaagggagaaagugauggugaaguucuugauccuugcugcuucuuuuacauauguuggcacaucuuucucaaaugcaggccaugcuccaugcuuggcgcuugcucagcgugguuaaguaaugggagaaucugaaaacuaggggccagugguuuguuuuggggacaaauuagcacguagugauauuucccccuaaaaauuauaacaaacagauucaugauuugagauccuucuacaggugagaaguggaaaaauugucacuaugaaguucuuuuuaggcuaaagauacuugggaccauagaagcguuguuaaaauacugcuuucuuuugcuaaaauauucuuucucacauauucauauucuccagguguuccuggccaucauuuaaggaagaaugaagugaaguguaggaugauuuauuucuuccacgacccuaauuuccuggugucuauaccagugaacccuaaggaacaaauggaguguaggugugaaaaugcugaugaagagguugcaauggaagaggaagaagaagaagaggaggaggaggaggaagaggaaaugggaaacccggauggcuucucaccuuaggcaugcagguacuggcuucacuaaccaaccauuccuaacauaugccuguagcuaagagcaucuuuuuaaaaaauauuauugguaaacuaaacaauuguuaucuuuuuacauuaauaaguauuaaauuaauccaguauacaguuuuaagaacccuaaguuaaacagaagucaaugaugucuagaugccuguucuuuagauuguagugagacuacuuacuacagaugagaaguuguuagacucgggaguagagaccaguaaaagaucaugcagugaaauguggccauggaaaucgcauauuguucuuauaguaccuuugagacagcugauaacagcugacaaaaauaaguguuucaagaaagaucacacgccaugguucacaugcaaauuauuauuuugucguucugauuuuuuucauuucuagaccugugguuuuaaagagaugaaaaucucuuaaaauuuccuucaucuuuaauuuuccuuaacuuuaguuuuuuucacuuagaauucaauucaaauucuuaauucaaucuuaauuuuuagauuucuuaaaauguuuuuaaaaaaaaaaugcaaaucucauuuuuaagagaugaaagcagaguaacuggggggcuuagggaaucuguaggguugcgguauagcaauagggaguucuggucucugagaagcagucagagagaauggaaaaccaggcccuugccaguagguuagugagguugauaugaucagauuauggacacucuccaaaucauaaauacucuaacagcuaaggaucucugagggaaacacaacagggaaauauuuuaguuucuccuugagaaacaaugacaagacauaaaauuggcaagaaagucaggaguguauucuaauaaguguugcuuaucucuuauuuucuucuacaguugcaaagcccagaagaaagaaauggacagcggaagaagugguuguuuuuuuuuccccuucauuaauuuucuaguuuuuaguaauccagaaaauuugauuuuguucuaaaguucauuaugcaaagaugucaccaacagacuucugacugcauggugaacuuucauaugauacauaggauuacacuuguaccuguuaaaaauaaaaguuugacuugcauacacuac

SEQ ID NO: 9760 - RNA, 3461 nt, Mus musculus
cuuuuuuuuuuuuuuuuuuuuuuuugacagccaaaucuuuuuuuauugggggaaugggucucuaggggguaggccaaggcccucacugcacagcuuguucauuggcacugccuccagaauccuguggcuuuaucaccucuagaagcucuggagggcuggagaagggcucgaugcgaagagcuucgaaggugucaucugcucgugaaagaaccuaguggggaaacccccacucaacucccgauucagcgugcacccaagaaucacgaauagaacauaacaccuugauguaacaacaagagguauuuuaauggcggagcuccgggucgaaacguaucucacacaggagacaguggauucgaccacgaggcuuggaagcuagggguuuuuauagaaaaggaguggggcugggggaggaauuggcgcgguuucacaugauugguccauuuaaacaucagcagccuguuaacauuuaacuuaggucagaggggugggagauagggaggcgaugggccugcccgggcauguccuggucuguucugcuauguucucagccccagguuucaaagcucauaaacaacucuuugggcuauuugacauacauuacaugaaugacaggucucaaguuuuauuuccuuucacucagaaggccaggcccaccguggcuggggccuauggccaugcugucuggcuagugaagccauauucgcccagaguuuugccaucaucagggagcuggucacccuuguaaagccgcugcuccucuggcggccgcuugaggaugcgcucgaagaugcgcuucaguucgaacacagugcuccacuuccuggcauccuuaaagaugguggucuuguggcaccggggaucaugagaaacaaguccuaaggacuguggguccgcgucagcgcuagcccgccccccccaccccugcguggccccagagcccccgccgccccccccucgccccccaggcugggcucuugagcuaagugagaagaugaaagaauagagcaggaacagaaacuguguuaucucagugcugcuuuugacuuuggcuauaauuugcuacuucuccaccuugauggacuggacccugaaauugugaaccaaauagagcuuuucucucuuuaacugcuuucaucagugaaguaugcauuuggggguccagcugugguuccuugucuuccauccccaccccccucucucucagggaugaaguggagucuggaaugggugggguucuggaggaucccaguccagcuggggagugagugugggagaggggagaagggaguggcgcgaguggagaaagaaagccuucugccaagguuuucaaugaaacagcucucuuaagacagucuugugugcauaccuguaucuggggcaggcuuguacgcauagccuuuauuuggggguggaacagggcucuauaucgacuuuggagaguggaaaggaguucacaggguaaaugaaacuccuuggcuggaguuucaaguucugugaauugucucauuugcauggagaggcauuucaggaaucucagguaccugcuggguggguucuuaugggggagggguuaguuuguaggucgguuccuuggcagccggcgggagaggcugugugggguuaggcuccccagacaagggacucucugcugcaaaagggaguccuccauuuuaugaaaagcugggaagagccauccagucaugguaucugcgagggaguuuccccacggucagggcaaguauuuuauaauagcaagaggauacugaaccaaggccuucaaguacucacuuuagaauauuugugugugugugaugcuuacauguuuguguguguguguguguguguguguguguguguccgcgcgccggcuuguucccaccuguguguggaagccagaggagaauguuagguguccugccuuaccauccucuguucuauuucuugacagacagucucucacugaaccuuugguuuauggauuuggccaagcuagcuggccagcaaucucucagauucacuuggcuucaaggucccaacacugggauuacaggcauauauaaccaugccuggauuuugcaugcaugacggggaucaaacucaggucuucacauucguacuguaaguccuuuuacccacugagccaucuucccagccuccucacuuuggaauuauuaaaaauaaaauuuuauguuaaaaauaaugaagaacauguucguauaaggcucacccaaagugaacaugaaccaauaacaaaauagguagauggacaaggguacagcagauuuucacacagugcaggcucuuagugaucucacaagcugcucuuuggaagaaaacgguacucauaauaaucuuggauauuuggagugcauaaaucagggaacucgggaaaaagccagcucccucgcacuaucacugaguaugcacauaugacauuaucuucgacauuuccagacuagaaaccauugauuaguaaaaugcuaauucacugaaaacaggucuuugcgaagacagcccugcccccuuaagaaucugagaucgcuuuuacugaauaaacaucauccauuucugcaaugugaguaagaugcucuuucugcaccuugugccacauauucagcccugggaacagaugugcaagaacaaggcuuagguggaauuggcacuucauaccaucaagauaaggcgauguggcuuugagcagagaacauaaacaguguggcucagcucagaaggucacugugaguaggcugcuuuucuuaaaugaaucggguaccccuggaaggaagagcccaccacucuggagaauuugcuccuuuugacuucauguuaugcucuuuagggaguugaaucagugcguuucucugaggcucccaccuggcugcuuccucccuguuuacuuuuuagaauguguauccuuuaacaccguauccugucugguaacaugcaugcaccgaaucacuguuuuccagccucugggggaaaaaaaaaacaugugugggaacauccauucugcccgauugcugcugcuucuacuugcuucagcagugggagagguaagaaggguguaugugcuucugacagacugggcugggcuacaugucugcaggaggccccuggaaguugaugccugagaugcugucugcugcuugagacauugcuauguucugagcauagggcauuuccugaugauuggcagcucccacguucaaguaaaaucaaggcugcaaaugaggcugugguucacggggucuagacaggugcugacaggaugugguuuccaucugagagcagauuucaacucuucuauuagccagagccuuuugaggccauugagcuaacaauguaaaauauuucacucaauaaccugaccggccacacuccccaggugccuccgcaccugcagagugaguggagcaacccagagacauccagucuuuaggcuuuuugcuucacccauc

SEQ ID NO: 9761 - RNA, 1440 nt, Mus musculus
ucaguguccuugcuggggugggugguccaggguuucuuacuccuuggaggccauguaggccaugacguccaccacccuguugcuguagcuguauucauugucauaccaggaaacaagcuuuacaaaguugucaucgagagcaaugccaaccccagcaucaaagguggaagagugggaguugcuaugaaguugcaggugacaaccugguccucagaguagcccaggaugcccuuuagugggcccucaggugccugcuucaccaccuucuugaugcugucauacuuggcagguuucuccaggugguaugucagauccacaauggguacauuggggauaggaacacggaaggcccugccagugagcuucccauucagcucugggaugaccuugcccacagccuuggcagcaccaguggaugcagggaugauguucugggcagacucauggccaucacaccacagcuuuccagaggggccauccacagucuucugaguggcagugauggcauggaccauggucaugagcccuuccaugaugccaaaguugucauggaugaucuuggcuggggggcugaacuggcugguucugugucaacuugacacagcuggaguuaucacagagaaaagagcuucaguugaggaaaugccuucaugagauccacuguaaggcauuuucucaauuagugaucaagggggaaggcuccuugugggugggaccaucucugggcugguagucuugguucuauaagagagcaggcugagcaagccaggggaagcaagccaguaaagaacaucccuccauggccuuugcaucaguuccugcuucuugaacugccugaguuccaguccugacuuccuuggugaggaacagcaguauggaaguguaagccgaauaaacccuuuccuccccaacuugcuucuuggucaugauguuugugcaagaauagaaacccugacuaagacaggggcuaagcaguugguggugcaggaugcauugcugacaaucuugagugaguugucauauuucuugugguucacacccaucacaaacaugggggcaucagcagaaggagcagagaugaugagccuuuuagccccacccuucaagugggccccagccuucuuccugguugugaagucgcuaguaaacucccuaacauacucagcacuggcaccaccccauuugauguuagugggaucucacuccuggaagauggugaugggcuucauguugaugacaaguuucccauucucaaccuugacuguggcauugaauuugccguggguggagucauacuggagcauguagaccauguauuugaggucaaugaaggggucauugauggcaacaaucuccacuuugccaagugcagagcagaaggcagcccugguaaccaggugcccaauacagccaaaucaguucacaccaaccuucaccauc

SEQ ID NO: 9762 - RNA, 236919 nt, Mus musculus
agagaggcccauuggacuugcaaacuuuauaugccccaguacaggggaacgccaggaccaaaaagugggaguggauggguuggggaguggggggggggaggguaugggggauuuuuggauagcauuggaaauguaaaugaggaaaauaccuaauaaaaaauauuaaaaaaaaaagaguguagccccugguaggucuacuaugcuccaguagacgaccacacaccuaagaguauauaggcagcaauaaugggauuccauggauucagacaaauugaggauacaagguugaguggguguggaaagaaagggcgaacugcgaacuggaaggagauaguaaaguggggugaaaauguucaaaaacacaauauaugaaauucuaaaaaaaauggaaaaacaauaaaaaauaacuucaaaacuaaaaacccaaaugaaaaagccgaacaaccaaauuuaaaaaugaggcaagucuccauuggcucuccuggcccucucuccaauauaacugaucucacagacccacaguuccccuccguguccccucucccauccgguuccccccauccaucugccuccuaugauuaauuccccuucucagugagauucaggcauccucccauggggccuccuuguuauuuagcuucuuugggucuguggacugggcauggauaucccauauuuuaaggcuaauauucacuuaugugugaguauauaacauacauguccuuuugggucugauuuaccucacucaggaugauauuuucuaguuccauucacuugccugcaaauuucacgauguccuuguuuuuaauagcugaauaguauuccauugugcaaaugaaccacauugucuuuauccauucuucaguuaagggacaucuggguuguuuccaguuucugacuguuaugaauagagcugcuaugaacagagugguaugauauauggguauaugcccagaaaugguagagcuguaucuuaaagcagaaauauucccaauuuucugagaaacggccaaauugauuuccagagugguuguacaaguuugcacuccuaccggcaaaggaggaaugcuaacccucgcucuacauccuagcuaguacuugcuguucugugaguuuuauuuuagccauugugauugguguaagguagaaucugagucauuuugauuugcauuucccugaugacuaaguacguggcagagccaggcugcaggguguuuguaaggauaauucuaaaucccagaaaccacauggugccucacaaacauccauaaagagaaacaaauaaaaaaauaccaaugggcuggagcaagagggaaaagggaaggggugggggaaggcugacucuagcugagacuccuagcaaugggaaauauggagccugaaguggccaccuccuuuagccaggcaggacucucaguagagggauaaggacaccaaccuaugggaaaccuuugacccaauauuuguucugcaacuuuggaccccacauuuguccugccuucaagaagugcaggaacaaagauggagcagagacugagggaaagaccagcaaaugccuggcccaacuugagaugcaucccaagggcacgaaccaaucccugacacuauuaaugauacuguuaugcuugcagacaggaucccagcauagcuguccucugagaggcuccacccaacagcugacugaaacagaugcagagacccacagccaaauauuagaaggagcuccaggagucuuggggaagagucaggggaagaauugaagaauugaggaauucagagaggauagagacuccacaaaaagaccuacagagucaacuaaccuggaccuuuguggacucccaaagacugaugaacugccaaccaaagagcaagcacgggcagauacauaggagauaugcagcauaguuuucgugcaggugccacaauaacuggagugggauuuuacugugacucuguugcuagacuguggauccugacccccuaacugggcugucuugucuggccucagugggagaggaugugccuggucuugcagugacuugaaguacuaagguggguugguccccggggcggggggaccuccucauuuucagaggugaaaggaagggaguaugugggaaaggccaugggagggggaacugggaggagggggaguguaaagugaauaaauuaauuugauuaaauuaauuacauugaauuaauaauuaauuaaaguuaauuaaucaauuaauggagaaaauaaaaaugaagcagggaaccaaacagaauguucucuaaagaugaaauaauuuauuauagauguucaacauccuuggccacuagggaaauguaaauuaaaguacuuucagauacgauaguacccaagucagaacggcugauuuuaaaaaaaaaucauaaaugcugguauaguuguggagaaagggaaacacuuauuuucuggugguagaaaugugaacccaugcagccccuguggaaaccagugugaagaaguagaucuagcucaggaucuagccauagaauuuugucuccauacccuaguauaaagaaacuuucuuauccuccucucuagucacaaagggcaagacauagaaauugccuagaugauaaaaugacccagcugaugaauggauaaugacauccguuguauuuacacaauggaauauuauucagcuguuaagagacaugaaguuagcuaggaguccuggagccugaaccagcggccaucuuccaaugaaggcacaaugacaccaacccauccacaaaaccuuagacccacuauuuguccugccuacaagaagugaaggguaauagauggagcagaauuugagggaagggccaaccaacgacuggcccagcuugagacccaugauaugagugcaagcccacaccugacacuucauuaauauucugcuauauuugcagaugggagccuagcauaacugucaucagggaggcuucaaccaacaacagauggaaacucaugcagagacccacagcugaacauugggcagagcuuggugaauccuguggaggagggggaggaaggauugaaggagccagagggaucaaggacaccacaagaaaaccuacagaaucgacuaaagcccagaggagcucaucgagacuggaacuccaaccagagagcgugcaggggcuggaccuaggccaucugcacauauguaauaaucaugcagcugaucuucauguagaaacccuaacagcagaaacaagggcugucucugacucuguugucugcuuuuguaucccuuuccccuaacugggcugccuuguuuagcuucaauaggagaagaugcaccuaguccuauugccacuugauaugccaggguaggcugauauccaugggagaacuccucuuuucugaggagaaagggaggacaggagaguguggggaguggagaagagaggacuugggguagaagaagggaggaagcugcaguagggauguaaaguaaacaaauaacuuaacuuuuuaaaaaaugaaagaagggggcuggcgagaugacucaucuuccgaaggucgugaguucaaaucugagcaaccacaugguggcucacaaccauccauagcaagaucugacucucucuucuaaagugucagaagacagcuacaguguacuuacauacaauaaguaaguaaguaaauaaauaaauaaaucauuuuuaaaaaaauggaagaaaaagaagcacaaaauuuccagguaaauaugugcaucuggaaacaauaauucugagguauucuuucauuuguggggauaaguuuugaaucuguagauauauuuaguucacuucgaguacacacagagggucagaaaacugucucauuguuuuuaacauuaucucuucauuucuauccugugaaauuuuucauguaggcuuuucguugauuuaauuccuuaccuacuguacugaaaauuaguaacugucuuaggguuacuauugcugugaugaaacaccaugaccaaaaagcaacuuagggaggaaaauauuuauuuggcuuacacuuucacaaggaaggaaauuaugaugggaacucaaacagggcaggagcuggugcagaggccaugaagggcuacuauuuauuggcuuucuuuuuauggcuugcucagucugauuucuuagagaacccaggaccaccagccaagggauggccccacccacaaugggcuggcccuuccccaucaaucacuaauuaugaaaaugccuuagaggcuugccuacagccugaucuuauauagacauuuucucaaaugcccuccacucugaugguuuuacuuuaugucauguugguguaaaacuauccagcacaauaacauuagcuucuauuucaugacuaaguaaaauuuuagauuuuuuuuuugagacagagucuuacuauuuagcccuagcuugccuggagcucacuguauagaccagguuagccucaaacucagugauuuuccugucucugccuuccaagugcugugauuaaagaugugcaccacuauaccugacauuuuuaaaaauucuuugucuaaguugauucuuacauucagaaaacaagaccuaaaagcugagcgcaugccugaaauaaggcucaggaucaaaauuacuguauccauauuaacauauccauauaaaaaggagugugauaccuggaacaucuauguccuuggaacuugguugcuuugacuuguccccuaacaaaaucuuuccuagguagaugaagacuauuucauuuuaaccuuccaugagaggugucagcagaauuuagcauuugaaauggugugccucuguuucaggaacuggcaaaauauuguuggaauuaauauucucagaaggcuggagaccaaucaaagauguucagcaauaugagaaagauuuauucaagaaaagcagccgaaucugaauaagaacagcaagcuuuguggucuuuuacuccagcucccccaccccccccacccccccaccucaggcuauccuugaaaacaguccauaguuuugguaccagagggagcugaauggauugcauacacaaagaauuguccuuauuugaucugucugguggcugucuggaagacccacugaaaaagcuugucuuuauuuugcugcuuggauuuaacccagugcuaaaauuccugagagaaauuaguccaaagcauuugugcuuucagucacugccgcuugaggcaacaggcaacaguugagaagacaauagccuaaucaagaaucuuagaaagaagaugcacagaagggcuuguucgccuccaagaaaaccuaaugaaucuagacgagcaggcagauaugcacaaugcugugcauauucgguguccaaguccuaggugcuuaacuggaaguuggcauugaggcuguacaaagaucagaguugaaacuaccaugcuacauuaaaggcaaugccauagcagacacugagaagcccuaugcaaauauuagaaguucuuuggguuuuuuuuuuuuugguuguuuguuuuugauuccaauuacugaauaaaaugucugucuguuuguuaauugaggacuaaguuaauguaauagacauuuuagugaccacacaugacaacaaauauagauacuauugaauugaaaaaaauacuaguaaaaacaagcaaggaacagaaacaacaaauccacacauaaauauuuaauguaucuaguuuuugccaaaaauguaugcagcgugaaaagaaaaccaaagaaaaaccuauauacgugagcagcaacaacaaaaucaauagaaauguucccagagaaagagguuagacuuucuggagaaugagucuauaacacuuauuuuaaauauuuucaaauagaaaaaaagaaacaauuucuaaagaaaacaugaagcuaugaauauaggaaaaauaagaucucacuaaagacacuaucagcaggcauaaauuauuuaaaagaaccaaaagaacugugaauuuaaaaaaaacuaaaauuaaaaaaucacuauggagauuaauaacagauauaaugagguaaaaguaacaacacauuugaaaauaaauuagcuggcauucgauuuaggaaagaaaaaauaaagucuuagaaaaauauagaacaccauugaauguaccaagauauugcacaacagaagucucagaaagagaagagaguaagaauaagaagacaauggaagaaauaaugacaaauuuccucaaauauagugaauaaaaacuugaacuccuaacccccauuagaauagauucaagagcccaacacguacacucauuauaaucaagcugcucccagugcgaaacaaaaagugaauuugaacuuggcaaguguacuggcuaguuuugugucaacuugacacagcuggaguuaucacagagaaaggagcuucaguugaggaaaugccuccaugagaugcaauuguaaggcauuuucucaauuagugaucaagggggaaaggccccuugugggugggaccaucucagggcugguagucuugguucuauaagaaagcaggcugagcaagccaggugaggcaagccaguaaagaacaucccuccauggccucugcaucagcuccugcuugaguuccaguccugacuuccuuuggugaugaacagcagcaugggaguguaagccgaauaaacccuuuccuccccaacuugcuucuuggucaugauguuugugcaggaauagaaacccugacuaagacaaauugguaccagcagagugggguauuccugugacaaccugaccauguuuuggggaggucuguggaaggacuuuggaacuuuggucuugaagauccauuuguuguuaagagcucugugggauguuguguaggagcuuggaagauaauguugagaacagugcagaagauggaggccuggcuugugaaauuucagagggaaaauuaaagacucuuuucagggccauugcuguuuugauugugaagauucuguaguucugguuagcuggggcugaagaaucagcugugauuaacaagauaccagaacuacugaagcaaaagcuuugcauuacugggacuauugaugcugguuagcuggagcuaagaaauuagcggugauuaagaagagaccagcaucauugaggugacaucuucugggaaguguuuucugagagcacaguggcuguguuccagauauagccaaaguuguaccuugugcuguggcuggacuugguaauguguaagagucacccaggugguacugguuuugaaggcaugaaggaguugagcagaacagcugaggcuuggcacugugagaggccauggaaggccauuggugaaaguccagccucauuugcaauugauggcccaggacugaaggggucaugcaguguuuuggagaugccaguaccaugagaugaccaccaagaacagcagcagcaguggaguacaggcaucuggagccuagaggaugacgcgugugcuacaaagggccuggcuggagaagugacccaagcccuuggaggagcccagaagauugugaguuggaucccagacauuggacaguuggagauugacuuuugcuuuugauugugacugugcccugauauuuucccucuugaaggaagaaacuguuuuaguggagcccacaguuaagagacuuuuaauuguaaaaagacuuugaauuuuaaaagagauggauauuuuaaagagauugaaaauuuaagaauauguaaagacugugggacuuuuaaaguuauuuagaauggggaugaauaagauuguaaggguugaggcuuacuagugauguuuuugugugucaaguugacaaggggucaauuguacuggcuaguuuugugucaacuugacacagcuggaguuaucacagagaaaggagcuucaguugaggaaaugccuccaugagaugcaauuguaaggcauuuucucaauuagugaucaagggggaaaggccccuugugggugggaccaucucagggcugguagucuugguucuauaagaaagcaggcugagcaagccaggugaggcaagccaguaaagaacaucccuccauggccucugcaucagcuccugcuugaguuccaguccugacuuccuuuggugaugaacagcagcaugggaguguaagccgaauaaacccuuuccuccccaacuugcuucuuggucaugauguuugugcaggaauagaaacccugacuaagacagcaagagaaauguggcuuuucaaguagaaaugauuuucauuauguugauuuuuaccugaaucuaaagaaauuagaaagcaguaggcugauagucaacacugaaaaagcccaaauuaucucacaaacauucuacauaccaaaaagcauuacucaauacuuuuaauggaaacaccacauuguauuucauaaacaugucacaaaaauuaacccaauuaauuuaaauauuuuaaggguaaaaaaaauaagaaguugccaguaggaauaucuugggauguaaugaaaggauaccagagggugacuaaaauccacacaacaaauaaagaacacaaggaaggguaauuaugugggugaauauuaaaaaaaaacuauacaaagguaguucauauuuauuuuuugaaauaauaccuaaaguacaacuuuacaaaacaauaauuauaaaucaagaggaacaggugcaaacuccauaaauauguaauucaugacaauggcaaugaaaggagaaacagcaauauaaaagcaagcuuucuuaugauauugaaaauaaguuacuauugugaucuucucuuguaaauuaagauucaaauuguaaugcacaaaucaucuauugggaaaauaacuaaaaguguauacuugaaaauugaaaauuaaaaaugguggaagcugauaugacgcccccaacagacauacaguagaggacuucugggucuauguucauucagagaugauucaccucaagagacuagaggccccagggaguuuagaggucagguggggugaggggugggaacauccauguggagacagguggguggggaggaggugugggauguggagcagauaaagguugaccggggcgggggggggggggauaagauauggaguguaaaaaaaaaaaauauauauauauauauauauauauauauauauauauauauauauauauauccaugcacuaaaaaagaaaaagaaaaagaaaaaagaaagaaaaaaauggcggagcagauuaugguggcauacaccuuuaaucccagcacugggaggcagugguaaguggaucuuugugaauuugagguuagucuagucuacauagcaaguucuaagacagccagagcuacauagugaaaacuuaucuuaaauaaauacauuaaauuaaaacaaaauuacaaugauccaggcuaaagaaugaauucagauucccacuucacaagauauuuaaaauuaaguugaaaugcaucagacuuauagguaagaacugaaaguauaguuugcuggaaggaaaauaauauaaucucuaagccuuuaugauauuauauuaugcaguggauugguuuaaauauucguggccuuguauuagcaaaagauuucuuucuuuuuucauuaguuuauuuauucacuauaucccaaucucauccccccucccuccccuccucuaggccccauucuuacaaauuccucuucccccauuaccuccuucucuucuccucaaagaaggggaagccuccuuugguaccacccugcacugggauaucaaguugcaucaggacuaagcauccuuucccacugaagcccaaccaggcaguccaguuaggaguaggggauccaauggcagaggacagagucagagacagucccccuuccacuuguaaggggacccacaugaagaccaagcugcacaucugcuacaaauguguagagguccuagguccagccccugcaugcccuuucauuggugguucagucucugugaaucuccaugggcccagguuaguugacucuguuggucuucuuguggagucccuauccccuccugcucccucaauucuaucccccauucuucuacaagaauccccuagcuccaucugugggucucuguaucuguucccauuuucugcuggaugaggccuuucagaagacaguuaugcuagguuccugucugcaaccauagcagaauaucauuaauagugucagggguuggcucucccccacgggaugggucucaaguuggggcagucauuaguuggucauuuccucagucucuguuccaucuuuaccccuguacaucuuguaggcaagacaaauuuugggucuaauguuuuguggguggguugguguucccucccuucacuggaaguccugucuggcuauaggagguggccacuucagggaacgguuucuugcaaaaaggaaacugacauaaggaaaaagauaggucaauuagcuauaaucugauuuuauuuauuuauucacuuauuuauguauuuauuuugugcuucaacagguacuauuaagaaacugaaaguuaaagaaaaagagaaaaaaauuugucaggugguaguggcacagaggcaggugggucucugaauuugaggccagccuggucuacagagugaguuucaggacagcuacacagagaaaccuuguauuaaaaaaaaaaaaagaaagaaaaaaaggaaggaaggaaggaaggaaggaaggaaggaaggaaggaaagaauagagggagggagggagggagggaaacugaaagacugaaauuaggcugguagugaugguacaaggguucuauaugccuucaauuccaacacuugggaggccuagguauguauguaugaauucaaagccugucuggccuauauaaagaacucugggccagccaagucuacauagugugacaugugacccugucucaaauaaaaagcaaaaagaaaauaagaaugaaauucacauaauaagaaaaacuacuuacauguuuuauaucuggcaaggugugauauucaaaguguaacuaacuuuuaaaaacuaaaaauaagccgggcggugguggugcacgccuuuaaucccagcacuugggagucagaggcaggcggauuucugaguuugaggccagccugguauacaaagugaguuccaggauagccagggcuauacagagaaacccugucucgaaaaacaaaacgaaaacaaaaacuaaaaauaaaaaugacaaaacucaaucaaaacaagucagagaauuugaauagaugcuuuucuuucaugauauaacucuucacugauacaguauaacucguucuucuaugauguaacucuuuaagaaugucuuacaauggauucugaccauguucccuccucacuccucccuuuaacuccucccagaugcacagcccacuucuugacccccuuccuaauuuugugccuuuuguuuuugaaauaacucacugaguguaguuuguguugcaagugugggggucaucugcugcagaaugguggauucaucaggggcaacauccuuaaagaaaacugucuuucccucucucucagaaaccaucagcugucaguaaccccucagugucuccauggggaaaccugaagcugcccaagcuggaaacagagcuucaggcacuucacagccaccagccacuucugacccugugggaacacagcaacccagcaacccagcuggguggaauuugccuaaacuacccacagcccacagaacagagucaagaaaaaacuacacacaggcaaagcugagggucuacaagagaauaauggaccaguaaaaauguacacagcccacaccaggaucagggagacaaaacagcagauaugucaaggaaauggaauugacauuuuucuaaaaagauguacaacagcuuaccugcccuguucuguuuuauuuuguguauguguguguguguguguuuuaacucacaaacuuuaacaaaaugguucucaaggggagugggggaaggacguccaaacuuugugaaaauauggcuaacacccucuaucauuagagaaaugcaaaugaaauugacaauggcagacugcuuuacacucaguaggaugguuguaaaaucaaaucuaaucaaaguccaagaggaguaacauguuuggguaagaacagagagaaggccagaaacucauccgcuccugguaagggcuaacaaucauguagccacaguuugguaguucucuucaaauuaaacggagauuuccuuugugaucuagcaaaucaagaacacugaaagcauguguguguacaaaagccuuguacguggccaggccuuaaaucccagcacucaggaggcagagguaagcagagagucucugcgaguucaagggcagcuuggucuacauagugaguuccaggacagcuagagcuacauggugagacccugucucaaaaggccaaauaacaaaaaaaauuaauuaauuauaauuaauucauuauaauuaauauuaaaauauaauauaaucauaauaauaugaaagaagccacauaaaucauuuccacaacauggcuauagggauagaaaguagguuagugguuuucagagugugagaggagcaugaaaugacgaacagggaaagggcagaaaugugcuggcauuaguggugaugcacgaaaaauuagauugucuauuauuugucaauuguauuuuuguauguguacauacaaagcuuaaagagaugccacagucucucuaggcucuuaccaaauuuagcucuagagauaugaucagcuucagaauauccacuaaaguuguagugacaagggacauugggucagaauguuaacuaugacauuggcauguaaaagugaggauuccacguggccuauaauagcugauuuggauauccugaaacacuuaucucuugucaugggaccuaaggacaaguugaugaguugggcauucuuuggaugugugugugucaaaaaaauaagggaaaggccaaccaguuuuguguuuugcuaaagaagaaaauccaucuugaauuucugaaaacccacaagacccacauaaaguccucuugguuuguggccauagcugugcaggagcauaaaaugguacgccaugaacugguuaguuuuuuguuaacuugacacagauuaggguuaccuuggaagauggaaccuccauucaaaaauugccuucacuagauuggccugugggcuugucuguagggacauuuuccugauuaaugacugauguggaagggcccagaccaccgugggcgaugccacccuaagugggugguccugagguauguaagaaagcaaacugagcaagccauggggaaacaagccaguaaugagcauuccuccaugguuccugccucugcucccacuugaguuccugcccugacuucccucaaucacggacuauaaaugggauguguaagccaaacaaacccuuuccuucccaaguugcuuuuggucaugguguuuaucacagcaauagaaagcaaauucggauacaccaucaagucuggaaauuuuuacauguuggaccccagggagugugcuuugacuuuugguauauaugagaaaauauuaugauuguuuuuauaauaugcugagagucaguauaaaagagaucaagaagaaccaaaguuggacaagagaaaugucccuaagcuuuuccccaaaccacugccauggguuccugccugcuggccuagucaaucagccucucaugagcauugcauuggauugcuaguauuuguuggaauuuggacaccgaaggaagacauucccuuugggaaccuggcucugcuccuuucaguaguacugcacagcugcacugagaacauagccaacuucuauguaaaggucaguuccuuuggugagcagaaagcaagcuaaggcagaggcccacaaaggggaugggggcaagcgauagauaaaacaaacaaacaaacaaacaaacaaacaaaccccuuauggggggugauggagauccaggcauaauggaugccauaaacaaauagcagguuuggaucugagauaguuacaugaaauuccagaacaaaauuucuaguuucugugccucucaggcuuacccccugcccugaagauuugguuugaaucccauggucccaugcaugccaagagcuggcugcuuucuuccaccacuaguuucagccuuggcuuuuagguuucaaacaaaugaaauuugcauagacaauauaauuucauaguucaagcauugagucugcugguuacacaccuuaaggagaccauagcucucucagucuccauagcuaaaggcucucagaacaaaacuaaccccaguaaacagaacuaaaaaugaccauaugaauuaucaguuccagaaaggaaacaaucaaauuuuaguucccguuuaccugaagccauagauaccacuguaugaucaacuauccucgguagccucccuuaaauuccuaccacagaacaacacuuaggucuaacagcaguacuccccuuggaagaagagauggaguccugugugacuguauccuuuaugucaauuaaaguuugaggacagauuucaguaauacaacacccauaggaacuccauguauuacauuuuuagaaaaaauggcacacagcaaagaagauguaacuacaauuaaugaacucaucauuucugugauuuuuauucauauuuuaaaauugacauucaaaggaucuuucauuaugucauuuguuugguccuuacuuuguucuuguucauccaucuccugcuuucccaucauaaaagagaaauaaaggaagaaauuaggaggaagaacuuacaaaauaacccaaaccauccacauugaugugaagagaaucauacagucacagaaaugugucauaaaugguaccugaacauggcacguaggucauaucaguuagagaugaaagccuagaccagagcgauacauucugaggugauuugguaauugucagugccuucuaauugaucaacaagguuaaauuaucuucagaggcuacccagggaggacugguauuugucugccaugugcuucccugcacuguguuuuguuggaaguuccauuguucccugaggaaccccaggucagcucgcagaagugaaagucaacucuguuuccuguaguaucugccauagugaugcuacuucuguaaugaaauaguuauuuaauaaaaacaugaaaccucucagacuaacacaguucaguuauaaggcaccagcacgcuuauacuugagugauugaucuggaaaaaagaguaagauuauauagguuuauuuuaagaauuaugggguccugguuaaugggcaucaauaacgccuguugcuuaaguacuuggaacagcuuaggagacaaaacuugagcagaaucauuuugucccaucuacugugaccuugagcuuaacuuuccuuuuuccgucuauaaaaguggauuuagcuuucucucucagaaaugaccaauguaucuugugcuaccuuugucuugacauugaucucacguucuauuagaguauucguguuccuugcuaaucaaugagugcacgcacaccuguggcuuuuucacugugccauccuuagcauuagacagagugcuugccgcauuguaaagaugacauaaauagcuagcuuugauucugugacuuguaaaacaucccacauucaggaaaaaagacauuuggggacuggagagauagauguuuugauguucagaaaacccagguuccagucccagcaagcuccuguaacuucagcuccaagggaucugugcccucuucuggcuuccacgggcaccugcacucauaugcacaaccccacacacaaaugcacauacuuauuccuuuuaauuauuuuuuaauuuuuuuuacauuccagauuuaaucccccacccuccaacuguuucacaucgcauaccuccuucccacuccccugucuccacgaggaugugcccaucccccacccucacccucacccaaccagaccucuaaacucgcuggggcuuccagucucuugaggguuagaugcaucgucucugacuaaacccagacauggccauccucugcuguauauacguguugagggucucauaucagcugguguaugcugccugguugguggcucagugagagaucuugggguccggauuuauugagacugcugguccuccuacagggucgcucuccuucucagcuucuuccaucuuuucucuaauucaaccacaggggucagcagcuucuugguugggagcaaacaucugcaucugauucuuucaguugcuuguugggucuuucucuuccagcuacuuguugggccuaucagagggcacacaugauaggccccuuuuuuugugagcacaccauagccucacuaacagugucaggccuugagacuuccccuugagcuggaucccacuuuggaucuguugcuggacuuucuuuuccucaggcuccucuccauuuccaucccuguaauucuuucaaacaagaacaauuaugggucagagaugugacugugggauaguaaccccaucccucauuugaugcccugucuuucugcuggaggugggcucuauaaguucccucuaucuacugucaggcauuucaucuaaggucccucccuuugaguccugagagucucucaccuccuaggucucuggugcauucuggaagauucucacaaccuccuaccucccgagguugccuguuuccauucuuucugcuggccuucaggacuucaguccuuuucccucacccaauaccagaucagguuccccuucugcccucccaacucccccaccuguccacuuucccucccagguaacucuacuaaaaaagaacauagaggaguuacggggaaauugugaauaagauaaauauaguguaugaaauucucaaagaauaaaauaaaaaaauaaaauuaaaauaaaaauaaaaaagaagaauuuuggguaaaagugaugcaaaucuacauauugacuaauauguagaacugugaaguacaggaauaaagaggaaauguaccuuguacguucaauggagggaagaggauuaagugaaggaacuaacuauagaacauaauaaaggcagaaaauacaguaugcgaaaguaaugaaaggccaaaugagagcaauacaaugguaagcugaaccuuaauccgauaaguauaucauaauuaaaaagaacaugguauuuaaaugaaaaauuauccaaauuauaugacacauaaaauauaaaaaugacaacaggauaaacacugucgggaauggauaaaguguuugcaacacaagcgugaaguccugaguuauagcccuagaacaguauuuuuaaagcuacacauuuugguguacuauuguaaaagucacgaccuuguggcugcuaucaauuuucccuuugcugccaauguagugcuuggaggacucauuccuuaugauauauuuagauccagucuacucauuuuaauucugguaugacuggauauagaacaaauuauugguaauuaauaaccauugaaaggggaagaauuuguucuguggauucuuauuuguagcugugucguucccccccgcuuuguuuuuuacuauuaaaaugugcuucagugaacauccuuaagaggagucucuguggagauuauauaugcuagagauuuuucucuagggcacauccuuagaaguguaauuacuaagccacagggagugcuuacccauacaaguggaauugcgagucuuaggaaguacuuaucagguguucccaacgugauugagccaauuugcuccuccacuguagugugugauguucuacuucucaacauugguucaacacuugauauaaucaggcauugauuucuuuacauguguuuucuugauauauaugauuguaaaaugagcaaucauucuaauacacauuuaccugauuacuagugagguugucuuuuccacuguuucuuguucagcugggugccuuccuccauuaccauccuuggcucaucaucucaguggcugccugccacgcugcuuuguugucauucuuuauauagcccauguauaaauccagucaugaccgcauacaucuuuagucugucuguagauauugccuuucauuuuauaguauauuuugaaucauucauguggauuauuuaccaaucaguauuccguuucauugaguauugauccacaaaacauuuaaaagcaauaaaugugaaagaaguuugcaugugaguugcaaaugaaagguucaggauacuacuaaaauguguguguguguguguguguguguguguguguguguguguuucuaagcauuaaacccagaaccuuacacauacuaaguacaugcugcuaccacaaauuuauacucuaggaacauucuuaucuucucauccuugaguccuggcagacaaaguaaacaugggaugagacagaauagagaccgucaaaauaaaccuucccuuauacgaucaguugauuuaugagaaagauuacaguaauacacaacaugugguguuggaagaacuggauauccauaugcaaaaggaaaguagacaugcaucuuacauaaaaaucaauuaaaaaugaacuacagacuuaauguuauacccugaaauuaugaaacaaguagaagaaaacauaaggaccaugcauaaggacauugaagugagugagaauuuuuuggggggguguggggugggaagggaacuccaacaauacaggaaacaaaagcaaaauuuauacuggguuucaucaaacugaaaaacuucugcagaaugagaagaaaaagugaaaaggcagaugccaaaagguaaaauauuuuaaaccuguauuucuggcaaaagacuaauauccagaauacauaggaaacucgaaauacaaaacaauccuuagcaaaauaauauacaacugagcuaccugcuaccuaucgugccaaugaggcuccaagagaacaggacccacucuguguucagcuaagcagggcucacagagacugaaguggcaaccacagagucuacaugggucugugcuggguccucugcauauauguuaugguugcuuguuagcuugguguucuugugggacuccuaacaggggcaguaggggcucucucuaacucuugccuuauuuugucacccuugucuuccuacuggugugccucauccagccuugauaugaggggagguucuuagccucauuguaacucacuaugccauauuuguuugauaucccugagagguuucuucuuuucugaagagaaacagaggaggaguggaaaaugaagagcagaguugaucuaggggagaagggaggugggggagaaauugagaggauggagggaggagaaacugugguugugacguauuguaugagagaagaauaaauaaauacauaaauuaaaaagaaauagcauaauaauaauaauauaaucuuagaaugagcaauagacccaagaagaauucucucaaaagaagacauacauauuguugaaaggaauagacaaagacaauacaaaacaaaaauuaaacccaaagucacccaucaucaggaaaugcaaauuaaagacacaauguaguauccccuuauccccagcaagaaugucaaauagcaaaaagacaaaagacagagcaagcaugucccuuaugagaaugggaacaauugggaagccugccaaacuguugggaggacuagaaaaccacgugauggguccucaaaacacuaaacauagacuuagcauaugauugaauaauuccacuucuggguauguacccaaaaaacucaaaucagaaucuuuagcgacaucaucaugcucauauucauugcuguauuauucccaauagcuaaaauuguggaagcaguccaaguuuucauagaugaaugaguggaauuuuaaauauguguauaguguaauauauaguucaacaauuaaagacaaggaaaccaaacagagaaaccuugucuugaaaaaaacaacaacaaaagaaagcaaaaacaaccuugaggacauuauauuaagugaaauaaguuaguuacaaaaaagguaaguaaguauuagauuacucugaaauaaaguacucagacuagucaaaaaucgcaucaacagaagguagaggccaaugucuagggacuggaaauauauuguuuaauggauauagaaaccaugccuuaccugaucaaaagaguuaccaagauggaugguugauaauggcugcacaaaaauuauguauguuauuaguaccacugaacuauauacauaaaaugugagaaaugcuauauuauguuagauauguguuagaaaaaauaaggaaaagguauacaaauucacaugccucuauugcuagauaaggucuggguuuauacccuuucucuugaauauagccuuaguuauucauucauuuagagcaacuuacccugaaauaaccuuugguucuucauuuuagcugauaggaaaagggacuuauuuauucagugaucuuucuaaaaaugaacuuaucuggcagaagaacuucacaccucacuggucuuuaacacuucuuucauaugacacauauaaauguauccaugauuuuuauuggaauuuuuaaacuuaaaaauuaagugaauaaaaguuuacagacugauauauuuuuacuacacuuuuauuagccugcaagggaugccaugaaaaauaucacagauuggguaugaacugaaacucauuucucacaauuauagaagcaaaaacuccaagaucaagguguagugaugauuugugucuguugaggacucucuucccagcuuauacauggcuaccugcuuacuaugugcucacauggcuuuuccucugagcacauaugaaggaaacagcauaucauauuccuuuuuaaaauaagcauacaaauccuguguuacuaagucuucaaucucagacuacaucuaaccuuuaguuucaacacaauuuuaggucuuauuuucaaacucaguagucacauauggcuggggggggcuuuaaaugaguucaaagaagacaaaaguuaguucauagaaaucuccuagaauuucuugaaaugugaugggggaaauugugcuaauuccuucagacugcaucacugauuucuaagcaaccagguugagaaaguuaccagggcuuucaagauuguucauggcugcacaggcacucuaaucucccaacuccaagggucuuucuuaguagaacaaacugaaaugcuuuuggcuuucugauuucauagauucuagcuuaaaaacuuccucucguuucccagagaacuucuuacauagaacguuuguuauuauuauuaucaucaucaucaucaucauuauuauuguuggaaacagauaauauuuaaucaaaagaccaguaaguuaaaacacacacacacacacacacacacacacacacacacacacacacacacacacacacacacacacauaccuucuaaaaauaccauugaguucauuuugaauuggcuucuacugccaggcauggagccugaccuuaagugugguuuguguacucagugagacuuuguugaggaaaacugauuuguccuuugcaaguggaugccaguuggagauagcuuguggauuagggaugagagaucuuguccacucccuuucucucaguauugggaccccaucuagcuugaaccugugcaggcccugugcugcugccaccaucucugugacuuuauauugugucaguucuauuguuucugaagugccuuguuuccuuuguaucuucugucccaucuggcuccuuacaaucuucccaccuccucuuccacaggguuuucugagcccagaggggagggacuuggugaagacauuccacuuagggcugaguguuccaagaucucucacauucugcacauuguccaucuguggguuucuguauuuguucccaucugcuucaggaggcagcuucucugaugauggcugagugacacacugaugaguauagcagaaugucauuaggagccauuuuauuauauucuuuuagcagaacgauaguauguggcuuuccccuuggcacucggcauaucuauuuucaguucuugacugcccaaguaguccuaggaguaauuuuucugaaugaaaaaucgaaaccaaaaaacauuguaucuuccucaaagcacauggcagagaugacugagaucuaaauccuagcucauccugagcuuggcugaacccugguauccuccaugccaugccauacagccaaucuuggcacaacaucagucuuugagccuuagauccacugguaaaauagggcugucuguacuucaguagauaaauagcuuggcuggccauggaaagccaaaagaccccauaacagggaauugagauuuacaguucugugauaagauguacuccucccuuuuuggugggacucuaugcccuacucguucacuauagcuggcaauuagccuauucuuggggugguaggaugaacucagcuuaaaugaucagagucaguucuacagucuucuagggcccauucucuaagacccugacuuuacuuugaacguuccaggaaaaaaccuacacucacugguauuucugcauaugugauuauauuuguuuauuuaaauaaaaucaacauauuaugaacuucauccuuuaaugaaagugagcaauuugguggguuuucugcauucagacguauacaguuaucgucacaauuuuaaaacauuuuccuuuucccuacaaguacacuuguaccauuagcauucuuauccucugguccaacucuaagccaucacuaauucacucugccuuuauagaguuacuuagcauggcuaucucguaaguggaaucauaaaauaugugguuucuacaucauuagucauugguuucuuucucuuagcacagugguuucagacuuuauccuccuugugugugucagcacuuccuuccauagcuaaguauuauuccaucagaugaguguuacagguuguauuuguaucuugauuagcauguggacacaugacuuugucuauuauaaauaaaucugcuauggacauucauuauaaguuuuaaugucaucaaauacuuuaauuucucuugguacacauauuuaggaccugacuuacugggccaccaggcugcucuguaaccaacuauuugagaaacuaaaagagguuccaguuuuccauguccuaacuaguacuuguuauuaccuuuuuaauuguagugauucuagcggguauagagugccauuucacuguggggucuuuguuuguuuguuugguugguugguugguuugggaguuuuuguuuguuuguuuguuugguugguugguugguugguuggguuuuucauuacagaauuucucuguguagcccuggcuguccuggaacuuucucuguagagcaggcugaccuugaauucauagaaguccuccugccucugccucacuagugcugggauuaaaggcaugcaccaccaccaaccggcucacugcaguuuuugauucccaccccauaaugauuaauuaguaauggaauagucaaauuuugucauguaugaauuuucuuucuuuuuuuauguguaaauuuucuacugaggaaugucuuuucaauauuuugcucaauuuuaaaaucagguuauucgucuuuucauugccauuuuaagacacaaacaagcaacauuaaauagaugcaauauguacauuaugugauauauauauauacauauauauauguauauauauauauauggauagauagguagauaaauagauacacaacaaaauaaaggaaagaucaugcauuucaaauuuuuaacacguuuuuauugauuauuuagaaaauucauauaauguacccugaucacccuuacuucccagucaguucucccagguuagcacccccacccuuuguccuccugcaaaacagacuuuuaaaaaguccaauucgugucauccauauaguccucugagcauggucaagcucucggaggccagucucuuacagaaaagugaguccuuccccagccugacucccgccuguagccuucuaguguggagagcuauauuucagcauccucauuacaauuuuuuuauuacguauuuuccucaauuacauuuccaaugcuaucccaaaauucccccauaccccccccccacuucccuacccacccauucccauuuuuuggcccugguguuccccuguacuggggcauauaaaguuugcaaguccaaugggccucucuuuccagugauggccgacuaggccaucuuuugauacauaugcagcuagagucaagagcuccgggguacugguuaguucauaauguuguugcaccuacaggguugcagaucucuuuagcuccuuggauacuuucucuagcuccuccauugggggcccugugauccauccaauaguugacugugagcauccacuucuguguuugccucauuacaauuuuuaagaguucccgucaauggucuucugucuagguuguuacauuuggggguggggugggaguugucauagaagccuucuaugucccucuuaaucaacugugagucugcagucaucuauaacacugcagaagaagcuuccuugucauuuacagucagcaggagcauggauucuggacuuccacauggugucuggcaacagcagggaucauagacaucuacuuguccuccagcaucaacaugugucauggaccucagcacacucucuggugacaauacuggcaauggacaggaaugggguccccagcaccagccuggaccacagacauuaacauggcuucagacauagccuuuggugguaacauaugccagggacaucaacacagccccccagcucuuguaggcuagagacccagacaugaccccuggcaguagcauggaucacagacaucaacagagccucagguugcagugcagacaacucacauuuucaugguccuagguggcaucacagcucacauacaucaacauggcuucaggugacagcauggaccacaggcaucuacaagaccuucaguaguaccauagaccauggaggaaaggagugauucauuugagagcagaggggaacaaaaugaguugcaagggagagagaaaggguuacaaaugaugcaacacaguacuuacuaugaaaugaucaaaauauauacauaauuuuaauuaauaaaggcuuaauaacauagauauuaguuuuuuuuaaccaaaaccacaauuuucaaauuuuuucuccuauuuuguggguuccuuucauuuuuguucuaggaaugaaauuuaauuuuuaauuuguaacaaucucauuuacauuaauaucaagccauaguuuauuuuuuaagaugccucuauaaagcuccauuuucuuccuuucuuucauuuugcuaucaaaguauauacaaaguuugacuuaauuaguaguauucuuacuaacauggauuucuuacuuacugguuuaugcagacauauuuuaaauaaauggaaaaaagaaagccaaaaccaaaaauaaaucuauucaaauuauuacucagcguuuuuucuccauuuuaguuugaaggauucacucaacauuuaagaaauuuuuuaacauuuuuuuccucuauaagaguguuuuucuugugcaccaagugaauucaguacccacaaaggacagaaggggcacuauauucucuagaacugaaguuacugaugguuguuggcuaccaugugggugcuaugaaccaagcccaggucaucugcgagaggaacaagugcguuuaacacuccagacaaccuuagcauuucuuauagggcagauuugcuagucaagaauggugucacuuuuugucaaucugaaaaugucauuucuucuuuauuuuccaaggccacuuuuugcuggauauaugauuguucauuucaguuuugugcuuucagugauuugaucuggcauucuauugucuucugcccuucuagugagaaaugaaauaucuguauucccuuucugcuuucaaaagucuaucuuugguauuggcugcuaacaguuuguuuaugacauguggcuccaucugaauucauucuacuuugagcugaguuucuucaauguauagauuaagucacuauuguagaugccaggaaguacuugcugacaggagccugguauagcugucucuugagaggcucugccagagccuuacaaauacagagguggaugcuugcagccaacaauugaacugaucauaggguccccaauggaggaguuagagaaaugccugaaggaguugaagggguuugcaaccccauagaaagaaccacaauaucaaccaaucagacccaccagagcucccagggacuaaaccaccaaccaaagaguacacauggcuccagcugcauauguagcagaggauggccuugaccagcaucaaugagaggagagguccuugguccagugaaagcuugaugccucaguguagaggaauucgagggcagggaggugcgagugggugggugggugugggagcagccccauagaagcaggggaagggggaggagauaaggggcuuccaggggggaaaccuggaaagggggauaaccuuugaaauguaaauaaagaaaauauccaauaaaaaaauuuuaaaagauguuuuaucacauuugggaauuuugagaugcuuuucauagauuuuugcgcccccccucccgcuuuggacucgcauaaugaacuuuaacauagcccacucucccgaggcucuguuagauuuucuucagcuuuugccuuuuugauuuucacauuugauaaucucaauugcucuauauucaaguucacugacuuuuucugucuuccauuuacccaagucuacuuugaauucuguuuaguuuuaaaguuuuucaauuagaguuauuuuauaaucuccacuugguccaucuucauucuuucuccaucuuuacugauauaguucacaucaguauagaaagaaauuucauucucauacuucuccuuaguucuauaaacauaacuucuguuucuuccauucuuuuucccauuaauaucuuuuuucaugaagauacuaauauuaugaagaaaauaauugacauaguucaugaauauaaugauaagcugaaacauaaauucccugcccccaaggacauaaaauugaucuaaaguggaucaauaugcuuaauaaguuuauauuaaaaaucauuuuuaugcauaccucucauaugcucauaaagcaaucaauauaaaacaaauguaaaagcuuguuuuaugcuugaauucaguugaugcccuagaauucacaaguuuuaagcauuuaccagcaccauuguguuucaaaauuuuauaguacuuuauauauugauaaucaacauuuaaaaacugaauacauaaaauggucuaaauaucauuaauacauuuuucuaaccuuuugcuauuuauaauuucagacuuuccaaauguuuucagugaauugacuaaacaaauaguaauaucugagguaucaaaauagucauauuuauucagguuucaagccacaauuucuacucccaaaauauggaggcacacauguuaauggcucuuuuuuuuccaacuuccuaugcccacaguuacacagucuacaguauaaccucauuaugucaucauugauguucccucuucaccaguggcaucuugggacaucugaggguucuuuagcauuucaaccuggccuaacucaaggcauguuuccauguucuguaugucacucuucacagugacagcugaaucucuguaacuauugacuuuuuuucuaauugccucaucuucaugagccucaaggaaaccgcaguaugucuuuauucaucuagauccaugcguucucuauguguugcaagcucuuuuaguuuuuacuucauacaguguugauccgguacaauucuaguucuuguugauuaauaccacaucugaaacucugaauucauuuuacuaacaugaucaccauuuuagugacaguucaacaaaucaaacccuaucacugggaccucgaaguauagaaggcuucaaaauuuuguauuuauuuuagaugcuuauuguauccagacuuucuccauguuauauuucuaaaacagcuuucugaaagaugcacuacauuuuagaucuuggcuguacugcauccauucacaauaaauucuuccagauguuugggauggcaugaacuauugacaagaugacuccagaaauuacuuauaucaauaucuacaacuuguugggaucuauuagauaaaugguaacucgaaugcucauacauacuuaguucauauuucccaggcuugguaccaguuuguguguguguguguguguguguguguguguguguguguguaccaguuuugaauacagauugacaauuucuacagggggaaaaguguuuuuggaauuguauguauaacuauggauauccugaaagaugaaucuucaggauguuuuguaucuagagggaacuauacaccggagaaauucuaucuuuagaauacauuguuuugaagaauaauaacaauccggccuaucacaaauuucuuugauaugaaguggguuuugaugcauuccaaauucagaaucagcuguuccagauaguacaaacucuauuuuugugccaucuuuugccugaccucaaucauagccuucuaguaauccuuagcuuuuguuuuauggcagucucuagcacauuuggaaugaaaugacauaguccagcccagauacuuacugaaggauaacaccauucaucaccucuuucggaauagccaauuuaacuucaagucuuuuagcaugggcucaaaccaaacaaauccugcacccacagcucuccuuuacucaggggaacuuugauuuuuuuuuuuccaaacacaaagcaaugaauucuaaagcacacuguacccaaguuccuggugacugaaaauaucuuugacauuguuugcagaaaggaauuaagagcuguuucagaaugccuuaacugcugucuacuugcuucacaaacagaccacacaaauauugacaggacuuaaacuaauugugcuaccacacucauagcauaaaaucagguccagagcuacaauuaaugcauucuguuauauacuucauuuuucucauugugagguaccucaaauacaugucuaaauucauaguaauucagcagcaaaauaaacuccugcuuccuuuucaguagcccuuccauuauuaagucccuuaauauauuucuuuuuuuaaaaaaaagauacauuuaucuauuuuagguauacaaguacacuguagcugucuuuagacauaccagaagagggcacauuggaguacauuacagauggcugugagccaccauaugguugcuagguauugaacucaggaccucuguaagaggacuuagugcucuuuacugcugagccaucuccccguaccaauguauuucaagugacauauuuacaguucuugucuaacuucaauggacugggcuucuuugaagauaccuucauuucaccaccuuuugcuuuuuagccuauguauuauuggucauaguuucuauguaggcuauuuuuuauguaucauauauucuuuuguuguugaaaaagaaauguuuuaaacaaaguaauuuacaacuuuggaaauaaucuauugugacaaccuccaaaaggguugcugcauuuugcuaucuauuguuuauuuauugacuuuugugaccuaaaucuuuaaggcuuucuucuuugcaauggagaaccaaugaaauauuugcucuuucaacuuauuggucagguaguuuugggagaacuauuuccuuaaaugucccaaaucaacaacucuccuagccuuugccaaagggaguggguggaggucgggaccugcauugcuacucagaaagacaacuucuaauucugcuuagacauaacucccaacuuauacugagccucaaggucagcuaggguugaaaaguuagaccccuaucuggguuuuccuagguagauguguuguauaaauaauaugccuucccagggugaaaucacuuggcacaauuagagaugaauaaaagggaaagcuccuuaauaauauuguaggaccagcuuuggcuaaugcucaaagaggaaccagcauagaauauauuuugcuaacuuuuauacaccuuacacauacgcauuccacaaacacuaucauccuuaauucucuuucagguccuggccccauguuacaguuugaacaauuuaaacagggacaggcgccagcaagucuggccacuaaggcagacuggaaacuuacacagcacagauacugacuagugccaggaucauuugaaguacaccagcacuguucuucacaaacaauugcuccccaaucuuaucuugcccaccuggcugaauuaucacuuucucaagagagaucugguucuuuaggccacuugauaaaaacauguccuuugauauggagauggaccuaauggcugguuuuaagucaggguugucucccagcucauaggaauggggcuuaaggguuaucaguuugggugaacaaucauuuacauccccgaauccuaaagucucaaagucucccuuaucucuaacaggucugguuagcaaguuacuuaucuuccagggcagugcuccuuaaaguuugcuugugugguuuaaagucuccuagaagcaagucuguuaguaaguucucuuaaagucuccuagaagcaagucuguuaguaaguucuucuuaacaucaacucuuuuccuuugaguuucuucuauaugaaaaaugcaguucugagcaggcacacagcccuacucaugcuaaugaccuucuaaggacuagguugauauuuuuaaaaaaagugacaaaacaaaacaaaaacaaaacagaacaaaacaaaacaaaacaaaaaaacaacaaacaaaaacuuugaacaucucauucucuggcguuuccuuuucagauuuuugacagcuuguuuuugucccaagcgguuuguuuguuuguuuguuuguuuguuuguuuuaacagacccagguugcugcuggguuaagcuauggccacugauuguuuuugacaaugcuucuagggagaagucuuuucacacggaauaaacucaagucaaauaaagauaggccuuggggaaauaauuuuccagggaacguccagacguaguaaucauagcagcuaacugaauuuggaacuuugcagaaaguaaaaauuugucccccauccacugggggugggggguuguuggggcugcuggggugcugauuuucacagacauguuaagauggucuguguuuaagccuaccaggggauuggggaaaaguaaaaugucaagcucaaagugcaacuacauucacuguuguuaacaaaauucaacauuguuuugugacuauaggcucuuuggaugauuacuaguguucuguuaaauucuaaaauaaaaaaaagagcaacuuugaccucuuuugauagaauucucauugcuuuuacaggggaaagaauuuccagaaggcccugcuauuuucacugggaguacuugacaauuuucaacucaguggcacuaccacgaaugguacugaagacagcaucaucugaacuuuucaagcagcaugagcugagcuugggcuucuagcaguuacccugucuaaaugugugauauuugucugcagaaaaacuuuuauuuaugauauggauugguccaugaaacucuguaacuauaaacauuggucuccaauuaaaacgugccacaacugaggugauuauauuuauaaauaggcuuauaagaugugcagacaaugugguagaaauauccauaguauauauaacaacuuuugcucuuuaaaucuuuugagugcagucuaagaucacaauuguucucugauaauuuuacauagugauagcucaggcugugggaucagcaugauuaauuaaauacugacacggugauauuuaaaaaugacuuuuaggacugguaauagaacagaaauguaauaaguguaauaauuguuuaaauaacgauaacauuuaauauuuaacccaaaagauguuugucauaaaacuuggggggaggguauucagauguauaaucccaagccuguaaucucaacauccaggagcaagaggcagguaggcuuugaugcuaaggccagccugugcugcacaacaagaccuugucuacaaaaaccacagaaauguuuguaauguucucacuucugugaugaccgaccuggacaagaauggaacaacauaagcuuucuccucuccccuccauucuguucuacucuugacaugccuucucucaucuaauugccuuuguuuuccuuugugaguuuaccuuccauauaagcaucccuaaacgaucuaauucugguuuauauagguuccaacuuucacacuuguaaucuguuguaugcauuccauugugacuacuuccuuucccaccauaguuuugaggcacuucucugugcuauuguagaagucugugauugauucauuuuuauuguugugcaguauccuauuauagaauauaacacaauuugccuguguuaacugugauggacaaccugaguguuucuaguguuugacaguuguaaagccauguauaugcuuagacuuaccuccuacuguacauagcacuugaauucugucugacuuauuuaagaaacuguacaucaguaguuuccugcaccaauguaacaauggguuggguuuguauucagacaguggaaaagggaauuuuccauuggacaccuggcgugaugagacuagaggucagaggaugagaagugagaaggcucuuucuuucccucuauucugcccacaucuuaacuauaccauagcauuuauaccaugagaaccaggauuagccaccucuaguauaugagauaauguauaccguggagugugugugcauguacgugagcacacacacgugugugcaugcaugugugcaugugugugugugugugcacucauguguguguuagaugcuuuugucucugugacaaaaauaauugaggucauaaagugauagagcacaaaucucagcuccucguuucagagauuuaaaucugugcguaagugcccccacugcuuuuaagucugugugguaggcagaagaguuaucauagaaaggcaaggaagacagaagccgcuuaccuuauagguaggaagcacagaguggcaggaagaagccagagacaagauaauguucuucaaauacauggucucaguggccuacuucgugcauauaacucaucgcugcacuaauggauuguaucacaauguucuccacuguaaaaugaaaauaacauuauuucuuuaaagacaguuguugaaggguuagcugaguuagacuuuugcauguauguaauggaguaacauggucuuguuaguaguccuaauguggaguaaacauaacucacuggacugagcauuucagaguauuuugagaucuuugauuuuuuuaaggacuuguuuuugauuacuugggaaaagcauagagugggcuggagaucuaugacucagcaguuaagaaagagcccuuguuucccuccggaagacaaggguucaguuccuaacaccugcauggugacucaccaucauucauaacuccgauuccagacaauccaaugaccuccccugaccccugagggcagcagguguguacauaccgaugagcaaaacccucaugcacauacaauuuuaagcaaucuuuuuuuuuuuuaaaaaaaaguuuuuuuagaaaaaaaaaagcagggacuagcacaaaggucacucucucuuuaguuguccugggucugcugagugacaaaauaaagcccaucucaugguucagaaacucagcuauuuguuauccacccaaacugagacaauuaaaaaaaugccucacauuugacaucugaguuuagaggggccaaaguaauaccacgcaugucuugccucuugguccuguuugcugaauaacguguuucaguuuucucccauguagcuguucuuuccaucaggaaacuugcacagugguccaacccaaaagcuaucagggccuuuucagaucuagucucagcuuauuccuuguugcaucuuaccuguccaaccaaugccaggacuagccuguaucaaaaacagccucuucugcuggguguagucacucucaccuuucaacccagcccuugagagagagagagagagagagggggggggagggagagggagagagagagagagagagagagagagagagggagagagagagagagugugugugugugaggcagguggaucuuuguggguucgagggcaaccucgucuacagagugaguucaaggacagacaggccuccacaaagaaauucugucuccaaaaaacguucaaauuaaaaaaaaaaaaaggaaggaaggaaagaaagaaagaaagaaacuagccucuucuacuugaggacaggaaaaccccagacacauugaaaaugaaucugcaggauaucauguguuguugucuucuuuuagaaguaaucuagcauaccuagauugugagccauuggaaucagaacccauuugccucuguugaaaagggacuugccuaugucuccacuguuagucucaagugaggaacaagccaaagguuuguuuggggaaagggugugugaaagagaugaagaaauuagucuuuucuucacagagugccuugccaccagcuuuuucguccuccaauuugacaaaauaagaacaagcaaauguaagauuccuuagaccgcuggaucauccuuagaccgcuggaucauccucugagcucucuuccucuugagggucauggaaaaucuaaagcaaagaagauaaauaucuuggguuggcaguucaacaaaggcuucagcuucuagauaguguuugugguucucugaaauaacaugaacacagugaugucauccacggacaaagucaggggaagggagaaccggccuauuggaaccucuggcuccugaaguuuucuccugauucugcauuuuugggugggagcaugucaugaaaauguguaggguuucuugugucuuuaaugucaaguugguuuucuuuagcacugaucuuugacuccgaggcauccuugaugagacuccguaggaauuaacaaaagcugcacauagucucuugcccauuugcuccccuucacauugcugcuuggccccuuccuccacauucuucagcagaagacccccccuaggcaacgccauuuuuuuuccugugcacaggauccucaccagccuauaauuucuccuucuuguaucauagauccugacaucccaauacucauuuuuuguccucuccuuuuacccauauugccucagcuaccaugucuaucugugccaugaagaucuauauccuccuagcccugccugccugaccuucauucugauauuacaguauauaccuggagagucauguuaacagggcuuuggccuguggacuucucuaacccuagaccuaguagggcuaacagcuucuguucauccuugccuuaaaauaagccaggguggcaaaucuuaccaagauacacguacacacacaaauaggcauauuuuauauauuuauauauguacacauaaacauaaaaagccacacacguauuuccauagauaugugugauagagauagauauacuuuaguugggacuaucaucauacucaguacaauaaagcacucagcauugauaaaaaucaaucuaguuauaugcagacacaggcacauauacacacacauauguaucgucauaugcaauucaaacguauacacacaaauaaagaccauacucagacccaguggagguagcagcagucuccaaagggguuacauagagauuauaaguacauacauguagauuaugaagacacugacuaucaugacuucagaggucugaugguaauuuugaaggccaucuagcgcauaauagcagcucacagauaauugcaccgcccuaggacccuuucacauucaagagaauauucaggcuucgucccaggugccuugccaaguguuuggcauacaucacagcguuuaaaucucacagugacccaggaaaagcaaaccucaacccuagcugucucucucaacacaacacagauggccugcguucccuuugguuuugagaaugcuuucacacgcauuacuucccguugauuuugcguguugcaaucacauuguggaguaggaaaguuuggcgugggcauccucaguuugcagcugagacuaccaguuucaguaguuuuguauauuuauuccuuuguuaaguucccaugugcuuauuauguuccuuauaacuuuccuggacuguccuagguauuaaaaaaaaaacaaauaaacaacaacaaaaaaaaacugggugagacagaggcuugacuucaaaauaguugucauuuuccaggggagaaagaccaguaauaucacgguaucacaugccagaggcugggacagagacuuggaaaaacuggcuagaguaacugguuuugcggaugaagucagcagagcuggccggagcggggggugggggggggugggggguggggggggggcuuuguuagaaaaacuguuuuucuauguagugcuuuuaucuguggaaaggcugcuuggcuucugugaaacuguaaaguuagucaaguucaccuuuguguucuugcaagggcuggaaggcagaggcgaucaacggcagcacgguuucuaagugcaauaggaguucuucaauuauuuaggaaucagucggauuucugcuuaccauggcuaaaucguuauggucacaaaaaccacauauuuugaguguauccuuuaaaacuggcugggcaguuaccuaacucuuuuagaaaauggguuacaggugaaaaaauuccaacucaaaaccacguuaaauguuaucuuuucuaugacgaucauguggauuguuuggauuuguucuuuucauuucuaccugcaguuucugcagucucucucccucuuccccacugaauuccacucuugaccccucacucuggcccccuccacuucauucuucauuguauggagauuucugagcauacucacacagggguugcagaguagcguaguauagugccaacccucacuuugaaaacuagcgacaauuucgcuuagccuucuuucaugcuugucuucguauugucacaccuuugggagagaguguugcuuucaaacaacuacagccuuuacuuugugagcgagugagagcaggaauacaggagguauugaagagagcggacauggaagggauuagaggaggaaagggaaggcggaagugauguaauuauauuuuaauucuuaaauaaauaaaaacuacgguccuauuauuuacaagguucuggaggagugccaaagaagaaugggaauguauauauauauuuucaaccaucaucacuuuggaguuggaaagagacacacacuuuaagugagaaaaaauaaacaaguuuuaaugagaugucacacguggcauuagaccaucuaggagcaugcagcucaccuggacgagguauuucuggcagcuuucaaccagaagaaacaacauguacacguuuuugacugaacaccucagacgagaacaaagcccaaugcaagcauagcuacauaaacauuuucucuuuauauaaagauaucauuguugucacuguccugggagcucauucaauuuggacuuuaggauagcauauuugccuuuuucugucacuggaacuaugacuucauuuguuuccuuuucuuccauuuucuguaagucagccuccuuaguuggggggggguuaagauaucugggaauguacuaugcuaacuacaugcuaguucauaggugaaaaacuggaaaucuauaauuacaguacaaccgugagccaacaccaucaccagcaauacauaugggcagcagcuucaauuaaaagaguuuaugacuuauuuuauuaaugugucugucugcgugugcacaccacgugugugcaggugucugcagaggccagaagaaggcaugcaauucccuggggcuggagucagaggcagcugugagcugccugauguggaugcuaagaagcaggacuccaguccuuuggaagagcagaaaguacucauaacugacaaaccaucacuucauccccucagauguaguuuuauucccagauguauaagcugugguaguauuuccauacuagaaaaaacuuaacguaaauuaaaagagcauuggaaaguaaacuacaguucgucuaaacaagaugagacauuauaaaugcauaacuuauuaaacauugcuuacuuguaugacauugcauaauaaaaaacaguauacaaaauucuauauccaagaaugagcucaccucuauaaaaagugccuggaaaugauauuggaagguaacgugccaagagguuaacacugguugcuucugaaauguaggguuaugacugauucuuauuuuauuucuuuuuauacuuuucuuucuuuuucaaauuuccuacaguaagcauguaauuacuugcauaaucagaaaaacauuuuuuucuaaauaaaaagacaagcaagucucauaaucccaaugccuagaagcagaucagccaaucuguuuugaauguuuccaaggcagugaaccaggcaaaaaaguaagaaggaugauuucagaguccccaggggagacuuguauaguuaguuccuaggaaaccagaaguuuuagccacucaaaacacauguaaguguuuuuggugugaaucaaaaccuuccauuagacauaauuucaacagcagcuguuacacaaccuguauaaacuauuuuuggugugaaccaaaauuuaaacaacauagaaacucuguuaacuauuucauggucccauaggugcaaaccucaucuaccacuagccaggauuagcugccuuuauuuaggggaaaugccugaaguuauaguggggcugagaagaaaggcuuggccaagaaucaggacaaccuucccacugucccuguaacagcuuuguguuacucccuuuuuugaaggcuuuugacauggcuuuaagaaucaacauauuaaaggaaaguccuaaggaauucacagccauucucauaagaacaacagaacuauguaaauaauggcaucauauucucuuucuucugguuccucucaucaggaguaagcaauguuaaucugauguguaucuuuauaccuuucucuaugauuuauaacacguuuaaacacacauaguggauaaagugccuccucuacgucuuuuauuugaaaaaaaaaaggacaaaauccugggccccauccuaggauuuuuuuauuaauauuuauuuauuuauguauuuauguauuuauguauuuauuuauuuauuuauuuauuuauuuuugguuuuucaagacaggguuucucuguguagcccuggcuguccuggaacucacucuguagaacaggcuggccucgaacucagaaauccgccugccucugccuuccaagugcugggauuaaaggcuugcgccaccaccacccagugcuuuuaccucuuaauauauaaugaaguuuaugucuaugagcaaaaaucauuacuuuuugguagguauuagagaaaaugagaagauguagcuaaaagugaauuauuuggcuugcaaaggacacuuaauuuuuuccuuuauucuuggaaauuucauacauguauacaaugaaauguaaucauauuuacuaccauugaucccuuuaacuccccuaauaucacccugcccaaaugucccccucuaaagucuauggauuuuuuuuccauuuuauuuuuauuuuagauauuuucuucauuuacauuucaaauucuauccugaaaguccccuauacccuuccccugcccugcuccccaacucacccacuccugcuuuuuuuuauagccuaccaauucuaguuaguacuucccauguguguaugugcuucugguauuaucuagaucauggggaaucuaucaguggauauagacuagauaaagaauaacuuucccuccacugacaacagcuugccaguaaggagugagguuuagauaucauccacccccaucuaugcuggaaaccuggcuagcuugagcuugugaaaguugucuauagguaagcacaacugcucuggguucaugagugcaaacagccauggcaugacuagaagacaguaguuuguagccugucuccccauccuccagcuuaccaaaaaaauguuuuaaacaauguugaaaaauaaaggcuagcuuagaagauaucuagaacacauacagugauaguccuaaugguaaaaagaucuugcaaauugaaaagugcguuaagaaacauucugagauacuguuaguuaccaaggugcaaguuaagaaauacucuuugaaucaccaacuaugaaagagagaggaaaauuuaggugacagagaagcuaaucucuuacauagacucaaaaaugguguuaccugaaugaccagucagaaucccuaaucacuuucugucaaauauaacugucauucauuuucagcuuacaccugcauaucaugagaguccauccauggaccaagcccaugcuguuuagcuccuuugucugcuggcuagaaguaaaucauaacuauauacugcaaguaugugcucaaguauuuuaucagagaugcugauaaaaucagaguggaugaccugugucuggaccaccuacuaaaacagauaugugugucccuuuguuuuucugggguugaaccauuucuuuauaaaaccuuauuacuagacccaucugauguagaguuuggugggaaugaucaacccuaggucaugaugagcauuuguagucacaagcauacuguuuuccuaucauccauuuguuccauuuauacuagggcccaaagcauacagguuauuuucuaaaggccuauaauuaaccugucuuaaguccuugaggucuacauugugauuaucuccauaggcuugcuauaaauuccaucuagccauuucccugccccuauaggauauaauggucaugugcuccaaacagcauuguuaguguauagaugcugcagagugcuuucuuauuuuggccucugcucaaaguauagggaauuugcaucaccuagcauaugggucaggacaggccuccugucuuuuaccuagguuguaauugcuuagcccccuacucacuggcaccuaaaaauuuauuaaugugguaagcccuuuaaucuucacaaggguuacccuccaugcugugaguaauuguguauugcucaagcuucuagugugaaagcaauuucuuguuuugguuaaguggaucaaugggacauucugugggauagccagcuuucuuaaacuauuuuacaguggaagcuuagagaguuaacagagcuauguagcacaaugacagaggucuauuguugugugaggguguggcucagagguagaguguuuacaugacauauagaagaacucuggagucaaucuccagcaccaaaaaagaaagaaagaaauaucucacaaauauguauucaugucuaauuuauauagaucugaaccuucuuauuauguuuucuaaacaguauagaagggaggaccuuaacauguuaaauacuuaaaggccacauaucaaauacccaaagauguugucuuaguuaggguuuuacugcugugaacagacaccaugaccaaggcaacucuuauaaggacaacauuugauugaagcuggcuuacauguucagaguuucaguccauuagcaucaaggugguaucagggcagcauccaggcaggcaugauccaggcagagcugagaguucuacaucaucugaaggcugcuaguggaagacugacuuccaggcugcuaggacuaggguauuaaagcccaaguccacagugauacacccauccccacagugacacaccuacuccaacaaggccacaccuccaaauagugccacuccgugggccgaacagauacaaaccgucaccaauguguucaucuucucuaacaaauaugccaccucugacacagaaauagaaaguaggacaauaauuugaugauauuacaacaucugucaucuccuacaaucuuccccacuccggaaauuagaauggaguaauucaucauagaucugauucuuacacauuggaucuuuaagagugauacaaauuucaauaucuuccugaugaaaacaauaucaccugugcaauucuccaucuucaaacuuuuaaacaauugacagaaccaugcaguggauaagcaaaaaaaaauguacuuuacauuuauauuuuauugcauuggcuuuaucauuuguuucugaguucuauccuaccagcccaucuaauuuuuguacgcauuucaaaguuacagacaaaagaccauuccucuugaaacacugcugcaugcaugucuuucaagaucaauguucacucccaguuuguuguuguugucguuguuauuuguuuuguuuuguuuugugaacaguuucuuuguucaugguuccuuucaggucaauuuuucacauaauaacauuaaaaaaguugaucuuuuugacaaugcauguagcaagcuuagucuaccauucaagugugucuccccaaacauaccuguucaccuggaacaagccuuccugggugaagaaacacgcacaacacauaccuuaaauauucccuuguacaccaguuaggcaaguguuucuuccuucugaaugccaugugaccugaagaaaaaucucaauuaaccacuggagaguugugccccuggccagcuggcacuaagaguuaccaaguuucacaaagacagauguugcugaagcaacaggacacuccugcuuguucugaagcaucaggcgcccccuuuccugucccuugaaauagaacaugucucugauucucccuacagugcucugacacccuggucauaauuugccacaguaacaaaacucuaagcacccacgacucuauuaaaagccaaugacuaauuccuuggcccccaaauaaguccccaaagaagacagggagucacuuuaaauccaaguacaguacaaguggcagauuucuuugggaaagccucauuuuaauucagucuugcaguuucaugucaucugugaaaaaaaagaagaaaugagccucacuuagcuuuaguucggauguaaggaccuuaggaggaaguggaagaagagccuucagccauaaguucuggcucugagccuaaaugcucacccauauuaagagaaaacaaaccagucauggugacccaugccuguaauccuggcacucuagaagacuagaagaacaguaugcauucaagagcaucuagaacuacaaagaaacuagaaggaaagugagagcuaacuaccacgaccagcucagugagagugcuugcuuagcauaugaaaagguuuguuugaucucugauaaccaaaccuguuuuuaauaaaacaauaaaucucaaguuugggucaaaauuaaggagaaaaaaaucaaauuucaaaucuggauacuucuuacccauauuagugcuacaauuuauacaaaagaugaagcaaaggccagaaaauauggauguggaaauuuagcugugagcccuagcucccuaucaugggagauaaaccuuucuccuggcuuaaggggccagauuaaugaacugaaucauauuuagcucucagcgugacaugucuccuagagaauucuaauuccauuacaguggagcauuuucuuauugucaucacacaaggauuggcagguacagggaaauuguaggcuccagcuucucucucagcaagccuuuucucucgauucagagcagaucugaggccaccugcuaugcuaucccucuaacuuuccgcaccaccagcccuuaggucugagcuccaagcccugaugugcucucccgagcuucucacagaauuuccucaugucucucaugcuuccuccccaggcucuuagccagcccuacugugccccagugaccuccuuccccagggagguuuccaagcuuaauugugcucaagugugugcuggccuuuacaggcuucuccuccaguaaaguagccucccuaauuuagcucucuggauccauuuagaucucuaauugagcugucauuuggagagugugucuugcccagcccugcccuugauuuucuuuguauucuggugaucuguuuguuuccccccgggucuuuacaaguugaguuaaaaucaaaucuacaugccacauucguggcuguaaugaaaugcuuuuaaaucucuguucaaagugguuguuugcauuauauuccaaauguucucuuuggaaugccaaagcuuuuuccagcagcaacaagccacuggagaaauaagcauuaggugcaaaucaagcuagaucaguaaagugggaaggcauugcuuucuaauugggaacugugacauuagaaacccucuccauugguguguuuccaucuucugugauuucuucuguguaguagggaagaaguugccagaaaauaugaagaugaagaagcgaauuacagccuggcauauugguacauaacuaacuguaguucuagcucuugggagguagagacagggggaucagaaguucugagucuuccuuccuuguauagcaagcuccaagccaucuggagcuacgugagacccuugucucaaaugccuuuccucucccucccccaaaacaagcaaauuacauccacccugugcuuguaacaugauuugcgcaacuagagcccgugcccggucugaacuuagaccccauccgaaucacaugaagugguguugggagggucugagaaugugcauuugugacauuuggggcaggugcuguuggacuaguguaaacauauggagaaccucagcuuuaggggcugugcugaagagacaggaaggucaagggacucuggacccaggggaacucaugccgaggcaaggauugcaucacaugaucuguaagagguccuagcuggccgaaagcaggacucaggugucuacucaugggucucaguaguuauagaguacaaguuaacccaaguugggccuugugacaaaagccuugcucuuuguggaguuuuucuaauucuugcugucaugucucauucuucccacaugaggagagaguggugaaggaaaauguggcacucaucuucccuggaaccaguggcccaugaugagcccugaguuccagagcuguagcaguugagaacuaccuacaguaacucucaggcugauggccccaugugguggcugagaaugcacaucuuugaaaagcccaagcgacacugacuucuugacagaaggggcuacgaaguaaucuguguccuuaagacugaggggccugugacagugagagaccggcagaacaggggcaguuuaaauauauacugaggauuucauugucaugggucagauuuuucuagaguuaugacuuugcaagaacucugccaguuuacauacaauugcaaacuagucuuuaaaccauuguuuggauuagguaguuuggguucagggaagagaacuaagagugcagaguucuaugacgcuuuagagguggcauucucucaauuuuuuuauuugcuucaugaauggcaggccaaaaauuccauuucuugcaaugaauaaguagcuucagagagcguaugugacuuuccuaauauucuauagcuuaugacacuuggaucccaacuguagucuagcucuaaugcccuuccuccauguuuacaauugccucgacuuuauucuugagacacccaaccuucagcaacuccaaggcaaugcuggcagucacaguacaaagaguauuccuucuccaggaauggguuuguuugaagaaagccuaagacuccuaaaguuguacagcaucucugggugauauccuguauccagugauugcucaaagguggcucagaaauaucuggcucccugugguaaaccacgaucucuuggauauuccauuggagaucgucugaagugucccugaagcccucuuaauuuucacauccuucucuggucagcacuguuaucuuuuccccuguagguguuuaucccaagagugccccuuauccuucuacccagaugcucugguucagccugcuuucuugggaagauuaucuguuucuaagaucacaggucaauucaguagaggagucaggacaggaaccagugccuuccuaugcccagcuuuugagaggcaccgggcagaucuccuacccugauuccuuuucaggcuucagcacauccauccaggcacuuaggguacaugaccuuaaggauaggucagaauaugguaggagaaauucacacacacccuggaucccacauucugauaaugcccaguaauucuguaugauuccucuagggcaaggcauuugacccugcccaagugaacagaggucaagaaauaacaaagaucacguagacuggucagaguuuauuacccaaaggcccuagaacaaaggggaucuggccuuuauuccuacaccucugccccaggacagaaacucacaggaaugauagaggguucugguacauccugcagaagcauuuccugguuugguguagcaaaccccaggguuucacagcagucuacugcucuggaauccaucuuccuucacuuaugugcuagcugcuguaaaagccuuguuuggggguugacauagugaaaguuuaugucauggcccuuugauugccccauggagcagcaauaauagaauuugcauagauuccuuuacuaucuuguuuagugcuuccuaguggcaccaaagccagaggaagccagguccuggauucuuagcagcucacuugccuugggggaaucacuucugacauagaaagcugaggaggaucugaggaaugcuuggaaccccagcuaccaaucauguuaaauuccuaugaggucacaaauccuacaaugguaaaaauacagucacaaugcccagaagcaagcaggacaggaagaccauacgugcacaucuuagaagaagacagugagccuguugagagauggccaaggcuugaauguaagaaucaagggguaaaacaaggcuuuccaaaugaugugcuauguuuauggaggaagaaauggcaguaggucauucugaaagggggacugaauuugucaggagacauaaacaauccuguuaaaguauuuuaaaauaaaccuuuuaaaagaauuauuuacuugauuuaugacuauauauguguagcuguguggguuuaauuauuuuugcaccaauguaauacauguacagagauuauuugguugucuguacuuucauguauuuuggaagcuuuaaaaaaagguaaguuuaaaagaaaagacaaacacaaggaauucaauggagaaaucugguucaaagauaaucaucuugauguacauuguuuuuauuauguuauuauguguuuccaguuaguuuuuuuaucaauggguucuacauauauacauguacuuauacauuuuauuauauacauauauuuauuauacauguaucauuacucaugcauauacacauguauuuauauuauuuaguuaaguuuauauaguaaauauauuuaaccaacuucagauuuaaaaccuuuugaacugaacagguacacuuuuuaaagaagaauucagcacaacauugauuuacauaguauuuacauuuauuaaacacuaaaaguaaucuagagaugauuuaaaguauaugagggaauaaggguagguuauaugcaauugcuacaccacuuuauacaagaugcuagagcaauuacaaaauucggugucucagggauucugaaaccaguccccuguggacagugagcugauuggauauacguaucuauguuuaaaugcauacauauauacuugauuucccaauaaaggguaccauguuacccaguguuucaugucuuguggagucuuuguauuugugccaaguagagagagcaagggcaaauuaaagaaauuacuccauucaaacuuaguucaaugaaccaaugauauuuguguguguguggagcggggccacagguaagggguuacuuacaggaacaugggcaauucaggcaacugcuuuuccaaaaagccugaccucagcaugagcuacuacucacaaaaagcugcauuaccagcagacccugggcaacuuacacauuucucuaccauaaaagaauugcuucuuccccaccaauuguuucccaucuuuauaaccccuuacccaguuucaugagccuuauggggaaaguuaauuucucaaaaaaaaaaaaaaaagacauacaaaaagccaauacauuauuucaacaugcucauuggggcuugauggugcaggccuguaacuaacuccagcuacuuggaauauugacaaggaugaauacauguuuaaccuucuugggcuacaaaguaauuucaaggccaguccaggaaccucaaugagaaucuaucacaaaauaaaggauaaaaacugagcuggagagagagacauaguuuggugauggagggacaagacccaauccuagacacguguacucaaaacgcucaguauggcagaaacgaaaaucauaauguggcaacaccucacucuaguuaaaaaugacaaaaugagaaagaaaacaauugccgguguggauguagagaaaaggaagccuuuacgaacuguuguugcgggugcaaauuaguacauccauuaugaaaaaaaaauguauggagcuuccucaaaacauuuaaacauagaauuaccuagaaccagacacagaauuaucuagaaauccccauucaguauacauauccaaaggaaauggcaucacuauagaagaagagacaucuucacucauguuagucacaauggcuacaacuuacauuuuuacauuuaacuuaaaugucuaauaacagggaaacugggaagugguugaguaaggcagucauccguagaagguggccagcagcuuaaguugcuggaaggacuaaaggcugguacuuuacccaucaauaaggcaucuauagcuggacguuuuugaaaaacguuuucguuacaaacagaagauaaauguaaugcugggcgugggggcccucccugaugucugagcauaugcugaggaaggaagauacagagccagaggccugccugagcuagguaaugagugucucaaaaacaaaucacucaguugggaaagcgcuugcugugcaaggaaaaggaccuaaguucaauccccagaccucguguucuuaaaaaaaaaaaaaaaaaggaaaaagccaggguuaguguccuuuuguaauccuuaccaccaccaccaccaccgagagagacggaaauaagcagauugcuggcuggcuaaucaccccaugcuuacuuagugauuucuaggcuguugaaagacccugucucaacaaacaagaugaugaccuuuggcuuccauguacaaauggacacgugaaaaccucgccacccauaagaacacauauacaccugcgugcgcgcgcgcacacacacacagaaaaaggagucuggagaaguggcccaguugguaaaacauuugccauacaagucugagaaccccaguucagauccccagcacccacauaaaaaugacugcaaccccagugcucacaggguugggaguagugauaauggugguaggggugcuugcguagugugcccuuccaggaccuggguuugcugucaacacuacaugaugacuccacagcacagguaaauguagacucacagcaggcaugcccuuuaaaaguggaauauaggggcagggaaauggcucagggaugaaggugcuugucacaagaccugagaaccccaaacuuacagaagguggaaggugagaacuuaacucccucaaauugugugcugaucgccacacgugcacacagacacacaaucacacaaaauaagcaagcgcaauaauuuuaaagacuguugaaaaagcauggcugugugaguuuggaaccgcagucccagagacaccaggccuucaaaugucaguggugugcaaacgaugcgcccccaagagcacaaacacacaaagcugcauauuacuuuaugcgcauccuauaacauaaccaacccccuauuugcagcgaguaaauucaguuucuccuacuauaaagucucccugccgguuugaaggaucgguaggccguuugccaauugcauucuagaaaguuccuggugcuuccauaagcuuucgaaguagcuagugggaauaauuccccuuagcuccagccuaucuucccagauagcaaaacugcaguccuucgaaauucaaagacuugucuuauccugccuguuagucaugaagccuaagugggacuccagaaaucccaugcacgcucucccuccucuugccacauucccgccccuccccacgcaccgccauccccccuccccucgcgcuuucccgcucggccgccuggccuauggcaaacgccaagaauuaauuaggggcggggauggaggagcgucugucaggagaucgccauauuucuguacggcccaggggcagcccuggcagucggugggucaggagaggugcugacaaggcggggcgggcagacgcuggguuccuccggcuucaccccucccgcuggggacagguggcugcagcgcgccccgccucugccagcugcgagugggaacgagagagggccaguccgggacggccaccgccagcugcgagucgggggacagcgcgaucuagugcggggacagccggcccagggguccggcagcagcaaaccgguauccuggcggccaaaaaaaugcuccuguaccgaggggccccugcgggccccggaacgccgggaggcggacuggcccgggcgggcagcgucccgcaggccuucaggauccgccugagcacgguagguccgggggcccccgaggggacggacucgcgcgagcgcgcccgggucccagggcugcggggggcgcgcggggagggcugggcgagcugaggccucacgcgggacggaaccuucucucgcccccagaugagcccccgcuaccuccagagcaacuccagcagccacacgcgacccuucagugccaucgcggagcugcuaggugagugacgagggcgggccggguggcgggucgcaagcccgaggcagaggugccagcguggugcgguggacgcaagaggaaugcacgaggcgcguggggcggguccucucgggacgggcugggggagcucggccaccgugaucucuuagggagggggacagggaggguaggguggggugggaugggguagggugaggugggguggggugggguaggggggcgacgggacuagaucgugccuggaaagccgaggaagcgagguguguacuaagaguuugguaggguucccgcgcuguuguucugucuggaucgugauguuccagucacuuuaggauucuuaguuaauaaucaaagagcaaugcauaaaaauaucgggccccgaagcgacuggauuugaccaaggcuggcgaccgacagagggccccaggcuggcaaaggaacagugcagagggcccuguagaguaguuggaaagaucuggaaaugacuucuuuaacuuuagagacuuaagucuaggaaugaugggccaucucuuagaugaugacacgagugcauuuggcucccggagacugcagagggcuggguccguaguccacgagcgcccucacaccgcuggaaugaauacggaggccuuaaggacuuaaccucugggugcaccggugcucgcucaaaaaaaaaaaaaaaaggaaaaaaauucacuugauuccuuagagcugagugcaucgcuucugcacuaauguacuguucaaaaggcaaagaugaaaagcaguucugcgcaaaaugcagcagagcaagcacauuauaaauauuucaaaaacugaaagaaggaagacagauuuauauggcuaguuagcacagaacaagacucuugaaaaugguuucagagccacaugaaugaaccccaguggggacguaagccaccacuguggccaugccaggagacuuguuuuccuaaagaugucggugagccacaggaagagucagaagaguuauuuggaaggugcuggaggauucugaugauuaguuuggcuaugagcccaaaugguauagaguagguugcugauugcuuucuagaaaguucaggaggaaaguaacauugaugauacagcuugaauuuccagacugaggugacucuaucguuuagguuuuccccuaugguuuuuucuuuuucuccuuccuuccuuccuuccuuccuuccuuccuuccuuccuuccuuccucccuuuuuuuuucuuuugagauagcgucacauuauguaguccaguugaccugaaauuugcugugcagaucaggcuggcagucagcacacaaagaugugccugugucugccucccaaugcuaggauuauaggcucuugccacuguacucagcucacuggaugguauuuuuaaagcauuaaauuaaaaaacauagaccugggcuaauguguguauauuauguacauauauguguauacacagauuuucuuauaaaaaaaaaaccaagucacaaauauuaacagggaaaaggaacaucagaguguuuauugauaaucccaaacuuucuuuuuuacuuuuucuucaaguguuuucucuacuuccucaugaauuuuuaggaaaucacucauuugauaaacauuuauuaaucaucuacuaugcacagggucaccaagauagguagaaaaauggauaugaccaaguucuacuuuauuaacagguaugaugaaacauguaaaaagguuuuaucauuucuguagcaaccuaguagaaaaggacgugugcaaagagaagcacacacgugcugcaggcguacagaagaggagggacuuaagauuaucaggaccagaaggggggucagaaagacuucguagaggaggggacacuugagaagagauuuaaaggguugggacauguggauauggugaguguagggacauuccacucacaaguaacaacuggaugagcaaaaccaugaagaauauccucuaggucuuugaauuuaauuagagcacugaguucacaaauaggagacuguacaccuuuaaagaguuuacaacaggcuuucgaaaauaacguuguagcuuuagccuuggaaguggguggcauuuuuuuuucucuuuccaaguugaguaaacaaaggucugggaaauuaguguacuuuucuaagguuacaugucuaguaagugacacuuugggcugcaagcacaggucauuuuacuucaaauuccaaguaggaaaugagguuagaaaggugagcuggaaccaggaugugacugggaggcuuggcauuugaccuguuagccugacaaggagacguccugauuagaucucugcuucaggaugguuggucucacaggaguguagcuggagacguggauuuuaaugacugguucugaagcaauugcaguaauaccaaugagcaagaguaaaccuuguguacuaagaaaaggaccuuaagagugggaagagcaagauacaacagagccugagggcaucuagagcagaaggacagauggauuaaagaugacuuuuaaaaacgauuucuuuuuuuaugaguaugaguguuucaccauguaucuaagugucccacaugcaugagugcagugcccauagaggcuagaaguagguguugguuccccucgaacuggaauuauagacaguuguaagccaacauguggguacugggaaccaagcccagauucucugcaagagcagcaauugauuuuuaaccacugagcuaucucuucagucccauaaaaacgacuuuuuaaauaggaaucaaacucacaguuucacacauaccaggcaaguauuccacugagcuaaaacuccagucccuaaaguggguuuugagauuuaugcuugccauuugaauguagaaacucacuguguguguuugucucugucucucucucccucccucucccucucucucucccugcccccccccccguguguguguguguguaaaaguagccuugugaccaaagaugaugaccuuauauauuuaaguauuugcaagccugucccugacaaccgugcaaauauccacgaacuggaacaggaacagauaggaggcuugugaaauaccauuucaaagcagucucccauccuuuaucucucuugucacugaacaacuugcuaaacaucuccccacccccgcuccccaccagguucuggugaaguaugagucuucuguuacagaacaguuuuagaagacaggggauccuguggacugggugcauauguaacagcuuaggauauuaaggauucucauguucuuauuaaaguaauuugguagucaaaggcaagguggagacagcccucucacuaagggauuagcauggaccaggacaggagagcuaagacucuacuagucuaugaaauugugaagccagacuagacagaugaagauaggguagcuuucacccagcuauuagguaaagaagauuaaguguucucucauugaaucuguucauagccuaaauggucugggcucagguagguaauagagucccugggaugugauaagauaugcuugcuacguguguuggcugauucuuacggagcugaacagcaagagguaggauugaaacugccugccuugcuagugcauugcaaguucauccacugaggugaggcuggucaaguuguuaucauuucauuuguugaggaaaggccacauagaaccagaaaguaagugcaaagcucugccuguuggcccacgcgugcugaucucuauuccccuuauacuccaucagacacuaaucucucuugggccccauacuuucuacacuuuaugaacccucagcucauguaugacugcuccagacagcuaccauguaacucaggaacugccucuguucagauuauuugaugcacgccuauaaaacaaacaaacaaacaaaaacaaucuaguaaugauguuuggccaaaauuuucaugagagagagagagagagagagagagagagagagagagagagagaauugauuuuauugauuuuguuagaaacccgcaaauugauucauuucgugucccaguguauacguguguaacuggagucaauguguguuacguguuugaauugugaauguccacaaaguauuaggaaaaagucccugauagucaucauuuuccauguauaaaugauauccagcugguugacaaguuguauuggucucaauggcuuuggcugucuaccagcaggagugacugauaaaacccugcgugccaagucaaauuuccugagugcugacagauauaaaaugcuagguccuucugaugguuaaggaacagaaaaaccugugggggugaacucucauagaagcagggagagggggaggggauggggguuugcagaggggaaacugggaaaggggauaacauuugaaauguaaaugaaauauccaaaaaagggaacuacauuucuguuaauacuaccauuauguaccaacacacagcuuagcaaauauagucccaguacauugucacauuuauaugggccuuaagucuuacuuggaccuuacagauugacucuaauagaccuuggaacccuucuaaagcuguccagauuuuuuuuuucagauuacagccagugacaauuuuaucaaugauuuugacagcacugcacuguuguaggacuugaaauuaaucugugucucauuuuauuuggcagacauuccacacaucccagugguuguaacugauacugauaauuauauuguaaaagaaauguauauuuugauuguaagagauauugcugauggagaaaauggcaugauuugaucaaugauauuaaugcaaaaauguaaucagaauuccacauggcuaugucaacccagcuauaugguuaucaguaaagccauauauaaugucugcaagagaaagauauauagguauauaggagggaaaguauugcuuagagaacuauuaggaagagaaauaacuucgguaccuagcuguguaaguccauuuugugucacuauaacaaaauucccaaggaucaauguguuguacauaaguuuauuuggaucaugguucuggugccuagaagguccaaauggcaucaugccagcagcccugaaagggcccccccuugugaugucacaaggcaucacagugugccagagaagucaaaacagagcucaacauguacagaaaggagccaaccccacagguggucuuggacuaaaacaacccauuuuaguggaaaccaaucuaguucccuucuaaugugacagcaucacucuguuccaagguagcauacuuagugaccuaauuaccucauacuagaccuugcuucuuaaaggcucugccaucucauuaauacaccagagacggagcuuccugcacagaagccuuucgagggcaaaccauauucaaacaauaguauacaaccuuuucuauagaauauacuucuaaccgggcaagugagccuuaaugagacuagcuagcaauccacauauguuaaugacucuaaaccauugucuauggcaauagauguggccuuucagauagugccauucauucucugauauggaggacuugacacauuuaaucugguuaaguuugaugucuuuagaaucuuaaauaauuagcuguuugggaagauguacuucaggaggaacaauggaagauucuaugcaguuuuuuaacuuaauuucaguuuuccauuucaaggggguagacagccucauauuuaauacagagaaaagcagcagaaucagucauucuaaacagacccacugccaucacugggauuuaagcagucaauuacguauuuuaauuuuaaccccugacuccuucagguccuuauaacuauaaaaagguauugcaaaaauacgcccccccaucuccucuuuuuugagacagguucuuacuaugcauauuugccuauccuggaacucacagaaauccaccugccucugccucaagagugcugggauuauagguguauaccaccacaccaauacccauguucuuuaacagaggagaugauaugaaaaagcaggaaaugauuuuuuuaauaaaggaacuguaauguacauagcuuacauccauuuuuacccaaacugcugcuucaacuuuuucacucuggccacauuuuacugcucgugaucuguaaagugucuugagaggcaagaaggaggaaagccaaaccaaagcaaacugcuuugcaaauaacacguuuuccauagccccuaacuuuuguagggagaaagucagauugcagugucauccuuugugugaaaacugggaauuagcuguguggccccaucugccaucuugucuguuguucucaaucacucaguaagaggaccacaauuccugccuccuuaaguauaggagugauucauaggaaguaauuaaagacagauuugcauaucuugauacugaacuggagauuuugguaggcuauugaaaggagaggucuaauauuacaggugucugucuaccuuuugcagauaaugcuguagauccagauguaucugccaggacagucuuuauagauguugaggaagucaagaagaaaccguguuugaccuuuacugaugacggauguggcaugacaccucacaagcuccaccgaaugcucagguaaaaaugucuuuauucuauuuuuuuuuuuaaaucuuggcuucacaaacuccauugaaggccugauaacuuuccauaauauuuuaacuuacuucuauuuauccuaugaacguuuauuaagcaugucuuagugucaagauauggaucgugaagcagacaauauuucugccuucauggagcauagaauccagcuggcaaugaagaugauuaaagcagguacccauaaugaaauccgaaaagcacaauaauaggaaagcgugagauguuugggguaaguccacacaggcacccaaucugaccccagaaaagaagaaaauggucuaagugacacccugaauuucuucauuuaucugagaucguccucagucccuaacucaccgaaacucauucuuaaaccccauguguuggagcugagaucacucauguguuagaaccgugaaagagaaauagauggaauccccauccacaaucuuagaagguuuuauaguacauccguggaauugagaaaugguauuugcuagcuauugauaagcugaagauaaauuccuaucgccauacugaguucauuucaucauuuuuaaacauucaugguugagaauguucgugcuuuauugucuuucccuaucacucugugcaagauggguguuucuucaacucuucccuucuuuauuuuuccuuccuagcagaugugguuguuaacucuccgugugcuuccugagcuagaccguguaaaacuuggguaacaauggagcagugcugaggaggagggaagggacucagcauccuaaaaaaaaaaaugaaaaacaaguucauuguguuguaguuuuaugggaaaguuuuaugaauuagucauuuaugggggcucccuuugaucuuucaaagaaaccaaaaaauaacauuuggucaaaguaaaugguuauguuuuacuacuaaacagucucuauauuuugccuuaguuuguguuuuaagaaaauauuuuguuuuauguguauggauauuugccuacaugcauauaucacagauucucuauagaguuggacucacagacagcugugagcuuccaucuagguucugggaauugcacguagguccuuuggaaaagcagcuggugcuguuaaccacugacccaucucuccaguccuucuucucuuggucucucuuaauuagaagacuauuugaaugccagguauggaagcacaugccuguaagcccagcacuugggaucugucuuacucccuaaaauuaauagugcauacuaaaagaaagacaauuuugguaggcuagaacuauaauauguuuaauucugauuuacuauauuuuuucgaaaaagugcucaucacccagccacaccuguuuuuuguuuuguuuuguuuuuuuuuuuguuguuguuuguuuguuuuguucaagacaggguuucucuguguagcccuggcuguccuggaacucacucuguagaccaggcuggccucaaacucagaaauccgccugccucucacaccuguuuuuguaugugguuacauguauguacguauuugugcaucugugugcacacgcauguccauguguggaggcgagagguugaugucagguguuuuccuaaauuaauuuccaacuuuuuucccugacagugucucauauugaaccucaaauuucucuucagcuagauuagcuugccagccauccccagauaccccucugcuuccacacccucagugauaggauuacaggcaugcuuuguggagugcagaguuuuauguggguacuggagaccugaacucagguccucuucuuuacacaucacauaguuuacucaccaagcuaucuccguagcuucuacugaaaaucacccgauugaccuccuccuacagcaucuuacccuaguuacaugggcaucaaacaguagguccagcgaauacaaacaccuuccuuuuuuuuuuguaguuauuuauaugaaaguugauacaguuauaagauagaagaaaggaagaggaugguuuaaaacuaguuucaggggcuucagagauggcucaguguuuaagagcacuggcugcucuuccagaacacuuaggguuaggcuccagcuuggugaaagugcuuuugccaacugagauaucuugauggcuugcaaaaugacacuugaggcaaaacaugaagggccaguaucaucucauugaaaauagggcuaggggugaggguuagggugcggguuagagcacuugcucuuuaucuuuaaaacuuaauuuuagaaagcauugucaaugcauacuuaguguagugcauauacuggguauugcuugugauuguaucucagaguaaacgugaaucagcuaaaaguuaucauuuguuuaaagaagaucauuuaguccagucuuaacauccaucccuagacucuacuucccaaaguuguuuuucuaccaguacacaugaccagcagguaugguucuaacuggucuauauagcccuagcucaucacaauuuuugagggaaaaaaaaccacucuacacuuuacagguaguuucaaagauaacuguauaaauuaucuuuucuauuuuucaucuuauggcauacuuacuuuguauuuggaaaaaaauaauagaagccauucugcaaacugugcaaaaucauugcgccugucacuguggauugaccucaagcauuuauugguauccugugccuguuuuccugacucaugcuccucuuccuguuuucuggcugauaaaccaggcgguguaagugaaggagcaguuucuuucauaaacacagaaucccaugaaaauuuaacucaaaaaggaaagucugggcugacuagguacuuccccugagugacacagaacuuauaugcaagauccuauauauaaccccagcuccuuaaguaggaagaaugaaacgaaaucaaagaagaccuuucauucaguuucuuuaaagccuacuguccuguuuggcuucuuggauagugugugaaucuggauauguuuguacccuauguggccuuucccagcaagguggaaagccccuuugaaagaucaaggauuaaaaagaagcacagagccggggauugagggccuuugcugccuccgcucagaaucagguaucauaguaggucuguuccaaaacagcagcuggagaguaaccguaugcuugucaguuacagucacuuacaguacagguuacaucaccacgauaucuaggaaacaaacacgcgaaagucugcucauguauuucccucgauuuuuugcuaagguucuuuucauuggucagcuucccaaauuacaucucucccuagacucuagauuccugacaucuucgggguaguccagaggaaguugcuauguucucguauuccaucagaagugcuaggcuccaagacccuugacuuacaaacaguguuacuuguuauacgagaggguggaacaagauagacuuaaugaagacgaaccaucuaagccaagauggagcuuuucacagugucuuagccauagaaagcuauauaaacuuugcuuacacauuucugucauuaagcauggcgagugcuuuuguauuagguauuugcaguuaaacagaacacuuaaggugggaccuuuggugaaaaucaaagcaaucauggaagagguagugaaaaaagaagaaagcaaagagcugccauuccucugcuccuugcuuugucucuuuccagauugguuuuaagccugccuuuucaacuuuuaccaccugaucuucuuaagguaacuaagacaaugauuuauacacaagcaggagaaaauagauggcaaaagggagaagagacuagaaaaauaaaagauugacaguuugucuguuguaccacuuuuccuugacuacuuaacugaaaguuuuuuugugguacuaggaaaaaaaaccacauuaaauucaaaugaccauacaaauucacuucaugaggcagguaaaaggccuguuuauggagagcucugaauuuuagagcucucauuagauguggagugcagauagggaacaguauacuccagucggaaggaauccuagagucgguuuaaaguuaaagauugaauauuacuuuauaauuaaugcuacauagacuguaaguguaucuuccucaugaccuugucuuuuccagccuacaaaaauaucagaaccuuaccaguuuauaggccucgcuuccuggaaucauuaagguccaaauguacuguuaacccaguguucucuuuccagaggaccacuuccaugaaaacuguuuucgucuccuauuagauuuauucguaggaugcacagagaccuagagaacaucaauacauuauuacauaaaauuauguaacagaacauucaaaagcugguccucuuuauugggcaguaauaagaccacagucuucuggaaauggaaaacagguaguugaaccaucuuuccaacuggaaggaguaagaccagaaccaaccugcucauuugcauuaugugcaggcagaguccuuucacuaauauuggaaaaguacuuacuuucuaauacaugaaguccaucaacuaucaguuuugaggacaagaauaucagcuuuauuaauauuuaugucuccagugcuuagcauaaugcauaacucaugggaguucaaaaaaaaaaaaaaacuagugacaguauacaucaguguaaaauugggcaaccuggagacauacaagccucaaaaucaguguuauuuaugguggcggaagguacaagaggacgaucauuuugugggugucacauguguaaauauucuuauacucuguuauuuggauguauaucagaguauuuaaauggaaaacauaagaaagggaaggacucugacucacagaguuagcugaugacagaguuuacugaggugacucagugagaggccuuuaauagaacaagagcgacuuuauacugcagcuguuugcagauauucccaggcagaacuaccuauuuuuaucucuuggccgcauuccagugaucugucccagcagagggaacggaggcuuaaaauugggagggcuauccuuuggguggggaguuugaauugucaagauaaauguucuccuuucgauucuuagagggugguaugaccagaugaaaagguguuuagucccaguaccucauuuaguacugggcuuuuaugacccucuccagguaaacgacucuuugcacauagcccuaccuacuaggagucagggcucauuuauugaaacuagaaaagcagcuccuccugcuauguuaggcaguaggaaggaacauugcauucacagagugugacucuggcauauagaacuguuuaauauugaaguacaaacaagccaaacuggaaaguuggucucauagcccaaugguaauuuccuauguuuugccuggaaguaccaaaaagcgugaaaaagaacuucuuucuagucugcacauguuagccaaauucucucuguuaacucuuuuaggaugcuuuuuuaccuuucucauuucuuuuucuuuuucuuuucuucuguaauuucagcuuuggcuuuacagauaaaguaauaaagaaaagccagcgucccaucggggucuuugguaaugguuucaagucggguuccaugcgacuaggaaaggaugcucuugucuucaccaagaaugggaauacucucgccguuggacuucugucacagaccuaccuggaguguauccaggcgcaggcgguuauuguaccaauuguuccauucagccagcaaaacaauauccuuucuagaaaugggagagcaauugguuaaaucuuagucugacgacuuuggcagaaucucuucuucaggccaaauccagcuguuacuugauauuccauauuucaaauguuuuuuauauuuaaagagguauucaaaugucucaaacauaacugaaauguccuuuuauuaaauauuuuuuuaaaauauugaaccauuaaaagaaguugaaaguuucuccucuguguucaaauuuucacugcuuuaguaugauuuauaaaaguauccuuuggcuagccacuguuccaugguaaaguucucagggccuuugccacuaaaggcuacuagaaauguccuauuuaccagcauaucugcuagcagaaugguuuauuuauauauacccagaugggcucucauuucugaagggagcaauauagccagaaaaauugaacuuacugcuuucagauaguuuaaaauuuugaccucgaacauuuuuuuaaugaaguacuaucuuuguuuauguuguaucuuugcagcuauauucugcaaguauaacugauuuugcuguuugaauaaacagccuuuccaacauuccacuuccuuuuuuugguagcaauaaugcccauccuuugugugugaauuuugugucuacauguaaccccaagggcacucauuuguuaauauuuauuaauuuacauaacuguauaauaauguguuucaguaucacauucucauguauauaauguguuuggauuauacuugcuucgcccucucuuggccccucccacugacccucuuccuuuucacagcuaggccuuuuguuuuauguccuuuucugugacccagggaguuucaugaugacucuuccuucuugcuagcauccucagaagauauucauuuucuuugacugauuuguuuuuacaaaaaaugauuguuacugaggauucuuugcccagccuagaagccaucuugaacuauucgauuuucaacugugaaaaagaccugcugucucaguucgaugccauuccaggcaaaaaaggcacccgaguucucauuuggaauauccggagguauaguauuacaagaauauuaaauucccaugagcaaaugaaguaugauaaaguacauuuucauauuauuucauuuguaaaggaauuauuaauuuauuuuaugaauauggguacauugcagcuaucuucagacacaccagaagagggcaucagaucccauuacaggugguugugagccaccaugugguugccgggaauugaacucaggaccucuggaagagcagucacugcucuuaaccacugaguuaucucuuaauauuauuuucuagaguugaguggauaaacacugagauguauuuuuaucuuuuugcauacagcucuguaacuuucuugauucuguugaaauagugguucuuguugauuaaauguuguguaaauaagguaaaaauauguauguccugagacuauugcuguaaaugaucauaauaauacaacguaacauuauagugacauccucaguguccuuuacaauuucauucauauauauugacauuguuugaagauuggcagauaaugguuauuuuaugcauuggucaguuaaauggauuauaagagagauuauagugaaauauacaugauaguuuaaaaccaagaaauucuuuacuaaugaucuuagaguagcuuggaauagagaaaaaucuucaaagcagcucaguuuuaacuauaaugaaguggaauuaagaucauaacuuuaaagcuaauauaacaaucaagagaaagucuaugaugcaucuuuuaauucuggcauagcaaauagaguacauuuaggaguguauuagagcuuaaaugcaaaaaccuuaaaaccuuuugauauagcaaagaaggaguacuugucuguuaaauggaauaauccacacacaugcgcaucuuuuuuuuuccuaugggucaaguacuuaugcaauuucuuguuuuguuuugauuuuggagacaggguuucucugugcaguccugguuauucugggacucacucuguagagcaggcuggccuugaacucaaagauaucugccugccuaccaccaccaggcauauauauauauauauauauauaaaauuaaaagaaugcuaguuucuacagacaguguaaauuauaaugaaaaauaagcaguaaggaggacuuacgugccccuauugggaaaaucaugaugagauaauuuguauaaccagggaucauuuugcugugguuccaaugauuuacacauauuaaacagacucuccccuuuauacauuguuucucaguuauacuuagaaaguuguauggucaaauaauguuaagaaaagcuuccuuaaagcuuacuguguuccuuuguugaaagacuuugcagucacaugccuguacuaauauuuaagagagcaauauaguauuaguauaucucaauuuuaaaaauaaaaauuaaaaaaacacuuuuuuccugacuuuuuuucuuggcuggggaaggugaggggcaaggacaauagggaucuuucucagaguguuuguauuagagugcacuagaauaguaagaaucacaguuaucccgaaaaaaauccagaauacacuuuuacuguggugugggcuuuguacaggcuguaugcuacaguggucccuggacaacuugagccaguaguaugaaugagguuaacauuagagcuugagguggcucuccaggcuaagaagucucucgauuuuauuuuaucauacgacuuuuauuucuauuuuucuccuuauuuaagaauauuuccagggacuacuguuccauagagcaaauuuuggaaacuauugcccugauauacauugucuuuguaacccaucuuaaaaaaaaaaaaaaaaaaacaaccaaacaaauguaagguuggcuuuuuaauaagggugauacuuuacauuuucccccugauauugguuaaugagguugccauggucuuggaaggaacaaagcuaaauagccuaaauaaauaaauaaauaaauaaauaaauaagaaagguccauaugaaagggauaccaguuguccuauguauaugauaauuccauauuuuagagggcaagaaaauaaaugauguucuuuagcacuauagcaguguguguauuacuuuuuaaccauuuaaaagauaguguuaggcuggcaugauggugcaugccuuuaaucacagcacuuuagagccagaggcagguggauauauauguauauauaugcauacauauauauuuauauauacagagagagagagagagagagagagagagacauaggcagagagacagagagagacagagagaguuaguugagaucuaggucagucuuaaauacacagcaugacccugcauuaggaggagaaaagacacaggaaugaaucuuggcuuucugcuaauaaugccagcagcaguugauuuggauucaucuacucauucaguuggaaaaagugauauuuagugacuucuagcaggacucagaaagcuguuauuuaggauuuugcauugagaauagcugaaauccauucgauucaucaaaucauagauauuccacauuccuuuuggucuuuccuuauaagcuuuguauaaccaacaguaagaaacaugacagauuuauaauaagaacaacuuaaauauuguaugguccucaaauuacauagguuguaguuccuuuggagugguagucagggaaagaaacauagcugaguuugguuuauauuucauuucuguuggguuccuaaugcaaaccccaccccuacucccuguugaagccaguuccucuuagauugguacuuaucucuuucacucagaaacaaagauggaaagucugagcuggacuucgauacagaucaauaugauauccugguaucagacuucgaugcugaagaaaaagagauuggugguguuaccucugagcugccagaaacagaguauuccuuacggguaagaauaguccaucaucgacagugggaacuagagucucccacagugggaaaacauuauagagcacaacugaagugcaguuguguagagaagauucucugcuaggauuccauuucagauuccuuuucaccaucuacaccaaagcagcuuacuuacuguauagcuccuuucauuucaaaaugguaguugaaauacuguaacaaguauagaaacuaagccaaauauuugccaagccuagggucaggaggcuagagauguuuugaggagauaguuguagaauugguagcauguauaacaauuuuccuuuuacaaauccauaggcauuuuguaguauucuauauaugaagccccggaugaagauuuuucugcgacaaaagaaggugacuacgcagaugauugcuaagagccuggccaauguagaauaugauauauauaagccuaccuccacgguauccuuacauguagcugacauuuuuauuucaggguuaaauugcuauauugguauacagccaaaacacuugccuuguuucuaauucaaaauugugugcuaaaacaagccuacuggauccuugaagaaagaauuuuuuaagggucugcaccaguuuuauuagaaacucccugugaacuguuaaaugaaauucauguggauuugaaggcuggggcucaguagauuauaaaaucuaauauuuauuuauuuacuugucucaagacagggccucccgcagcuggccuggaacucacuguuuaguacaggccagcuuuaaacuugaggugauccuccugccucagccucccgaaugcuaagacuauaagaauaugcugccacaccuggcuuucaaauauuuuuauuagaaauauuuauuuuuaagucgucagcauauaccagugagcagccagauuugagaaucucuuccauagauauccacauuacauuuuuauuuauauuggaauugugucacauuuauauugauuaaaauaaaauuuuaguuggacucguuaaucuuacaguuuauguuguacuagguccagauuuggacuuggaugugaauuaguggguggaaauuaaaguuauuucuaggaggagaugaaucauuaacaagcucaacauggauuuccugggaacuucucguaaugacagccacuaagaagagcacuugcucauucucucuaccucauugcacuguaaguggauuucagauacuagggacaaucuuaagaugaacuaugcuaauuaaccaucuucacucgugucguuuggaggagaaauuagucuucagaagacucagaacucaagugcuuaugacaaauugcuuuuuuauuuuauagugaccaagaauauaauucuuggaccuagagacauguucucugcauuuuaaaaaucaaagacauuauuuuacuuugucuucuuuuuuacuuguuuaaaauaaacuguguagucuuuacucacaguggauuuauuuauuuuuuucccuuuugggaaacacauaccuucucuaugaggaaauuuacuuugaagggcccaaacaagucccacauagagucagagcuagcaaguaagaaaguuaucucuaacuucaccucauguagguuaagaucgguaacacugugugcaguuagcagagucccccuaaugacauguuuucaacucguguguguuuaggauacgcguguuccuuuccuggguccagcuucuuauguuuguggguuucuaucagaccaacuucaaugcuugcauuuuauauuuauugcagcccccuucccacuaguccagcuuccuucuucuaguuaaauagagucacuguaggcacgacuaaaaugaaaccccaaacacuagaauuauuuuccugagaugccugcagaacaagguaauugauacugauuuauuuauuccuuagucaucaacucaaaagccucuucacuccucuuuguacucuucguacaaauuugaugaugcauuuccucccacaagguacccucggcccauuacauaaaauuuuaagaguguacagcacaaaauauuugacaauuacuaucuuuaaaaugucaacuuugggguaugugaauuuugauuaaguugaaaaauuuugucuuacuucuuuuauuuuuuuuuugagcccagaaaauuuuagauauucugagugagauauaucuacaauuaccaauuacaucauguuucccauggugccugacccauaucauaugguaucgaugaacacagcuugucauuuccaaagucuguguacguguuuuaaaaguaucugugacagauagcaagagaaauaaugggaagaagauugacuuuagcucaugguuucagagguucaguccacugggcaagaaagagguaguggagcagaguagcucgcuuacuugcuggcagccaaaauguagagcccuguguggugacacacaauuuuaaaucacaacacaagggaggcaaaggcagguagaucucugagggcaaggcuagucugucugaucuucagauugaguuccagaauagccagggcuacaccacgauacccugucucaucccccucuccagaaaaagaguagagcaagagaauguguuuguacagucugucuuuguuguguuauucacaugcacugacauuugguggguuuuguguguguguguguguguguguguguuuucuauaauacaauguuucuuuuuuucuuccuuaagccucugauguuugccuccuuaacgauuugcuccucagaauaagcaggugagaaucacguuuggauucucuugcaaauaccauaaccaguuuggaguuaugauguaucauaacaaccgccuuauuaaggccuuugagaaagcaggcugccaguuaaaggugagugcuuaauguuuugucaugggggccugcaacgaaugggaagagaaaucuuaauggguuucagccccuucucaugauagugguucaagucugauacuaaaauccuuuagcaguaggugaggugugcucuguggaaaaauuauuucucaagugcucaugcagcauaaggaauugagcucagugacaaccacaucaccauguguauugccuuauuagcauguaaaauaucucuuaucuuguggagacaauaaagguauauuggaagguucauaaaauuuagugguugaaaaagaacucgcacaauauguacucacugauaaguggauauuagcccagaaacuuagaauacccaagauauaagauacaauuugcaaaacacaugaaacucaagaagaacgaagaccaaaguguggacacuuugccucuucuuagaauugggaacaaaacacccauggaaggacuuacagagacaaaguuuggagcugagacgaaaggauggaccauuuagagacugccauauccagggauccaucccauaaucagccuccaaaggcugacaccauugcauacacuaacaagauuuugcugaaaggacccagauauggcugucucuugugagacuaugccggggccuggcaaacacagaaguggaugcucacagucagcuauuggauggaucacagggcccccaauggaggagcuagagaaauuacccaaggagcuaaagggaucugcaacccuauaggaggaacaacaauaugaacuaaccaguaccccggagcucuugacucuagcugcauauauaucagaagauggccuagucggccaucaguggaaagagaggcccauuggucguacaaacuuuauaugccucaguacagggucaagaagugggagugggugaguaggggaguggggggggcgugugggggacuuuugggauagcauuggaaauguaaaugaaauaaauacccaauuaaaaaaauuuagugguugaaaaccaagauuuaggggcuggagagauggcucaagaguuaagagcacuaacugcuuuuccggagguccugaguucaauucccaguaaccacaugguggcucacaaccaucuguaaugggaucugaugcccucuuuuagugugcaggugugcaugcagauagagccuacauacauaagauaaaaucuuagaaacaaacaaaagaaaaccaaacaagauuuguguccuggguuuucuaucucuaaguucuaucccugggcuaaucaguucauuucuuugagguucaaugucuacgcuaguaaaguagaaacaauguuuucuuuaucucccuuucagcuuaaagggcugaaagaugauaaguaugauauaugauaugaaauauuucauaagccaaacuacgcaaauguuaccauuaucuuugauguuuuaaugaucauuuaaaguagcaauuuccacaaguaaccuuuuuguuccuguuuugaagauuaaaucgcuauugcucagagaauaagagacugcuuuguauuacaguuuacaauauaccaguauuacuagucgagcaguuauauaagacccaggcuagcuaacuguggauagcuugguuuguccuguuauagcaucuucuuaaacaauuccuaguuaugugccagucuaauuauucuuaauucuaguaaagaguaaagcaagcuuuaaaccaggcccccaaaucccuugcacuucaucuucgacucugacaguugcuuggugaccucucuguguguggacaugccuaucgugugagauucaguguggucauuauauuacaccucaaauuuucaaaugagauuucucuccaguucugcagaacauuaguauauaauuuugcuuuuuagcaguguaaauucuuuauucuggugaaucuuucggcaauccuagaauauaaaacacaugaaaaugaugauguauauauagcuacuggagcugagggauuauagugaucugugacucacugaacaaucuaagcgacagaaacagggggaacugaagagccaggaggagaaaagaaaggggagacaauaauugagauauauuauauauuauaugaaaaaauguacuuucaaaaauaacaugaaaauauagucuagguguuccucuaggucucuauggccuuuccuuacccaugaauauuguguaaccuuggucacuuguggggggggggugugugaaaagcgaaugccuccaggcugucaauaguaauguguugaaauuaacauuuuucuucuaagccaaccuguggagaaggugugggaguaauuggagucauugagugcaauuuccuaaaaccugccuacaacaaacaagacuuugaguauaccaaagaauaccggugagucacucccaaccugagauggugcagaugaguugcucagaugccauugugcucuccaaaaaccucuaaaccgucacuaaaaggcagcuuguuaggagaaauuaacugacaauucucucagauauauuuuccaugacuagagaugauguugcucuuuuuaaauuuaccuuaagaaauuaucgacuauggagguauuuugguacgauauuucugguaaaauaaaggaccuugguuuucaucucgaagcacaugaaucugaaguuauugagcacauuuuggggagagaaauugaaauuugcccuuuaaauugucuugaagccaguguacacuuguggaaaugucaguacaacaggaagauauuuaugcucucacggaagcauguacggaagauaaauugcuaagaaucagaaaagaacuugacucugagguuaagccaguuuauggggauauuuuaggaaucgaugagaggaguuguuaaaaugggauugaagauggguuggggguuuaggauacaggagagauuucuugcuuaggcaugccugacgcccuggauuugauaccucuuaugucuuagagaaaggacagaggaugaaaaaguagaaaccuugauuguuaugaaaaaaugugguauaugaaaauaugaguuagguacaucuaaauuaacucacauauauaugcaaaaugggacuuuguuuauuguuuucugagcgaaguuucucugugauacugugccuuuauuagagcuuccucuguagaccaugcuagccuugaacucacagagaucagccugccuucugacucccaagggcugggaucaaaggugugcacugccacggcccagcugaggagaaccuuuaaauaagaccaaagaaaaucaaggaaagcuucgcaaaaccguguauauuuuaguuuaaacugaaaggaaaauuaaugucuccuaggugaaccaaugggaaggguauuuuaaguaaaaggauaguagguaaugacacaaaagguagggaagagaaaaugugagaccauuugcugauauauuuuuuuaaucccaguaauauuuuucuaagaguggaaggaaaaauaaucucucagaaauauuuuuugugcucuaaccuaugacaaaauuaaugaaauguuucuuuguuuauaugagaccauaagaauugaugagaaacccuuuagaugcaggguuugacaaagagauagcuauuugaauggcaaccccaaguuaauuucugcauaauuggguuugaaucacucaggcuuaucaguaguuauggcaguggugcacccuggauccaaauaaauuaaucauuuaaauguggguuugaaccauaaugaagaccuuugaccaagacuugucuccuaaauauaaaaacuuagagugcuauugcuuuaaaggaaccaaauauuguuucuuuugagugaaaguagugaauuuaggauaauuaccuaaauaauauuugugaaaucuaaauguuagcuauuaaaaaugauuucuaugacuuuccaugcucuaucauuguuaacaccauaaaaaucuguacuucuuucaucugaauacauuagacuugaguuuuuuuuuagagauuuacuuauuuauuuuauguauaugaguacaauuauagcugucuucagacacaccagacgagggcaucaaaucccaucacagaugguugugagccaccaugugguugcugggaauugaacucaggaccucuggaagagcagccagggcucuuaaccucugagccaucucuccagcccagaccuuagauuuuugaugccuaguuuugguaugauaaauuugagguuauuauucgaagguccaaauaagggcauucuauaaacauguaggauuucuacuuaaguaguuuaauagauacuauauauuuuauuacaauacuaaccuaaguagaguuuugugcauaauuaauuugcuaauuauuacccaguucaggcaucauuggcaucuuuuuaaaauauuuauuuuuauucuauguauaugaguuuuuucuugcaugugucccacauuuguucuuguugcuggcagguaacaguagaggacaucaaauccccuggaacugaaguuacagauaguugugagcuguuguauaggugcugggaacucaauuguggguccuucuucaagggcagcaacugcacuuagccacuaauucaucucuuuggcuccacuuuuuuuuaaagauucuuuuauuuuauuuuuuauuagauauuuucuuuauuuacauuucaaauguuauccccuuuccugguuuccacuauuuuuuuaagacaggaucucccauaguucacacuuggucucaagcucacuauguaggugaagguaguuuugaauucuuguccuuccuaccuguaucucacaagugccaggacaauaagaaugaaaccaccaggcccuaugaccuuauauuucuaugcuagggacugaacccaaguacuuguuugcauuuguaagugcaagcaauacuacugagcuauaaccccagccuuuuauggaaacuucaugcaaggugagagauucuagauaaaaauaaggggggggggguugaaacuagacauagggguguagaucucuaauccuaacuccaggaacuauggcaaugggguugcgaauucaaggccagacucugcuacagaaugaguucuugggcagccucaucuacauagcaagacccaccauuccuuuugccccucucaaaaaaaaaugggaaauugcaaaaaggauuagagaacacuguuugcuaucaccaaauccugugaguauuagauucaaaagcacagaugauaaaagagaugcaagcccucauacuaccggaauaucugcaaagaaaucauccauaacauagcacuuugaacaaucuguggauaguagacguuagcuguaaauauggugguucaagcuuaaaacauuuuuagagucaacuuaaccuuuaaaaacgcaacaaccagagcauauuaacugagugagccacuaacacagaacacagugacuagguuauagagagucuuccaaagaauuucaaaauugcuuacuuuaaggacuuuccauucuauuugugauauagauuaucacacaucugaaagcaguuaaauagcaguaaauggcugauagaucaauugaaaccuuuuugauacuacauuggaaaaaugcccugaggggaaaagugagaaaguaucagguaugauuuaagauaugcuuuaaacagaucucuugaguuugaggccagccuggucuacagagugaguuccaggccagccagggcuacacagagaaacccugucucaaacaagcaagcaaacgaacaauaagcaaacuaacaaaagauauucuuuaaaaagguacaagauuggaacuggagauggauggcuucgugguuaagaacagcggcugcucuuccaaaugacccagauucaauucuuagcacccacaugauggcucacaacuuucuguaacuccaacuccuagggauccaauuucuaacuucuggcccccaugggcagcaggcacacaugcaugcagagaaaaauugagguacccucucauagaagcaggaggagaggaaugggaugggggauucugggggcaaagucgggaaaggggauaacauuugaaauguaaauaaauaaaauguccaauaaaaaaagaaaggcaaaaacaccacuccaaaaaugcccauauguauaaaauacauaauaaaaaauuuuuaaaggacacaagaugucauaggggaagggaauucugauauguaguuguggcaugagguauggcauugacaagaacuccaaaggggaaguaagauggggggggguguacaagagugaagagaaagccaaugcaauugacaguacucugcacuggggcuuagagcagacacagggaaauauuuucagagaugggcagauuuggguuuuuguaggccacccagucucuuacccagcuucucaauucugucuuagaaccccuauuucugaacuauguuccagguuauaacuaaugaauucaggggauccaggugauaauuucucauuuaugggagaacagugauauuucacuucuaccuguaaacaacagaaaacaucuucaguuguaacaacucgccauaaauucaguggcuuaaaauaacacuaauugacuguucuagaggucucuagguuagacgucugacuccgaucucacugggcuaaaauccagguguuggcagccugucuucuuuucugcagguucuaugggagacuccagauugcucuuuuucuccaacauugggggcugcuagcauuccuuggcccaaggcccucuucuccaacuucaaagucagcagugaugacuugcauccuccucacauugcaucaguccaguaaagaugcuuccaucaucccauuuccuccucuaauuccgacuccucugccuuacucucccauacuuaaaggcuuacuuugagauuguuuggaauaaucuuccuacuuucaggucagcugaugaguaacaguaacucucuuacuguguaaccaaagaugcucacagaguuuagagauugggaccgagacaucauuggaagacuauuauuuugucagucuguccucuagugcuuuaagacuuauuagaaaaacugauugccuuguugcucuccagugccaucaaaagcaucagucuuaacuaaacuucguaagcucagaaauccuguauuucauauucaaaugacauuuuaugagucuggcagguacacacacacacacacacacuuuacugcuaaaauauaauagcgugaggagcacagaaccccaguuauuuaaaaguucugugucaagugaaaguucaaacugaacagaaaaaaaguucuagguaccaagcaauuuuacaaauccagcuaggcaaauuccauuaaauaucccaugaccaggcaugauuuucugaggcuugcaacacugcccuccaucaucgaaguucugcugucuaaccuuauggcucaacucucaaaauuaucuguucauaaaaacuaguguauuuuuacagcaggguaguuucaucaacuuuuauaugcacuagaguuuuggaaguauuuuauuucuugcaaugauaauauaauuacgucauuucucccuuuuccucucuccaaaugcuuccaaauacccauccuugcucccuuucaaauucauggccucuuuuuucacuaguuguuguuauauaaauauacauacuuaugugccuauacauauacauauacauauacauacuuaugugccuauacauauauaguccuaauuccaaccugcucagucuguagaauguuauuuguauguauguuuuuaacagucuaauaggauucuuucauuauauauucucuccccauuuauuccugacaguccgagcugauaaaguuugcauuccucaucucaaaacccuuguagaucuuccaugaaugugaugaaucgucauuccauuuaagaagaggcucuugacuggucuuccuuagauaaucuuauuucuuuucuuggcuucggcugagaugguugugaaggucuaugagucacaugcuuaauauugccaaagagccuuagaugugacugaauauuuugaccuuucaaacuuccuaauauauucgcaaaugauugucuaaccccacucguuauucacagaacucaucuuuugugauuuuucacuaacugaaaaaaaauuuuuuuugucgaauccugauugcuuucugagaaucagugauucauuuaaauucucguugcuuuccuguauuuuacaugagcagcuugaggacacaacuccagccgcugaccuggagaucucagccaaauguacaaauucgucauuuacaagcugugcguugcauggaacuaaccacaggacaugucuuugcuaagcuuucucugacuguguagcuaggaucagcuuucaccuuuuccaggagcgugcuguucauuucaccugagccuagauuagaagugucuuuaacguuucucuuccuaacucggcuuaugauggucuggcuauucuuugagacaaucucuauuuucuccgccgugcuucuccacucccuucugaacccuccaauuuaauuaacacccuucucauauaucuauuagcaaucuguucagugcaguuuagacucuugcauguuucucaaaacucuucaaacuuuugcuauuuuuuuuaauucuccuuuuuuucugcuuuuaguuggggccuuguguagccucaagaucacuacauagcaaagaugaccuugaacccuuguccuccaaaauguuccaggcugccaaacuucagguucaaagcaacuuccucauauuuagguguuuuuuuuuuuuuaguaguacucuguuucuagacaccacagucugccauuuuuauuaaauuucuauauauuuagauaugugugugugugugugugugugugugugugugugugugugugugugugugugagagagagagagagagagagagagagagagagagagagagugugugugugugugcgcgugugugugugcagucucaggucaugaaucuucauagcaaccaucuuuacccacugaaccaucucaaaggcacuuuuucuugucacauuguauacuugugaauuugggcugaauucauuuacauuuaaagcaaucguuuguaagggaugccucugucaucuggcaauaaaauaaagcagcuucucugauuuccuacguugcuguguuuuaugcuccggugaugcuuucuuuauaguggaauguuugaacuguuuucuccuuuccuucuauagauaacaucucacuauuuccccuguaguuagagagaaugcauuucacaugucucugccucuuuagaucucuaugaugccuaaucuccucaggucuauauuuuauuuugguuucuauuauuuuuuuagguguucugucucuucauugccauuuccauuuuguucaaaaguugcuuuuugacuuccuucacaccuuucuaggguuguguaagcaucuuaaagccagaacuuucucagagucaguuucuuuggacuucauauuuuuaauuauauccuauuuuuauauuccuuuguaugcaucaugauuuucauaacaugauaguucuggaaauaagauucuccccacuucucuaggaucugcuauguuguuuuuguguauaugauguugguaguguguuuugcuguaagcugucucugccaggaaccagguagagaguaaacuuaagguuuucuuacuuguguucugaccuguaucuucuucuggaaauucacugcggcuuucuaauauacauauguguaugguuauguguaucuaugcaugcauauguguguauauauguuugugugcgugauuuugaguaucuucauuuuuaacaucugguucacuaagcagaaaaaaaugugaagcgaugaggauaaaguuccauugcuuugaauguccuggacauuauuucaucuagcggagaagcuuguaaucauggcgagauauauuuuaaaaggccacuugcccauugugugaccacaaauaguagcaaugagagcauguaaaggauagcguccucuuuuccgaucauggugcuuacaaguggcuuaugggauacaugcaagacucucuguugaggauccagagguggagaauguggaacuauuacucugccaagaacagagacagaccaaaauuaaccacaguuuaccaucuacauguuccaaaauauuguaguuaaauaugaacuggaugacauccagacgccuauagcaccugugcgguaaauguuggaggaacauuuuucuuauuaguaauauaccucugugaucaugcagauucugcaguuguuaucaagguaaggacccuaaucccacaugccuaucuaucuuccuaggcacccauccaauuuucuuuaucaaguacauuuugaagaugaaacaaaacauaauucuguguuugggaaauuuauaacagagagaugagagcagugguaauaggagaaggauaaguuaauacaggaaccugccuaugauuauuuuaaucucauguaugcagugggaaucuaauuuaaaaugaguaaaguggaaguaaggaagaggcauacuuaagaagcauucugcaaaaauaaugaauaaugacccugaggggaaagagagguuugaaauuucucaaguuuauaguguuccagauacguguacauuugcauuaaguuauaaucccgggggcggggaagaauuugauaggaauuauucauuagacaagagggcaaacucaaauacagcuucuaauaacaguguuguaggaaaauguugaagaaucguuuuucguagcaguacuauguugcuaugguuaguguuuggaugccagggaacuauaaagacagauaauguaaagacaguuaauauuugauugugguuaauagauaagguuuugcauauacuucucucauuuuucuuuuugauucugaaaguguaagaauucaucaguguuuaugucuguccacguucugaaguggugcucugucauagucucuaaugacaacuuacucauucugugagucuguaaaccuugaaaaacuagacuguuuuacuuuggggggggcggucuuaaaccauuuuaacuucacaaccaaagugaccaucaaauauuaugauguuaacguugugauuuuuuuccauuauguuuuucauuaugguuuuauuauaggacuuuucaaaggcacuugacuccuauguuaguuuuuuuuuuaauuggagguauucaaauuuaugcugacuacuugaaauggcuggauuccauuaaacaggagcuucugagagaucaaaacguauucaaaugcugaaccuugacauguuucuugcauuuucuuucagguugacaauaaaugcccuugcaaggaagcucaaugcuuauuggaaggaaaaaauaucucaagagaauuuugagcccuuaccuacuuccaggcuaguaccauaaacaauaaaauauagaguaugaaaacauuaaggguaauguccuuccaucaaauggaagaaacaaggagaaaauaguguuuuuuuccccccaucagggauguuaguuaacuaacaauaagaaggcacauguucuaauuacauuguuucaucucuucauucuguuuuaaaauguaugugguuuggaucauaaaugugaaggguuuaaggcugucaguuuaggagagacugggggauuauugccauuuaaaucaagcacuccugggugggaagucuagaccugcuccuugauagcugagugcacuuuauaagugagucgcuucaccucucugaguuuauugaguuaaguuccaugcuuuuagaacaguacaugacauugaguggguguucaaacauguuaacaaacuugcuuccuuuuuuguucuugcuaaauauugggagugaacugguauuucagagaagaaauaggaaaccaaacauauaagagaaaaaguagacuuuucugaaucugugccuuacuaaguaaggagaaaaaaaaucaaaacagaaggcagacugcauagcaacauacauacaguuaguuauggccucaauaaauuaaagauuaaagaacuaaagacuauacugcccccucccccggccucauauuggggagcaucuacuguuuuaaaugaaaacuacuagaguaaguuaugauacagaauuuuuguuucaaauacaauccgaaugcuguguauguuucuaacuuauucuaagaucucagcucauguuuauccuccauguuuugccaaaaauucaaauucaaaugagaugccauuuugcuuuucaaaguagcagugauaaauguagugagacagauguucguauauuacuaggccauguaagagcuagcagcagaauuuuaauagagguuguuuauugaguguuuauuuaaauucuaaacauuguucuuaguuccuuauauguaauaauuuauuuacuaagccacaaaacucuaaaguauauacauauuauuacuuagaagauagaaaucccaguacacugagaacuuucaucauuuguacaggauuagacaaguagaacacagcagaacuaagcuucaaacuaagcaaccaugccccugaagcuacaaucuucuagcaugagcaauauaguauagcaucuuuagcuuccuauuuacuacaaauagaaauucuaaaccccuucuuugugccuggauugaaggauucagcauggucuguuuguagcccuuagcagagaguugcugccucuuccuguccuugucaucagaaaugaugcaggcaucuuucugcaagacauucuucuguguaaauacaucuaaaaccaaagcuaacaugaccuuuccguucuucuuccacuugugcugaaauugguaucuaugggcucuggcucuguaguuguguggaaauaccagacagcagaggucaggcgugagcuuagagcagauugcaagucuggagcaaccuaaagcaauagagaggucuaaaaguaugagggcaacuuggcuaaauagauguuuuuaaaagaggacguugguuugagugucagaacuaccuuuuauuuucuucuuuauaaauuucucuauuuguaauuuucuacaagggguuuuguuauuuuuauaacuaguaauuaagaaacaggauuuaaaacaaugaaacaucacuacaagaagucauaaaagaaccaugucacguuauugaauagucuagcagaagagcaguaaaauacuacauacaaacaacugcaccuugauaguaaaguggaccugaggugucucucuccuccuugagucuuuucauuagucccuguucacuuuccaauucaacuuuuuacuuuauguauaccgucugucauauauauacacacuauagacaguuagacagggaaaugaauucacuuuaaucuauaagugauugaguuacacaguucuagaagugacaaaggcagaugugcauuuggagaguucaacucuggaugccuuuauccuaauaaugcaaccaguugguggagccaucauuuauaguuaggaaguuuaaucaaauucuauugcuguauaugaugggcauugggaauauccaccuaauaaaagugugaaugaaacaauaugaagaugguuuugaaacaaacagaagaugguuuuuaugugauccuggaguuuagauuuggagccuuguguauacuagccaagcuauaugcugagcuacaucccuaaacuuaaaagauaaagagaagucagaaguguacauggaaggaggggagagauuuugaugacagugcuucugugccuccuauaaauauaaaauguguucagugauuggacaaggaaauaagacacuuugaugggucuuauuuccuuauagcaauguaugauacauauacuacuuuuucaaguuaauacaucucaggaauaaaauuaucucauuauuuccuugcaaaaugauucuagaauaaauauugauagccucuauaaauaaugauagaucacuggguuuuuuuuaauccacaucugguguaguuaucuauguugcucaaaguacacacauuucaaacaucaagauuauaagacuucuagccuauuuuccauauaaaagguuuuuuuuucauucuuaggacauaccuuuuaaaugcaagaugaagcacagagcuaggaucuacauaauaacauuucugguuuuccucacccaggaggauuccugaccagacauggguacaaugugaugaaugucuuaaguggaggaggcuucccgggaugguggauccauccacauuaccugcaagaugguuuuguuauuauaauccccauccgaaauucaaguaagucucgaggauucauuauucuuucaauaauaacuccugauuugucuuccucuuuuacagaaccacuuuauaucuaauccgcauucuuuagccugguaucaagccccuugugcugacuggccccacuuuaacuaucuagcuaaccuuauuuuuuucaguauacauuacaaagcccuacacucuuguaaggcacuauucccccacuuauaccaugguuacccucuccccuguggcugugagagugucaugucuguugacugaaaucaaucaggauaucccaugcuccugaugaaaucauagcaggcucaggagcugaagucuugcguggcagcuuuucaucucgauagcaauuuuuaaugaauuuuuuacccuggccuccugcaguauuugauucuugacauuuguucauaagccaauuuuuuauuuggagguguuuuuuacguguacaguuuuugauuccacacgcacuuuuaaguucucuaagccugagcuccuugcaucccacauugagugaagcuuucccauguagcuccuggagcauccguguaaauagaaucuguugcagucaauacuguugcuuuccuugguugucuuccuagugugccauauguuccuuauagcagccuaaacagugccugacagaagucacuaguuaccuuugcucauaagaaaccuggcgccuuggauccagcugugaucuuuuacauagucuuccuuuuuucagaccacacgcugguaaaaaaaaaaaaguccaaaauggaagaaaguaaaugaaugaaggcuaggucugauuuggaagugccccucauagucuccacgugugccuaagcucuuucuaggcagaggaagugaggcuguguggucagguuaugggauggacuagaagaaguuccuuguugaacguuuucuuucuuugccuguguugucuuuucucuguuuccgcuuauccagaagggagcuuucuaagccauuuuacucccuuggaaagugaauacaguacaccccccaaucaguauuuguucuuguuugucauuuucucaggucuacuuguggccacugaguacuuuuuuuuuuuucaguuuuucaguuuuucaguuuugcaguuuugauuuuuuuuccuucugggauucccuucucugugcuauacauacaaccaacuuuuauagugugaacgggauccaaaguguagaacuuuacacaaugguuaagcugcucuguaauagucauaagggaaguaaagaguaaaaccuagggccauguuuuaguuccaaacgauaauuuccucacuaugcuacaggagaugcucuguuccagaagaacaagaacguauugaugaagacuuacaccggagcaaggcuaagcaacaguugaguauacacggggcgguguucuccaucccagagggaggggaccacauucccugaaauaagacaagggauugacccuccucaucuguauguucugccagcucuuccuucugucacauaauccagaaugccuuaacuuaucauuaguccguucuuuucccuguuacacacacacacacacacacacacacacacacacacacacacaccaguaagugaugagagagagagagagagagagagagagagagagagagagagagaacagaagagaacagaaugagaauuugaaaacucuccaguagcauaauucaggaauaugaccucaguuucucagugaacuucaggagugaacuaaguagcaccucauuuugagacagagucucagucccuagcuuagacugagcugucaacccacucuauagaccaggcuggccuugagcuuuccauccucccccuuggccuccaauaucuaaagagcacuuuuaucuucuagagucgaggcugcugagaagaagcagaagccgauggaaagugacaaguaccaggugagagacagggccaugucuucuucucacacaguuuuccccgacagaagauuuagguugaagaacacugccuagcaaugcugagggauucuccucaggcucaguugauuggaucguuugggguuugugccgaucuucuguuguugauguugggaucacuuaaaacagaagagucaugucauuuauuuuccagauuuggauucguauauaucgauucggggaagugggaaggacacauuuggugucacauaacaguugugugccaucuucauaagcugcuccucuugacugucugguucuccugucuccuuuucuuuugggauucagggaucauuccuuccucuuuucucuugggaagaaggguugguucuuugugccuccccgccccccucaucccugcuuucaggcuggcuggcuuuauaaagacucugcuguuuugaauuuucaggagcacugucucucggacaugguugcccagcuccggacgcugaagggugcaauaagguuggccguccuuugagggacacuccuuuccuggcagccaccauagcacccauauauuucucccaccccuccuugccuuucugcaugauuucccucuugacccuauuuccuagagaucugcuagucgcauguuagauucacuuccuucccgaguugggcaggucauacuagugaggagagaggcaguugaacacuaaugcuccuucauguacccugcucacgcugaggcauaugagagaaaucacuuuacauagucuaugucuauacagagauuggguuuuccaggacugcccuguccucauucaguuugccuucccuuuauucuucuacccuaauuauuuauauuuucuucguaugcuggcucuccuacaagaucccaggagcaugucucuguugugugcacugugaacaugugguagccucuggcaugcgucucuccuaaaccagcagauacuugcugcagugcucuuccuuucuacccauauuuucaacacagagcucgaaaggaugaagacccagccuucaccugggucacaagagcaaaauagacagcgacuggggcuuggguuugugucguggguggaauaggucuaguaaccaauccaagaaucgcucgcucacucgcucgcucgcucgcucgcagucuguuguaucuagcugauaagguuagugacugacuguguuuggguccaguguucuaguguacauuacuguggacuguuuguucuguuuaggaaacaguuucuuuugauuuggccaagcauuccuuccuagcaucagaagaauugacacaucuuuugggauuucguucaaacuugggauuuuuaugaacuauuucuuucuugcuaggucuucaguaauccaccaaagacuccuccucuacaagauauggcugaacuaaaugacaagacaauuggauaugagcaaaucaauagccccagccugcuuccgucuguuagagaagaaagcagaucacccccucggcuuaagucucuggauuccagugcuuuucagauuuccaggugacuaaaaccauuacuuguuaucaauaguaagccaugggaucuguuuuccuauagagcaauuuaauauguccuauauauuuuauguauauaguauauaugcauuuuguguguguguguguguguguguguguguaugugugugccugaacucauacuuacaaagagauccacuucucucugccuuccaaguguuaacauuaaaggcauguagcaccaugccagguaaguuuacauuuuccuuuaacacaugacguucacuaauggaaauauagcuugggacugauagaauugugucuugcacgcaccuccuaguuuacaagugcaauaucaagccuauauauuuuuaaagugaucauugacuucggaacuguucaugucauguggguuguugagcaaaugaagugauggggcaggucaacucugaaaaauauaguguuauauaaaugagguagugcuguguagaaacccauuguuccuauacuuaaauuuaugaauacuaaaguauaccaaguauucacaagccugggcuaugcuggcccucuguaaaaucaacuaguagaaauguguccuauuaaguaaaagaucacuguuuccuaggaaaaaaaaugaucacagaagguuuguuccuguggaacaagucuuuaaucucaccacccaggaggcacaaggcuaguuugagacuagccuugucuacauagugaauuccaggccagccaaguuuucacagugagauccuaucuggaaaaaaaaaaaagaaaacuugguguuuuuuuuuucuucucuccuuucaucucuuaccuugucaucaauguuguuaguccauauauccuaggaaggggcauggcuauuuauuuuuguagguauuaggugucucugagguacuaaaagacaugacagccaucauauugccacuagaaaugaacacaguacgccuaaguggcaugccuugccuuucucuucccuacuguuuucauucugguagacugaacugcagaguaggcacaggauugcucuaaaagguagaaacgucuaaagugaucauuagcacgauucuuugauaauaggugugaguuucucagugcccuuuucuugacauagaggccauagacuauugcauaggguccguuaaccccuuccuccagugauaauugauccuuuccuugucugguucuucuuagguaagucuucagccucuuauaaacaaagaauuguacaggugugcgaguccccuguacuucaauuuuuaaauaauuaaacccugugaacaauagagggacauuuagauccucaugaacacgagcagauggcuucaagagaagauacauuuguaggagucaaacuauugagacucuuaaaagaaguuaauggcgcccucuaugaaagcauguagauccgugcucaguaagcaguagccagauuuaaagagcagcuuagaaaacugaaguuuguagcaaggaguaaaaagccuauagucgaccuugucucuguaguuugauccuaacuuuacccucuggcuaucaauagauuuucaauggccauuggagguuuaaaggggcacacagggaaugauuuugauuuggaagcacaauguuacuuuggccucccguucuucuggcucucuugucuccuuacacuuuaaugaucacguucccuuuucugucugcauuuguagggagauagcauacuuugugcgugcaguaccacacuacgcccacuggguggcacaccucaucagcuuuuuauuggaguuuuuguaugagucacuguggaauguauaaggcuuaagcuguaagagggcaagccaagugcuuugaaaauuuaugcgaaauucuaauugguugagaguaaaauucuuucaaggguuaagugauaccugaugcugguaguaguauaugguauguaagauuagcaaauaauaauuacaucauuucaggcugcauguauaguacuauucaaauuuguugaggcauuuccagcuacuuagacuaaagccugaaguucugcugaguccaaagguuggagaccagccuguaaaacauaccaaaaugcugucuuuuacaauuauuauuagcagguuuuuucauuuguaaguggaaaauggaggugcucacagguuuaauaaaauauauaguuucugauaaaagaauauugaugaaauaauaguuuaaucaagaguuacaaagcuuuccuuuguugucaaagccuauagcauagcaagagucuuugaguuauguagcccugcuuauuaacuguaccaaauaaaaccuggucuguucaggagcccuuuaagaagucauaccuggggcagguuggaaggagccuccgugaaggccaguagaaaugacuuuaugagucucgaacaucuaacaaggggagaagaggaaucacaauacaauagauucaggcaggauguaagcuuuaagucauaaccuucuauggaaagacagcuuguuucuguuagagaaggcgaaucacuucaguccauucauucugcguaaauuugggugcucuaugaaagguuuucuuuuaggguaguaaugggauccaagaugauggagcagucaguguucaaugcaaaucucuccagugcaugcaaguucccuuacaaauagugcaaacuaaggucuaaaauagccauaagugcaucagcaaaggaaagaagcaaugcuugugguuucuuuauauauuuugaaugaauuaugcugaaaguugaugaguuuguauuuuaaaauaaugcuuaaagggugccucuguugccuaggaauacugguuuuguuugggaggagcaugcuucggacugcucucaucucccccagcuuugucuuguggaagguauauuuagguagaaccaaaaggacuggcucucucuucucccacuugcaggguagaggcacucacucuggcauagcacgcugacaaaacuaggcuuucauuggaccagcuugagauugcucauagaucaaaggaucauucuaggcagaacaaguccagaaagacuccaauccucauucauaaugcagugacuauggaagaaauaggcucuugucucuacuuccacuuuuugcauaaggcaagccuuacgguugaacuuaaggugccucuaccuaaaggaacugacuaucuacaacaaaauaucaagaaguugaugccuaaggacacugccagaaauaaaauagauuaugauagaugaucauuaagauguuacuuauaauuucauaauacagcuuacagacauaaaguagcuggacauucagacauuugguaauggaauccgagagagacaauuaagaaaaguuuuuaugagauggcaguugauucuaggugucagcaagacuaugcguaagcacaaaccagcgcccacuaagaaacaaacagaauagguggacaucaggugaacuggaaaaccaauacccaagccacauucagagaaaacaacaacagguagcaaccccaguggcauagauuuaauacuaugaccaccaaucacuggccaaauaaugcucuuauccagugacaguuccuaagaagccaggcuuuaagauaaaaaugacacacaucccugacaguuuggacuauguauguauguauguacguauguauguuugagucucugcucucuuggaguucacuaaaaagggagaaucuaagcaauuacaaaguggauguuucagaaacaaacuccuuacauuuugguggcagccuccgagucacaagcaaauacaguauaaaaggguaaaaagcuaacuggagaggggcacuaaaucacaaacucugaccaguaacugaugagugggcuaugauggaccggggugagcccuagguggugugaguucaauccaugagacacgcaugaaagaaggagagagccagaucccacaaguuuuucucugacuuccacauguaugucauagaauacacaugcauucagacauaaaaaacaaaauacaauaaacauuuaguaaaaguaugcaaggaaugacaauauagagcccaagacagggagaaucaguguccagaauuuuuauacuauguuugcuaaaauguuuaggugucaagaacaaauuaggagauaugcaaggaaauaugaaagcauaacuauacauaggaaggaaaaauaggccauugaaacugcucuugaagauaccucgguguuuagucugacagaguccaaagcaaccacuaauaauauguucaaagaccuaaagaaaauuauggaugaaauauuaaggcauauauggagacaguguuuuaucaagcacaaaauaacaauaaaauaauggaaaaauaaccaaaucaaaauucuguaaauaaaaguacuggcaugaaaacuucuucaaaagacucaaaaacacaauuaaaauuaagaagaguaacgaauuaccgaaauggaacaguccaauauagauuauucaaucagaagaacauagacagaagugacaauggagauaaaaaucacacauauuccugacaaagccucagagacaaguccacuaacucugcauaguauuaugugaagaugagacggagggaguagaaacgguauuuuaaaauaauagcuaaaaucuucccagauuugaugaauggcguuagccugggcauuuaagaacaauaaacucaacauagauagacagccagucaggucacaguaaaaauacugaagcucaaagggagaaagaaaaucucuaaagcagagaguauaagucuuguacuagcaaauugcauucagauuaauggguaauuucucauuaaaaaaugaagaucagaaggugaugggaugguacuaugacuaggauaugguuggcccccaguaaaacguauguugacauguaauugucuguguaacaguauucaucagaucauuuagagcuauuggaccuuccauugugaaggucucugccuucugagugcuccucucccuucuuccaugagugaggcuguagugagacuuucuccagaagccaaggagaucagcauucagaacugcgaaccaaaaucauuaccucuuuccuuagaaguuacccagcucugguauucuauucuguuaauagcaauaugaaauagauguuaaaaagauaaaauauuuccaguaucaggaaaaaaaaacaacaaacaaacucuccaaaaugagaucauuuuauuuccaaguauaccaaagcuguacaaauuuacaagucuagcagaugauaauuuuaacucuucuuuuuacagcuaguuacuuauuuugcacacguaagucugugugcacacaugcaugugcuacagcauagguacggcagucagaggagaacucgugggaguugguucucucucaccauguggauucuagugaucaaacucaggcugucaggcuugaugucagguguccuuaccugcugaagcaucuugcuagcacagacuucugucaacaagaccgucuacgauuaugcacuuuaaaacaaaaaaaaaauuauucuagcuauaaaaagauauuuaaugauaaagaaguccauuggggaggcauaauaagaaaaccacaaagcauaauuagacauaaggaaggaaacgauuaaaguggaaaugaaacggagauaaccaaaacaguagagaaaaucagcaagacuaaaaugcacaauguuuaaacaacaacaaaauuuaagagaaaaaaagacaaaugcaacuuuauuuauaccuucaaaaauaucuaaaauaaauguagcagaagugauacaaacaagaucuguacgcuagaaaacagcgaaacauuguugaauuaaaggcagcuaaaugaauagaaagacaucugucauuucuguuaucaaaggguuucuuaccuuaaaaaaaaaaaacucaguagucuccaacugguguacagaugcaguauaaucucucucaaaacaccagaugucucuguuguaauaucaacagacucauucuaaaauucauauggaaaugccaggaacagaaagucaguccaacagucuugaagaaggagaaaguuagcaaaguuaucauucaccuuuaauaauauccaguaguuaagacagugugauagugguauaagguuagacacguauuucuguggaaaagaaaagaaaaacauaccuuuacauuuauggucaguagauuugaaugcaacaaaauauacauggccaucaacauaaauuuuucugcuucaaacuuuggagcagcuaacaagccaggcuuuucauaauuggccucuuuuauuuggcauguuuccaagguuuauccaauuuguagcccacaucaguauauuacugcugcucuagugcugauaugguugcaccccaauaauuuacauguaaaaauguaaucccuccuguuugauauacaauauggaaacuuaauccaaacauguuuggagguugggucuuugggaggugauuaggguuggauaaagucauuagggaaaccuaaugacuaaauuuuggugagagucauuaaaaggacaaggggaaacagaguaucaugagagagagagggagagagaagaggaggacaguacagaaggaaagagacugaccagaaguggcaacauagagacuacagacacagauacugaugugugcucccugucucuuaucacaggaugccuugcaccaucuuggcagucuguacucaaguaggaugagaaaauauacauauauaccccauagaugggaauacauguuauaaaagaauguuaacguuuuuacaggaggacugggagagcuagaucaguugauaaagggcuuaccacccaagcacaaagacccaaguuucauccacagcauccacauuaacaaaagccagauuccgcagugcaugcuuguaaccacgucacuggggagauagaaacagagaaagaaucccucuccagcuaaccucgccuaaacacgagcuccaggccccaaugagagacccugucucaaaaaccaaggugagugacucuuaaggagcuacacacccaguauucacugcuggccccacauacacacguaccugugcgaaugugugugagugugagugugugugcacgcgcacaguguuagaaaacuucagaaguggcacucaagcuagauuuagacguaaaauguuagaaaagagaaacucauucuggucaaaugaagcacaaaaagaagucacccagcaguucaauauguccaaguguuuagaaagaaacaauagaagauacaguuaaggccaaauuauauaucccagaucugccacucagcaucagcagacagucccuuauaaccucuuccugaccguucuuuacaagcaguugagauaauauuaccuuccaauugagagaauuagauaaggcuucacacacgcucuagcauagguuuuaggcaugggaaggcuugcuuguccagcuaaaacauaaauguuauguuauuggaagcaacguguacaaauuuagaaauaggaagugcauaaucugaagcagugcuucgggagauuaauuuagugcaugagcuggaggcaaaacccaucccagaagccauugcgauaauccagaauggcagcugccucaucuggcaauguucggaguguaagucaccuuauaaaacaccaccacaaaaauugccaagaauuugauguuguucacaccaauagaaacaggagcgacuacugagauaccauugggauauccaggaaaaaaaauguguguuaagcaguuguaaauacaggacuuggguguuaggacuugggagaaugugggagauuuugcccucccacagguuggggccaacagguugucucagauuacaggaaagaaggaccauuaucaaaaguggagcuaggaacagagcucuuagaguuggggaaaugaagaccagacagacaacacaacuuuuuuuuuguuuuuuuguuuuuuucgagacaggguuucucuguguagcccuggcuguccuggaacucacuuuguagacgaggcuggccucaaacucagaaauccgccugccucugccucccgagugcuggguuuauaggcgugcaccaccacgcccagccagacaaugcaacuuuauuuaaccuuuuuuaaaacuuguuuuuuugucuuuuuuguuuguuuguuuuuuuaagacagguucagucuauaacccucccuggcaggccuguagucuaggcuggcuucaaaguuacaucagucucccugccuucucaugcuucccaagugcugaaaucacaggcaugcagucugcaguucuauguccagccuuucucaguauuauacaaaccuuuccucgguuccugccaaaggaauguguuacuguccucagccccagagcuaagaacacuauauguaguauccuuuaugcagucuuaaggaugaagauggauguuccuuccuauucucagaaucccucuucaucucccuaaaggguaacaacagauccguugagauggcaggccaguuuggggucugaaaaacucagagcaucauaagaaguuaagacugagaugucucagaaaccacagaccuaugggcagccuggagguccucugaggaggccaauuacaugccugauucuugcucauccaaaguucaacuuuuuuuuuuuaacuguggcacuucuuggucaucugaagaaacauggcauuccaauccuucagccuguauaaaaucacccaugggucucucugguaaucagcuguuuugauagauucuucacccaauuaggacuucuugcagccagaacaggaaagugacuucagaaaaaaggcaauuccagcuugugccugaccaaaugaaguuguuugucauaaugggaaaaugacuugaacugacuggucuauuuucuugguuucuaacuugggccuuguguuuuaauuaacuuuuacaggggaaaaaaugggcaauggucauaauccacuuggcuggcaaggaauuguacgaaguucuguugcaauauaaaaaugugcuaagucuuugauacuggaggguuuugugauacuuuaaaauuaaugagcuggcuuuauucucugcauaaacugcuaggcuuuuuuuuaugaccuuuuauuccauucuauguuaagaaauuguggugugugugugugugugugugugugugugugugugugugugucuaguuuuuguuugucuucgucuauuugcuuuuaggaagccucacaguuagacugguuuaaacuucaucucuaaaacuuuuuaccgagcucagucuacuccugguuuauucuuaugcugacccuuaaaacccaccgacuuuauuucucccucaacaccgucugccagcucauccaguuguaggaguggaggcguuggggcuuagaggggccgaguuguuguaccacuuugguaauggaacagaauacauuagaccagguaaccugaaaaggaaaaaaaaauguuuguugagaguacaggucuaaagauucgagggcaugguguggcagugcucuggugaaggccuuaugguggauggucucacaauguuaagguugugugugugagaaauguugcaucuuuuauaacaucugguuuuccugagaacuaagucagggucccauuaguggugcuuuaauccccccugaagauaacacccccaguaaccgaacaaccucucacaaaaggcuuucucuuaaaaguucccauuaccuguuaacauugacacacuagggacagauucuaucauacucuuagggaauaaaccauaucucagccaugaauacgugccauaaugaggggcuuugucaaauuagaauaaucuuuaccuguucugugacaaguuacaauuuuaucucuucuuuuugcagaaaguacaaauugauucuaggcgaggagccuguagagaaacgaaggaagauccaaacugagaugccgcuaucuccuauagauuacuccauguccgguuuuuacaggaggguagaagcagcuaccgccuacccagaaggagaaaacagcccugauaaaugcaguucugagagaaguacaccaccacaucucauaccagaauacccagaaucaaacaagcauacagaggagaacagggaagccccagcacuuuguccagggucccaggaccaagaucagggguuccugcuuccugaagaauuagaagaucagaugccaaaauugguagcagaagagucuaacagaaguagugagaacauagacaaagacaugaauaaagggccguuuguagcuguugucgguguugcaaagggaguugcagauucaggcgcucccauccaguuaguccccuuuaacagggaggaauuuguaggcaaaagaaagagagcagaauccuggaagagagcaaauccuuacucuucugcggcuccugcagccacugcuggaaaaggaaaggauugccaggacaguagaagucggaacaugccaaagauaaagaccccaaaagagucggaagaauugaagagaaccacggaaaaauuggaacguguuuuggcugaaaggaauuuguuccagcaaaagguuugggcaacagcuuaccacuagggauaagaagagaucuuuguaagcaaaggacuagggcagugguucucauccuuccuaaugcuggggcccuuucacacaguuuccucauguugugguaacccccaaacauaaagucauuuuuguugcuaccucaugacuguaauuuugcuacucuuacaaauuguaauauaaauaucuuuguuuucuaauggucuugggcaaccucuuguaaaaagagucauuugacucccccaagaggucaugacccacagguugagaaccacuggacuaggguguugcuauuuuggugauuucuuucauucgcugaggcuuuuaagcgaaauccccaucaacuagauugugguauaucucagauugaguggacccugguguucuuucccucuauguuguagguuugacaagagacuuguguagguacaauaaaguauuauaaauaauggaaucgcaggguagauuuagaaaugguuugggguacucgagcuuaugguuguacauuggaucauuggauuccucuuucuuggaauacagguagaggagcuggaacaggagaaaaaccacuggcauucugaauauaagaaagcucaacaugaauuggugaccuauaguacccaggagacagaaggcauauacuggagcaagaagcacauggguuaucgccaagcugaauuccagauucugaaagccgagcuagaaagaaccaaagaggagaagcaagaacuaaaagagaaacugaaagagacagagucacaccuggaaguauugcagaaggcccaggucuccuuccggaacccagagggagaugaccuagaaagguuaauuacuaggguuuaguuaucagcuugugaguacuaaugggaauuauccgcugagaccccccaguugcugggaggaagccuuaauccauagaccaccacggauugaguaauuauuucuuagaaaguggcagccagguucccaguguuugauggcguggugcuuucagacuucuuucuacauaguggagacagaauuguuaagaaauguaggcccauuuugaagggacuucauuuuauucuguuggcuaaugacuucaugucaucucuucuccuccugccccuucacuccaucauacagggcuuuggccaggcucacucggcuacguguccacgucagcuaucuccuuacuucuguccucccucacuuggagcuucgugagaucggguaugacucagaacaaguggaugggauccuguacacagugcuggaagcaaaucacauacuggacugagcaccaggcuauauauccucucguagcuuucuuuucucccuugugccuguguacugaauguccucccuugucuuguuucuccuuucuccccuucucccuuccuccccuucuccccagaccccagccucuuucuuucucuucaccuuuaugccuuauauggagaaucuuugaaugaguccuggcucuuaaucggugugcuucacauuuauggugggugugaagaaagaggcccauucaacagcuuuuuuuuuuuuuuaagaguucaggaacagaaaagcaauagucaccaaguuaggugaccugaaagcuuuaauuuugaugaucuaguagauacuuggcccguuucauauuccugauaaugguuuguauuaauuuaggugaaaccagucagcaaauguuggguccaaugugcuuggugggauaaguaaugauuucagcccugccaagguucuagcaaucuaguuggaagcacaaggcacaccaaguuaacuaacuauacagagaaggguaugguguguaugagugguauccacaugacauggaagauagaguagagugguuuaaaggaaggcaguacaccauaagugggaccuaaaugaagcuuucaagagugaacaugacggcacucuuaaugaugguuggugcuuaggugguaggauuaugguugaugauuuuuuccuuccuaucuucuugcccucuuuacacugcaauuuuucucuaacauucuuguugcccuccuuacauugccaaauaaauuguuuugaaagcuaacaaguaggcuugaauuugggugucaaaugagacauuuaugaaaguaugauguaauuuuacauuuauaauuaauguugaguuuaauauuaccucuggagagacagcauaaacaaaugugccccuccccccaauccagaaugugaaaaauguguuugguaacaacaauagacuagaguaaaggaaagcugccagccaccgcacaaguguuccaugguguuuuuauugucauaaaagauaugugaaaauaaauauauaaggaucuaaaucuuaaauuucagguagcaggggaaauauuuuaggauagaaagauuuaguugccaucccucgcaauauuccuacauacuuucuaggcuauacagagugagagauagaccucagaguacagaagucguacaucuuaugcacauguaaagauguuuugugaauccauugcuuuauuauauuuauauaguauauugucucaaagagcuaagguacuccugaagggucacugagcagugaacacuauauauagauaccuauguauauguguaucucagcaggaagauaaaccaggaaguaaaagguaggaauaagagaagguggaauccaccaucaguaagaugauucucugguacagaccaaacacguugaauagucauucuguuuuccucaguagauuaacuucggaagacuauccuaaggauacuuuaccuccuuugaaaggaggcccaucauagauagauauuccugugagucuguagagaauauggugaggccaguagccaggcuucaccaucagaaugguacuuaaacauagcucugcuccaccauucuacuucaccccaucucuagcaggcuguaucauuaacuuucaucguaaccauuugcaucaguauauccaaggccucaguugucuaaaugggauugcuagcaagggaaggauaacacaugcaauuauuuuucucagucguacuugucacauagggacugggagugguggaacuuugcacagauaagaauaguaugaauggaagcccgugagaggaggaauaucagugaauguuggaugaguguggggaggggaagcagaugauggagcuuaaauggggaagaaagauggaaaacuuaacucauccuuaccggugcuuccugucugcacagacuuuaucugauccaugcccugccagcccaugcuuuucaaugcaggcugcuucuuccagaaagacucacuugugugagucuguccacuccaguaacaagaccuaguguuugguuagcucuuuacugaucaccagcaccaccaccaccgacauuggugccaaaauucuaaccuuuuacaaauguccuacaagacccgcugcauaccucuacuuugucucagcagcccuuugucauuugccacauacucuggucugcuugauuuccuaccagaaacacaucaggcuagccucagaucugggcugcauuggucugucuguggucucaccauccuuuacccuuacugcaaugaaggaauucucuagugcagacaauacacuuugaaaggugguccaucauagauauuccugugagguuugaacucguguuaaauaccacuguggaaagaaagauugaagaguguugcccauucuuaccagaagccaugacuuaguaugaagacggauacugacaacagagcaagcacgggugucuccuccuggcuuuuccucuuagguuaauacaaaucucuuuacaaauguuucucuuuuauuugccacaguuagcauguaggcauuuauuaucuaauuccuugacaaugaaauagauucuuaguuggccucccuagucuccuacccucauuccucaauacacacuucuuaauaucacuaucucuauuuaaaagcucaacuuuaucaggucauaucucugcucaaagaccugcuauugcucacuauugaccacagaaugcuaugcaaauucuuuagcaugguucucaaguggugugugccauaaccacccuuucuggucacucaucuuccaacaagggacacacaagcuauauuacacucacaugggaccuguagcuucugaaugcaccuugagauuuguccucugccuuugcuauuccacuucuggaauguucuccuuaaucaucuuuccuuugguucaaaugccaacuuauuuuugaaaauuccucucacccaggagggcaugaaauguuucucugagcauuuaagccucguaucauuuauucgacuuguaucauaaaauuccugauccuauguuuccuauuaggaagcuccagauugauauucaacugccuacuugacacuuacauaucucgcagacauuucaaguaaaucauguuaaaaaauaaacagugauaccccaggauuauuccucccccacaauuuucuucauguuagaaaauggcacccccucccacccuguugcuccagcuagaauccuggaagucaucuuuaauuccucuucucucauuccccacauccagucugucaagaaaucuguuguuucuaguuccaaagcauaaucuugacuuuacucacuuuuaccacaacaaccuuaguccaaacucccaucaguuugccuuguaucguaaugacugauagagauguuggacucucccuuguucucacaucugucuuaucacuagaaauagugugguuuucaaaauaaauuacaaauugaaucaugugacucucagcuuaaaggcaaugacucuucauuucacguagagcaaaauccaccccugcuaacagugucccacgaaggccuaccuaccucuuacauuugucucaguggucuuucaucguuuacuuuccccuucacauuuggcuucccagugaaacauaccaagcucucaccuaagcucagaccgucaccuauacugugccuucucuugagauguccuuuacccauucugcuccuuugggaaggcuguuuccagucuuggcacgguucacucuucuuguuuccaucuucuucccagaaaggccuugucuuuuccugcuauuucuaccccauuaucuucccacaauucccuuguuuuguuucuaauuuauagcaagcuuguagauuuggccauuuucauucauucaagaaacauucguugggcaccuacuaugugcugugugauccccaguggugaauauaacacacauuguuccuacauaccuguuucaauaaguucuagaugaccaugcuugguuugcuaauuccuguauccuacugcuuaccauaguaucugggauauaggaaaugaacaauaaaugauuguuaugaaugguuuaaugauguguuuuguucauaucuccaucucagugaucuaaacaaugucccauucaugggagacggugaauaaaugaauaugagugagguagauaacagcccugggcauuaaccucugaaaaugaaagacugacacaguaggugcugccagcuguaagaaauaggguugcugugaguagccuaguagcuacuguuuagcaacuuuucuuuaugagacauuagacuauuaaagacaaaggggaacugaguguucuucacacaaacaaccugaauagauacugagaaguacaaaauguagccaggagacagaccagaucuugagaguaagaaccaaaaaaaaaauauauauauauauauauauauauauauauauauauauauauauauauauguaagaacuccucuucagucuucucaagagugauggugguuccuugggauuguaaaaagaagagcuauucacaagcuaagaacagagcaaguccgaaggaaaaaaaaaguucugggcguggguuagcucagcacauacuuguugugugaacagauggguaccaggaugauuagcagaccagcgacccugaggcaucagaggucaggaggguuuguuuuuccauggcuaguacuuguacauuauguggcuuaacaguuuaaaggcaaaggcuguguucuugguucccaggggcagucucaagauagagcauguuuaagaaggaaagcuacuuucuguagcacuucauuagggggaaagaauagcagucuuugcaagaauuuuugaggaguaaggucaggguguaagaucaggcuaagacaagcaugauuuuccccuaaggacuagcauguuucaugaggaccaccuugccguacaauuuauaucaggagccauccaaaugcuugaauucaaaagucaucuuuggcuggagagauggcucggugauuaagagagcuuguagagauuaagugcucuuguagaaagagguucccagaauccauacuggggagcuugaaauagccuagaauuccagcuucagaggcucugcacccucuucuggucccacaggcacccauuuguacauaugcacagacacacgaauagaaauacaauauaaaauagaucuucuuaaaagucaguguuggacuggagagauggcucagugguuaagagcacugacugcucuuccagagguccugaguucaauucccagcaaccacauaguggcucacaaccaucugugaugcccucuucuggugugucugaggacagcagugacaguguauucacauaccugaaauauauauauauuuuuaaagucaguguaaguuuguaagcucagcauucaagaggcuggggcacaaagauccggaaucaaggccagccuuggcugcauagugagaacaugucucaaaagucaaaacagguauucagauaauuaaaguguaagaacugaccugagagucuugggcauacaaaaguuaguuaaucagugagacaugacuagcaauuuauuuuacuuauugguucuauugaaguauggccuugugcaugggaaauauacauuggcacuagcgaacuagaacucccauccaguuuuauaauggaaaauaaagucugaagaccaaauuuugguuacucggcaucuuggugugaaucacuguaaacucccaacccauuuuuagauaauguaguacaaaugcuuugauuguuuucuacacaccaaacgcauuccagacaucugcccaucauguucugaaggacauagaaaauaaccuaaagagucagaacaagugcccaaugccccaaaucugcucauccagauggacccugaaaaccuaaaagaguuagauaguacaauguaaagagagaccuuuccaguuauagggaauagaauaaucacaugauaguaacagaaauauaggaacacauagguuaaugggaaagcuuaaagugaauauccacuugaagcacaaggaacagaaggaaucaagagcuuagcauucauugcuuuaggggcucagaauuagaaauguggcuguugagagcuccuaaacagucccuaaguucaggaaguuuagccccaguuggcugugcccuuggaucagauucuucuccagcagcgggaccuggugaaugcuuaguugucuuccacaguuacaggaauaggcaaaagagcuaucucaugcucacuuucuuucccagcuuauucugucgauagaaucacaugacuagaaauugagccaagaccuucaggaaaagaaucuugaagagcuuugaccuggaaaagacaagugcacaucuaaauucaauugagauccauguuagagcaugcacuucacuggcccggugacauggcuuaauagggaaaggcacuuguugcucauccuaacuuguucaguucccagaacccgcaaggggaaaaccaacucucuuaaauuguccucugaccuccacacccuuccauggcauguggagccauguggcaugugugcacuugcccuucuuuagccuaaacacuugggagguagaggcagaaacaucagaaguuccaggcaagcugcaguagcagcuacauaaccagauaaagaguugaagucagccuggacuagacucucucucucucucucucucucucucucucucucucucucucucucucucucucucucugugugugugugugugugugugugugugugugugugagagagagagagagagagagagagagagauuuguuuuccccauacaucacagacacugucaccagcauguuuagauaugaguuaaugauuucaaauuugcuacaugccaagacugcacagggauucugccuauuuuacagacaagaaagucaaguauggagaauugacaaggcuuucucaaaauguuaagggaaaaaagucuaaauccagguuugugugaccccagaaacaucacucuuugaccauugcuucauauaaccagucuaguuuuucuccuuucgguagggaaaaaaaaauucgaauaggcagcccacacugaucagaguggucgcaaaucacacacaauguuuaacugcccucaugaucggaaaucauucgcuuguguaacaaauaucucuccaaacaaccuggaaauucauuuccucuugacuggguuuuucacucuggcuguuccuuggcagcuuuccugauaucaaaacaguuguugggauccuauuccuacacuccgggaggucuuggacuggcugcccccuugccugaaguguucucucuggcuucuuugaaccacaccccccccccuucccagacaaugcugaguugggcaagucucagggagugaaaaagugacacuugagaacauacuaguuuauuauuacacagagaagaguaaaauuaaccccacgagauguccuggaauugccaacgggaugguagcacucccuugccuacccuaucugccuuuuucugauuucucugcuguccucgucuuugaagcugcugaaucaucuacauauuucaggauauguguguguuauuccaaauaaaagcuccugcuccgcaguggcuucccaaugacugcuguaguuuuguuauuuuuuuuuuuuuugaaaauuggauucuucuggcuccauuaaggccugaauagaaaauuuagugcaguuucugucgucaguggcugaucugugacugaauauguuucucuuuccagaaaauggacuugguuuuuuaagucaaagucuucgggggaccuuuaaaccaagggauuaggacauucccagcaucaucagauagugcuuuguggaagcugcuccucccuccucuccuaccccaccggguaauucccagagcaaacucaggcggagaagcgacacuuuuagagcacugcccuuugccuuggccuccagcaucucucacugaacuuuuuucaaagauuucagagugauaagugugcaaagauggugugccugacacaccacucauuugccauuuagugugccaucuugcuaccuaugcugguaaaaggauacaaguauucucaggguuaucucucuacaagaucaugaguguuugcaaaggucuccaaagaccuccugggggucuccugaggcgguuagagggucaucccaaagagacaaaacuucaaggaugacaaagcagcaacaccucacaagggccaagaugcaccuucacaugguguuuccugcuuugucaagugcugcuugucuucuagagcauggacucuugggacagaaaacucugagugagaguuacgguucccagaagugcggucagcuucgguuaagagagggcguggucagaucauagucucuguagcuaaccaccugcuaaucuuuuaucaguuaucacaccacaacauucaaugaucaaccacauaggggaagaagagagagauaaccugcgggacuuccuguuugaaguucuuuuccuucuugagauaacaacauuucucaccaaagcccauggagccgcuuggccagggaacccaggcuaaaaaaaugggccaggcuucagccaagcugaggaggaagauacacgcuucauagucuguggccucuguggccccagagcaggaagcugcaggcaugaagagauccuguguucacugaccagagaaggagcaguugacccucacugugaagccuccugagcuccccuaacacucgcuccucacacaguucugucuacacucuaguccagagccaaaaggucccaggauaccuagauuagcucugcuucuucugccccagaaauuucugaagaacuaccuaaaggaaggagauguggaagggaagacggagcucacucuugggucacucccucuuuuggagccuggcagaggucuggugagaacggcucugaaggauaauggcuuaucaauacagucaggcuccauucuccccuuaaaaaggcucuuugucccauccuugagcuccuggauacccuuagcuguaagaaacaggguuguuguuuccaucuuccuccuccauccuucccaagcucaaaccguguuggauccuuuuuucaaagggguuggcguuuaaagggauuuacauaaauguuugcccccagacaccuuuagggaccccuccgucccuugagcggcagucuguguucugcuuugugcugugguuacacacacccgacuuuucuuuccaccuuagcugucaacuuccuccagcacagacacuccauucagccccacaguccuuacuuggcacaucuuggggguuuuggaggggaaaccaggaaaggggauaacaucugaaauguaaauaaagaaaauaucuaauugaagaagaaaaaaaaagagcucaagcagugugauuuggccugccgacuggcuggcucaaaaggcuggucaguugggggggcuguuugacugaagguugggguuugccuuuccacugagaaggcaguuucagccuucccaccuccauuaaugaucacacaauaaugggucacuagggccccaagaugggaaaacaugagucacacuaguaucacaggaaacaaagaggccagaaacaucucuuugugcaagggucagaggcaugaggcgaggggcauuaacauaauggcuuuuccucugccuucagucuacaguuaaucuaaauuacuuuaugauggaaaugcaaugagggagcugggaacuguucaguuuggaccaggacucaggaaacuucuaggaaaccuuucagagcaaagauuuccuugcucaaccaaucaaagggauccuguuuuuugcccuuuguuuuaggcugaggcuauccuggugguuccuacaggcaugaggcucacuuccuucauaagcucuucuacucuguggcagaugggguggggugaggacuggguuucucaaguuggaagagccacgggucaccacauaccuucugaaguucaaauugcagagccauguuaccgugguuuccacauuuauaacccagauucugacagacuguaaccuuagagauguuauccacuuccuuaguccuccauuucaucucuuguggaaaaccaauuuggccgacagacugugggcaaucagagccauacucaggagucaccaagguguaguuaucaaagcaaaccuggcuuuuagccucugguuauccccaauuaggcacuggggaaaucugguaccagauaagagaugacuucuuccuauguauugugggcccuucuccuccccugcucuucccucuaaaugaacuuggauacugucuucaauccuuugcaccagagaaggcccacuucagaagugcaaggccaguguuuguaauaaccagcuccuaugggcuggcugcugcucccuaaguacaacggcuggcucagcugaaucucauuggaccccacuauuguuaguuuuuuuuuuuuaauacccuuauuacuagguuuuguuauuuccuuuugaagucaaaucacugguguguugucucaaacuccugcagaguuagagggcuuagaacuaagguguucgaucuuagaugacacccuggcaccccccccccccgacagacagcuagcacgggaggagugggcaguagucauguuugaugaauccccacuuucccagaucaccuucuugggugaccaggggagcccauaugucacauugguaugcugcuggcccuaaguaaaaauuuuuagacugccggggaacuuuuggaaugcuguucuuaccgacugugaauauugucggaucagcaaaaccuaguuucauagucaagagaugaaggcauuaacuccagcuguguaacccugggaaaaccuuaacuugugggaaucuuaguuuuuguauaugucaaauauaggaucaaauauaggaucauaaccucagugacguaaaauucaaauaaaauuauuuuucugaaauaagaaugagcaagguaaagaacuucauuucugccaggcaugcugguauaugccuugggugcagcacucaggagucagaggcaggcagaucuuugcgaguucuaggucacagugaguccaggacagccaaggcucuguuauacagagaaaccauguuuggaaaaaaacaaaacagcaacaacaacaaaagacaaaaacaaaaacaaaaccccuucauuucuuuugugagggguguugucaugauugcugaucauauucacaaacccuggaauuuucuacucccccuuguguacagguucucacugccuuucuuaacccaauuccuuucuuucuuuuacaugugccuugucuuaguugucuuuuaaucaauacaacaauuacucaaucaacauccguuuauugaucaccuugugugugcccagcacuguuacagucuuggguauacauauggacaggucuaagauauagcaauugcccuccaaguacuuacagugaacuuuugagaucacacagacagacagacggauagagucacacacaaaugcacauacaagaacuauaaacuaucaaucaaaauuaugaaugaugaggauuaggcaauuuauauauugggaguuggaggagggaaaggaaagaacaggaaggaguggucagagaaggcucaaugagcaaguucuccaagcauggggaugacuuaguuaaaaggaaauggcuuccaggucagcauaucagcuugaacacaaguaauaugguggaaauaggaaaggcauguuaagggaaaccucacauaugggccucucuugccggugcugaaguuuugaugaggugcgcuggggaucuucugaagcuggugauauuaagcugguggugguggggaaaugucucugguuuaugacccccaucuaccacagaagaaauggagcauuuuaagaccguggaaauaaaacuguuggacagggaaccagucuccguucucccaccucaagcacaaucccaggcagaaguucaccaauugcucaggucaugaacacaacaccuuggucacagauguuccacacuggagacuuugcauaccugugagaguaucuucugaugggcgaugacucaagugugaaaagugacaaaggaccucucuggugcuguggucuuucagaggcucuguagugcugagacauagacccugauggguuggucuuccaucaagucuaaaguaucugguagggcugccucucugaaacaguaggagcacacauaacagcuaccacacaucucuguccgguucuuugauacccaagcccuuauucuuucucggucagggcuaaaggguaguauuuuuuuuaagccuucugcaacucgcaugucaaagggcaguucuagaaaaacugguuuauuguccuuaaggaaacccuugucuagggcuccaagucuugugguuuagcaggaagcugggucagacaccccagugggaggcagagcuuucagugguccguguucaccuuggcuucugggcaauuccucuguggagucagagggcagcagccaugugcuuucccuuggcuucuugugcuuuccuuagcagugcuuccaucccugacccacaaauguacgggaauuauaggagauggccugagaagggauucugucggguuuugcuguuuguuuuguuucuuuagaucccagguugccucccauccugcacccagcuguauucugcuggaugccaugagauagcuuuccuucaguucauucacaaugcagucuggacauacugcauucauagcaaaacuggaagagaagcuucagggcccauuacugacuaauccauuucuuuggcuggagauuugagaagggagcuagaaauguccucacagaagccaccacucuuucuucucucugucccuuaguaauugaguuaagagccaaccucagccagagggagagggucuuuugaucacaggugauuagucaacaggauaugauugguuuggggacagaucuccaaguaaaccaaagggcagaagagagccucugggcauagccuaaaguggcagagaugggauuugggcuuuuggguugagcauucaaagcacaggagguacuuuagugaggucaggugagggaaauagaaaagcuagcuuggcaagcguccuuggcaaugccaucuacaugcugacaccccucuucucaucucugccuucacuccauccaauggccaaagucauucuacccucagcagcaccuuacacaugauucaguggcaauguccuuugcuugugacccugggggcauuguccacugcuuuuuuuuauauauauagucccagccacuaccccacccuacccccagcucuggccccugguucuucacacauacccagucaggcuguaugaguugaacucacucuuggcuuugggcuguugagcagaucuuggagagcuccuaguggcaagaggcugggccugguagccaucauaguaguugguacgauugcccuggggcgagcaggaaaagcaaaggaugacuccggcuaccaaagaaaacagggcugagaugaugcccaaguacagagccucuccaaucucaaauuucaugcugucaggaaccagcggcgaguagaagucccgaaggaugccaugaagauuccaagcaacugggauaaagcccaggaugccaccaaggaugaaaaagacuccacccacuacagccacucuguccuuagcucgagaauccuggcagaacacggugcaucucaugcccaccacagagauaauacaagccagcgaggacauugcacuggacgucaccaucauggccugggcagccuggaugucagcaggaaguccuaaaaggguacuguagauaucgcacugggugaugccugugcugugugucgcacacuccauccagaggcccuuggaaaagccaaccgccgucacaaugcuggcaccaacauaggaacucguucgccaguugggaagcagcauggcaauggaugugccuaacagccccaaaaggccuaggauguagcccaccaguuggacgccaagggaggccauggcagaccucucaguagaaguaucuucggagccuguuugcuugucguuuggcugcugcucuugcuucuuggauccgagccucuaaucccuuauuucacagugucucuggcaagcugacuucuuuccuccuuacaaguaucuguggguggccacaagcaggcucaagaaggcaucuagaaaaccuuaaaaaaaaauccauaaaccagauuaaauauugaccagaagcuuaugagaaaccagaaaacgcuggaugccuuuugaccuuuguuaucuuuaaaaauaacacaugagaaagaaaaaaaaauacuuuggaaguagagccaaaaugucaucaccuccugcguaggcacauguuuuaggcuggcagucagacaaaggcaggggccagacagguggcugcuuuccgagaaggcagucauggcaauaagaguuguggugugcuaaccccacugcuagucuccaaggccugcuauuuaacauauugccaagcaaccacaccacgggggccccucaguugcagacugaggccaaacuccaggagacuggaucauguggaacaaggcuuagaguguggccuuggacuccaguuuguuagaggcugccugaaucuccaaaggggacuaaagaguaguggcuuagcccucaaucaauucaugcuucuggcaauaauguacuucccaggcagauuggaguggggagcaaagcuuucugcccauacucggaaagagaaggucuuucuagccuuggccagaucccuuccugcaagguagcauaaggacccuuaaaaguauaacauaccagauaucuccugucuccucuccuaacagaaucccaugacacaugaagacuuuagggaaaaguuguccagaguccuacaaguccucaaggcuugucagagaugguagaaagggugugugugugugugugggagcugcugcagaauuagagggcuuuguaagagguaggcaggcaucuggugagagaugggauuuugcacuguucagggauuuuucacccuuuucuaaggcucaagacacaaaggucaaaguuagacaccucccccaccuucugcaaguccauucaacccacuaauuuuuaacccaauucaacauugcuacuccauuuucacuucccucaaaauaucuuuuggcagcuagagagagagagagagagagagagagagagagcugcucagugguucagaacacuugucucucuuccagagggccgagguucauuuccuagcaucuacauggggacucacagcugucaguaauuucaguucaagagggaauccgauucccucuucuggccucugaggacaccuggcacauacaggcaaaacgcucauacucauaaaauaaauguuuuaaaauuucccauuccuauugcucaagaguccauucuucucugaacaggcauguguacccuguuaccuaauguuuucuauccaaaucugaauuuucaguaggaagccucuuaaaagccaacacagucaaagggaccauuaaaaaaaagagcucugugaggaggggguuaggauuuagcauggguuagacaugggaaaugucauaguaaccuaaaguuugacauauucaagagaauacagcaccucuaccucugugucuuuugaucaguucuugccuaggucucauguugucagcaaaugagaacccuuaccauccagaccaacaucccugggguaauccuugacacccugugccuauuucuccagggcaucuucuaacuaagaaguccuacuaguacuaucucuugaacuuacuugaaaugucuuauuuguguuucucauuuccaccacuacuuucuaauucaggguuucaucaucccucuuuccuugucuggagacauaauaguuuauuaacugcucuuacuugcagucuugccucuuccaauucagucuccauaguguugccaugacaaucuuucaacacauuaaucugauuaaguuguuauuugaacgugugucuacaugugggcguguggacacacacacacaaauguucaacaguguguggggggagugcuuggugcaugagccuguggagaccagacuuuggguaucuuccuugacuuuucuccauuuuacauuuugaaguuuuugauguguuuuauuuuaucaugcaucugugccucucucugugugugugugugugugugcuuguguguguguguggugugugcgugugcauauagaggucagagagcaauguguaggugaguugguccucuccuuccaccaugugaguucuggugaucaaguguagguggguagacuuggcagcaagggacuuuauucacugagcuacguuguuucccucugccuuuguauuuugaaauggucucucccugaaccuggaacuuguuguuuuggcuagcaagugaagcccugugaucugccaccuucucucccacccugagugcacauaccuccacacccacauuucucuucuuuuacauucuucuugcagcucugaacuccgaucaucaugcuuucacagcaaguugcuccucuaggacauuccaauggcgaaggauaaaguccaagccuguuugcacucugggaccucucaagguucaccuauugccauucaccugcucacacuccacacucugccuucacuaaauuacucucagcucuuuaaucaugucaugugguguuuaacuugugguacagucugagcacaggccguaccguaagaaaugucuugacuuccuuggagaucucucauucuagacaugguccagugccccuauuaguuuuuucuaaagauuuauuuauuuuuauuucuaugucuggaaaugccuggccuguggagaugucuguaugcccauaugugcagggccccuggguaccaaaaagaggguaucggauucucucugugcuuguguucccuaugugguucccucccauagugguugugagccacuauguugauguggagauuugaaccugggcccuugggaagagcacccagugcuguuaaaaacacagagcaauugcuucaggauacucuucuauauucuuauaguaccuuauauucauuuacuucuguuauuaucauaaggacaacgauaauacacacuaauguuuucuucucuuuuguuguuuucucuuucauuuuguuuagagacagauuucacucaguagaccagaccuggcuggaacccgcuguguagcccaaacuagccucaaacaugaucaucuugccucggcuaccauagugcuaagaaugcaggcaugcaccacuauaccagacuauagagaguuucuuauguaauucuuacaagcacuuuauauguguuaaugcauguaauuagcaauuauuucaugacagacuaauagucuguaccauauauuaaugagaaaaauaaggucgugacauacuuuguuauauuguaauuuccuauuuaaacucauaguugcucugcugguauaugggcuacaucaaggcaacauugguaucuuauuuauguuuauaucucauguaccuuacacaguacucuacccucaaaaaacuguucaaacaaucuuuuguuuaaaaaaaaacuggagacagggucuuucuuucuaugcaauucugggcugaucugguacuugcaauguaaucuagguugcccuugaauuccugcuucguucucccaaaugcugagauuacaagcauacaucaacucacccagcgucaaauacaucuucuuaaugagauaauaaaagcaguuaacaggguuugaagggccccaugagacuauaaggagucaguaaacuuugcagaguaaggguuaccaaaaugcuacccaugcacugaaagaaggcuaucagaagagggacuaaguagaggaggacaagauggagaacuacacaguugcucccuccauccuuccuuccuucccucacuaccccccucuccauuuguugaauaucuugccuauucaguugaaggugaaaaacacgcuaaauuuguguuaggcuuccacagcauaagacccgguugauagcacugcucaucggcacugcuaugacaugguaugcaaagcaauguagcacaguugccagggcauauuuagcaaacucugcaaucaucagcugugacaaggggcaaguccuuuucuggcaccguuuuccuucugcuagucuagucacaucugugcauagccaggucucaaauguacaucucagcaagaccuucaggguuucuccucuguggucagcauccuucugucaaauccuucucguguugcccacaccuuuuuuaagcuccccuccccaauguguccuuguuaggcagcuauuauuguccagccugacccuucuguuuuucagucaaccuccuuaacccauuuaguaucaguaucacuacuugaccucuguacacgcugcucugguugcugcaggccugcaucugcuggccacugagaacgcucuccccaagguuaaucauuuucuuauucuaacauccaagauucauauagcugccacuugaccuugccucucccuucagaaaacugacuucgcugcuauuuucucuagcgccucugccaauguugccauuccucuuucuuuuuagagaccgccuuuuaaaauguagaagggcuagagauggcuggcuuacuccucacuauguagcccaagauggcuucaaacucccagcaaucuucuugcuuuagcuugacaauggcugugaaagccauaccucucucaugucagauccacaccaaaagaggucucucuuuuacucaacguuuggauagucgacugcauucucaaugaccacccaugaauguauuaaggcauuaacggcaccucaaacucaacacuuacaaagcggaagucuuuuguccucuuuuuuuuccccauccucaaacuauucuucauacaguauaugcuaucucaguaguagaaccaggcauucuguaacccaagccaguaugccuugauucuucagccuuucuguuuucuauauauuuucuucuuuuugagauagggucuugcuauauagcccaggcugaccuugaaccugugccaacccuuccacuucagccucugaaugcugggaguauaaggaugagccacugcagcuggcuuccucacauguucuugauuuauaaucauagugcuguuuugccagauauauuuucaaaauaaaacacaaauuuaucuuucucucuaucuccaccguccaacccuuuuuagacaauacagucaacaucacuuguccauuggaacucagauuggccucuguaacuucacuucaguccugucccugagaccaaucaucaagauagucaugagggaucuuucgaaaguacaaauccagucauagcagucaugcuacacuuugccaugcuuaaaagacuuuaggaauguuugauggcuuuacuaugaggcucagucuccuaggaaaccagggaaagcucucuauuaucugaccucauacuucugaguuucaucucuagcccuuaacuucccguuucaugacccccaacacaugugcauaccaacuuagcuguaucagaguaggugcaguuuccuucaucugccuugccagccaccauuuuaccuggagacuuguuggucauucuuuaguguuauaaucaucuauuuuugagaacuguucuuggacccugcuccacaccuugccuggggugaguuaaauacacucagaaaaguacucccuugaagagcgcucccuugaagguuuuguuagcaaagagccccuggcucgcagagaagcagcucgggccucugcuuucuugggaugguaacagacagaagcuugagcugggcaugcuggcacacaaaccuggaaucccaguacucaggagguagacacagaagugugcugaguuagacaccagcuuggggcuacacugcgaaguuccagggaguauuggauagcaaaacucuguuucaaaaaaaaagcaaacagaaacaaaacaguaauccucaguuucccccaagggaaucaaagguucuccaggaggaaauccuaugcagagaggcaggccuuacuugguagucaugagagaaaaguaucuguaguugagugaagaaacuacccuuacugaaggcuggaaucuucagaaaguggguugccauagcucagcaggaggaagggacacuauccggguuuauucaaauggaagaaguggcucccugccacuuaauuuucccuuagggucaggaagauaagguugacaugcuggccagugacuggcuggugaggugagccagccaggagugauucaucuuuggugagcaguagcagacacugaagcuuaaggguccuggcggggcgucaaacgcucuaguuucuugucucaguugugccuagaaccuggggaagaaauccccucggucccucaucccuggcuuagcucaucgacaagguucucucaccuggaagcagguaguggcaacaggugaccauuuuaaccaacacaagacuauggagcugcuauuugaaguagagagggcuuuaaaagaaaccuuucuuucagggcuucuccuaaaagccacaugcagagacuuugggggauacagagacucuaggccuugcuugcugaaauuugucuccugggagugaagccauggcuaaaagcuggccaagaaaguuucccucaggaccccuaccuaaucuuccuuagaggcgggauuggaacugcgggagaagauuaagaggaaaggcugacagcagcucccuacuuaacuccuucucaccagggaaguuggucugauagucuccccaucuauguugccuggugucaucucuuacaaucauggaugccaccggaccauuaagagucuccggcucaaggaaggacaugauauagcuuucuguuaugaauggaagccauuaaagccuguuugcuggcggccauccucauuucucagucccuugcuuuuagaguccucccccccccccccaccaccaccgcagaggaauccgagauaguggcucccuaucccgguaagcuacucccacaagccagggucucgaguagguggcaaagccaucucuuugcaaucuaccuuucuguaccaguugauugaggacagcuaagggacuugcaccuagagugauagauuucauaauugucuuuaaaaggaagcuuauuuuugucauggccaccaaaguaaaaucaagcauuacuuuaaagcacugaaaaacacagaaaggaaagguuugggggacgaggaggaagaacgacugucucccuaucucuaagugccacgaauguuucgguuccgacucaauauuuaagaacgcuugaaaagaagagugucuaaggcaggacauuuacggagagcgauugagggguucaaaaggagagucacagaggaacccaccuucgacugcccccuuaacucucaugcccaggagaguaugggagcuuccugaccugcuuagcccccugugguccagcaaaaagggaaaagcucuagcuccugguuccuucguuucagaucuucuggcccguaagacugcaaaucgugucacaacuugaagaaaacacguagcgccaugugcccacuuccaaaaccuucccucaacgguccaagguagcccacccugacuccaucaugggcuccagaaacagcagcuagguuuaaaaaccacccgccuaagugagccugaaggguagcaacugcaucaggauacucacgaccagauacucacggagccguccuuucgaagagcucuggaagagacgcuucuggggacaaggacuagguccagagaaaggcgaacgggguccaaggggucacaagcuguggugauaagggauuucuaauuauuagccacagcuuuguaaacuccaccuguaacucugagccuucuuacagaugggaaugaaacccuuggaggcuggaaaagauugcgguacucuuacaaaaaacguuugguggguuuuauauuuuucccugucaagaacuccagcugggcuuuuguguggugaaccucugugaguccaggagaaaccuugguggggagggggauuugggccaaggaggaauuuagaacauuccugcuuuggggggaggggagcgaaggguguucuguucugcccauuagguguuccuggcgcgcagccccaaggcucagcaggaaggaagccuucauaaacacagccugggugaaccagggcccaaguagccuggcacugccguuguuugcuccaggaacucuuuaacucacugugguucuuuggucaagacccgagcccuauucuaccuauaagaucaacuucccaagggaagacacguguaccuuagguuaucagaaguuuuagaaugaaaaccuggccucuggcaggcccaacaaacuaggcuucacuauugucucugauacacaaauuaaagccacaaguuauagcaaaaagcaucgggaaaaaaaaaguauuuauucaauauguccacuuuaggaagaagaagaacuaaagggcucaggguucccgcaagucuaucuucaggguguugacaugaggauuaggcuucugcagaagguaugcaugauugagcaagccuggccaaggugcaguccuguccauccugggcugucuguuguuucuagcucuccccuguccugcuagguggucugacaacucacaggaaaucucugccuaagaagcacagccgcccuuugccuguccaaggcuuuagcccucuucucuuaccaggcuucagacuuucccuucucccagcaugggaccccuggggaaguuuuaauucuuucugguugaucauuucaaaagcucaacuaaacgagaccuggccucaaaaauaaaacaaaacaaaacaaaauaaaauaaaagugggauaugagugcagccuuccucucucucaccucucccuuucuuccuugcuuccuucccuccuuccuuccacacucccucucucccuccuacaaaaagaaugucuuuucccauacuaagagaggguacagauccaggcucuguggguucaaagcagguccugcacagugagacugaugaugcuacuauacuaguaggccucuucuccccaccaccaaacacagaagcacuaucuacuaugccauuuaagccccuucgaaaguucuguauaguguauugauuaaggcuccucacuaaguagcucucaaaugcaccccaagaacuugaagcaauccuuuugacucuaaagugugcacacaaaccacuuugucugauucuauugauaagaauucagagaauaaaauauaaaagaaggaaaugggguccccccccccauaaugccacuggccagccgucaacauugcuaacauugggaaagcauuaacggaaaugugguuuaucaaacugaagcacacacuauuuacaauucuguaaccucucauuucuaaagaauguaucguggaucucuucccaugucaauuggaaaccagagcaccuauaguacauuccaucauguaaaaugauuucuuuagccacaaccaaacauuuugucauauuucacuuuagcugcugaaaaaaaaaaaaccaaagcaaaacaaaacaaaaucccaucuuuccauaaauuccuaggccaagaauuguuugauuagagaaucuuuacuguuuuuuuuucuuuuauuuauuaauuuuuuuuacacuccagauuuuuuucuccucucaguuccaaucuuuacuucuaaaggccaauacaguguuuuacaaagacaagauggcagcugcuguuucacggaagaaguuuaagccccgaaauaugaaagaacaaauuaccuagcaacucaggaugaguuagaccuggcaucugggugucuagaugaguaaauuuccaggcaacuaggcugugacucccaaggaaucucacaucaaaaaugcucaggucagaggccucuaaggaguugaggugcucagccuccugcugaggcuuucuuuccccaugccuggcuuuacugagcuagacuagagcagaguacuaaaccuggccaaccuggccaaccuggccaaccuggccaaccuggccaaccuggccaaccuggccuuggacucugaaucccuguacguuaggguuuuuuuuuuuuuccucaaguaauaucaaagcaaacagauuuguugccuagggagaauucagugaagcaaauaagaauucauccuccuucucaagauggcccauccccgccuugcagguaugaaugggucacugauccccaaacagcucuccugcacaagagacucuuuaggauuguccccagccccccuuggcaggcugggacaggcuaaggucagugaggccugaacucaggucuggggccucagcaugaaagcaagcaaggccgcagggacaagaaggauaacaugcuaauucccuaaccagcucugugaccuugggcaaagcuuuccacccucuuuuuuuccaggcuccccacagcugacucuucaagccuggacuaaugagucugaaaauguuuagacacuuagaaaaugcuggcugaaggcaauauguuuggcuuuguggggggugagggugggguggggcggcucuaucgauucucagugauacugugcaauugaggagaggaaaaggcagacucguggggacaggugccagggcggaugagggcacccuguucgaaggaugugguuaccacguuggcaagcauucaaggacuaggcucuaacaaugcuucacacaggucggcacggacagauccugguggcaccgggccaaaguguauuaguccuggauucagagguugggagggaucuuagcaaucauuucaaugagacccccagcugagaugcugccagccuaccuagguagcaguagcugauggagaagaggauggaggacaagggcagaauagcagucuggggagagcagugccacuuaaggagaggagugaguaguaugagaacaaagagaggaaaacaaaaauuuggaagagaagaggaguuugaggagaagagcaggaaagauaaagugggucuugacagagagggaagagaccgugcaguggaaagaguagucuagagucagggauauagcuuaguagauauuuguuugcccaaugugcaggaagcccuggguucaauauguagcauggcauaaagcuaggccaugguguguaccugugauucuuauacaacuagaggcugaagcaugcuugccauggauuuguagcuaaccugaguuucaagcuaaccuggacuacugaaugaggucaugucucaaacaacaacaacaaugaaaggaggagucuaguaggagaaacagcagcaacuugagagaagacaagggaggaaaggauucugggaagaacugggcaucuguggccaaggaaagauucaagagauggcuuccugaccauuccaccagugccuaccuuuccggccuuaguuucacucacguccauacagcuuucacuacccuccauaaguggccuccugaaauaucgaccuuggcuucugacacagcaccccccugguacugucacccuaccucuugaacuccuuuuucccugacacgucuccucuuucagacaguaagaauucauuuuuuuacggaaucagaggacagaacagugauaaccagagccuuagucggcaaauggauggugggccacggggagccaaugguuaaugggugcacuggugcaauuggauaaggcacggccucuaauguucuacgucaucauagguuaacuaugguuaacaacacuuaauugucugucucaaaauagcuagugaggaagaucucgaauguucccagcacccacacauggcagcucacaaccaucuguaacuccaguuccagggccuccauuuccuccuccuggccuccaaaggcacuguacacaugugguguacagaaaaaaauccauacacacgaaauaacaaaacaaguuuuaaaacuuguuuugggugaugguuguaucaauuacccggauguaaggauuacacaccauguacaggcaucaaagcaucacacgguacugcauacugcaggcagauugaauauuuccaaauaguuuaagggugcuugucuaggguacuucgggcccaagguuccuuuuccagcaccucaaaaaauuguuuuuuuuuaaaugagcguuucuagcaagaauaagagagaaauaagagaagguggaagaaauaaccaggaugcaggaaaucaucaaugaacacaauuuauugauacaauucgcaugguucucgggagccuggcuccagcuuucucuucucauucugcauuccuacuccaggaaauccccuguguccuccgugguuucaauuagccuguauaauuggauggcuuucaaaccaucauugucaguucagauuauucugagcuuuagaccucucugcgcuggcaucuuuuuacuaccucacugugccccccacaucauagcccuuuuuguugagacggaaucuuacuguguaucuccgauaagacuucuaacucaccguucacugccucgaaucucuccagugcagggauuauggguaaguacaaccacggcuggccccaaauuaaguccuuaguuccucuuugaacuaaaaccaguccuccuucaugauucuguauuuggaguggaaaaaaaauggauucuuaagccauaaaucucaaaguuagcuuugauuuaauuucucagcucaucucaccuggauauccugcugauccuacuucccaaguauggcuuuuucauuccuccaacuggcuuccccuccacccuuauucccagcgucuccugccuaaacgaaggugcagcuucccaucuccccccugcuucuuguauuggcuuucggucaguucugcaaugcaaugucuccacaugaucuagugcuccucucugaucuucucucucccucaagauaccccugcccucccaaauggcuuucuuuuagcaaaagaaaagaaauccugccaugcacuccuccagcugauggucuuuacagucuacauucacugggccuggaacuccuucuuugucuagacuacaucuccuuuaguucucagucuagguaucacuuaccugauuccugaugcccccuugcuuccccucugcccccaaaguacuuuguuauguuaucuccugccugccccaccauaccccauccuccugagcuguagugacugcuucucccugacugguuuauaaaugcccagagagccuggccuuucauuaagcuguucuacucaaguacagucauuagcauacaguaaguuuuccucagaacagaugaaauugaauugagaagacaacgugguaagaaaagaaauggaagcuaauucauggaugggaggacuaugggagaagaagggggugaaaugggauucuauaguagaaauacggauggagaagaugucuugaaggugaaagagaaagaacuacaaauaucucuuugaggaaagagacaaccaugguuuuuaaggacauggauaugaagauuuaggcagagagguguggaguaggcaguugugaugcacugggaggagaaacgggauggaaaguucacaagaucccaccauuagauaaagagcucuauuugauuaauaauagcuuauuuaauuaagagaaggagaaucaguguucuccagggaauucauccacaagguguuguuguccugugccagggccaacagacuccagacagguaugcaaggugucuuugggaaaccucaaggcacaguggcuaggguucacauuggcaaggucaucauguccaucugcauuaaagaauaagaaaccuguggugauugaggugucaugaaaagccaauuucauguuucuuaaggaagucagggacauuugaaugggagauguauuugaugugucauugauggugugaaaagacugggacuacauaagaagaaaugugaguagucuuuagaugcagagaacugccuuugugugacagccagcaaggccacagaguccucaaacuguagucauaagaaaguggauucugauaacaaccuuggaagugaauguuuucucagauccuucugauaagagcccagcccaacugauaauaugacuuuaguuuuguaagccccuaagcaaagaacacagaugaacccaucuggacuacugaccuacgucacugugagauaaugauguuguauuaaguuguuaaguuuguuguaauuuguuauggcagcaauagaaaaugaauugugugggaguuuuuaugauaaccaaacuucgaaaguaguaguuucuuaauauuuauuugcaauguugaaacuaagacccuaucaaugaaccuauuguacuuuauuacauuaaaacccauugguuuaucuuguacuuugaauggaucgauuauccgugcaugguuuuuagaacaucauacauuagucauuagaaaaauaucacuucacuugguuauagagagcuucugaacguugacucauucuugacuacacagaauaaacaacucauguucaccuaauauuacuaaucuuauccuaaaggucuuuaaggguauaaggaaguucucaagcuugcagugugagauagagguuuucagacuugaacauuuuacccaacggcuuaaauguaaugaccgacaguaaaugccaucaguuguuuuccuuauggugacagaauugcuuuguugauuuucaacagaacacuagccagauccucaacucugaauaaccacagucugucugucgauuuccaauaaagagaaugcccuacaaaaaguguggguggugcucauuuaaaagaagaaaagcaguuugcccuguugacuugcagcuggcugcacagaugcguuugcucagaacagucaucauacuuuggggugggguggaauugcuccccuuucuauagagacaugcauaguauuuaaaagauacacugaauuauuugauauagaauaaaauccuaacuuaaaaaaaucauuuaucaucauuguauaugugcgcgcauagauaggagugccuuagugcauguguggaggccagaagacaaccuuguggagcuuucuuucuuguuuucuuucuuucuuucuuucuuucuuucuuucuuucuuucuuucuuucuuucuuccuuccuuccuuccuuccuuccuuccuuucuuucuuccuuucuucuuuccuuccuuucuccuccuccuccuccuccuccuccuccuccuccuccucuucuucuucuucuucuucuucuucuucuucuucuucuucuucuucuucuuccucacuuccaccuaagucaagucaccaggcacgugaugaagcaaauaccucuaccuacugagcuuguuuguagaaccccauuauacguuuuuauuuuauuuuuaaauuuuucauauauauuuuauugguuauuuuauuuauuugcauuucaaauguuaucccccuuccaguuuucccccuuccuccacaaagucccccuccagcucccccucccccugcuucuacgagggugcucccccacccacccacccacagcuauggagcccauuugguauguuuguuuuaggagacagggcuagcuucaguucacaauccuucugcuucaaccuccuaaagugcugacuccaggcauguggauaccacaccuggcugcaauacaguaauuuagaucaucuugucaagauguucugaaauggcauuuccgcuaucaggaguaaguucauugguuaugaagacugagugaaaccacugccuuuguccaugcagaggcaauggcacuuuucccccagucauguuuuguuuuguuuuguuuuguuuucucuugacaaaggcaacuaguggcucugccuuacaaaaauccauccacccuucagaauccuaggggcuccuuuugcuuuggaccacacuuuaggguugcuguucuaaggcgaggcuaggagggaagggaagcgauuuuuaaaaugugcuggcucuaaggaagugaggagaaaaugucuacuucauucucccaggaacucgcacuucccaccccugauuuaccuugugucugaaggugguagcugcucccuaaggcugucugcauccugagaucguacaugcucugucaaggcccaggcagcugccauugguguuugccaguccauccugcugccccgugccucagcuaggcuagaucuguuugucucucagaccaaauaccuugugucaaacaccuuucuacucacagagaaggaacaccugccguggaagcaaucccaggucaggcgcuaaggagaggggggguguagguuagucccuguucccagagcuccuacauaaagaagcucacuucagagaagacuaaagagaauggagcauaccccuucauaggagggggcuacagauaagaggccucugguggaagacagccacuccuguggcuugagggcuuccuggaguccaagugcguucaucaaggagcucauggguuagguaauuucuuguuauggacucgagggaggcauuuagagcacacaguaguaauaauaugaaccaaaugagagaaccuguacaauguuggaggucagaccaaaacuauaaggacaaaucacaggugccugaucccuuuuugccagccauaaguugcugcuguaugugcgggagcuggacaggagccaaguaugggaagccaaaucuggcccgauguguagaaacugcccaaaggugugagagauggaaagaacuacaagcaguugaccgacucaaguuuauuucuucuuacuccagccuuggcauuuuuagucaugggaauuggagacccagagagaugaauuuauuucaugcgaagucaccuggaugauaaacuacaaggaaauucuucuaaccuaggaauuucuaggaccagcacagucgaagcucugaguguccacagccauggaugggaaauggaaugauaacaaagggggaaagccaccgugcacugagugcccaucccacaucaggcugcaaggacaauguccacccuguuuugcucaggcuucucuuacaggcuuuugagguagagaucguugguaucccugcaugcaacucuaacuagagagccaagauuuuccacuugaaguuuuccugcagaaacgcagguguaagauaaguggggccucaagcccaacggccaccaagucacgucacagcuacuugacccuuagccgauuaaaccuucugugccuccguuuucugcuuaucuuugaguggagacaauaaucccuugcaagauuuuuuuauaaggcauaaaugaaauacaacaauaaaauccuuaacacacugccugagagauacugagcauggaaaccuguuaacuauuguguuguugccauuuuaauaguuuugcuaggacccgccucccgggaaggcaucugucauugcuugccagugucuauagccaggauaucacaagggccugaagauuaaaaagacaagaaaaaaaaucguaccacagggaauucaaccccauuuucagaaagccucaugcuagugagggaaaggagacaauauuaaaagggcaggguggagagguugagacagaagagacaggccuagaccuggccugucuaagugcaggugggagggaacguuggugggagugaccaugacaggcccucuccauccuagccuccuccuuacccucuaccuuuguuuuucuaggccuccgcaguccaaaugaggagcaaauggggagcugcgagaggcuuugccaagagagcaacgccacaugugccauagccagaacucauggugugugugugggaugagguagggggcugcauagucacaaacuguuccccagagggaacucccugucccagccaccugagaggccgaguccaagacauggcacauuugggacauuuggacuugaggacagaagccccaggcaccauuugcucucugugcuuugggaucacgcucucauuguagagaaggccuucgcuccucuuucugagcagcuucugcccaccuuuguccuuaccuucuccacccagcacuuuucacugugcauucaggcuuugcaaccccagaacaggaugcugauucaagaaccagacaauguaaugauagaguggguagagugggaugcaguuuccagacaggagagaacacuggugacugggucuuucagcucagccuucaggggccccaugauccuggcuugcugacugaggcacuuccugugucccugguagcuccuuuucuucacuggcuucugguggcuucuguuaagagcccagugauggaguucacagcccaguuuugucacuuucagcucuuugaccuugggcaaauguuuaaucucaacugcagagugaagccuuuaggaauacauuuccuccaaguuugcuuaugaggcuaaauuaagcccuaaauguuucacugauggucucugcucuugguuucuguucugagcuccuuguccacaccaacaucacaucuccauuuugccauuguccuuuaaacucaguuccgugcauuuucucccucaccuaauaguuuucuuucgcccacuggaaucgaccauucuaugguuaagaacaaagaacuaugugaacacaacgaauuacagaaugacauguacuacuuuaaugcugacauugucuuuuacuguaauucccaauaagauauauacuuuacagcacaauucagcacacaacuugaucuaucuaucuaucuaucuaucuaucuaucuaucuaucuaucuaucugaguaaaauaaauguuucucaucuuugucaagugggauucauucuuucuucauuuuuaucuacuuuugucuuagggucucacuauguaucuuuggcuuccugaaauucacucuguaagccaggcuggucuuagacuuacagagaucuacuugcuacugccucuugagugcugguucucaacacaugugccaccacauccaggugggguuccuccuugcauuugcuauuccuuuugguaaacacugaucucaaccuaccaaguugguuuugaagccugcugaaaggcuugguuugagaaccacagccucgggagaaccccaagacucacugauacacucacuccauucagaaugagcauaagauuuuucaguggcuggaaaguaugaauugguuacagaugaaaguccuguuugugaaauagaaaucgagucacugggaacugcagagauucugaagaggcaggcuggacacaaaugacaagaaagugccauacagaggaguucggcuuuuccccauaaguaacuaacugggugugucuagcaguuuguaagcagaggaagaucacacacacuguuauaggaagaugauuguacauuggguuggcaaagcuaagucaagacaaugaggaagcuagguugcuucaaaaagaauuaugguuuuggacuauggguuuuaaaugauuaaacauauuuucauggaucaaaauggaaaugauaauaacuuuuuuuugccaacaacagauguuuguuuauucuuauaccauaaaagucugugauucaggauuugauaaacuuuuggcaagcauuuuuuuucuccauccuacugauuauggaaguguuucccugcaaaauguugucuagaugcuugaaguaggagccaguugcugagauuaguugaaaauagcagaugaggcaggacucagacccugaaguucuucauuuucuuucuuuaguaauuaaauuuguucacugauaauuuaauacauaaacccgacacauaacaguugaggagugacucauugcugaugacugagauaaggaaggaugauagucuaaaaagacauuuacaaauugcucucacucuuuaccuuucuuuuuuuuuuuuuuuuggccacucacccauauaaacacccauccuucagaaaugaccccuuuaagcuuugaucaucguucauccuguggucagguauugucguggagaauugggcccccucuguugacaauacuggccacguuaaccuuaguuuuugguucaucuccucaaugugcugagcacacuccuaggauguaauggcuuuacuagggagcuagaaagcuauauuggaucaagcaggcaucacagcacccaauagggcccaagacccaguucuugauacaaguuugacuuugggaaguguuuugaaacuucucaauccaaccacugagaggauugucagcaguuugugcaacaacauguacuuucuaucacacagucaguugagaaauggcucauugcuguugaccagaauaagggaggauggaugauagucuaaaaugaugauugaaauuuuuuucaacaguuuaggaaguaccacccacucaucgauuugcuuuccauucugaauggcuauuaaagagucuccagugaaaucuuuagcagugccugcuccagugauaagaggauugguguggaugggucguuguuaacuucugguaaccagccaucacacucuucauccucaaagcucuaaucugcucucuauaaacacuuuuaggcaaccacugcacugaauggcuuuugguacucccuggacuaaauauguugaugauguugaaaguugucuuugcugcucuacaaucauuuugaacuuggagagaaaaaucauuugacuuuguuuuuuuuuugucuaacaucaucuacacaguauaaaauaagcaucaagggagggccuuguagagauggcucagugaaagaacugaggcugcucauccagaagacccagguucaauucccaguacccacaggacagcucacaaccauguauaacuucgcuuccagggaaucuaacgccuucuuguggccuccaugggcuaugcauguauaugcugcacauggaggcaaaauagccauacacaugaaauaaaauauauguuaauaaaacuaaacaaacagcuagucauggagccacaugucuuuaauuccagcacuugacaggcagaggcuggaggaucucugugaguucgaggccagccuggucuacagagugaguuuuaggacagccaggauacacaagaaaccaugucucaaaacaacaaauaaacaagcaagcaaaacaaaacaaaacaacaacaacaacaaaagaaaaauacgaagucauuaagaaaaggaaagaaagaaaagaaggaagaaagaaagaaagaaaggaaggaaggaaggaaggaaggaaggaagaaagaaagaaagaaagaaagaaagaaagaaagaaagaaagaaagaacaugaaaacaugcauuauaacauaaccacacuuauuuaggaaugucuaacaucaaauggcaaauuucaaauaugcaaaauccagcaacuuuuauagccacucaagguccagauaagagcagacagagggagccaucagugagugggaacauggacgugcuggaggaggcaaaugugaaggacagcaaaacagaaaaauugacagcacacagagacuuuagaucaagugcugguucaauaucaugcuggcuaugagaugcgaacacaggagauuuguugggggaggccaauccuucaacuuuggaaugaacgugagaugcccaccgagucaaucccaggcuagaaacauaacucuuguucuuucacucauucaauaaauacuuaugagagccacacuaagagguuagcaucucauuuuaccaagugggaacauuaaagaaauaaacuaguauucaccaucaccuucacuuugaaaaugagauuauuuuaucaccccaaacuaggaaggacagcaucucagaaugaaggacaguuguuacgaacuuaauaaauuuaaauuguuggaaaauucuccuagugacguuucucucauuuuacugugguccauugaaaacaucacuguaucacuuggaucugaggcucagugaguggagaaaugaguagaagaagagagguuggauucaaagaugcugagccaggccuggcagagcaugccuggaaucucagcaggaaguggaagcagaaagauucugaguuccagaccuguauaggcuacagagacccugacucaaagaugaugaugaugauaugcuguagagacaacucaaaauacuacuacuacuaaugaugaugaugaugacgacagcaauaauaauaauaaaaaaaauaaacugugagguucaauucccagaugauagacaagaaaugagagaaagaaaaauggggaguaucauggaggccaaaagaggaagaaagauuugaaaccuuagcucuuggccaacagugucuacugcugggcauugccuagcaaggggauggacuagaaagaggaccuacaguucagagaguucaucgaauuuggcaauuaggaggucauuggugaccuuugucagugacuuuucacggagaugaugggacuggagccaaauugccauuggcugaggugugaaugggaggcugaggaaagugugaguuuagaagugaguuuuuuuccuuucagcagacuggagagggagggaaaggacagagcaugacaaggagguggggagagaaagagauggagggaaagaguaaauuaggggaguaagcggacuuguggggagggagcucccuuguuuuagggagucacagaaacaggcaguuaacacucugguauagggaaccuggguuuugcuguagggaaggaggauacuguccuggagggagagcacagaggaggguggauaaggccaaggcucaggagagaagggauuagccuuuaacaaaaggggcaccuuguccacuguuaggacaggguggagggagggaaggacuuuggagaggcaagucaguuuuggggguugggcagggcacugagguaauccauccuugaaggccucuguuuucucagggaaguaggaggagaaguuguucugagcagggagaaggguggggcaggaacaugguagguugcugaaggaaauuuggaaugaggcccagagacacuuggagguugcucuggggccuugacaagggaaccugucugagguugguggagggguuccgguuuggcagaggcuaauugguuuuccuccacccucuaagcugugagccuuuuggggcaggagccacaacacuuuccucuuucuagccuaucucuuugccaagcaauguuuaacaaaguguugggcccagagagcgcuaggauucuucucaggaaagucugaggaaacaauaacugacaaaagccugcacacuauaguugauagagaaaaauaggugucaucuaauugucuuuauuaguaguugcccuguuuggcuucggcugaucuuucccgccaccauuuugaccugcucauuccuguucuguccuaacuacaagagagagcagucaggcucugauuauuucuguucagcaacaggccucuaauccaacaacuggggccagugccuuugucuccuccacggcugagggagugucagagcagguguauugggagacaggcagaaggcucccucggaguuaggugagcaugcuggaugcugaguagaaggcgauccaugaagccugcuuuggggagggaagggacuagcugaagggauacaguuuuuaaggucaaugguggcauggugagugacauaacuaagucagguugaaaugaccugggaccuccagagaaauacgugcuccccucgccuucccucugaccucuuuuggauggugagaggucaccuagagagaggucaaaaagauuccaggggguaauaauaugccuuggguucuguccgauuuugcaugcugucucuuuucagcccagucuguuuggcuuucguccuucguucucucagucucaucccuccuuuuagcaaauuuccauagaaauuuggggauagcauucccucuuagagccagcauccagcuccaacuuaaaaugcagcaucagagagcuuggcccaguccuagguagaguagcccacugggcucauuucacuuccuauaauaaaccucuguuuguggauggaacauacagugccaggcccuuaggugguugaacuguuaaaaaacaauuuacuuagauuaagccaaaacgagucuuccuuuagcugcuaucaaugggccucucugucuuugaagucacacaggacaaguauaauucagugcgguccaauccucagguauuucaaaauggcugccacaaccccaagaaauuucuuguuuuguggauaaauguuuuauauauacaguuuuauucaucaguuaaaacagauaauguauacuguuuuuaauauauauucuuuggauauguauucaauauauauuugaacuucucuugcauauguagcagaggauggccuaguuggccaucaaugggaggagaggcccuuggucuggugaagauuauaugccccaguacaggggaaugccagggccaggaagugggaauggguggguuggggagcagggcaggggaaggguauauaggggacuuuggggauagcauuugaaauauaaacgaagaaaauaucuaauaaaaaaaucaauaacuaaaaaaaaaagagugaaaagcauaagguugagaaauaucccuuagaacuaacccguuuugauaaggaaaacauguggaauguacagaaugcacagcagaaaaugcuguucaguuuucuucuagguaaaagaaaggauaaagaacauauuuguguuguaaaaacauaaaugucauguuuuucaugaacugagaaguuaugcagccuauauucaccaugccuuccagaucagccccacguccauaguaacucaacuuuguguucucauucauuuauacuuuuuggguggaaauuguuucaaaacaucaugauauaauaaaggagguaaaacuucgccuuacucucuuacucccagagccaacaguugcagcauccuucccucuaacuuuuuaauuuuuuuucugugcauucuguacauuccacauuuuuuccuuaucaaaugggauuauccuaagggauauuuucgaaacuugcgauguuuuucacucuugaacacacuggcuguuuacgcauucuuccaccagaacauucuuccaccaggacaguuuuaauaugaagucguuuucuuucuuuuuucuuuuuuucccucuuucugggaauagggguugaagccugcuguguguuugcucuaccacagagccauaucuuuagcucuguccuuaacuuuuuuuucuuugcuguacagaucugaauaaggucggaagucaugcugaguggcgaucaguggggucuccauaagaaacccauggacaaaauucgucacagcauuuagcauccagcuuucacaagcuugugcauugaugacaugauuuugacuaucugcuuaguaugugauuacaagauuggccacaauuaauaaaucuaauggguuuccuauuauuggacacugagguuguuucuaauuucugaccauuacaagccaggcugugaugaauauuugagacacuaagucugggcaggugcuggccacugagaucaggagaaauauuuuugaaaccucuaagcaugaagugcuugccaguuguuguaacuggaagcguuuuggcaaaggcccaaaagcuggcuaaugccaaggacucugccucaaaccuuuuggcucucuagggucacuagucauuacccagcucuuugucacagaggguucagguuggcagggccuuggggacccacugagccagcacccucgucucacgugagaugaggccugggaugguccuuuggccagccagugcugggcagaacccuucuagucuccagcaccugggcuccuaaacuagaaacugagcuguggcauuuggaaucugcccugcaaacucccugggcccgcucugcuccccacaccacaccacucucugcggaggcgguggaggggcuuuaggaacuuuugcaagucaauugagcagggagagggguggggagggaauugaaaagaugacuugagguuugcccagcaggagacuggacaggccccacccagaacccuucuuuauccuaagccacaugacauacuucguggcagugaccccguaucagggaccaccuggcaaaucuccuugggauuugagcugaaagagcuggugagucugucacucuucuuuucucacugggaaccagcuuugcuaaaggcucuuguauucagccuucugucccagacaagccuggcugccuuuggguacuaaugagagccccuccuucccaccuuggguccugauccugccuggggaauucacacaaauggugugagauuuaucccuucuuuauuuuccuuacugacuuggagcuguagcagaccccucaccuccuccccagacccuguuuacucaacugggagagauuucacacccaagaacacagcucucucuccaagaucccccucccuagaucuuuaccagcaucccucaucccccauccuugcauugccugaauaauugaugagucaaggcagggcuuauaaaagggucucuaggggaaaagccaaaagagugcugaagguucugagaacuggaagagcugucuggcuuggugucccaaggauggaccccgcugccucuccugcugcugccccuccugcugccccugcugcugccccagcugcugacccugcugcugacccugcugcugcccucccuggccaggccuuggcccaagccccugcccuagcacaaaucaauggacaagaaggugcuaggaaugaacgguaagugcaacuuagccuuugacagucugaacccaggcuuagggagcugcgggcaggagaaggugugacgcccaugguggugucugguucucuuugaaggggagagacaacagagagccucagcccuucuucuauaccuuuggcuggaaauaguuugccucacguaucauuccaggugacggggaagggcgcugagagagagagagagagagagagagagagagagagagagagagagagaaagagagagagagagagagagagagaacauugccaaagcuggaagccaaguagccugagcuucauagggaguccauacaauucacugagggaacaggagaggcuacuguggaagcuaggcuuaacgcaaccuggacuaugggacccagaugguagcagguaacauagagugacagggccaaagucugaagaggccuuuuguuggggggggggguugcugccucuguccugagcaugccacguuuccuuuuccuugucucugagagucuagaggagaagcaacaggcccaggaguauucgaaaccauuucucuaauuaggaagauggcaggguucuguucucaauucuuugauaucagaagcuggcaguaagauagauccucccuauacagcaggcauucucuucuuccaaacauuucauguucacauucaaucaacauuugcucaagccacuccuugcacaagguaauguacuagggcuuggcuaggggcaaaugugcccauacauaucuuucaucuuagaagggcuccaucagacaaugacaaagcagugggguaagagcagcgaugacauuguuggagcagagaggaaggguaucugucccagacuuggcucaguugucagggaaccagaggaguccuggagcacauggcuugugagucaaaccuucagaggaagccuguguuuacaucuuguaccaauuuaucucuuugucacagggcagcuuaucuuuggagacccuggcuguccucuauaaacgaccagccaaggcaggcgaggagucugguggacugggugaguuugaugcccugugacauguuugcacagacacuuacagccaugucccuucucagaaauccccugaccccagucccaggauggacaaucugggaaggcauuuugccaacucugcuaacauuucauccccacaguagcucuaggaggaaggcaggaccaaagcuuccaugacaaaugagacuaggagaucaaagcauagcguggguaagggaccugggcuggacucgcagucaguguauuauguauggagcuggugcugggauucaggucccuuggugccuugccucagagcuuacuuacucuucucccugaauguuuuguccucuaagagaacucugcccccuguaucgccuccaaaugggcacugaaagaaaacacucccccaggacuuguuuucaaccagcucgaagacagaccccuugcuguagggcagggcugggagguggcuggaucccaaggcaugccuaaagcauggagauugucagaaccugcagguuucugacuuuucuaugggagaggcaguuaagccacaugcucgcuuuugcuuuggacaggcugauaauagggcgacagcggcugaggcugccaagacugacucugacuuccaucacccggucagguaagcuucuggcguucaaguucagacuaugacaaauagccacaagcacugcauacgcucaugacaaggccaugaugcaggaggaaagaggccaugcgacuuaauaggccaaagugacuugccccugaggcccucccugucccugagcucucagaacgaaauccugugauuccaaccaaugaaagaucccuuaguaggaaaagaggcacuggaaugacggaacuguuagugaggcuggcacuagaguugugaggcucuggggugacucacuguaccacagugguaggccugucagaggugaugucccuuccgggaaccauuuuguagcaguuguaaagguucucugcuaaagcuccuucuucccucucagccuuucacugcagcuggugacuggcuugggcuucuuucuuggcccuacuggcccuucugcauuugagauuugccuaagguaggugcccuguuucuucucuguccacaggcucuacuggcccaagucccacuccuuugacuaccucuacagugcuggggagauauuacuaaacaacuucccuguccaggccaccaucaauuuauaugaggauucugacagugcagacaaugaggaagacaaggaggaggaggaggaggaggaggaggaggaagaugaugaagaagaagaggaagaugaagacaaagaugucaaugagaaugaaccagaaguguguauggggguaucagaggccacaacacauaaggccacagcucauuccccugacccacacucggccuguccaaauugaagcaaucccagauauacuuggcacguuuccaagggcaucgauucgcaaagagucuccagacacagcuuuucuggauugaaaccaguguccucaggcugucuagcuccccccuggcuuuccugauuggccugcaagucuaggccucuggcaugcucucgucugggcugcucuugugccaacaguaggagguucuucaggccugggagggaauagggaggcuugauuucugaagcccucaugaaguagagcaggaaggaugcccuuauagaagagcacagucacuccucugggccuuuugaguuuucaaagacaccaacaccaguuccaagcaauguuaaggcaccuggagggaaggaagggaaggaaagagaagggaaggguaggguagggaacgguaggguagggaagggaucagaagggaagggaagggaagggaaaaggaaccugaagaaucugcuuaucugggaaccugcaucccacuuugccugcuauucaguuagucugaguauuggccuaagaugagucaggagauaaauaaauggaaugauguuugccuuuuucuuggaauugugcugauuucuuaacugaacucugcccauguugugaagccauagguggagggucagagaccaacccaaggccaacucauugcucuaccucuaccucuggucagcugacagauuuuucuccucugagaauguaacgcuggggucagagccucuugaccaggcccucucuguuuacuugugaaaucaggcuugauuaaacuucaagggcagcuuagaaaaggaaggaaaaaacacccccacaagcacccccacacaacagcacagcuugagaguuacggguagagaauguagacuuggguaagagugaaauguguuuuguccuuuaacccuugggggcugcuguuugaugugaggagggacaccuaaauacccaaucacuccugucaguuggaucucuucgguucccucaguaucuauuguaccuccagcucugugaacuccugucccaauuauuugucaacacuuggucauaacucgcagcacuuggcuucacaaguggucuacacacuggacaccaaauaaggucauggccuugccucaccaacaacuagacauauggcuuaugcuuuguucuuucuugaaaggggugugucacauuaccacgaggcacucugacuucuuuccuuaggaaagcaccugcuugcuuggauacagccauccagugcuauaccuucacagaucacaccauuacugugcuauucuggcuuucuuagucaucugcuuugauguuugcagcuuuuauuuuauuuuauuuuauuuuauuuuauuuuauuuuauuuuuuucagacauagucuuguuucauagcccccguuguucuggcacuaugcagcccaggcuggacacagacucacagcaauccuccugccuuagcucucgcuaggacuacagguguauaccacagugccugcugcuggucaucaauuucugcuggucuuuucagauucaucucccuacccuuacaacuuguuuuccuugcucuuaaauguagcacacguucuaccuccucuguggcuuucaaugccugccugccugcuauggcuuuccacucuuacaggcccuuuaaacucacauucauucaauagaaguaccucacacuauccuucuauggggaacgucuccaggcuggauaaccccacacacccacugucucaucuaugauagcaucugucccuucuucccuauauuugauaucccaugcaacuuccuagccuagcaugcugcucaaaagaaggcucagaaaaucauaaaggaaaaaaaauccucugguguucucaaaguggcucuugggagaggcacugacccacuagcccgcucacuuaagcauggaggagaugugcuaacagcaucuuauuaaaaagcaaaauaguggcucuuuuccuuuuccuuucccuucccuguuacuccagcucugagcccuagcagagacuucccuaaaagggauggauaugcuggaguaggccaucaaacucaggcgcuggggccaucuaucaguuauuugucugggaagaaggcuaucaggcaauugaccuuugaccucuuuaaauuccuucaguucauccugcuucuucuguaagggaaauggaaucucccaggagccagcugcaugaccuugggugaguuacuuauccacccagagcuuuaguuucuuuaucccucucaugaggauacuggugacaguugcugucagggaggcugugcugauucagugagauggaauaaagaaaacagcacaggcccuggcacguagggacaacugcugcucacaggacggcagucaccguuguguuaacaucugaacuaggaauucuugauaguagaaaagaaaugcacuugcaggcuugagugugaucaugccugauuuauuuaacuaaugaguaugucuggggccucucugguuaaucuuugucaucauuugaugguuuacaagucaaagaaaagguuacaguguugauaaacaaguaaacgacaaaagaggccuucuguggcuugcugggccucucuacauucaaaugguaccuagacuugaugucccuuuguccuaggacagagguuuugaaacuugaccugcuuuagcaggaaaacuuuucuucugaauugaauguggaaaucuaacaaguaagucagcuaaaaguauagcugccccaggaaacaaaaaaacugaacuguggggggaagggggugggcagaaucccccuuuuacucuuuccaguaagugagcucucgccaugccauccucucuuggaaaucccuucaaggauccccagacugugggggaagacuuuggaaacacugucccaaggguaacgucaagaaugguuugaaacugaagggggauuaauuaguauuuuaacauguccuguguuucaucuaaaaauccuuguuuucggguccuaagcucugagcauuuaauaauuugcucaaguucuucuucuacuguaggcuauaaggauuuaaagcccuuggaaucccaauauccuugguuuuaaaguauuauauagcuuagaauuaugaacccauaaauccucauggguuuagagacccuaaaacccuuggaguaguaauucccuacuccagggagcacggcucacccuccuccccauugcucacaugcuguuagugggcugacauuuugucuuauguuccucccagccuuguguccugaaauggcuuccaauccuccuccccugcacgguugcuuagugauuggaauauucuguucuaauuaggcacagccagugagcccuaccucauaacaacugcagugccgugccguagauuguggagaaaauaucuucauaagacccagacacuugcuagcuccucccacuuguuccgcccuaguccuccauccaccaucuaucgccccagcauggacuguuuccuauaugaucacaacauccgaugacagugaggcuguauuugaaauauggacaucggugcacuaagugcuaggguucagagagaucaaaccauuaaguaagguuuccauguuaaaaaaagaaaacagguagggaugggaggaagaucugggaggaguugagagaggagaaagaacaugagcaaaauauauaaugugaaaaaauuuaauaagaaaccgccaacaaugacuaucuaugaguuuugaccugccauuguaucaauacacuacgcuaaaacagugccugaaaaggcuggcagauucauagauuccccuggauucagagugacaguagugagucauuguguguguguucagggaaucaaaccuggauccuuuagaagaagagccagugcucucaauuacuaagccauaucuccagccucaagaccccaguuuuuacucccagugucucgggaggaaaagggacaaauguccagucaagggugugugggugguuggugaugccacugaauuggacccugaagagcacacacaggggguagaaugucugcgagacauggcagaaccacagagaguucuugaaguguuacuaagcagcaggcuuggagacuugacaugaaacugucauacagcaacucugagggacggguaguuaggguagcugagacuuugauugguuugauaaaaccgauagccuaggcacaucuucauaugagucaccucagcuaacccuuacagcauucccaaguguaacaacuauuguuauugcccuuauuuuuaauagauaaggaaagggagguucagagguaauaaaaucgucucuacccgguuacacacauacuaaguguauaccuucuacuaagcaaugacugaagugacugcacucgcccgugcuuacagugauggggagugggaaaaguagggguugggacccugaggucugaagcccuguggcccaggagggaaaaugaacaggguauggcaaagguaucguccugugggagggucaaaaagaaaagguuuaaguucugccuagaggggagugagucagaggaugugagcucugggccaggagccaggaaaagcugaaggccacugaaaggagucgcagaagaagggauuuuggggaucugcugcugggcacagagaagaacugcagcuaaaggcacagggcugucagagacaggggacugucgagagaggugagggaggcuuaucaucaccccagugucacugugcuugagaaggagccaggccucaucugcccagaccauguuucagcggggcacggacuucacacggaacuacccacugcugagcacucccuagauggcaaaugcagugcucucuacucuccccacucugcugagaaagugucucaccaaagccccgcagagugggugagcuuuuccucacgcauacaugcaugugacucagagaaguggaguggccuggccaguaguuccccagugggacagcuggagacccggagacaguacaacuacugaguccuggcugauaacaacuagggcccucuuuccauuuccucagagaagcccccaagagcccugcgagcaaacugccucguacagacuacagcaaaaaaguguggaaaaggucacugauaccugucaucggugauaucugaagcccgaggggaaguguggauuguaaaacacaaagagacaacccuacaacuaacuggaaucacaaggugugagccucgcucuggguucaacugguguacauuaccagacagguacacagcgcccucucgugguucaguucuaaacguacaguuuuuggauucuaacuugcucuuaccugugacuagaaugaaaagcugauguguuaaucaauuaacacaucaauguguuaaucaauauguuaaugugaguugucuguaacauuaagaauucuauagccgggcgugguggcucacgccuuuaaucccagcacucgggaggcagaggcagacggauuucugaguuggaggccagccuggucuacagagugaguuccaggacagccaggacuacacagagaaacccugucucaaaaaaacaaaacaaaacauaacaaaaaagaauucuaugaaacacauucagaaaucuuguuugaagaagguauacaugaaaacugaagaaaaugacauuaaagggaaaauauuaccauaaaaucucucuuccuucaugggggagggagagauacacauuaaauauuaagaacuugccacacuagacuagaaaagaaccuuuaauauuuaaaaaaaaaucauuuucaaugguucugucggacaacuguuuuuaaaaaaaacccacauaaaaucgcagccuauuagcauguuauaaaagauuuucaauuuguccauagauccaguccggcuuaagagucuaacuaugugauuuuauauaaaaaugcaucacccaucaaacauuaacaaaaccuccaaaagucagucacuuccaugcacuuugcugugccucugugggucuugccggacgcugaguucaagcugucuuuucaccucggacacuuagaugacugagacuaugaacaggugacaccauaccugggcagcaauuuuuagugccagguuguaaugaggacagacuguugaaugaaaccaacucgccauucaaauacucuucucuagcuaugcauccgguagaacauugauuuuuuuuucaauuuuuuauuagauauuuucuucauuuacauuuccaaugcuaucccaaaagucccccauacccuccccaugcccugcuccccuacccacccacucccacuucuuggcccuggcauuccccuguacuggggcauauaaaguuugcaugaccaaugggccucucuuuccacugauggcugaguaggccaucuuuugauacauaugcagcuagagucaagagcuccgggguacugguuaguucauaauguuguuccaccuauaggguugcagaucccuuuagcuccuuggguucuuucucuagcugcuccagaacauuaauucuuuuuuuuuguuguuguuguuuuuguguuuucuagacaggguuucucugccuucuucccucucuuucccuuucuuccucuuuuucuucuucccucccucucucccuuguagacaugcacccauuauauauagaugcauauuauacauguuuauagacaaucgcaaguggcucaggcuggccuugaacugacuaccuagcagcugaccaugaccuuaaacuuccugccuuccucuuccaagugcugacaucacaggcaugugcuaccacaccaggaugacuguuuuguuuuaaacucaugcuuaguagucacaucucugacguccccuuuccuucccaccccgucucccuucuuuauuuuacuuuucaaucucugguugccucaaccccacugucuugucucaaaggaugcacugcugacaaucauguguguccugaccucacuauaugggguuguguaacugagucagggguagcaaacauuuucagacaguaguaaaaguuuucugaaugcauaaauaaaaauguaauuuuccaaaucaguuuccuccaauagaggggugcuggguauaguaacaaaaccucaugacaguucccauuugugugugugcgggugaaauuuuaguuuuggcaauuuccauauuuucuguuuugauuuucacuuuugugcgagagagagagagagagagagagagagagagagagagagagagagagagagagagaaucaaguuggguggguggggaagaucugggaggagucgguggaggggaaauacaauaaaauauauuguaugaaaaauuuaugucaaagaaguggaagcuuauuucuaaucaaacacacacccgaaucugaggugcuuuguucacgguuaccaugaaguguugcuuagcaucacuaaugccuuacugauaaccacaugacaugcacacuuugcacuguacaugcugcuagucacagcacgaagucccaaugaaugcucucugaagccgugggucagaugcaagccuacugcauuuaugagcuguggugcuucugcuaaccuuaaugaguucucccuucuuacaggaguguucugguuugaguaucuagucaaccaagacuuucacuggcuucuuucuguuguuucucagcauguauccaguuagcccauuuuugaauuguaucagaauguuugauuuugaaaugugcugcugggguugcugauuugagucucaucaaaacaaugaauuuuggcuuggaacuaauaaaacauuucccaugauuucugcaaugguccucaacauacucuuaccguuuagcacuacauaccuaggaaaaauggcauucucaguacugaccacugucaaaauauaucaaacacacucugagaaaugugaacgaugcucuagagacugcaggaucaaauauuccaccaagguucaguucuuuauguaaaaccaggcaagcccaucuaucucauuugcagaccaauuguuuucaucuauacccuuguucucguucuugugugugcuugccugcgugagcaaggaguaagcauaccacggugcucaugcggacuucugaggaccaaguuucagagucaauccucucucuuccauugugggaucuggagauggaauucaagucagcagguuagcacaguaaguguuuuaccuacacugaagcaucauaaccaauaauccagcccugcuuucaucuuuaacaaaugguaaaaaguauuuguauaccaaagaauuaaaaaucaaauuauuauagcuuaugagagguaaauguuugaugugcauaaccuuuguauauauuuauauacccaacgcugugcaaaauuucauagaacguaaagggucauaagugagaaccguuuuaagaugcucuguuuuagugcuugugggucagacagaccagcucacuucgguuuuuccccccuguggauacuuuuaaggcuuucaacugugcauuuucagugucuugcagacacuaacauugccuugcacagacgugcaucucucuccgcacuuuaaaacaacuuuacauccgugcucucauugcuucuuuucauacuaaagagauggagcaugguacaaaaggaaaugcuguauucaaggcugcacagggcucaggaccaaugguacccagcgucuucaagucaagcucagugcuuuccaccagcccuugcagucaccuauggccccgaguuccauucaagugugaggcacuuaauagcccaggacaugguugacccuugaaagucacauugccauacuuugaugccccauuuccuauuuccacagaggcugaaguuguuccccagauaaagagucaaacuagauagaggccuucacauaaaagaacuggcagcauguugcuaggccugcugacccaaaauagccacaucuuaaaaguaggccaggaguacgaucaaagguuagaugacagggcugaagcggcauggacauaucuccucacccaagcacuggaaacugcuaagcaaaugccuacacuugcaucgcagucagcuugguaaaguugcucaucuccucuugaaacuaaccauuuggucucagaagggcaacuugucucuaguugaugcaaagauggggaaguguugaguuguacccucaguguggaucccagugguaggcagcaucuuuuugcagacacgggugggggugaugauaauaaauaacucaaaucucccagugucacuugacaugucucaggggcagagaacacgggcuugacagucacuaccagaggcucugucaucuuauucuuacguacuggcaaccauccaagcgggacugagauaaaucacugagcccaaagacacccccccccagcccuuuauuugacaugggagcucuggcaagcauggcucugcagagaggggaaaucguguuacuucuucccgauggauuucugagugacacugaauuucucuuuguguugucacuugauuuucccucucucaucaccaugacaacccgaaccgaggagccagcacugagaucaauuucuucccaauaggcauuuguggaacagcgagugagcacuguaauauuagggaagaagaccauuuuuaacccucuuuccacgcuucagccauggacuaugacagagagcaaauacugucauuuguaauuccaggcacuucauaucuuccugucuucaaucuuucuacaugggaguuacaaaucggauuagcugcagaucaaguacugggccuccugucauagcaaagaugucauagcaaaacacgauacccaucguuuguacacaguccaugcgcuauacgauuauuaggucaggccagaucuguucugaagccuuuagcuccucaggcugacagaaauguauccuuaugcugaguuuucugauuccucaaaagccagaguccccuggaauggucagagagaggaagauguuaaacucucaaaucaagauuuuuguuaauauguacugcuuuguaagaacgucacaugcuaagacucagguaugaaaacuucccuuugaacccacagcaugcaggguuucagcgcuaucccuacccauguccacuguagguagaaagggggacacauacucauuguccacacccaucacugaucugaggaacaggggcauacaucaaauuagauuuaaaaaauugaaguuaauaacuuuuaaacggacacagcaacuaugcauguuauuggggaggggggaaguauuccaaugcauuuauaacaaguaaagacaggaucaggguaguugacuuaucauccccuacaaagcuuucuucgaguuagggccauucuaguucuucuguauuggccauuuugaagucuuuucuugauuccuguuagucaguaaucccauucuccuauauagaauggaaggaguuauuucucccacucaucuggauccuugcucccuuuaaucauucuuuguucccuuacucucacacucuucucaucgucuagugccuaugaggcucuccaguauuuccacaugcaagugagaauacagagcccuuacucuucugggcuccacuuauucagcguaaaugcuguacaccuacaaagcuuccagauauccacagaaugcucauggccaucauguagugaaauuguuagucugggaguaggggcuuuacacugggauaacaguguaaauguccucugaacauaagcauggaaaccuguuugagcagcagaacauucuugggaaacuacugcacauguuaagaaacaaaccauacaagcucgcaacguaaaauugcucuugguuucuugagauaguguuucauguacugcaagcuuguuuuaaguaugccaugcagccaaggaagauaaugucgaacuacaguguaggaauuuuaaguuuucaucaucacgccuggauuuuaaagguuauucuuuauagauguaggggauucuacuaauauuuaacauuucugagauggggauacucugauggaaaggaagaagcacaggauauuaggagaccuggcuugggcacuuguuuaaguucugucauaucaccaagaaaauauuggaugaguggcuuaguauccuccugucuaaaaauggggcaaucuuuagcccauuaaccucagggguuuuguucuuaggugugugugggggggugcauaagagaauuggauaccuuuugaaaugauauaaacuacuuugaaaccaugagaguuaacauuuacuuauuuuguguguauggaaguucgugaacauguaugugguuugccacagugcacaugggcgaccugugggagccaauucucucugcaucugucauagggaucaaaguaggucgucaggcucagcaguaggugccuuuauuuguuaugccauuucucucuaggucaaagugaacuguucaagaaggacugugcaaagaacuucagcaucauaaucuuccaaaaaaauuuuuguggugugugugugugugugugugugugugugcuuguguagaguaccuaccaucuuuucccuuaguauguuuguuuguuuugagagaacugauauacaucuuaugccaaccugaagcucacuaaguagcccaggauggauuugaacuugcagcauugcuuuuacagucuagaaucuaggcauuucuggugaaaacacaaaugaaaauaccauaaccgagaaagaagacaauaaaauuaaaugaagagagaugagggcuggaaacauggugcagugguggggaaucuuucuuucuccuggagaggacucagguucacuucccagcacucacauugguuggcuuacaaauacucagaacuccaggcucaggugauccuguguccucuuccggcaucuuugggcacccacacacaugaaauaaaauaagaaaacuacacuguuuccaaggagaagagagacauaaaguuggcaugguggcgaaaacggucaucccagcauucuggugguggaggcaggaaguuugugaguuugaggacaagccugaauuaaauggugagaacucaucauuaauucauaaguaaguaauaaauguuuuaaaagggagauaggcagguuaaacacuauuucaaauacccagucucugcaaauucguaucugugggauuuucuuuuguuuuccaaauguuccuuagaaggcuuaccuugcuuuuuuuggcuuuaaguuaaggguucagccgguuagagggggaauaaaccaaaccaaaccaaaccaaaccaaaccaaaccaaaacaauccccacccccagauacauuagucucaaaaaggcacaauagggcuggcagcugcauggaaucacuaaaaaccaaagacaaugggaucucccuguaaaguccuagaaauaauaaacaaagacaaaaaaacuacuggaucaacugcacaggcagaggcacaaaacacuaaaguuugaauuacaccucauacuuuauuaaaaaauccaaagugagucaacucuuucagauugugcaucuaaaugagaucaucucgaauuugucucucuguggguggcuucacuuaagagcacggugcccuucgucauucauaucucaaguggcaggacugcuuucaauuuacaguauuccauugugcaugcaucccacugucucuugaugcauucauccacuguuuacuugagcuauugugcauagugcuagaagggaccaugggagcacaagcaucucuucaacauacagaucuuaucuccuauuguuuaccuccuaaaaaccaggagcugggugcucagaucagagguuagagcacaaagaaaggaaguuggagaccuaccggugaaaggauccaaaaugaccaugguuauugacaauauguuacaguuuugaaaaaugcuaacagagccauccaucugcuguugguugaugaguuauugugcacacugugagaaggaccaugggagcacacuaugaugacuaugguuauugacauugacaaaauguugcaauuuuggaaauggugagagucaagcauggugccucaugccaccacccgacacacacauaccugggaggcugagaugggaggacagauacaagcuuaaaacauacugagauagccaccuagggcuacauaguaaggcucugucucuuuauaauguaaggaacaggagguuaaauauuuucaacacaaaaauuuagaacuauguaaagguaaugugucugcuaaccgggaagauuugguuauuccacaaugcagaaacacuuuaggaaaucaugacauaauuuuaucugugauuuuuaaaagacaauuuaagauuaaacaacagcaacaacaacaacagcucuuaacaaggaaacaaagcacauacgugcugaguaccagaauccugaccaauugguggagaugagggaaugaaggaaagacagccacauucccuaaaagcugagauacagugagcuggagaagacacagcaucccaaaguacagccuguuuauuauaucccauuguacagggagaugggcuauugcaguugaacagggaagcaggcuuauuaaggcagcauucuuuaggcccuaagcagcuaggguugggagaaagcuacaguggauguuuucuguacacacacacuguuuacauucacacacagucccaaagaaggcuuugccacacuucuaguuccugcuuggggaaggcuuuuccacuccuauggguccaaagaacuugggucuuugacaugucaaugcucaugucaaacaauugacauuuacucagaacuucauuugcucuacacacacacacacaaacacacacacacacacacacacacacacacacacacacacacgauagauaaauaaauaaaauaaauucaaauaaaacuaaaaccaaaaccucaaaaugcaccagagagcuggcaagaugcuuuaacagauaaaggugcuuuauguucaauucccuacaccuacauagugcaaacagagggccaaagagauguccucugacuuacacauuugugucauggcaugugugugcaugcacuuauacauaugcaauaaacacacagcauacauaauacaauaaagacauauaauuuaaaaaaauggagcauagaccagugcagaaaaucuuugagaucccgggacaagcaggcaaagagugccaaggcaacaucaaacuuaccuuacuacaaaggaaaaacugauaagcuggaugucuccugcucuguuaaagauucugugagucauugacuacaagccacaaaggacaaagacaucuagguuauagaguccucaaaacacaacagcaaaaaacaaaacaagcaaaagaaaaguagaugugcaagucagccaggaaagggacaaagggcaugggacauauagcugacaaaccagcacaugggaagguggccagaguuaucagcuacauucaauuucuagacccugcuacaacaaaauagcccagguugugugaguuaaaccacauuaauaauaauaauaauaauaauaauaauaauaauaauaaauuucucacaauucugguggcucaagggucaagcccaugaugucagcaaugcuggcuucucucuccucagguuguagaugggcuuucucagagcuucuccaugccaguauuccucagugcacacacccaccccuacuguguaccuuucuuuuccaaaaguaaaauacuuguauuuacucuuuaaaguuuuguguaaguauauaaugcacugaucauauucaccccucacuccccauuccgacccucacuacucuccaaugcuucccaccucccaacuucuuccccuucuuccccuucuuccccuuccccuuccccuuccccuucuucuucuucuucuucuucuucuucuucuucuucuucuucuucuucuucuucuucuucuucuucuucuucuucuucuucuucuucuucuucuucuucuucuucuucuucuucuucuucuucuucuucuucuucuucuuccccuucuuccccuucuuccccuucuuccccuucuuucccuucuucuucuucuucuucuucuucuucuucuucuucuucuucuucuucuucuucuucuucuucuucuucuucuucuucuucuucuucuccuucuccuucuucuccuucuucuccucccccucccccucccccucccccucccccucucccucucccucucccucucccuccccgauuacugauacucauaugcaugugauuguggggccauccauuggagccuggacaaccuaucagugaccacaccuuuaaagaaaagugacuguuuuucuaccaagccacccacugguaauuacuccuuugguaggauuggggccuugcgaguuccuuucccuuguaugcuggaaauuguuuaucaauuaaauuuguuuucagauaauuucauauauauauacauauauauauguauauauauauauauauaauauugugaaggucuuauuuucuuaacaugaaaacauucuugcaggacuaacaccccaaccuaaggcccuguacugacuaguuuugugucaacuugacacaggaguuaucacagagaaaggcacuucaguugaggaaaugccuccaugagauccaguuguauggcauuuucucgauuagugaucaagggggagagucccauugcggguggugccaucccuggguuggguagucuuggguucuauaagaaagcaagaugaacaagccgggggaagcaagccaguaaguaacaucccuccauggccucugcaucagcuccugcuuccugaccugcuugaguuccaguccugacuuccuuugguggucaacagcaauguggaaguguaagcugaauaaacccuuuccuccccaacugcuucuuggucaugauguuugugcaggaauagaaacccugacuaagauaggccccaguauauucuuugacgaugccauacauguaugcaacauauccugaugauucuuuuuuuguuuuguuuuuaugguuuaagugcuuuauuauagaaaugcagggagaaagagagaagguagaaagagagagggggucuagagaguaagagaguaagagagaggagagaggagaggagaggacaaagagaaaggagagaggagagaagacaaagagaggggagagagaagagaggagugagagaagugagaaguaagagaucaaaggagcgagaguccugaugauucuugucuccuucucucucuccuucucccccuccccucccuuaugagggagagagcucaaggggugucaucccccccccaggggaacuacuggcucucacugggacaagggcuuauuuuuuuauuuaaucaucucuuuaaauccccuguuuccaaauucauguuaugagguaauagguacuaggcuucaauaucugaaacugauguggauacagaucaucucauaauaacuauaaagaucauaaaaugcuguucaauauuaagugucaggcuaauacgaaugaaaaccugcagugagauauuacuacauacuaagacagcuguaauaaaaagacagaaaauaacagguguuagcaaggaugcagagaaaguggaaaucugauccagugcuacggaaaauguacaacaguccaagcacauagagaacaaucugucagugccuuaaaauauucaacguggaguucccauaugccucaguaauucuauuucuagaucuauaaauacuuuaaagaagugcauaaauaugggcacaaaaauccaaauacaaccauccuuacagacacauuauauauaauucucccaaauuggacagcaaaauuuccaucaaaaguagaaugaauuuuuaaacuauagcuauacaaugaacuaucagagcacaaucaaagggaagcaaugauugagauaccauaugaaugcauuucaugagcacaaugcucaaucaaagaggcuaaagacaaaagaauaccuauuucaucacaaauguaagauuccaugaauauaauuuucaaaaauggaugaaacaaauuugugaguucuagaaaucaacauuguuaucucuggagagaagcaaaggagcuaaggcccagcagggggcaguagcucuacagcacuuacugagguauauguucauucaacaagacuucagucauuuaucugugcgguuagaguucacauggcaaaauaauucaccuauaauuuccaagggccgggacuugguccuagguucuuguuuuuuuguuuuuuguuuuuuuuuuaaauuuggucuuuucccccauuuuguguauuuacacuuuauuuuuuaaauuggauauuuuauuuauuuauuugcauuucaaauguuuuccccuuuccaagucuccccucuggaaacccgcuaucccauuacccuucccccugcuucuaugagggugcuugccccacccacccagccacccacucccacuuccccacccaagcauuccucuacacuggggcaucgguuuugacaaggggaaauagacaugggcucucaugcccaaccaagaaucugucuccaauugacaacugcuugccauguuaaaaauaguuuucuucaauggagacucacuaguuauauuuaccccacuugagaaugggcccggugaccagcaguggccagcacaacaugaccucaaugguauuucuauagacugucuuuugcauguugcuuuguuugggcauguucugucuuccuggguucucuguuuuuauauuauugcuucuaacucuggacuuuuauguuuucuuuuuuuggugugucuauuucuuguagguuuuuuuuuuuuuuaauucugguuuguuuccugcuuuuugccuguuuguuuucuaaagagaaagagauagaaaggacauggcguugggugagagucugggaguugugggaggggaacuguuaucagaacauaggguauaaaaguauuuuuauaaaauucccagggccagcaagauggcucaguucucucuguacaaguaugauggcuuauguuugaucccaugaaucugugguggagaaagagagccaacuccugaaagcaaacucuucccugccugccauaugaccauuaaugcaugccucaccccauguaauaaaucaagguaaaaaauuuaaaugucccuaaauuaauaaaauaaauaaauaaauaaauaaaucaggcaugguagugaggcagaugacccugagaagcuagaaccaggagaauuacgaguucgaggucagccucaacuacgggacacaggaaaguuccaucaucuccuaacaugcaauguugcuucguugugcucagauggacucauacccugaaacccagagcagccgcuggucucuucuuuaucacuauagcuuuggccuuucaagaaugucuagaguuugcuauuuuaaaguagucuaauacauuuagagaagaguguuaauugguacagagcaucaauacuuaaauuuacacugagaagcaaauagaaggacacaauuuaggugcagacaggacugcuccucacuggaguauguaucaagugaggguagacuucccuauagaagucuucauuuauuaauuuguaugauguugaauauuagaacacgggggcuaggcaaguauaguaccaaugguuuuaucuucuuucuuuauuagacacggucucucuguggagcccuggcuguccuggaacuugcuaugcaggcuaggcuggccucaaccucacagagacccacuugccucugccuacugagugcugggauuaaaggcaugugccaccuguugguacauauuauggucaguugacuuuauuaaaguugaucagauaaagucuuuucaaucaauuacaacaguugaauuucuaauaaugagagaauuaaaaugaauuauuuauuuaaaucauauaaaaaucacacguaauggauuaaagauugcaaaacucuaugaaauugucaugagcaguuuccuuaauaugaauccaaaagaacaggccacaacccaaacuaugggaguguaucaaacuaaaagcacugauagcguugaggcaauggacaacagugugaagaaacaacccagggauggggagaaagcacuuguaaucuauuuaucuaauaaagggccaauauucaaaacauguaagaagcgaguucauuagcuagagaaaccuguuuaaaauuauuuucuccauguuuugcuugcuguaacaaaacaccuuauaaacaacacauguauuacuuacaguuuuggacacugggaaagucaaagaccaagagacaagcuguuucauaaaugguauacuuccuucugucuucaccaggcacaaaaggcagcucucuugggucucuuuuguaaggguacuaauguuuucuaaccuaauuaacauuuuuaaugauuguauuuuauuugcauugguacuuugccuacguauaugucugugugaagaugugugaucgccuggaacuggaguuauagacaguugugagcugccaugugggugcugggaauuuaagucagagccuuuggaagagcagucagugcucuucacugcugagccaucccucuaggccccuaauuaacauuuacuuugcccucuucauaccauuuuauguuggggauuauguuucaauaugugaacuuuguaaggagagacauagacauucaaacucuaccaauaaacaaaggucugaagagguauuucuaaaauaagauaauuaauaaauaaguaccgacgaucauaugccccaguacaagggaaugccagggccaggaagcaagagugaguggguuggggagcagggcaggggaggggauagggggcuuuggggauagcauuugaaauguaaaugaagaaaauaucuaauaaaaaagagaaaggcaaaaaauaaauguuaacaaagcuuaaaauuuuucaucccucagauacuaugaauuugcaauuuugcaauuguuuauacacauacaacucauaagaaaaaaugcuguucuuuuaaggagacggucuuuggacauuuaagaauuugcucuagauugccuggacaagaccuauuaaggcaaugccacccuagauuuauaucccaggcagauuauuauaggccuuacacaaaaauaauuggccauauaaucucauucuuuacaucaucaaaauaguaauggcuugagauaauaauuugguauuuaaaauaaauagauagauagauagauagauagauagauagauagauagauagauagauacauagauagauagaugugcaugucauguuguaaagauuugcucucaguguccuuagauucuaccugcuccacacauugguauuaauucuugaggacuuauacuuaaucaauuauugcaaauggauacucauuuuugauuuuagaaaaauaaaauaugcacaugugacuauugauaccuuuuuagucuuucuaauuacaacugcuuuaacaagaaaagcaacuaaaaguauaguuagucauugccuguguugauuuuuuuuuuuggcuugguguuccgaaucaaauuaaaacuggcuauuacagccaagcauuugagauguuuugucuacaauuuaauguuacccauguuacugagauuucuauaauucucaaggaaacgguacuguggaacuuuaaaucuauaucuucaaaaaaaaucuaaauuuggaugccaaaaaucucucugaguaucuauggcacccuaaaaccaggcauacucaugagaugaagggaucuacuuauuggcacauggcaagauccuguucagauaccuaauaugggggaaagggggcaauguuucuguuuuuuccacagaaugcugcaagagcacacuagcuuccaaugugacaggcugaccugugaguaggaacugauagugcccugacaguggugacaagaaagcuguauugagcacacagagaaggagaaauuggagagagcagacacaagcaaaauaaagaaacucuuccuaucuccgcuaugggcuacagcaaggagagccaacuugcugucaacuuggggacaacuuaaaacagcugacucgugaggcagagggacugcuacagaguauuggacaagauuucaucagagacacuguuuuuggccauucaggccaacuccccgauagcuguaaaagcuuguguaccuuaccuguaugcuauauuguuagauaauuuuaagaguuaagaucaccaaucuuggcaagucuuuucauauucauuguaauucuugucaauuaauuaauuguguacauccuaauuuauauaagcaaucugcuguuaugauuuuguuaaaaagaccugcuuauguuuugcugucuauuagaguuaggaaaggauccuugauuuaaaaaucugggaaugcaaacuuugaaaagguaucuaccacagcuuuagaucagcagcugcauacugcucauuuuguuaacgauaaacauaggaauauuuccauagcuuuaucagagcaacauauuauaaaaaaauggaggcaaaagaugucuuagaaguaguagucuuaguaauagaacaggauauaacauacauuaaggcuagaaaggcgaaauuucaaauauuggcaaaagucauuuagacacuuggaacauugaugaauuggcuagagauuuaaaaaauaaccuaagugcauugaaaccccauggauuggguucaauauauaauccuacuugcuauuauuauuggcauuguuuuauuaguaaucauuguauuuccacucaucuuuagagcacucuugagaacuguagcuacgacaagacgggacauucuagaacuucggcugaaaaaaaaaagggggggggaugccacgcauaauccgaugaagucugcuugacaggcugagaggccuggaagugcucacgaggcaaagaguuucacagaaacucaccuccuggaguuuuggaguucucauuaacccauauacucauacccuauuccugcguuagucugguguauggauccacgugcucucuuuuaguauuauuuuauuauaagugccuuuuaagauugaauucugacauagcuaagccuucgccaguguuccaacguccuagaaaguccuugagcugaccaugggcuuggaauucaauguugccuauucagugacauucagaauugccucugguauuacacuaucacuuagaauaaaagccaagucgcucccauauacaggaauuuacaaugguuuaggaaguagaucgggcugugguuuuagaguauugcauuauucaugagaugguuagcuagaacggaacucccuaguuagaaccaugacuugggugugaaagcccuugcccuaggaguauaaagaccucacaccuggcuucuaagacuauagcugaccuuagauagggcugacuuugucucaguuguuuuauugcccaguuccugccagucuuugugcuuacauuccucuguuuuguguaagagucauuaagcauccagcauccgguaaccucauuuguaucuugccgaugugucaccuaacuucccuauuuucuucuguauaaaaaguuugaugcucaauuugacaaauuacauucagauuuuacacaaucucccguguuggucugucugucauucgccaacucuuugcccaccugugaccagagacccguuccacgaagacaaagggacccagagggucugugccauggcuaguggauaaagagugcuggguacuuccaguagacccagguucaguuucuagcacccacaugacagcucauaaccauguguaacuccaauucuagggagggucuggugccacccucuggccucugugagcaccaguuauaaauauacacguaugaaaaaaaaacccauacacaaaauaaaaugaauacauuuaauagccagaugaaccauaagaaacugcagaucacuggaaagaucaagaucuuaaaagcaugaggaggggggcauggcucaguaguuaagagcacuugcuacucuuccagagcacccaaauucaguucccagcacccacaugguggcucacaaccaucucuaacuccagauccaggggauccccgccccccucuggcuucaaugggcacaaaaaaaaugaaugugaugcacauacauaggcaaacacucaugcacauaaaauaaaacuaccucuuuaaaaacauaucuucaaagcagaaaucagagagaugguucagcaauuaacauuuuguugcucuuguaccggaauugaauuggucucccagcuuauaucuaguggcucacaaauggcccaugacuccagucucgggaguucugaugcauucuggacuccaagguuaccuauauucauauguaugugcucaccucacacauacacauaauuaaaaaauaaaaaugaagacaaguuuaaaacuaaucucgaaaagaugauaccugcaaagggagauggguggaauuggggugucuauugauggaugggaugguugcaaaaauguaguuuugaugacagaaauagaaacuguagcacaaugugggcuuaagaagaaaggcaaugugcuuuuccugaugccugaguggaugucuaguaaugaaguugcugguauaauuugccuugccuucagagauaccauggcauaggguaucagugucacccagauuucuacuucaagcccucaaacagaauauagcugauaaaaaccaaacuggaaaguacugaaauacuaauacaaucaaauuaaaaauggugguggugguggauaaauugugggcauucaaaaucccuuuaaccccuacuccagaaccagagaccacuauugccagaaugcacugcauucccugccuuuccuaugccuugccuaucauucagaaauucuaggaacacaugucugaugaaccauuccuuaguuacauggcuauaagggguaaggaugcugggaaaucagucaccugcuguuuuauaagguacauaacugaucaguggcuggugagguaugugaaagaauacauaaaugugacaugagggacuuuguuuuuagggcaaagaaacuauucuguauucuuguugugauacaaguauauacauguuaauauccacagauguacauaccauaaaaaguuuaugauauuaucagaccaaacccuccccaacacaaugauagcccugaccuguuguauaaaugaggacugcaggagauaaacaguuucuccauccuucuuaaguauuauauauucauauauaauaucaauuuucuacaauagucucucuucuuucuguuuuauagcaggugauauuaauuaacguaucauuuaguuuacacagugcaggaugucaagaucagaucgagaaugauuaaagaggagcaaacaucagccguggauggauucugguaacugauagagacuuggaucuuccguuaggagagagcaguguccuuuuguuuauugaggggagguuuaugugaugaugggcagggucagcagcugcugcuauugccuauuauuuagaaguacuagaagggugcggugcauagcaaaagcaagaaguaacauagauaaugacacagaucaacaaugguggcagguagauucuaaggcucucgggggcagcucuccuaaucucugccuguugaucuugcuuuuauguaaucuucuccccuugagcauaggcagaacucauuacuuguuuuucaucaaaaacacagggcaaaggcaggacacugcuauugggguucuggcacaucuaagauacucuuugcagaagacucacccuagaggcuagccuuuuaucuuuuuaucaagaccuauagaugcuaaagacaccuguggaauugugugaggcauuuagcgacugaggguggccaccuauaacaggcugugguuucagagcuacauagaaaggacauagagacuuggaaguagauuucuuccccagcggaaccaagucuuuaccugagaaccaagucuagauuaucccuugcucacagccucauaauccuacccagaggaccuagcuaggcugagucccuagugaugacacacuuaaauaguuagaugauaaaugugcauuguacugauuucuuaugcagcacgagaagggggaaaugcucacguaguucucaguauccauucuggucuggggggggggggguugcuggacuucagaagggaaaagcacaauucccaccuuucuuuagcacucugauucuggacuaugaugauucuuggcuggcagggugaacacugcacuucugacaucugcugcugaagaugacugugaagauuucuggcuauuccgcugcaauuuagucaugagugccugggugcugaggggcaaggaacuuggcauccauuugcaagugaaucaugucucuggagguagcgaguguuuucacucuggcaguuuccuaucauacaagaauuagcaacuguccugcuagccugggagggagguggucuuggauguuguguuugaaaguucaacuaagcugcuccuucuaauaaugauacaagccacuuacuauccagggauaaacaguuuccugccuaaaccaauugagaaugaauucugguuuucuugcagcuagagucgaaacugauguagcaaggaugcauaggcucaagugauauuucaguuaugugucaguaaagugcauaauaaaacauuuggccuuuuaguaaaccuuucauauuuaauauaauagauuuuuaauacuuaguuuuauaaagacaaagucauguuauaacauuuaagguaaaaggcauaaugcacugguccaguuugacacaacaaaauauuuugaauauugugaacaacucauuugcuuaacaaagcagcagcuauaaaacuagaacauguuuugcuuccuucuccugcagacucggaaaauacauuguugucuugcuuucauuuauaaucuucuugaaauucaaaaaaucucuuuauuuauuuuuuauugaucaagacuaaaauacaauauucaguaaucuuuaccauuuugacuuuaaaauaauaucaaaaacuaacaacauauucucuuaagaaaguaucuguuguaaauacaacugacaaaauauucaacaaaguguguauaacaguaucuuuguauacaagcgcggaccauauguuuuucuagagcuaucaucguauaauuuaacaaucauugcauaaugguagaugugugaugguucucacauaaacuaucaacuaggauugaaaauugggacauauuuuagcuaaucaucucugaguugaggcagaaaggcuuaguuuucaacuaucucuuuuaaguagucauguccuugaaaagacagcauaaucaaaucuuaaagaugcuaccagcauuugaccaaauucaacuuaggaauuuucuuucuuuuuuuuuuuccuuugaguuuguuuauauaguggauuacauuaagggauuuuuuaaauuuauuuuuuuuuaauuuuaauuagguauuuucuucauuuacauuuacaaugcuaucccaaaagucccccauacccuccccccgccacucccacuuuuuggcccugguguuccccuguacuggggcauauaaaguuugcacgaccaaugggccucucuuucuacugauggccgauuaggccaucuccugauacauaggaauuuucaaagacacaauuugagaagugcuuagcuucacugaaaauaguaugugguaugguaacacaguuagguuuuagucacaguacguucuugucaaagacugaccaugccaauucuuucccagaaagggagacuuguuuggucaccaugaaggaagucuauccuuucauuguuucccuucuagccaagucagaggcucgaaauccaagucuagugugaagacagaagcuccacacacugguuccugccccauuucccaagucaacugcuaaauaagucccucuucaaaagcggcagaagacaggucaggucugcauggauugcuuguuuuuguuuguuuguuguuuuguucuuuugaaagugcuaucagcguccauauauauuuaaauggacugccauagaaaaagcauaaaguauguaaaaauugcacaucuaagucuaaccuuuuuagguagaugcuggcaauucuauauaguacccuaguaaguauuacaugaaguauacuuuacaugcuugccagacuaauacagcaauucagucuuagugaaacucuuccacacuaccuacuauaaauuaaaauacaauggguaaaaauucaaacuacaaagcugggacacaagcaaucagaagcuauucugaaaccaaagcaauaaacaaugccacucuagagaauuuuuauuugugucucagucuaacugaaagagcuauauaguuaacuaaacugucuucuaaccuuucuuuucaaaaugcuggcuuuauuugauuuaagucuaaaucugguguuguuuuucuuuauaucagcccagaauuuagacuucuugauuuguguuuaucagcaacagaguuaguagcguuaaacaccgagugcucaaucccucgagagcagagaaugcagaaguugcauguauuacuguaaaaccauguauuacuguacugaauaaaauuacguuuuagaaguaaaucuuuuaguuauauaacuuggaaaucagggcccuaaaaggcaacuuccuagauaauuaaggcuacaguucuaaagcccaguuuuguaaaguuuuuauaagacuggggucauuugaaaaacaaggcuuaccaauuugccauaacagcauuauaauaaauauccuaccaccuuucaaaagaccagcaaucucauggaaacagcaggacaaacuugugacugacucacuaaagugauaugguggcgcccucugguggucccacugagcaugugacccugaugcugcuuaucuugugacagggggagaauuuuuuaaaagugcauuuaauacaaaggaaugaaccauugugcuucugaguaucuuuuucuucugccuuggagcacaucaguaaugcaacauaucccugagaaguauucccaggaaucaggcugauagugcaggaaucuuggcaaagcugaugauggcagagauuuacaucuugguucuagaccuuagcugggagcuuuucgcauuuucuagcuuggcuuuuaaaucuaagggucucucaaaaaaccucaccaaggcugguucauuuaacagggaagcaagaaucugcucaaaugcaaacgaccacugauguucuucccugggagagggaagaucuuucuucacacugcucucugcauucccuucacuggguccagaaucacgagcuguacuggcugaugaugccgggcuauggaguuuccuuccaacuucuuccauccugagcagaagguugguuacaauagcaauggcuugauauagcgacucuucuucaggguccucaugaaauaaauuauacagggucuuugaaaauugaauaaauugugacuagaagacacaaguuggaaauagaauauuuuaacauuaaacuuagcaaauauaaguggaacucagaagugcauagcauccuguauaaaauuuauagucuauaaccuucaucauagaacugaauucaugauacaucuuugcucaaggaaauuaaguaugaaccaugaaagaacaugccacuaaagccaucucacacacugccuaaucaaagaaugucauauccaaacuaauuucugacagguuuauuggcugaaauauacuggauuuccaggauuauuuaguguugggugacaauuuugguuauucaaaauuccauauuuuccuccauguauaucucaucaaccaauuuuaagaaaaggauuauggacuucaucugaucucaaaaagcuacacugggcacuaaaugaaggugauuuaauugggggggaagaaugacuuuuugagaccuaccuaguagugaaaggaaucuaaaauaucccuuuggauugcuugucuuuaaaggcagacauagggccaaaguuaagaagagcuagucagucugcuaacuguccugagagcauuccagauaguccuagaaaauacuugucaauuuaaaagcuauucaaauccaaguguucuacaauucagucaucuaaccuuaaagguugauauggauauaaaccaagcacaaauaauaugcuucauaaaauguauuauaaacaugcuuuccucuuuccuuuucauaguacauuuauaauguacuucaaucauuuauaaagauugaagaauaaauauguaauauacuuauuuuauaaaggauuuauuuaacuaucaaacuggaaagcccauuaagacacucuaagcuauuugauuguuuuuguuuuuguaaaguucugggaaacuugaguaugagaacaucaaucagucuuuuguuguagaguauaaaaacauacggaugggcaagguauacaaagagaucaauuucaaucacaucuccuaguccuuaguauugccuaugcagagucaacuauaagaauauugggcacuaaagugaaaucaaucuuagucauauuuuaguaacuagcaauagauuugacauaugguagacaacuaaaugucuacucgguuaauauauucuuuuaacguuggaaauauguccuauguacaaaauuuccuguagaaacacuaaauacacuuaaguguuaaaaguguaaaauaauuuaaaagauuguucaccucuuucaugauuuccugacucuuauagagauuacauguagauuacuuaacacuuuugauuauaguauguagcuuauuuuauuuuuauuucuuuuccuuuugugauacugguaacugaaccaugggugccaugcucucacauuauuaaaaaaaacauuaagaauuuuucacuuagaaaauugaauuggaaaaaugaauaccugauucauucuugguaaaucuuuaaugguuucuucuuuuuuaagaagcucaucuugccauugacuuaaauaggcuugaauaucaauuuuuccuuugccugaaugaaagaaauaaacaauuuuguaaugaacagcucacaacauuuccccaacucucaaaaaaacaaaacaaaacaaaaacaaaaacaaaaaacaaaaaaacccaaaaacugaaacugaaagcuauuucaccgagguaaaacagcccaucucuuucaguccaggacaugaucugaauuuagcuuugaucucacucacuggccuucagaauauauucuccacuuccauuuacaucagugguucucaaccuguggguugucacgcuuucgggggguaucaaacaacccuuucauagggguugccuaagacuaugggaaaauacacauauuuacauuauguuucauaauaguagcaaaauuacaguuaugaagaugucuuaggguuuuacugcugugagcagcaggcaccaugaccaaugcaacucuuauaaggacaacauuuaauuggggcuaguuuacagauucagagguucaguccuuuaucaucaagauaggaacaaggcagcauccaugcagacauggugugggagaagcugagaguucuacauccucaucugaaggcugguaggagaagacuggcuuccagacaguuaggacaacagucuuaaagcccacacccacagugacacacuuccuccaaaagacuauaccuacuccaacaaggccacacuuccuaauagugcaauuuccuuggccaagcauauucaaaccacuagagagguaguaacaaauauaauuuuaugguugggggucaccacaacaugaggaacuauauuaaagggucacagcauuuguaucuuauugcugugaagagacaccaccauuagcaaggcaacucuuacaaaggacaacacuuaauuaggacuggcuuacagguucagaggugguaagcauggaauuguacaggcagacuuggugcuggaugagccaagaguucuauaucuuacucugaaggcagucugcaggaggcucugauucuauuacaucuuagagaucugccugucucugucuccugaguacugggauuaaaggcauauaccaccacucuuggaacugagauuuucuuuacuuggcacuugcuauguaccagacuggccaugaacuuagagaucugcuugccucugucuccugggauuaaaggcacguaccaucacuccuggaccuaagcuuuucuuuaauuccuuuucacaagaucuuuauaagcauggccacuaugacucaagaucugggucauaggugugcacuccauuucugcauugcaguucauuugagauauagucaaguugacaaacgagaauagccaucacaauccaucccuugucaauuugucaaucauaucucuuuauguccaaaugaaaacaauaaccaagucauaauaauaauaccuaauauaacuaucccuuguucaacugcaaacaaauaaacaauaaacuuaguuugauggaauuuugccccaagguuaccacucccuuaaucuauuuaucuccuugaauaucuugaauaucuccauucuacuuccugguuccccuuuaauacuugaaccacacauuucauauuuuucuauucuaagcuugcuaugcuugaucaaaaaugguuuucauaagcgugacccauaggguagagucaaugcuaggcuuuuugagacuuccuuugucaauggaauuaaucuaaaucucuuuauuuuagccacaggaagacucuucagacaagggcaaaaagcagucacaaucuucgccaaaauaucacaaggacaaucucuaggcaucauacuaaaauucaucuccucugaaaccucuugaaccgggaccccagauuucaaaucacccucaucacuaaaaucuuccauaaugcuuccagaguggccuauuaggucugaccguaagcauucuauugcuuuccaaaucucaaaugccaaaauccacaucccuccaaacaaaaacauggucaggcucaucacagcaauacucaacuccuaguaccuacuucuuucuuaguuaggguuuuggugcugugaagagacaccaugaccgaggcaacucguauaagguuaaacauuuaauuaggucuggcuuacaauuucagagguucaguccauuaucaucauggugggaacuauauuggugaacuuggugugggagcaguuaaaaguucuacaucuugauuugaaggcagccaggaggagacucugucccacaggcagccaggagucucugauuccacccugaguggaguuugagcgcuaggagcccaacccccagaguaacacaaguccucuaacaaggcuacacccccucuaauaaggccauaccucuaaauagugccauuucucacgggacaagcauauucaagccaccacaauuggaaagguugagagucacugauuuagaucaaaauuuuucuuuggcaaacuuaggcaauagcaaaaauaugagcaaagaguaaaaaugauguauuuagauuaaaauagcacacuuugaucccaugauaaauuucacuauauacccauauauccuaucauccuuaauauuuucuauauccaguucuucauaugcacauaugaaagucacuaaugguagcucuuuuucaaaaauuaaaaccacugcuuauugauucauuuguuuaaaggguucaguuaagaugauauuucugugaccuuuaaauucuuauuuaaaucuucuuuaaagcuggguaaaauaguggaagaguuauguucaacuagaucuucgggaauuauuuuuaauuaaauguuuuaaaaugaagaaugaugagcuuuaacuggauaauaucauagucucuauuaaaauaucaaaggugaauacuacuuuauucaauauucuuauacuucucuguauuuaucuuauuguaaagaaauaucgcuuagauugcccugaaauauauauguaaauuuugggcaucauaguuugcagugaaaauaauuggaaacauauuaaauguccaucaauauuggguuagugauugaaaaaaaagucuugcaauuaaauugugaaauguucuguuccuauugaaaguuaaaaaugaaaaucaaaugaauagacauggaaaauuaucuaugauauauuucaaaauaagaaaauagcacccaguagaccacuguuuaugaauguuuuaaaaagaaauauaucuacauguuuguguauaaaaagaaagaagucugaaaaggauauuggcaaaauuauugcagccuuuacuucugguuagguuuaucuggagcuaagaaagacuacauacugucugaauuccagccgcaaauauuaccaauuacauuguaauuaaaauaaaaucuuuaaaauaauaaagcugaauauggaucacuuaguguuacauuuuuauaacuucugagauggaagugucacaagaagaaacaauaaacuguuauacuaauacgauguaacuaaaaccuucauugggacacaucuacagccuuuaaagaacucuaccuccccccuuuacagcuauccauacuuauagaauaagucauucaauaaacugaaugauaugccuagauugucauuguaguaccuuuuucagggcuauuucuucccgauucuguuuccuucucaucugcaggcuuagaaacuaaagggaaagaggcgagugcauauuggugaacuguuuaacaggcaucuuuuaaaagaaaagcagcauucuguacgaagacuuacaagcacuuggguuucuuacccaccaaagcacuuauggaaccugaccuccuaacaugagaauguaaaguauuagaaacauucauaguaaaaaagaacacuguagauuaauauuaaaaauauccuagaggacaauccaccaaauuuaaacuuguuccugagugauaguuuccuucuuugacugcuuucaaauuaaguuguauuauuuuuauuaaugggaggaaggcuccucauauaaugagagucuaaagaacaagccaaaaguuccaaguaugguaacaacuuauugugaaacccuguacaagucacuuguuucuguacucagugcccuuauauauacaauuggaagacuuaaauagauauauauuuuuuagauuuuuauaguacucauuauauauauagcaaccaaacagacacaggcacacauagguguucucuauaagacaacugacagcuaugaaaaugaagcaaaugacacagacaaguguguaucacuuccaacucaugucagaaagcacauucaucccgauagcguuaaauaagagccauggcuuguaaaucaucaaagaucugauuggcuucauuguccuuuaucaaagcacaaacaugauaugauauagcauagagauuucuuuaauaaaauuaaaugcaaaauguauuauauauacugucucuuaaauucuuucguaagaaauuucaaaacauaaaaauuguuaaauacugucggaucaguccaauauucagaggcguugcuaacuguuauugugggagcaaaggggaaagugcagcagccccaagucaggaagaucuccaugaguaugcagucaucaagauguccuuagucccaucuaccugggagacggacggaaacaggaagaugacuggagcccaagaguuugagacuggucuaagaaauagagcaugaaccaacuccaaaucaacccagauucuguuaaaagguuaaacaaauauuuacccuggagcugacugaaauaaaguaauucuucuguugaaagcucaucgcccuuugaagacgucuuagacaucacuucaguauaagcugaaaacauauaagagaaaaguaguucuuacuccucagacuaaguuuaggugacuuggguggaaauaauauugcuguccucugcuguccaccaaauaagccuacgaucacuuugaguucccugauuucuccuuuuuauuguaugagaaugucauguauuuggauucuguauuugaucaaauccaucuccccauuucuuuccuguaauguucccucuuucacuaccacuauucccuucuaacuucaugggcucuuuuauacaacccacugaguccauuugaugcugagggccaucauaccguagcaggaguagccuacuuuuuauacucuuuaaauaaauuucggagagucauuacacauugaacaaagaaaaucuggcauuuagguuauaucugaacaugaaaucucagcauguuuaaaacuccuguacuaauaaaguaaaacacaaagcuaggugccuaacuuugcuuaucaccuguuauuuaacagaaacacaauauuuccuauuuuauauuuuauucuauuuaauauuauuacuuuuaaucccucuacaaaaauacaugaaauggaaaaauuaaaccuucaaaugguaaccuaacauaauaacaaaaaguauucuuauaauugaguuauugugugguuuaucuuuuauuuuuaacauuguauuugugauucaaguguuugaaggguaaagauguuuuuaauuuuuuugucugcuaaauaacaauuccuugcuaacaugaaaaggcucuaaaaagcuuuaaaaggaguccagggagagcauuagacaaauuaugaggugcuauuugauuuuuuuuaaauugcccaacccaagcuacauuuuacaauauuucuuuuauagaguagggauauguugaaaguaauuuucuuaggucaguggaaagaacuuuaugagaaaugaaaaggcaagguaacuuggaggaaauauaguagaacggagucagauggaucucauaucaacuaugugauaucugccacauacuugaaucuucccaacugucagcuuccuuuuuguaaaaauuggaaggaugacauaauuuuuucagagacugugaggcuaaaauaagugaguacauauagacauauuuuauaauguguaugguaaugcauguguucauucaugugcccuuguacgcauguggaguuaaggcugauacuguguaugaaguggauaacaugacauagcuuaugcucaauaccauagcuucuguucugcuucuuuugguaaguauuuacuauaccuuccaucugguccuaguaucugaaugaucugcaucaccugcaaguuugguaaccugccuacagugaaucacuauucuaaggacaaugagagcagaaauucaacauugucccaauauuucaaugauacauaauuucuuguacaagcuaucauuuaagauauagcuagcugggcaggauggcauaggcuuguuauucuugcacuucugaggcugaggucagcuugggauauauacugagauccuauaucaaaccauacacauuuauacauacauauauaaguaagugccuaauaggaaacugaggauccaccuguuauauggaaucucucucauagauuuuauuccaucuauaucuauauacacaccagugaaaauacuuaugauacuaccugauggucauaaugaaacaauaaccuugugacaaauggaaaauaaucuuuugaaauagaauuagcugcgcagcaaugccgguuacaauggaaugagcucuuacuacacacccgucaagacaguuacauucuuaccuggaggaauaugcagcuuaaaaagcagcuugagcuugucaguaaaacuuccauuguacauuauaucuguucaauaaaauucaauuagaaaaaucauguuaucgaaauauucagcagaucucgaucaaaugauuaaagauagcugguguggagaagcagcuaagaauuaggauccaaaccauuguauuucuuaagauaacaguuaaacaaacuacucaaucaguuagacgcuucucuuucgagcauggaagcaaaaaaacgcuccaccaggcacacagcaugcuuacugcacuaguuccuuucuuccaaccgcacguuugucuuucucuuugaaugaggguuuacaauucacuugaggaagaaacucuucaagauaacccaugaaaucauugcugggagcguauagcaaccaaagaaacaaaaccuccaacauagcaacuauaggcacaacucauucauuuacuauuucuguaucacuuauccaggcuauauggauagauuuuuacccgaggagaaaucccuucuuugcaucuauauaucugguguggaaaaacccuggacauucucuuccugccuuuuaaagcauuaaaauagucacaaugaacagcuugcuucuuugagagguuuggggcaaaaagaucaauauguggggcuggagagauggcacagugcuuaagagcaguagcugcuuucucacagaacccagguucaauuuccagcacccacacacacugcagcucauaacugucuggagcuccaguuucugaggauccaacacccucauacaggcagauaugcaggcagaacaccaaugcacagacaauaaaacaguaaccauaaaaagguuuaugcauagguuuagcaacaaacacauuaaaaagcccccaaaauuacuaaaccugaagauaauguaacccagagugaaacaucugucuaaacuagcagcaauagacagcaguaugaaaugguuuuuggagguagggaagaaauuuauguuuugauuuaggaaguuaaaggacauccaccuaccuauugcagaggagaauucuuugaaguuuauaaggcaaucagaguucucauccaacaaucggaauguccauaaagccaaugagucucuguuugcagaaugagcccagggacucagcaagugauauaauacucugaauugcuggcagucaaucugauauuguuccaaauauggcaggcuggggucaugaugcuucaauccuggacaacucaaauaccaauaacaagauauaaacagcucuuucuaucaaaaaaacaaauaaaaaaggaagaucauuaaaucagaaagaaguaaaauauuccuuuuaaacauguccauuaaaacguaaaaaauauuuaagaguaauugugauaaacuucugcuaagagacuggcuuucguuacagaggaacagcuguaccuuaaaaaugacauaaaguucguccaguuccugaaggcucauuuucacgucuugcgauacaacacguagcuuuaaaaagauuaaaaacaaauuagaccguaacauuucuguuucaaaacucuuucuuugaauucacuaccaguuucccucucccaggagaaaaugguuuuuuauuucuuuuuuucuuuuuaaaucuacacaucaauuuuuuacugcagcucuuuucauaguagccaaguuaguucuugauaguuugaccuguugaauuaaccuuguguuucugauaaaaauauuauuugacuuuagugcaaucacuauauaguguuagacuauuaacacuuuguuaauuaguugaaaaaguaaaauacauuuuuacuauaauaaaaaaaaucacaaauaaacgucaacgagaagaaaauuauaacuacugacaaaauggcucaguggauaaagacacuugcuaccaagccugacgaccugagcucaaucgcaggaagccaugcugauagaagcaaaugucauaacguguccucuggcuuccauagggauguuacagcacaugggugcacccuccaacaaauaaauaugauaaagaacuaaaagggcaauauauaaagaugaguauggaagucguuacaguguucauuauauagaauggcauaaauugagguaaaauacauaacucucuuggaaaauauaucaccaaaauaaauccaaauguguaaaaaucuaccccugaauagacaaaacagaaaugauaagcaaagagcuacuaccaucaucagaagucaguagacccaaaagguuguauauuuauagucuuguuuucuuaaacuuucuauggaaguuaaaguauuccagagcauagaaaaaaugaguuuacuacaagauuuauuauauaagauaagcaaaacugauauaaaaauuagcauucacacacacagaaaagaaacucuuaacugugcgugguggugcacaccuuuaaucccaauauuugggagacaagaauaggcagcucacugugagugucagggcagucuggucuacauagcaagcuccaggcucgcuagggcuacauagugacaugaugccucucaaaaagcaaaagaaauucugaaaucaauguaauuuuaacacagcugcagagaaccuugcuaaaugauuuaaauuaucgaaacagacugugaauaaauauuauacccaaauaagguucauuuaaaaaugcaauagaauucuaauuaauucuuuaacaaaauuuacuauauuaauaaaguaaaaauccacacaaucucaggaaaugaacauucuaucaaaguuaauguucacuauuaauuuuuuuaaaaaauaauuguucugaauuccaguuagaauucugugggugcuuagcaaacacucuacaauuaccuuucaaccuagaaaccuaauaaaacuuccguaguuuaauaaaggacauccuccaaaaaucaauaguaauaaaauaugagaggcaucucuauuaaauuuagaacuaagacuaaaaagccuacuucugcuauuauucaauauuucuucaagguuucaagauauauauauauacacaaagaaaaagaguacacauauuaggagggucaaaacucuuaguacuggaaacuauauacucuuuauuuaggauaucaaaaaaaaaaaagccaagugacaaauaguacaaucaguaagucagggcuguaguugcaacaacaugcaaaaaacccaaaucaagagcuuuuacauuuaugccaauaaauaguuggaaauuuuaaagaaacgagucucauucacuuuagccacaaaauguauuaggacaaaaucaacaagaaauauuuacgaccuaggugcuaguuaguuuuaugccaacuugacucaagcuaaagucaucugagaggaggguaccccaauugauaaaaugucuccauaagaucaggcuguaggcagccaagccuguaggccauuuucuuaacuagugauugauaggagagggcacagccuguguguggggauaccccugagcuagugguccuagguuucagaagaaagcaggcugagcaagccaugaggaccaagccaguacucuucuauggacacuguaccaguuucuuccuccuccaggucccugcccugaguugcuuggauaacagacugugaaacugaaauguaagagaaauaaucccuuuccuccucaaguugcuuuuggucaugauguuccaucacagcaauggaaacccuaacuaagauaauguacaggaucgaacccacaaaugcuugcuaauggacauuugaaaagucagaugacuacaauggauauugaaaagaaaaaagauuucaaaguauacuauaaagauacaaaaauguaugacauaauugcaacaacagaaauauagaagugauuuuauguauguauaaaagagcacagaauaugaaaaaguauaauauaguaauagacaauuuaauaguuuucagauaaugaaugguuuuaguuaaaaauauuaacaugcauauaaaaucuuccagguauauuaccugugaguuaaauguuaaaauaugaaauacuaaaauagaaauaauuuggguagaaaagggccaaauuuuacaugaaaaccaggcauuauguaagaaaaaggaaagacuugacuaacaaaaaaaaaucugugcuuuguauacucugacagacauuauaaaaacaugacagaaacaagauaagagagaaauguuggguuacaaugauaacuuucaaagaauuaauauuacuaauauucaaugagaucuuauacaccaaggauagaaagauaaugucauagaaaauggcgaaaggcuacaacuaaucaauuaagaagugagaaaaacuaauaaacaauuaguaaaauauuuaaagcacuagguugucuaugcugcagaacuugguacuaagaccccuuuuuuuuaacucacccaagucacagaacauugacagaucuagcuggugcuggagagugcaauaugacugcagucuaauccaguugugaacucuguaagccacaguaauaccugccugguaagaucugcccacuggugcaacaguggcuaacugcauuuuggguagauuuaaggccauccacaagauagaacccauaacuucccaaucacuuaucgcuguacccauagaucagugugucucucaggccucauuagagaagcugcuucuugcaguagacagcaauugguauagaaaugaacgacugguuaaugggaagagaauaagagacuuuggaguguucaucccuaaacuggaugccucuaucacaccuugccucacaaggcucagaggucuaugcagaagagggaaaagaaagguuguaagaggcaaacguuucagauaacuucauggaaacuuucccagacacaagaggguagaugugcauaugaacucacagugguuaugauaguacacauauagucucaaaccauaaaaaaucccagcauguaggaggggaggcagacacaaaaucuuauucuuagcugaggagcucuugguguuugaugacugcugggagaggcaauaucuguuuucuagugugaugccugggcuccaggacaaagccuauugccaggaguacacaaccaacagaaacuggacucauuggauuuaagagagacagaacaugaaguugaguggaucggcaggugaggacgaaucugggaggaguugguagaaggggaugaauaugauuaauauauaguguaugaaauuuccaagaauuauaccaugguauacuacuuuguguacuaaaaagaaugaguugauuuaauugugcugauaugcaaugauaacuauauauuugagugacugauauaaugugugguuucauuuuuuaaauguauaugcucucuuccuaucaacaugaauauauuuuaucauauuacaugguaaaaagaaauguaagaauccuuucaaauaauuuaaaaauugugggguaagaaaacuucaucuuaaaaauauuucugaaaugauuuaauuaucuauaauauauguaauuauauuuuaaguuaaauaauauuuagaaacaaaaccaaaggcucucugucuuaugucauaguaacaugacagaauuauuuaauuggaaccuaaaccuaggaucuuuaggaauauuaauccuccuagauuguaucucugaggacuuaauuuuuaaguaaguuuauaaaacaauaaaucauaaugauaaaaagucaaacaguauauaucaacauaaacaguaaaguuuuucuccacgggaucagcaaucuauucaucucacagagcagaagaaaacaauauuagcagccaccuauggaagcacagaaauagucuaagaauggauuccguuuucuacccuuuacacuuuccuauaggcauuacagagaaauaguauuuacuagaagcacugacuauuaugagggucagcuauuauuuuaauuuuggguuuaauuuguuauguguauauguacauguguagguuugugcauuugagagcagugcccauggaggucagaggaaggugcuggguucacugagcuggcgguacagauggcugugaacggcugaauguggauuuuuggaaccaaacuugcguccuccagaagaaaacguucuuaaccacugagcucuccagcccaaacuguucuuccugaagcagcgugccacaaauguguguuaguaaauguuaggugacuaaccacagcauucaguauugcuucacaguaauguugugggccaaguaauacaaagcaugcuuaaguaaacacagucauucaucuagaagaaaacaacauugcuccuccaaaaacuuacaaugaguccagcuaaggcaagaacucagcucuaaauuagccuuucucauuuuauucacauggaauuuuacacaaaguaaaagaaaaguuacuuugggguuucccccuacagaguggauacucaccacauucugcuuuguugucucuuccagggucuggaucacauacaaccuauuucgacagcgcaugcuauguauaucuucauagcggauacuaccauauuucugcaagaaaugauuucaguggauacucauucauaauaaugauccacuucucuuacaauugcauuucaucagacucaauucucugaggccuugauucaauuucuagcuauuuucaugaucuguucagugacuuugcacauuuucaucccaguuucuucgugcauuuauacauauagacauauagucaccaaagaaaauuguaucuuucuacuugugccuugacuaagaacacugguaaaacucuuagucugcaaaagagaaucauuuuaacuuuuuauacauugauacauauuuaaagaugaucaucauuugugaaagcaagugaauuuaauaucauuuaaugaaaaaucaauugagaaagaggcaguuauacaaccuagguucaguuuacagaacucuuaacuuuauaguaaaguuaaaauuuaaguuguuucuuugaauuguuaucuuacucuuaauauauaaguaugccaugcaauuauuuauaaacauucaaauacgcgaugucaucauauuuaugguauaaaaaccuuaccucauuggacucuuuaaucaaaucuguaauauccacuuuaguaugaucacuuuuuucauuacugauauuugaacccuguugaacauuugaaggcagugggcuauccuuauuaaugacauugucaaagaaccuauccaaaaaugacaauaauauaagaguuagugaaagucaaacaguuguagcagagaaaaccacggcuaaugucuccugagauugucagagaucaauuuuauaucugagaacucuugggaaggaguaugaagaagaagaauaugaagaugguugggagauaggaaaauaaguggaaggaauuacaugcaaacauuucuuugggagaaaaaacaugagggaagugaacaggcauagcaaaauuuuugagaauucuggaacucugguuucuuuaaaaaccacagaaauauuauaagaaucuuuuauaugcuuuuguuuaaucccagguguagagaugugaggcugcuucagucuguccacagcagcugacugugauuugcgucgugcucucagagaggugugguuuuugccagcugcagauaauuucugcgauuguaucauguuugaaauucugggagguuuucagaggguauacaaauacuaggcccugaggggugggugcuugcuggucauucagggagguugguugugacuuguuaguauccaugagcaaagaagaaacaaagaaaagaaauuagauccaggaauuuuccuaauucuccccccccccauccuuguuucuuuccuaccuagugauaguggggaaaaccauggggaucaaggaagaaaaggaagaacccacaagguagcaaagagcagcuacaaaauagguucggcacauauucagcaaauaacuccaaccccauugagaaugcaaugaauaucagggcuguagagggaugaaaugggaaaucgguuuuaaaaaggaaaacugaggccuuaucuuaagaguucugaaugccuugggaggcagaggcagguggauuucugaguuugaagccagccuggucuacagagugaguuucaggacaguuagagcuauuaauaaaaaaaaaaaaaaaaccugucucaaacaacaacaacaacgacaacaacaaaagaguucugaaugccaaagggaggugucuauauuauucuguacagaauggaguuuaaugaagcauugacaacagcugccaauuaauuuucauuuauuuaacucauacaaauacauguauauacacaaaaucucauguacuccaacacaaaacagcauccauacaaaaugaagcaggacaauaaaguccaaccuacccgacugcuaccaccugggaaccaggauuauuuucccuacuggaugcuuuaauguuacuaccuaggcccccgagaugccauuuuuauauagagacauucuggcuuaaacuagaauuauuguuaugauuuacuaaauuaaugauauuaguacgaauguguuaggaaucuaaguguucacaucaaagugauuuacuuucacugcauucugucuaaaaacaaaggaggguacuuggggcuugacuuuaucuaucaaugaguuaugugacuuaacgagaaucacuugacguuucuaaggucaguuuccuugcugguaaaccaagcagacugaauaauguaaucacuuagcucuccacuggauuuaaugacuuaaacagcggcuggagagauggcucagcagguaagagcacugacugcucuuccgaagguccugaguucaauuuccaggaaccacaugguggcucacaaccauccggagaucugacgcccucuucuggugcaucugaagacaguuacaggguacuuaaaaaucuuuaagccaaagugagcagaggcccugaauucaaauucccagcaaccacaugauggcucacaaccaucaguacagcuacaguguacucauagacacaaaauaaauaaauaaaucuuuuuuuuaaaaaagacuuaaacauuuuacuagugcguaugugugucuacauaccagacauguugaggggcuuauggaggccagaaaaggcuaucagauccccugaacagcagguugacaugggugcuggaaauggaacucauuugggauagcagcagacauuuucaauugcuaauucaucucccuagccccaccuccagauuucaacacaauauauauaguucuuccaguaccuguuuagugccgucaccgcuucagcaucaucuuuacaugucagaaguuugucuaaauuauagucaaguauugccaaucccaguuguaaaauggcuuuuauuccaucauagaagaaacaguccaccacauucacugcacuuucaauagguagcacacuaaugaaaagugugagaaaccaggaaagagaaacagaggaaaagaaagucaugucggucauguggucugucagcugaggaaggugaucccugauaaguucuucaaacacugccugguccaccaaggcaccuggaaaacaucaaaagaaauuccuuucaauagacuuucuuugugacuccucuccacuuucauuagcuucaggacagagcucaucuuacuuucuccaaacaggagcccauuaguaccuuuucuauaauuugcacaucucugcaacugcuaguucagugucaugagcuuaaaaucacuugggaaacuaacuuucaauucauuuggaggguuccugaguccuucuagcaaucagagacauguacuagauacuauaacuaauggugugagcucuucuucaaagaauguaguaucuuuuguggugggaggauguaauucagagcucaugcauacuaggcaaaugugcucucauuaagccacauccuuccaccuaaaagaauucaauagugagcagagauaaagguaaaugcacauauagaacuauauuaaagggaacauaauaaaaaacuaggcacaauacugaaaacuuaugaaggaacaaaggacagaucaucuauagguguuaaaauagguaaucuuuauauauuugauaacuaagauaauaucacaaauuaacaaagaaagacucaauuauuuuauauguaaauucauauaacuauggagacauuaaguugauuaaaaucucuuucucaucaagaaacuguuaaaaauuucccuuaguaguucuagauaucucaaauccuuauuugggcaauauaguauuuauaaacuaaguacguuucccuuucauuguggaggagagcacguccuucauuuuuaaaauaguaacauauaaaacauuuucccaacuauacauucaguagcagaggcuccuuuccccaaagcaucagccaaggcuuugugagauugcuugaguuugcugucuuucucaaucucauuuaccaacacuucaauuagauuuguaaucuaacagguaaggagccaggcauggugguccauaucuguaaucucagcacuuggcaggcugaggcaggaagucugcugguugaagccacauacugaguuuuacagucagaccuugucucaacaaauacccugcuccgcaguucacaaacaaaagcacucucggacccaauagacaacaggcauuaaaaauuguuuugaaaagauuaagucuucugugguugaaaaauucaugggaaccuaaaccacuccucgauucauauauucauaguauucggaguuaggaccuuugggaagugauggggcuccugccuuaaugaagugacaauauuaaugaauaggugaguuaaugcauggauuaaugacuuauaauggaaguguuuuugcucuuuuuaaaagcaagcuaauucuagugaacuugcacugucuggccauaugauaccuuaugccauguuacuaugaagcaguaagacccugacaacaugcugagcagaugcuggcaccacgaucuugggccucccaaccucuagaaccacuaauuaaaauaaaugucuauucuuuauaaaucauugccugugccauuuggugagaacagcaaaauagauuaagucagcaacuauguguagauauaugcauguauguguguguguguguaugguuuuuuuguguuuguuuuuaccaaugauucgacgauuaaaauaaucaggcaacauucguucacauacagcaaccagaagccaaaaagccucuucuucuuuugcauauaggagcaauacugaagucaaaauguucauugccuaaauuucauaggaaagaaaugaaaaauaaauaaguauuucucagguaauaacugcauuucuuuuucaaguauagaacuucucaacagcaguaaugacaaaaagaguaaauacugguaucauaaggacuugaagcuaguucaaaacagcaaugugcagucaggcaaacacuugcgaguugcguauuuucuaucauaauaguaaaggaaaaugaagcagaagcaucauagauacaaucuaauuaggcugauuuaaauugguuaaaaguccuaauaauuaugagccuuuaaaacaaaacccauaauugugaaugauguccuaauacugcagaaaacaaacuuucucuaguggagacuauccuuuggacaugaacucaaaucacccaucacuaugcacaaaaugaaauaucacccccuauuaaauacuuugucuucuuaguuauuccauuuuuaucacuguagaaacucauuaucugauacaugcuaauuuugauucaaauccuagaguuucuacuaacaaaauagguuuuuuuuaaggauauauucuuucuucucuauuuccauuccuacuuaacuuuccgccuauacuggaggaaagagaaagggggucggagcucuuucaaaguaccauuuguagaggacugucuuuauucaaucugucugauacuccccugaagacuccauuuacaaagcucucuuuacuugaccugacaccaaguucagguagcacagaaguuuuuuuccucaggaguguuuguuaaaauaaucagagucaucuacugagcauguggcugccugaggcugcugggccaaaugagaaauuagcaaaaccaaaccaaacaaaacauuugaaggaaaucuggggacucugaaaaacucuagcauauucccaaaaaucuagaagucuuuguccauguauauuuauagcuuuauguauaguuuucugaggugcuugguaugaaagccauggcuuuguguaaguuuggcaagaacuguauuacugugcuauauucuagccuguauauaugcuaagaaaggaaagggccaaguucucaccacuaggcaagcauaaagugauaggaaacagaaaaaggaaaagauaagaaaacucaacaucaucagucucacucagcuauaaacuacauuaagagcugaccuugcaagacaucucucagugcaaagguggugcaaaugauaugggcauaaccaaccacuuucuuaguauauuugugacccacuucacaaaaugaaaccauuaucaggccaagaaauucuugcuagagagaucauugauuguagaaagaaccuacuacuguuguuuugcuaaaugagcauaguauuaagccaacuccuaaugauaucaucauacccacacauuaagguaucuccugacccuuguccgagaaacuguuugcaguagaugaugaugaauguggcaaagagccacaacuagccaaagggcaaagaauaagagacuacauaaugucugggcuuaacuggaaccgcuccuacuccagaagcucaaaggucacugcagaacacuggaaagaaugaguguaagagcgagguguagugagcaacuacaaggaaacagugccuucuggauacugcaggcuucugugaacuugaacucacagagguucugacagcaugcauaagaccuaugcaaguguaagccagaccaaaucucagcauggaaaagauaguuggggcaaaguuccaucccuagcugaagaguuauuggcaaguguuagcugcucaggaagaaaguaucaguuuucucuaugcaugucuugauugucuaccaugugccaguggacagugacacacccaagaauauuuagguagcacaaacuggccucgaugagacagggaaggacaaagaacauaaaguugggugggaagggaaagaguuugcgucuggaaagaguuggaacagggagggugaaugugucuaaaauguacaaacuucucaaaggacuaaugaaaauauuuaaaaaguaauuacaacaaauaaguuaggcucaccaaaauauuuuaaaaacuguacucuuuaaaacuaacuauauaaaacccgaaaggcugaacuucaacaauuaccauaugaaaagagguaacauacaaacaguauacagaaacagaauguggugaacaacuguuuguuaaauauuggauaaaauguauaacuuucuuuaaaaauacuaauuacaaaaaacagcuauagaggaaagaaaacccagaaucgagauacaauaagagacugaauuaguaauggaaauacuuccuacaugagaaugaaggacagauggcuuuacuuggcacagccugcuaaacauuuaaagaaguaacaccagucucucacaaaccauguaaaaccgaagaggaagaaacaucauccaacucguucuagaaaucccaacauaaaaauuagacaaagauuuuauaaaacagcuacauaucaauguauuuuaugaacaugaaugcaaaauccucaaaauaauaagaaaccaaccucaagaucauacaaaaauacuauauaguaaaagcaacuuggauuuauaauuugaacacaagaauaguacaaaauauaaaaagcaaauaaugaaacgucauuuuaacaaaaaaaaaaaaaacaugauaaucucaauggacacaaagaaaaaaaaaucauuugacaaaauuuccagaggcuucaaccuuacacaaagaacuacaagcaucugaggaaacugggaauaggagagguagccuccccgggaaagaacgcauuaagugcuuauccagugccuaaugguuggcucugagaacauacauacgaauagcauuauagacugaacacauuauauuuagaaauauauggcuguauguacauauauagcuaagcaacauagaggccauacauuugaaagagaguagaaaggaguuuauugugaggguucuggagagaggaaaggggagggggaaauguugcaauuaaaaauuaaucucaaaaaaguuaaaaaaugaaauacucuuuuuucccugguuagcauuuuaagacagagcccacuauauagcccagucuagacuuaaacucaagaucccccugccuuagcuccuaaguguuaggauuacagguguauuuucacuguacucaacuucuauacucucucucucucucucucucauauauauauauuccaaaacuaggaauauaaaggaaauucuucaaccaaugaucuacauauaaaacccuucacaguuaacugcauacuuuagcaaaagacugguucuuagaagacuacaucuguagucccagcugcuccagaggcagacaugagaagaucacugaagcccaggagaacuagacaagacugaccaauaaugagauacaucuaaagcaguaaaauaauaauauuaacaaucccacuuagcauuauauugaagguuauccauuuuggcaaggaaaaaagacagaacaccguucagauggaaauuggagaaaaccaugucauuauucagauuuugugauuucaauauugaaacuugaaagaaacccacaaacuauuucuuaggaccacuaauauguuuagcaaggcuaaagaaaacaagauagguauagauaaaaugaauuuuguuuaaugcacuagcaaaaauauaauaaaaagaaacaaaauccauuuacuauaauuucaaaaggauuaaaauacuuagagauaaaaauuauccaaagaaaauuuuaagauuuguacauugaaagcuaucaaaugauauuuuuaauaaaaagaaacuagagucuuaaagaaagaggaaaacacccuacauucauaguuugaaagauuuaguguucucaagauguacuuacucuuccccaaguugaucuguagaauccauguaauggcaucaaagucuuagcuuuuuuuucuuuucuaagaugauauuuugaacccauaucauaaagaaucuuuaccaaggauucccuuuuauuuugagucaggguuucucuguagccuuggcugucccagaacuagcucuguagaugaggcuggccucgcacucacagagaccugccggccucugccucccaagugcugggauuaaaggugugcgccaccaccaccaucaguggugggacuuggauaugugcugaugcagaacuugugggaaugaccaacuaaugacuggucuaacuugaggcucacaucauggcccauggccaacacugucuggauggccugaaacuagagacugaauagcucagagaccuaggguagaauuaaaccuaaccaaaaaaaaaaaaaguaaugaaugauaugauuauugucaucagagaggauucauccagcaacugaugggagcagaugcagagauccacaugcaaacauuagguggagcuaggaaaauccugcagaaguggagcuagggaaauccugcagaagugcaggaggaaagauugaaggagcaucuagaggggucaaggauaggagaaaacccacagaaucaacuaaccugggcucauagggguucacagagacugaaccuaucaggaaaaucuauauagggcuaugauagguucucuguauauauguuacgguuguguaucuuggugcucuuauagggagugggggugccugugacucuuuugcgugcucuuggcaccuccuuccuccuacgggguugccuuauccagccuggagaugaagguuugugccuaguuuuaucauaacuucuuaugccauguuugguggauauccuugagcggccugcucuuuucugaaaggaaacagagaaguggaugugggagagaggagagguggggggagaaacagggaggaauagagggagagaaaaacugcaguagggauauauaugagagaagaauacauuuaaaaauuaaacuccuugugaugguuuguauaugcuuggcccagagagugacacuauuaggaguuguggccuuguuggaguagguguaucacuguggguguggacuuaagacccucauccuagcugccugaaagucagucuuccaccagcagccuucugaugaagauguagaaaucucaguuccuucugcaccaugccugccuggaggcugccauguuccccccuugaugauaauugacugcaccucugaaccuguaagucagccccaauuaaauguuguccuuuauaacaguugcacuggucauggugucuguucacagcaguaaaacccuaacuaagauacuccuaaucaacuccaaacuacccagugauuucuuuaaaugcauugcugcuuuagucauccuucacuuuauuaaaacaguauaugacuuuauacauauucuuuacuuaccucuauucucauggggccguacaaaccuuuucacuuagaaggcuuuaaaauuccauuucuguauguucaaaauucacaaacugccuugaccugcaagugcaaccucuuccacauaagccuucccugaucaucccagaugaaacuaauuuauuacagacccugcacacucuguauucaucuaauauuuuuucucccuuguuuuucaauuucccaauaaauauucauuuaacuaugccucuauuguguguauaugcacauauacaaaauauggaugugcccucccguugcaggcccaugugaaggccgaagguugaugcuauggguucuucuucacuugauauuccauuucaucuuuuuuuuuuugagacauguuuuuguuuugcuaagccauaacuguuuuuccuuuuuuuaaacaucagugcuagagauucaaacucaggcccucauguuugcacuacaaggauguaaccaccgagcuauaccuucucagaccugauccaugcauuuuuaaugacaaggucuuuaugugauguaucuuucuauagccuuaaguaugcaacacagugccuuuuuuagccaaauaauccauauacauauguguguguguguguguguguguguguauguauauauauauauauauauauauauauauauauauuuguuaaacgaaaaaagaagauggcucagugguuaggagcucagaagauuuaaguuaauuuacuagugccuauguugggcagcuuacagcugucuguagcuccaguggcaggagauccaaugcccucuuccagcuaccuaggguaccuauacacaugugcaaauacccucacaaagacacacacauacaggugaauaacaccaaauguuuaaaaaagaaauuaaugaaacaucagugcuuucaaauguucccgcugucaaccuccuuacuuuaauaauauucacuaucaaucuuagccuaccucuguucucauuaucauaaugucccaaaauucuggaguugcaguugguaauauuauuugaaauaugcacauaauauuugggaaucacaaugauguuauaccuggcaguauccuauuuugggauuccuauaugcauaagcugucaguacccgccucagagcagauaugccaguaucacucugaaaugcuggauguucgggcagagagcgacgcaaaucacgcucaauuucuucaguagccaaguuggaggucccuaaggauugcucaaccacuucagcauaauagccaggguuuguugccaugucauuaacagcaccugcaaagauaauugcauugacauacaaauagaaugcuacacuaaagcuacgauuugcauauaguggcauauuuuuauuaucuugaagucaagcucuaugcuuaaauaauaucugaacacaaaaagagaaauugaagaaaagggaagcaaguuaauacuauuccccagaauaacauucccaggaaguuuuuucauuuaauuuuuccuugaugcuacagauauggaccuuauauucccaauuauacacauucugccuaauauauucaacuugucagacaguagauauguagauauuuaggcaagcacauguaacuaccacuuucucucuuugaauagucugaacucauguccuggacaucuuugugcuuagagccuaauuccuugaaggggcauauuuacugucuauucagugaggaaaucaaauaaauguaauaccugagaaaagcauccagagcucuccucuuaacgucucuggaaucccucuuaccaccagaucucgagucuuuuuuguccggaacaugcuaacaccucgcccacauucugaaaauaagauguuccaugauugcuccuucaucuuuucuuucaacuggaacagaaaaagcaagacaacuaaacagugaaaaauucauuucuuuaaaauaacucauucauuugguuuaccaugaaacacuauaugcagagcaaauuuuagaaaaccaaaaaaucauauucauauucuaaagcaccggacuguuaccauacaaaaaucuuaaaccccggcaaaccuaacaguuuuaauguacuaucauuagcaguucaacucuuaaaaguugccaaaguauaacacccaggugguaaaagcuucgaaccauuacucuucccuaaucaauuccauuuucacacagacuauucgaaaucuaugcaaagaaaacuuuauauccaaaauuccgccuuuaucuucaccauugauaauagucaauaauagaaaauagaguguugccaggcgugguggcgcacgccuuugaucccagcacucgggaggcagaggaaggcggauuuuggaguuugaggccagccuggucuacaaagugaguuccaggacagccagggcuacacagagaaacccugucucgaaaaaucaaaaaagaaaaaagaaaagaaaaggaaaggaaaggaaaggaaaggaaaggaaaggaaaggaaaggaaagaaaagaaaagaaaagaaaagaaaagaaaagaaaagaaaagaaaagaaaagaaaagacaguguuguggaaccaaacaaggcauguuucaaaucucagaaguaaaccuuucuguucugauacgauuuagaucagugguucucaaccugugggucgcaaccucuauugaggucaaacaacccuuucacaggagucagcuaaggccaccagaaacacagaaauugacauuacauuucauacuaguagcagaauuacaguuaugaaguagccauggaaauaacuucaugguugggggucaccagaacauaaagaacuguaauaaaguguugcaguauugggagggauaagaaccacggcucuagcuguuuuccaacuguucuuaaacaacugcucuaauccauagauuuaaugaucuuguuuccuuaccauuuuagaaucaagauuuuccagauuuugagggugaaauacugucauuaaggcuucaguguucacaguuuugcugcauuccuuuggacaugucaaaggcugcuccucaaaauucucagaugggccugucgagucagaacuaacagcaaccuagaaagaaaagucggagugugacagucagauauauguucacaaguuccacaaaaaaaccaaacaaauacaaacaacaacaacaacaaaaaacgcccccacaaaaauccccaaaaagcaacaacaacaacaauaaaaaaccaacucugcauugaaacagaggagcaauggaucuggggaagaguagggaucggagguuggaacuuggagaguggaaggguguaaauuauggucaggauguaauauaugagagaauaaaucaaaaaagaaaaaugucuugauguucugucguucauaagccacaaucuauggauauauuaaauauuuuaaaaagcauuguuuauuuuuuugucaaaguuugucaacaaagugaccucuaauaacagagcaaggauuagaaguacacuguuaucuugguggccuggcugucugcuaauauaacguuucucuccauuucuauaccuugacccaaguggaacccuugacauuuauucucuccuucuuuggggaauuaaaugagaugucuguuugcuccacugcacaaagagccaccaggcccuuuuggcaagaguacaaauuuguuuauuuaauuuauuggcauguggagaauaaacccaggaucuccuccuggcaggacaaacacucuaccacaggcuacaucacaagcucucaaggacaagcuuugggggcuauauagguaggcauggacucaaaccuggcucucucaguaagggaagcgaagaaacaaacuacuaaaugcaaaugagcuauaauuugcaggcuuuagaaauguuucaucucaguuuucauacaugacaagauaauucugagaacaagaucuagcuucuaggcaaauauaaaagccagggccacaauucauaaaauaguaaaaccuaaggguccaacugaagaaccuuuugguaagauaucagaaagaucaaguugguguaugcuagaccauuucucuaagaauauguuagcaacucuuucuguaaaccuuuagaaaagaaugaccuugcccaggaggccaaggagacagagacuuggaguaugauguugguuucauaggaaguagaaaguauuuacaaggauucauaaaaagcccacauaauuuuuaaggaacuauuuguggcuugaauggaaagaacugagagaacacaaaaggaaaauaaauaguaggcaaauaaguaguaggcaaaagauaggaagagauagcaaauaaaaacaucuggcaucauacggcauuagcuaaaaacauuuuaagaaagaauccacaccuacuaaaaucagagguaacaauaccaagugacugugaggaugugaaacaagaacucuuacucauuaccgguuuaaaaaaaaaaaaugagguagcuacuuugguuuggcaguucuuccaaagguaacacaguuuuaacauacaguucaaugauccucauugaauguuuacagaagcacaaaauuauaccaguuugaaauaccuauuacaugaauuaaaaaaaaaaggcuaaaauaaaaauaaagaucaacugcaaagccagucuggaguuaaaagauuauuuaaaccauccaaagaaagccccuacuacuuguagucauucacuaucaucucacucagauucuagauaaaaacuggcuuuuauauaaacaaaaucuuaugauacauguuauauugcauuggacuuauuugauuucauuuggcauaguauuuucaaaguuuacgccuguuauauaauaccaguucauuucuuguuacugcccuauacuaugccacuguauaagugauuauauuuaaucaucauuuuguagacaaugauguuuuuaaacauuuuuuaauaauuacagguaaucucauugggcacauccauuauggguagcugugagaaaauuuuagucuucaugggucaauagguauagguagaauuagugggcaugcaguaaaucuauguucaacauuuugaggagcuacccaaauguauccaaugcagcacagcacuuaacauugccaguagcagucuacgggcuuuucaagcgcuuuauucuucuuuacccauuauuaucaacuuuuuaaauaauagcuaugcuagcagguaugaauggauaaugcccuauuauggcuuugaguugaauuuccuuagcaacaaacaauagagaaaaucuuuucaugugguuauuugucauuucauuaucuuguuuagagaaauacuuauuugaaucuguccucaauuuaaaggcauaaagacucacugcuacacuuauucuaagacuuacaaaguuucaggcuuacaguuuucuuuaacucauuuugacuuaauuuuauaagugcuuucuuuuuuauuggcuauuuauuucauuuacauuuccaaugcuaucccaaaagucccccacacgcucccgcacccacucccccacccacccacucccacuucuuggcccugucguuccccuguacugaggcauauaaaguuugcaugaccaaugggccucucuuuccacugaugaccgacuaggccauuuucugauucauaugcagcuagagacacgagcucugggguacugguuaguucauauuguuguuccaccuauaggguugcagaucccuuuagcuccuuggguacuuucucuagcuucuccauugggggcccugugauccauccaauagcugacugugagcauccacuucuguguuugcuaggcaccggcauagccucacaagggauagcuauaucuggguccuuucagcaaaaucuugcuaguguaugcaauggugucaacguuuggaagcugauuaugggauggaucccuggauauggcagucucuagaugguccauccuuuugucucagcuccaaacuuugucucuguaacuccuuccauggguguuuuguucccaaaucuaaggaggggcaaaguguccacacuuuggucuuccuucuucuucaguuucaugcguuuagcaaauaguaucuuauaccuuggguauccuaaguuucugggcuaauauccacuuaucagugaguacauauugugugaguucuuuugugauuggguuacuucacucaggaugaugcccucaagguccauccauuugccuaggaauuucuuuuaauuagauauuuucuuuauuuacauuucaaauguuauccccuuucuugguuuucccucugaaaauccccuauccaucccuuucccccugcucaccaacccacccacuccugcaucccugcccucgaauuccccuacacugaggcaccaagccuucuuaggaccaagggccucuccuccuauugaugcaugacaaggccauccucuacuacauaugcaauuggagccauaggucccuccauguguacucugugguuggugguuuagucucugggagcucugaguggucugguugguugauauuguuguccuuccuaagggguugcaaucaguccuuucucuaccuccuccauuggggucccugugcucagucugaugguuggcugcgagcauccccaucuguauuggccaggcucuggcagaaccucucaggggaaagcuguaucaggcuccugucaggaagcacucuuggcaucagcaauagugucugggguuggugucugcagacaggauggauccccagguagggcuauaagugcuuuaaagaaagaguccaagugcauuccuuguauacagucagcuaucuccuagaagcaguuguugaaaagacuuuagcccuuccugaauuaacuucuguccuuguuggaaaucaauagauugcaaauguugagguuucuuccuacacuauucaauuacauuuauauauguuaaugcaaaugcguugaucacagcuauagcugcacaguaugguuuaaaucaggaagucuugguuuucuaagaguuuacuugcuuguuuuacuuuugcuuuugagaguuucacaguucaagcuggccugggccucaagauccuccugccucagucucuugaguacuaggacuacaaacauguaccgucaugcccaguuuucaguauugauuuaucuauccuaacucauuuguauuuccaugugaucuucauuaucucugguuuuacuuuuauaauauaucauuuacccagcuucuucugaaaauuaacuauuccagggaucuuaaguaauugaaaagaaaacucauuuaaccccuuaaauuuaccagcuuaagaaagauaaagauaaugcccauggccgaggcagacggaaaguaacaccuccuuuuguaaauacagauagaaaaguugauguuugcagacugaaucucaaguaaugcacauccauauggccaaggcagcaauuauuacugauaauauacucaaacuaucagaaaaauaauuuagaggaagaaaaaaagcucaugacaaaacccuaaauauaaauuuacaagaacaacgaaaacuacccuagcuguauuuauuacugccucugaaguguucauaagaucacauccaccuacagugacaguggcuugaaacaacugaauguuugaaucguuaaaagagcacagugaaguagacuacuuaagcagcaaagaugaauucuugucaagucuguuuuuccuccccugacuuuuacuucauggcuauaccacuucuaagaggcaccgauuuaggugcucacaauuauggaaggaauaaacuuggcauucagauauuuuguugccugagcaaaauccacucccaucuagaaaguaacauagguuauuauccuuuuuuuuucccuuuucuguaucaagcacugauuuuagaaauagaauaugucuuuaacagagaaggaaauauagggcaaagguuaaauuuucuuuguguauaaccuuucuauaaaguaacagacuuaaaauacuuacaaacagcacaaucaauagugauuaagagacagaguucagcuguaaaauaaaaaauuaacacaaaauauacagagaaagacuucuuucaaauacaagaagcuuauuguaauuggcaucccauucauauccauaaccuacaauagauuguuaauuuuauuucuaacaaaauuucugguuuccuuacucagaacuaaaucugcuaccccugagcuaagauaccuacagaaaacacccuuuuuauuuuuuaaaaaauuauauuuauuuaguguauguacaugaugggaauguguaugaguauuuguauaucaugguaucucuauuuguguaugugcacacgugugcauauguauguguguaaaggagacauaaauaucauaucccuucuccugugugugugugucuguguaaaugagacauaaauaucauaucccuucuccuguguguguguguguaaaugagacauaaauaucauaucccuucuccuguguguguguaaaugagacauaaauauuauaucccuucuccuguguguguguaaaugagacauaaauauuauaucccuucuccuguguguguguguguguguaaaugagacauaaauaucauaucccuucuccuguguguguguuuguaaaugagacauaaauaucauaucccuucuccuguguguguguaaaugagacauaaauauuauaucccuucuccuguguguguguguguguguguaaaugagacauaaauaucauaucccuucucugugaguguguguauguaaaugagacauaaauaucauaucccuucucccguguguguguguguguguguguguaaaugagacauaaauaucauaucccuucuccuguguguguguguguguguguauguguauguguaaaugagacauaaauaucauaucccuucuccccacggcucaggagacaucuuagaagaggaagaagaacaguguuucuaggcaugacagaaccacucagugccaugguaacucacagcaccuguagguaccuacacaaggcuugauuaacaucaagccaaucaauauucuagcacgaaauuggggagaggcucaugagaccccaccucuagaugaagagcuauggaaaguugaugguuucugagggagggagagucagcuuucuugaagaguguggccacuggugugguaccaagcacagccgacggcucuacauccauguacauaugagcagcaccaguuggauuaggaaggauguuuaaaaaagagaaaucauuaaguugggaaggagaagagugaauauaucaaaauauacugugugcguaugugaaguccucaaauaauaaaauauacuacuaauaaaauagaaauguccuugccaaaaagaaacccccuuugcuucuuuguuuuaaauauagaucgaauccagggauacaagcaugcuaggcaaaaguaguaauacugaaccguaucucuaacccuuuuuauuuuuuuaauccuuaaacagggucucccuuaguugcuuaggcugugcaaucuuucugcccagccucccagggagcugggguuacagguccuggcucuauuagcuuuucuuugcaaaucuagcauuaggcaacaucauuauguccccacaacucaauacuuacaauuaaaaacuuagaaauucaaacaaagccaagaacuaauuacauaugcuuugauuaucugcagaaaauauuugccuaccuaaacauguuaaggcauaaauccaguucuacuuuucuauuuuucuugacauucuacagcagcgguucucaaccuuccuaacacugugacccuuuaagaguuccucauauuguggugaccccaaccauaaaguuauuugcacugcuacuucauaaauguaauuuugcuacuguugugaauuguaauguaagcauguguguuuuccaauggucuuaggcgacuccugugaaagggucacucuaucucgaaagcagugacgacccacagguggagaaccaguguuuuaugauucauuuguaaugcaauuuaaaauaaaggaaucucugagaauucuuucuagucuuuggaaccacuuugccucaugcuaagcuaaaagagcccaacuuucccacacuuaguagcgucagaguuuaucuagcacuauuuucuuuauuauacacaucaaaaaacagcuggccagaauuuuauaaaaccuguucaugugcgcauguuuuaguguaacuuauuaaacuguagaacaugguaauugacaccuaguuauaauuuggacaguauugaugcuucugcauaaucccaauuacuucuggaaguguuuguccuuuguaacauauuuuuauguccucacagguccuaugacauggguaaaacuuccugaauuccuuucugugcucagauuuaaauguguucauuuagacucuugagauuuagauuuaaaaaguuuuauaguauaaaagucacuggguuuguuaaaauuacauaauccacuuuuuucaauguuuagguaaguugauuacagcuauaaaagaauggagugacaacuucuguuauuuagaaaucaaaugugcugccuuuuuuaaugcuaggcauuuaauacuggacauugcccaugauaaauaagugguuuaccauugagauguggcccuagccccuaguucuuguuuuagaaagguuucuuuucacuaauuuuuaugucauacagaaaucacaagguauauacagauaauacuaaaauggacccaaauacuucauugcuaugaugaaaaucuucaauuaugggccagugaaauagcuuagcaguuaaaguucaaucaccaaggcccauaugguggaaacaaagaacugacucccacaagcugcucuauagugacaacuacacgaaaaacugcccccccuacaccacacacauacuuaaaaucagugaaaauaaaacaugaaaauucaaaaaccauauuuccaugcaagcugaaauauaauauacugauuaguauauucugaacaucccuauaguaagccucugaaaugggaaagaacaacuagaaauccuuaacauuuugaugcaccuacaagugaugaacauuugaaacaaaaucuuuccuugacaauggaggccacucauccaccagagacaugugaggcuuucaagaaaauuucuagugggacaugaaaggaaagugaaggauacucagaauaaacaccggaucuaacauagacuaaaccugagauuaaaaaaaaaaaaaaaaaaaaaaaagggucgggcagauuugacauaagcagggauaugggacuaguaaggaaguaauuaucaagacugguuaaauuuuauguccuugcauuagguuaaggaauauucuggcuaaaaauauucuaaaaaauaugugacagcaaauauaggcaagaaaaacucuucauggccuauauaaagauucugaaucugggacugagaugacacacauuuauuaaaauacugagguuuauugaagggaagguuuagucuaccaauacugcauuaugaaugaauuagcauauuauuuaguuuucauucuccagugauaaagggcuuucucugucaauuuaaauaaaauaaccuaaccagcaaagccaauguucauuauuuaccugugaaucuuuaauuaaaaguaaacuguuauguuugguacauuuuauaagucuguaaaaauacaacacuccuggauucagaguugaaaauucauuugaauucaaucugucaaucuaucuacauuuucuugaaaaauauacuaaaaauaaaaaccagguuucuaacuacucuuuauucagaguauuuauuaucucuaacauuuuuauaacuuaaaacugucagcaaaaucauuguauauguuuaaaacuuauaauuauuuuugcuacacuuguguguauguguacagguauguguguacagagaucauaggacaacuguggaauuauuuucuucuuucauccuuacuugcuucuaggaaucaaauuuagguugcagggcuuguguggcaagugccauuacaugcuaagccaucucaucaccccucuccccuaauauuuucauaauaaacaccuacaucacuguuuugccugggacuaaauuaugucaauaaagcuaaacaguuagguauuaaaauugcuaucucuauagcaauaaaaagaaaaguuuuauucuuuuugcuuuuauuuuauguauauguguguuuugucuacauguuauuuaugugcaccauguacacacaauaaccucagaggccagaagaggggauuagauccccuggaacuggggugauaggugguguaagcugcccaaugcaggugcugagaucaagagccaccguaagagcagucaguagucuuaaccacugagccuugucuccagccccaauaagagacaacaauuaaggucuuauuaaguucucaaauauagauugacuuaaaagucaaguuguaugaacauacaaggugugcuuauugaaacacagcaaauaaaguaggaagauaaaauuacaguaguuccuaaauuauuaaauuacaguccggcucucuuuccguucccagcgcagccauggcucguggucccaagaaacaccugaagcgcguagcugcuccaaaacauuggaugcuggauaaguugacuggcguguuugcuccuaguccauccacugguccucacaagcugagggaaugccugccucccaucauuuuccuaaggaacagacuuaaguaugcccugacuggagaugaaguaaaaaagauuugcaugcagcgauucauuaagauugaugggaaaaucaggacugguuucaucuacccugcuggguuuauggaugucaucagcauugacaagaccggagagaacuuccgucucaucuaugacaccaagggucgcuuugcuguucaucguauuacaccggaggaggccaaguacaaauugugcaaagugagaaagaucuuugugggcacaaaaggaaucccgcaucuagugacccaugaugcucguacuacucgguacccugauccccucaucaaggugaacgucaccauucagauugauuuggagacaggcaaaguaacugacuucaucaaguucgacacagggaaccuguguauggugacuggaggugcuaacuugggaagaauugguguaaucaccaacagagaaagacaucccggcucuuuugauguaguucaugugaaagaugccaauggcaagagcuuugccacucggcuguccaacauuuuuguuauuggcaaggguaacaaaucauggaucucucuuccacgaggaaaaggaauccgccucaccauugcugaagagagacaagaggcuugcggccaaacagagcagugggugaaaugucucuaggagacaugcuggaaaaguguuuguacaagccuuucuaggcaacauucaugcuagauuaaacagcauggugaaacuacaaaaaaauuacaguccuuguuacuucugcauauaauauagaauauauaauuucuuuagacuuagguuuuuacaauaagacagauaaguauaaagaggaaaauuacccuggauuccuuuuggaagaccagacuauucuaaagacaaagcuuuucuuaaaaacuacuugauugcuauagagauuaccucuguacuaacaucaucuugaguugaagcugcccggcacuugagccugaguuuugccaccaguugcucaaagucuuuaagcucacugaaacgaaaagcuguuuuuccuuugaugcuaaugaugaccgaucuguuggagucaucaguuuuaucuauagcuaagaccuggggaguaaaaagauaaagaagucagucgcauuuucuccuagggcuggcauucagcuaugugcuucuuugaaagucugugguauggcuuacuaagagauucaggaauagggacugugcuagggaugacccacaauuccucagcucgggcuacuuuacuuuucaaggaaagagcuaaauuaacauggccuucaacgucagcaauucaaacaaaacauucaauggugaauacuaaguuuugacugacaugaaaguuacccauucuaguccugaugaucaaaugcaucaaaugugacagucuaaacuuugauaaucauaaucuucggggucagaaugaucaaacuuaucuugugugacccuaaaucaucaccucucaaccugcgaguugugacccccuaggagggccauaucagauauccugcauaucagauauucaaauuauaauucauaagaguagcaaaauuauaguuaugaaguaucaaugaaauaaguuuaugguuagggguccccauaacaugagaaacuauauuaaagggucacagcauuaggaagguugagaacuacugcccuaaaucuuuaucuacuuuuuaaaauuccccacuuuuugcaaagcuuuucuaaaaggaauuuuaaaauauuccauaagcuacuauuuuuaacuugaagaguaauuuuguacucaaaugauuauuuaaauugcuaaaacgauacauuuccugaguuuuucacuaauucacagaauuagaggguguucuagaaauuaaaaacuuauauguacccaaauugauauuaccucucguaauggaaugauuacacugcauagauucccauccuggcuagcaaagcaaauauaguuuucugaaaugcacauuuuuccgugacuacugaaguggcugaaugguacccauaagaaacacucauguacuucuuucaaugucucuucuuuggguagccuaaaaaaggcuuugaauugcucacugugggcucgauauuccaaaccucuguggaaaaaaaaaaagaaaagaaaagaaaaaaagggagggaggggcucaagggaugaauucuaaaguacaaauacaccaauaguguuuaaccuauauaagauagaaagcagaaaaauuaaccauuaaguggucugcucuucaaugaauucuuaauuggaaaaauaaaauaacacacagauucucgauaaauuucauuuuuuguuuuuuuuuuccaaucucauuuuauccacugauaaggauacacaaaaauuagagauaauauaggucucaagaugauguguuaggggugauuuucuggaggacuacuauuauaauacauuaauaauacguuccuaugguuuaauccaaccuuagaaaauaguaauuacauauuugguuauuagauaaucaagcagcuauacaaauaaaacaaaauuaaauaaugaaaauuuauggcacuaaaguuuaaagagaaagagcauauuauaaaacagaauaucaagguucaaguugaagcagaaugaaacaacacugcuuguaccaugcugggcagaggacuggaguugauaaacagaugaaucuuguuaacugacagauaaauauauaaauacaaagcuguugcucuaaauagcaugauuuuucuaggggcacuaaauaccuugugcuaagcagcacugccaucugggguacugaggaaauuaugcaaguucuaacucaaagccaacaaaauugaaacuaaauucauccuuccugcaucaacaguuugaaaauguaguacuucaucgugucuggcaaaauaauccugauauauauauaaccagaaacccauguauauuuuuacucuacuuaaguuguaauuugguggguuauuuauuauuaaauggaugacuaaucacagcccauucgugugaauagaaaaaaaaaucugugcacuauuacuacaaaauaaaaauaaguauguuguguuaagcccuaauuuugcugacauuuaaaauuuuucuggaauaaaacacaugaaugaauauacauuaaaugucugcaauaggacuucuagauuguuuacauuauagaggacauauuuuuaaagcaaacagaggcaugaagugggaguggguggguuggggagcaggggaaguggggagaggauaggggauuuucagagaggaagguaggaaaggggagagcauuugaaauguaaaugaaaaaaaucuaauaaaaaauaaauaaauaaaaaugugcuuuaaagucuguccuaguagguuauacuuaacuuacuagaaaaaugauuuagacauauaugacuuuuaauaugcucagucaaaaauauauaagacaaauuuacuacaucucauuuaaauaaagacucagcaauggauaaacucacugaaacaugaucucuuacauccuauuuuaagggaauuaaauuuguaauuuuuuaaauuuuagauuuuuuucuuuauuuuuaucuacuuugugugugugugugugugugugugugugugugugugugugucugcaugugggucagcauaccaugugcauguaguacuugaggucagaagaugguauuggauccccugggacuggaguuccagaugauugugagcuauuacaugcaugcuggauauugaacccaggucuuuuguaagaguagccagugcucuuaaccauugagccaucucuccagcccacaaguuuuauauuuaacuaaacuauuauaucaccucuccuuccaaccccaaaccuccccucuuuaaauauauguguguguguguguauguguguguguguguguauacacaugguuguauggauauaugauguacagauaaagagguaaauacaauuugcugagucucuuuagugucgcuuguauacccacgaguuuagggcuggccacgugguauuagguaaccauugagaggcucucccugaagaagacugacucucccuuucucagcagucauuauuuacuuggcauuuaagcaaaugccaacaagaauggaauacuuucucuagcuccuccauugggggcccugugauccauccaauagcugacugugagcauccacuucuguguuugcuaggccccagcauagucuuacaagagacagcuauaucuggguccuuucagcaaacgcuugcuaguguaugcaaugguaucagcguuuggaagcugauuaugggauggaucccuggauauggcagucucuagaugguccauccuuagucucagcuccaaacuuugucucuguaacuccuuccaugggugcuuuguucccaauucuaagaaggggcaaaguguccacacuuuggucuucauucuucuugaguuucauguguuuagcaaauugaaucuuauaucuuggguauucuaaguuucugggccaauauccacuuaucagugaguacauauugugugaguuccuuugugauuggguuaccucacucaggaugaugcccuccagguccauccauuugccuaggaauuucauaaacucauucuuuuuaauagcugaguaguacuccauuguguaaauguaccacuuuuuuuguauccauuccucuguugagggucagcuauuggauggaucacagggcccccaauggaggagguaaagaaaguacccaaggagcuaaagggaucugcaacccuaucgguggaacaacaauaugaacuaaccaguacccccagagcucgugucucuagcugcauacguaucagaagauggccuagucguccaucaguggaaagagaggcccauuggucgugcaaacuuuaucugccucaguacaggggaacaccagggccaagaagugggaguggguggguggaggagugggugggggacuuuugggauagcauuagaaauguaaaugaaauaaauaccuaauaaaaaaggaaaaaaguggaauaugaagugaacuuuuaaaucgcuuuuauucaugugaaugugaguguggcuguaugagcucauguggaccaugugcaugcagguguuugaggaggccagggcaugucaaauccccuggaacaggaguuccaggcaguuguuaaccacuguauggcugcugggaaucaaacccugguccucugcaagaacagacagugcucuuaccuucugagccaucccugagcuuuaaauucuuaaugagguagcuccauucagaaaucaucagagauguaaguuugguaauaaaguguaaaaauucaccucauuauucuacuuucuagaaaagcagacucucagaguaaucuuuacgcaucugaauuuuaggaauaguuuaagaaccaugggagaaugacuacgugaucagggguggguaguauaaaacagccuccauaucucuuucuagucuauccacaggacucgggauuaggccucuguugaacuuucccacucuauauccucaucuuccuugcccaaagcagcucgcacuagcuauuucuggauccuuccucuccuccuccccgcuggcaaguuccuuucagucaacugcuuaaguguugagcagaaugaaaggcucuguucaguuucagcaaacugaauauacugaugaacaacguucagucagauauuggguuuuuuuccuccucccugaagacaaggucuccuuguguaggccaggcuggacuagaaccaauuagcgagccuccugccucagccugccaauagccggaauuguguacauauguccccauucccaccuagucagauacuucugauguaggcacuaacagugauuaguacuuacauagcucuuuuauauuuaaccgccacacacuucacucuuuccuaauaaggguccacagagguagaaccauagaggaggaaaagaaaccccaagaaaucaagagauuucuccagucucaaacuaaagccuauacuccacugacucuaccaagcugccucuacauaaaaaaucuuacaguaucacuaaacugguugaaaucauaagcaauaaguuuaacuacucuagacuuaaaauuaucuagacuacaaacaggcaaauuuagaguuaccuaaacacauuaaacucucugcauuuuugaaacuacucugugcuggcuacuuuuaugucaaccugacacaagcugaaucaucagacgaggggccucaacugaagaaaaugcuuccggaagacuggguuguauguaagccucuaaggcauuuucuuaauuggcgguugagaggagagauucaagcccauuaggggugguaccauaucucagcagguaggccugggugcucuaagaaagcaggcugagcaagccuuggggagcaagccaguaagcagcauuccucaaagaccucugcuucagcugcugccucuaaguuccugcccuguuggagaacuccuguccugacuuccuuugaucauggccagugauauggaaguguaaguccaguaaacccucuuuucccccaacuuucuuugaucauuguguguccuugcagcaacagaaaucuuaagacauccucuaauagaaaucauauuuaaguuaaaaaauaauuuccaaaccuaacuucgguuaucucuuagaauaaaauuucauggaggaaaacuucugaaguauauucaaauaagcuuacaaauguaaacaucaaggaucaaucccagagcaaaauuaucauauaauaaacaacaguuaacuuuuaaugcuaaucaguguuaugauucuuacaacccaaaauacuuuaaaauguaaacacuggggccaguggcauggcucagagggggaaggugcuugcuuccaagucugagucgccagacgccacccaggauggaaggaaaaaacugacuucugcaagcuauccucugaccucuguacccaugucuuggcaugaaugacucccccacaaccccuaaaauaauaaaugaaaagagaaguaaauauuaaugauugaauaccuuuugguaaucuguagaggaucaucaaggacugggucauuaucaaauguuucuuuaucaaaaagucucuuuauggcauaguuugccaguuguuccauaagaagguaugucucauuaaugugcaaaaacauugaaaaauagugauucucuccuugagaacauacgugaaugcucucaguuaauauaacaguugaagucuuuucaaguuuugagauugcaucccaggagauaaugaguuuaacugcaaauaaguaagugugauuaaauucucauauugauuuauguuuguaauucaguuacuuuaucaugaccacuggcaaaaugccacaguauuuuuugaagcagugucauaaauauauaauagucagugauucuaaaaauagacauauguucuuguuuguuguuuuguuuuguuuugaauauuauugggauugaacccaaggccuuaugcauaacacacaugugcucugcuucugagcuauauagccaauauuugaaacagauaucauuuuaaagaauuagaaagcaauuucgauauguuucaauauuuuucuuuauauauaacuaucuuuauauaauuaucuaauuguacaaccauugauaaaaaagcuauacuuauguuacaaguaguuucauuugauucuuuguggcugcaaauuaagauguagcucaugagguaugauggguacuaguuuauguuguauguuuaagacaagaauuaaaauacacauuaaagccaguagguagcuaaccucuauaagauaauacaugcuuaucuuuuuuuuuuuuuuuuuuugagacagaguuucucuguauaguccuggcuguccuggaacucucuuuguagaccagacugaccuccaacucagaaaucugccugccucugccuccccagugcugggaucaaaggcgugcgccaccacgcccagcuacaugcuuaucuuuuaaaauucaccugcaauucauaaugucgaagauuucucuauaccauuguaauuguucccugugcuacauaaagagccuuaaagggguucuuccugugguugaaaccuuuuugauauguguauaauuuaauuacuuuuaauaucaaucccauuacuuuaucaacaaccuaacaccacugagucaagaagacagucagaaaaucaaaagccacgauaaacaauaaacacuuacuuucugauccuagcaagaaggaauagaagcucagaaaguugguacuuagauagagccagcccugacaagggacccguccucuccaguaacugcaggaauaauaaguuacuaauuuuuccugcucugguaaaccaaaagauuuuucaaauuucaaaagggcuucucgaaauuucucaggaucaucuucuuuagcaaaagacuguuuccccucuucagcgauuagucccuagaagagaaaaaauuuuucugaaaacuuuccaucaccuaucaacaaaaaucuuuuucuuauuuaguuuuaggucuaguugaucaaauggaccuacuaugcacacgcauacuucucuuaggauagagaugugcacauggcuaguauuuuucucuuuguaagaaaauaucacaaauguaggcaucaaacaucaucugaaugaacaaaagcuuugcucacaaucuaauuuaagagauagugaaaggagaagaccaacagggagauucgcaagagcacugagagcaaaccauugugcaauuuucugaagcacuuauccuggcauucacacaugugugccugaaagucccgaaaagugccaguaagcaugaccuuacaugucacuuccaaucuuuaucgaagagggcugaagauuuuagcauuccacucacagaauaugcccauacaccuugguuuuuuuuuuuuuuuuuggagucaugugcauuuucuuuggggcccuuagaacucauaccaacugucuaagcaaugaggaaacugaaggugaguugauuuccauaaauucuuacuauuugaaaaaaaaagauauaaaauacuggguuuuauuaugacauuuccauacauguauaucacuguacuuugcucauaauucaugccuguagcccucucuugucccccaccacucuacuccuccaaaccccuucuuacuuucaauuucaaugucauucauauauauacuaaaacuuauauuguauacauguauauaugaaugacauuguguguguguguauauauauauauauauauauauauauauauauauauauacaauguaaguuuuaauaaguauuuauauuugugcacaagaaauaugcaacaguuucugcuccuauaaucugaauauuaauauacauugaaaucuguguaugagagaaaaaugcaauauaugucuuuuguuuuauucccauuucucuuucuguuuccauuaguucccuuccuuccuccauguaguuuugucccucacuuugaguaugcaugugugugcaugucuguguguguguaauuuaaauucugaauaugaaagaaacauggaauacuugacuuugaaucuagcuuacuuugcuuaacaaaguuauuuucaaugcuauauaucuucugcaaaugcuauaauuacuuucugggagaauaaacuccucugagaauaucuacauuuuucuuauauacucauccauuccacuuacucuuauuuugccuuguacaaaauugguaauaucuucauuugaaucaaacacagauaaagucuucauuauauuuuguuccaaccagucccaauguuuuguuauuucuucucuguuggcuccugauuuguaauauagaaaagaaaaauucaagaaaucuccuuaauaaaauucaugauacuuaaauuuaguuuaagaagaaauuugccacuuccacaaaugauggcuagauaaaaacaaagauaguacauuuauucucuauuccaucuagguauauaagcaugaacaguagagcuauaguuauuauaaaugaaaaaugcaauauuuaauaaaaugggagaaagugauuguagcucauaagaaaauauuaaaauaauucugaacaguaauuagugccuacaaaguaaucauuaccuuaaaaaaccauguaaacacacagaauaggcgcccccccacacacacacgugcacgcacacuuuaccccuugguccucaaauacaacuacuaguauucugucuaaauucuucguggcuaaaaauaguaagcauaugacaguccuucauauugcugugcaaaugaggacucuuuacuauggucacaaaacagaagaaaccuuugguaacaaucagaccacucauuuaaaaaccuaacaaacuuauagaaaauuuacaauagaagucaggaaccucgcggcaauaguaaaccauaagaccuacugcaucaguguuagcugucuuauuggagaucauguuaaauauuauuauuucuagguuugauuucacuuguagaaaguuucauuaucaagacccacuccucggccuauuccuucuuagaaggggaacaaaauacucaagagagggaauacagagacaaaauguggagcagagaccgaaggaaaggccauccagagacugccccgccuggggauccaucccauauacagucaccaaacccagacacuaugguggaugccaagaagugcuugaugucaggagccugauauagcugucuccugagaggcucugccagugccugacaaauacagaaaaggaugcuuguagcuaaccauuggacugagcacgggguccccaauggaagaacuagagaaaggacugaaggagcuaaaggaguuugcaacccauaggaagaacaacaauaucaaccaaucagaacucccagagcucccagggacuaagccaccagucaaaaaguacccauggagggacccauagcuccagccacauauguagcagaggauggccuuauuggucagcaaugggcagagaggcccuugguccugagaaggcucaaugccccaguguagaggaaugcaagggcggggaggcagaaguggguggguagguuggaggagcacccucauagaagcagggggagggagcaugggauaugggguuuucggaggggaaaccagggaaggggauaacauuugaaauguaaauaaauaaaauauccaauaaaaagaaucuuccuagagauauggauuauacagaucucauuaaaaugaauaaucuugacugcauagaauguucccaugauauauagagaggaacacaguaaaauuuuauugacccugaaaacuugcuuauuuuguauaauccaguuagacuuuuauucauguuaugaauacgagcuaaauuuauguaaucagcuucauuugcaagaauagucaccuuuaacucuuuuagaguagagaggacauuucuuuaaaacaauuuuggucaaccagcuucagaacugagauuacaaaauucucuuacuauuaucugcauuuaguucugauggaaucuaauuuaaaagaccaagagauaagacucagcagcaagacuacggaaauuuagcgaauuucuuuuaaagccacccauccuaauaauguaauugugcacucuacuuucacaaauucaugugcauuuuuuucaaaaacacacacucuuuggaaaaaaaggaaucaguaauccaauacuuaaagggucagaaauaggggcuggaaagauggcucagcaguuacaagcaauuguuguucuuccagaggacccaaguuuaauuuucaguagccauguggcggcucacaauagccuguaacuccuguuccagagaaucugacuuccucagacauccaugcaagcaaaacagcaaugugugcaaaguaaaauacauauauacauacauauggacagccaccaaacccagacacuauugcggaugccaacaaguguuugcugacaggagccugauagagcugucuccuaaaaggcucugccagugccugacaaauacagaaguagacacucacagccauccauuggacucagcaugggguccccaaugaaggagcuagagaaaggaccuaagaagcugaagggguuugcagccccauaggaggaacaacaauaugaacuaaccagcacccccagagcucccuggaacuuaaccaccaaccaaagaguacacaugggggggggggauccauagcuccagccacauauauagcagaggauggccuugcuguacaucagugggaggagaggcccuugguccugugaagguucuaguccccaguaaaggggaauuccagggccaagaagcagaaguggguggguuugugagcagggggagggaggaugggauggagguuuuggaggggaaaauaggaaaggggaugacauuugaaauauaaauaaagaagguauucaauuuaaaaaagauaaaaaauuuaaaagaccagaaaugauuagguuuuaguucuguuuacuauuacaauggaauuauagaaaagauaccaaacugucacugugaguuuaaaaaaaaaaucugaucuguauuauuaggaagaucuggauaauuugagcaugaaugauuauguagcacuacuuauaaaccauuccuuagcauuuuaagguuacagugccuucugugaaauagcauauaugugaacacaaauacauuucaaauauucaggcuuccacuucuucaaggaacuaccuuuaaguuuaggcucagcauaaacuccaaguucucuucaccucaguuauuagaagaagaagaagaaaagaaugccaauacuuaaugggggaauauccaaucuucccagagguuugguaagaaaugaaagaguugauaaaaggagucagguaacaggagcaccaaccaaagaugcucagaaucugcucugcucgaccacauacuucaguuaucucccaucaauggaguuuucaucagcaauaaaccguaaucacucuuaaagagagguccucucaaagaauaguugcauuuagcugccuuccaaaucucaaaccaacugcaaaguacaaguuaauauucaguuuuacuaucuccaaagcacaugcaaccgugcuuaguauauagugacauucaauauuaagugauuuggauuuggguuuuauauaaguaagauaccuuauacauuuaaauaugauuaaaaucuucauuaguuaaaauauauuaguaaaaguauuuucauuucaguaaugauuaauucuucaauuuggaaugggacgcucaauuaguuuuaauaugauuaucuuagcaucuugauucuacuugaauuguagggcuuucuaaacaaccauacuuaccacaugcaauugacaaguacacuugagaaucuggugucugguguaggaugcgaaauggagcuacuuuagcaguggagucuaagacagaaucaagagucccaaccaagagcccuguuguaauagaaaaagagauuacaguauagacuuugcaagagauaaaauaacuaucaauuuauaugucgaauuaauggacuuauuuuuuuuaaauguacuccagaguuguuauugagauuuuuuuuucuuaaaauauauguauggaggauagggaaauggcucaaucagggaccugaguucaguucccaaaaccuaaauuaaaaugucaguaaugaugacaccugcuuugcaauuccagcacuggagaggcagagacaacuugggucccuggagcucacuaguuagucugcuuggugaguucccgaccaauagaagaccaggauucaaagagaacaaagguagaugacaccuaaggaacaacauccacgguuguccucuacacuccaagcgcaugugcacacauacacaugcucacaccuacccaaacauaacacagacaaaaaagaauauauauuuggaauggaaaaaccaacauuuauaaauauaagugguguuugggaaaaugauaauuuaauaaaaauacaugagguucaauuguccaagucucuuacuugaaguacuuggaaaguuguauaauaaggcuguguauuuuuuuauuagacaagaagguagaacuaguacccgagaauacuagaugagcugaauucuggcuuugucacguaugccaauuugaacauguuaaaguaguuuccauuucuauauccucguuuguaaaauaagggagacaaaccagaaugaacugcaaaggguaccacaaagauuaaaugaguuauuagagcaguaguucucaaccuuccuaaugcugggaacucuucauguugcgaugaccucuagcccugaaauuauuucaucgcuacuucauaacuauaguuacuacuguuaugaauuauaauacaaagaucugauaagcaggauauccgauaugcaaccccuguguaaggagucacaacccacagguugagagccauggacuuagagcaauguucaguaaacaguagaacauucaauauuaguuauuuugaauuauauaagaacauuuuaaauauguaaauaagggggaaaucgucauuauugagaauguuuuggcaaaaugauuuucuuuucaacaauuccuaauuccucaauuuugaauucaaggaucuugcucaauuaguuccauuguaauuaucugauuauauuuccuacuacuuccuggaacaaaauuuucuguucucuuaaauagccaguuaauuuuucccuuagggucuuugcugaacaauuaucuuuuuacugagaaaugcuaacaaaaguguucuagcccaguccagcuaauccaaacuguguauuuucuuuaagaccuacuucccuauaaaagcuuuaguagcaaugccaagcaauauuuucccucuucucuggguacuuauaauacuucaauuuuauacuucauaacuggguauuuacuucuuagguugguuauuacaauuacuuucuaagcauuucauauauauacagucccugagaauaacuauguuaccuaccuuuggguuuguaucuuaucucuaaauacaaugaggcauaguguauggccuuaacuaugucauggaauggcucaacuauauacaacuacuuuucuauuuucaaaagcauugguuggcugagugauauuucugcucuaugaacauuucuuuuuaacuuagcauacauaauuucaaaaaauuaaagacaacuacaaaccaggcuuuugguucuuuucauauuuuuaccaacuauaaauguguucagauuucaaauuagcuuugaaugaaaauauaaguaugcuggcauauaugggauaggaaaucaucaaaaucauaaauggaagcaaaauagagaauaaaagauaggaaaauugacucagcagaaaaaauaggagugagaauauggacuaaauguaagauaaaaaggguuaggaaugugguauaaugucaguuaguaacaugaccaaggauuuggaaagugcaaaaaucucucaauaauuucuagggacuggagagauggcuggguaguuaaaagcacuuguuccuuugaauuuuagcaaaguuucuuuaaugacuguagaugcccuugcauuuggagcauagauguucagaauugagaguucaucagggagaggaggggauaggggauuuccggaggggaaauuaggaaagggaauaacauuugaaauguaaauaaagaaaaugucuaauaaaauaaauaaauagaauugacuugaaacaaaacaaaacaaaacaaaaagcacuuguucuugcagaggacucagcacccacaugguucacaacuauccauaagugugcacacggugcacauacagacaugaaagaaaaagguucauggacaucaaauaaaguaaaucuaaaaacuuuuguuuugacauuugggguaugugagagaggggggggguggagaggugaagaagaucuggaagguguuggaagaggaaaaaauaugaucaaauauauuguacauacauuuuaaaaggaagcauacaugacaccaguacacucugaugccaaauugcaggcccugaaaauauacauacaaauaacauacaaacaaagcaaguuauaucuaggaauauauaaaaacaguuauugaaaaaagagcccaugcauuggaaagaaagcaaggagggcuacaugggaagguauggaaagaggaacaggaagggggaaaugguguaauuauagucucaaaaauaaaggaaaaaaaucuucaaauaaaccaaguuaaaaaauaauaaaacaggacaaauugucaccuacugacacgcaacaaauuagaauagcacccuguagugggcuuaaauugagccuauuuaaaauuguguaguggcacacuuuccuagccauauggcaagaaguccauccuuuacauaagaaaacgaagcaagaucuuuuuuuuaaaaaaaaaaaaaaaaagaguacugcaauggcagcauguagguuauaaagaaauaaaucgaauacagucaaaaguuaaggugugggcuggagauauaguugauggcaugaauggcuagcaugcaugagacccugaauuuuggucuucagugcugcaaaagaaaaacaaaaggaagguaugaauugaagauuuuauugaugaaccaaggaucaaaaaaucuagauggauauuauuuaagaggagguacuggauaagagaccauuggaaugaggcaggggaaaugauuaugcuucaacuagugaggaaagaaacagaggaguucaguauacaaagaaagauaauuaagcaucaaaguaguugcugcaaaaacguggacauguagucaaggaugaaagaaagcagagcugaacauaugcagauagucuucucagaggaaugugagugaaauuacccaagaaaugaagaaaggaagaauguucucaauuugaagguaggacagugaacauauucaaaagacaaaagaguaacuagcaaaagacaaccaaaagagauggacugaaaaucaauuuguguguguguguuuguuugcguguguaaauacauacaacaaauugacgaaguugucuaguuuaagaaauuagccaggugaugguggagcacgccuuugaucccagcacuugggaggcagaggcagguggauuucugaguuugaggccagccuggucuacagagugaguuccagggcagccagggcuacacagagagacccugucucgaaaaacaaaaacaaaaacaaaaaaacaaaaacaaaaacaaaaaacaaaaaaacccaaaggaacaaaacaaacaaacaaaaaacccaagaaauuaaaacuucugaaauuauauuggaaucucaccacuuaggaagaucaggcauucaaagccagcuuugguuccauaccaaguuggagguuggccugagcuauauguccuaucucaaaggagaaaaaaaaaguauuucuuuucaacagggcagucuggcugcuaguuuacuugacacucaucuuccaagaguuucauuuuaaacaagguuuggggaaaagaaaaauguauaauugcaaggaaagcuacuuauuuauuuaugagauuuuuaauaaaacuagcucaacuguuauuucucuuuuuuugcacacauucugaaagauaauuauuagaagaacuggugaaaagauaaguagguaaagucugacagaaagaacacgggcaauguuguccgaggugcagagagcacaggaagagaacacaaaaugauuucuaaaugacacaucaguccucugauauguugugacacuagggacaagguagccaaaaucacugaccagaaagguuuauuacuuuuugggggguagggcaacagaaguauugacaacauuaugucuuacauaauacaaaagggaauugcuaagauuuuauaagugcaugaaguaguuaguuaauauaaaacugugcaacaagcaacugggacgcuagcacuugaauacauuucuagucacuugggagaacucuuccagcucauuaaggugggaucaucaagucccuccaagucaggcagggauuaaugugugccaaugugugaguucuaaaaguacaagaaaauaagccagcagcaauggguugccuuuccauauuacagagguucaucaucugacugccugaacauugaggcucauaaaugagccugcucaugggaaaccauuguaacuaucauaaauucaaaagacaccagacacuaucagcugcaugguagaauaagaaauuugaaaauacugauacucgaauuagccuuugaauggcuauaacuaugauaucacucaauguucuagaauguccauggaguuuggcagcauccuggaaaaauaagcuacacccaccuucuuaaggaaauaauaaguacauuaauuaaugugaaauguuuuuauuuaauagaguaagauuacaaaaaaugccaaguuacgugauauuuuuaaaggcagcuuuuuaugaauaauaauuacuaccacaagcuaauccuuuuggcuagauaaagaauugcagacuuuggagaugaaaaacauccugauuagucauauaaucuagucucuagcacauuuaccuccucacaguaucccuugcccuuacuucuuuaaggcuuccuauuuuuaaacuaaagaagauauuguauucccaaaggucauagucagggcccguuauuuggguuuaugaucuguaaacagaacucugugcagaacgacucugcuugguuaauguuguugucaauacccuaaaauccuuaugauuucaugggucauuuuguuuucauuuugcaguuaguucuaccuacuacauagccuauccuggaaauaaugguuaaaagugucacucaaacuagacuacuaaaacagauauaguaguuccuuucuauaaucacaacacuuuggagauggagccaggaaagucauggguucaaagucgcccucugcuacacagcaaguugaagacuaaguuggguuacuugagacccagcuccaaaauaggucaaaaauaaacuacuucaauaccaaauaaggucugaaccauuauauuauggacuccauaauucuuuuuaaauuauuuuuuucaguauccagggccuuguuuaugguagccaagaacucuaacacugagcaacaucugcaguuaaaccccaugguucuuaauguagccuaagauggcuagauguuuggauaccagauuacuaugaaauuaugcuugugauaaaaauacauugacccuuuuuuauaaauguaagcacugaccuuaguauuacuuguuauaguagagacuguuuuuaaaaauauauaugugagccagguguaguggugcacgccuuuaacccugacauucagaaggcagcggcagcauguggaccucugggagaccaaggguuacauagugaguuccaggauagccagagcuacauagugaaacuaucuaaauuaaaacaaaacaaaacaacaaaauauauguuuauauuuacccauuuuaauuuuaugucaucagcuuuuguucaaaaaugaaaucuuuauuuucuucuugauaacuuguuaauuuugagauuauaauguaauuacaucauccccuucccuuuuuuccuucuaacaccucccacauauauccccuugcucucuuucaaauucauggccucuuugucuuuaacuguuguuaccuuuguguguguuacuaaauaauucuguauaaugucaguuguauuauguuuucagggcuaccauuuuguauucuauaaccaauugguaugcuuuucccuaggaaagacuguugcucccacucucagucaucuuuaauuacccaucguucuuuguguagaguuaagacuuuguaaugaccacaaagauccaucuacuuuggcauguuuacugucgaccuuguucagcugaugaguagauaauguuguuggugagaccucauagguguagcuucugacauuucuagaagacacaaacucccuguuccuuuggcucuuacacucuuuucacccccuuuucuguaaugaucucuaacuggguuccacacucugcaguuuugauugguuguauaucacugcuuuuaccugagcacuccaaaccacccagaucuuucugauucuugauuuuuucccuuuuauauuccaugauaacgauucucaacucaaacaacaaauuugagucagucagaagaguuuuaaaacuuaaguuuugaaacuacugaagcccaaggauuaugacuuaauugauccauccuaagauauuguuguucuauuuuucuuuacuuacaauauagcaguuugucuauguauauccauaauaaucaacauuuuuauuuugucuucuuuccagaaauauuuuaaauuaaauccaagacaucaauuucuccauaaauacagcaauaucauuuaguagcuuuuaaaaguuccucagucaaauguaacaggcagccaguguuaagaacacagccaguagguuaguguacgugcugccaaaucugccugaguuugaucccuaagacccauauggugaagaagagaacugacuucuacuuguccccuuguuccccauacagacauacacagcaucaggguaaacaaauaaaaucuaauaaaaaguacacagaucaaugauugccccuuccaauuucuuaauaaugaaugccuuuuuuuuucccuguacuggagcaaugauuuugauaagcaaggaauuaugaagaguugaauguuaaaggaaaggccauuggaauagcuacaaguugaagauggugcuuuugauggcuaauguuggccaucaacuuaacauaucuaggauggaggaacaucaauugaggaacugccuccaucaaaucagccuguaggaacaucugugggggcauuuuuugauugcuauuugauguacaaguacccaguccacugugagugauacuaucccuaggcagaugguccaugguugucuaagaaagagucuggaagcaagccaguaagcaguguuucuuccuaguuccugcuucaagcuccugccuuggguuccuguuuuggccuccccagauaauggguuguaacauauaagaugaaauaaaccuuuuccuacccccaaguugguuuugaucagagcguccuauuacagcaacaguaaagcaaacuauggaguguucauuaccaauaugcuaguuuaguacacaaaauaauguguacuuuuuuggggaagcaguucuguuuauaaaguagauugagggcacuguguaauacaacacuguucuagcugcagaagaauaguguaaacaaacuuucuaauuaccaauaggauucauuucuagucucuauaaaauguuugauuauauauuugguccauaguaaugacuguuguaaccuuacagcugauucuuuaaucauaagcugucaugcuuacaaagucuagccaguacaccuuuacugaauuuuuuauaaugucagucucauuaaaaguuaaugagaaaacuaauuaguaaacugccaaugcacuuaguaagaaacauauucaaguaagagaaaaguauuuucaacggagguuauaaauuuucccgauucuauuauuuugcuaccagaucuaaacccuucaaacagaacugugagugauuauuuuagaauaacccaauggccacauggcauuuugaaagcugccaauuuuacaugaggagcuuuggaaaacaguuaauaaaaaauaauucuuuagguucuauuuuuucauccuugaacauuuaaaaaaaaacauuuugguucauuuaaaauaagaagaaaacaaagauaauaaaacccaacaauuaugauuauccauugcuuuaaaaccuuacuccuuuacucuauauaaggaagagaaaaacaagccccuauacuuuccauugaaauaucaucaaagaccaauuaaaugucaauuuuuagaucuuuuuaacucacuguuucaaauuuuccucugguauagaugaagauguucuuucccaacaaccuuuauauaguuauuaacagcaucguaucuugagucccacguuucuaauuccaaauaaaugcaucuggaauaucuacucuguccccaacaacugcuauguuuugcuuuauaauaucauuccucaguuagaauaccuuuugacuucucccuagcaaacagccucucagauacugauagugcuuauagacaaaugauuuaauuaaaaaugaucuaaauuggauuuuggcaaaaagcuccacagaugccacacuggaauucugccacaaguaucccagcuauuguuauuuauuucugauuuuagaaaaauuuuguuuccuuuuuuuauuuauuuuuauuuuuuuaaauuuuuuuuuauuuuuuauuauuuuuuuuuuuuuugguuuuuccagacaggguuucucuguauagcccuggcuguccugaaacucacuuuguagacuaggcuggccucaaacucagaaauccaccugucucugccuccugagugcugggauuaaaggcgugugccaccacgcccgacuuguuuucauuuuuauagcaccucugcuaaucauaaaauauaucagagcuagguauagaaaacuggacuggagguuuuaaauaucuauuuauucauagauuaaauaagucaacaaacugagcuacuaucccaguaauaaaauacuuguuuacuuguuugucaaaugcucuagaagacugcaaacuuuguaggaaccaugccuauucuauuaaccaaaaucaguaacaauacauuucacuguaucugauuacaguaaaaucauuccaagaauuauuacaauuuauucuguuaccagauacaauuggcucacauguucuaaaucccuccagucucugcucauagaucaauuuuugaaccccuuccuuguguaucagaacaucuuacuuuauucuucauauugguuaucaccuccacucguaucacacaggguuugacuguuuaucccucucagcuagaaugagaccccauggaaaaaauuguuuuaguuacugcucuaucuucagcaauuaaaaacaguucuugggggcugaagagauggcucagugguuaagagaacuggcugcucuuccugaagacuuggacgugauuugcagcacccacacaaaggcucacaacuaucuguaacucuaguuccauggcacccaaugccuucuucuggccuccauaggcaccacauacucauacaugcauacgugcagucaaaauaugcauacacauacaauuaaaaacaagcaaaccaauccuugauuguuagaaggcauuuaguaaauacuuguucagcaaauaugugugcaaucacauuuaagauuuuguauuauccuuuguacuuacauagcaguggcaaaaaaaaggcaaacaggacaaaauucauaacaaaaaggcaacacaaagcccauguaaccaccaucacagcaauacggcaacuaugcuguuuauuauuuucagcuuacuuuauacccauauuccuuccugaacuguccacacgcagagagagauuucauaagcugaauugguauuccuucuucaagaauuaugcuuuaaaaauacuaguaggagaaccaaaauuguauauuguuuuucaauaacauucuccaguacgagugguacuuagaucuguagaagugcuauuuggaaacugcugggauuagagccauccuagaucaaaggaaacuuggucaugauaaauuauucuaauucucuuaaauuauccugauuauaaguaacagauguauagucagcauuaucauauucccuagugauuaucaggauugugcucuugcaguguuaucauuauguuggacauauucaauauuauuccuucaaaucaauuucuauauacaacauggaaaauaacuauuaggggaaaugguuagggaauauggggaaacuggggagcgaggaagagagggagaggacuaagacugauuucuuuggucuuuagggccuuaaaauagcauuuaauaggaaaggugucacauuuggguacugccauguggguacugagaauugauuucaaaacccauuugacuuacacuacagugaccugagauagagaagacaauguuaucuucaccucacagaugaguaagcuaagcuuuuauuuauuaaaaaaauuuuuucaacucuaaagggaccaaauacauauuaaagaacaacaacaacaacaaccaaaaagguaaaaagcuaaaagaagcaggguuaaugaaggaaguguaucacuggauggugcaucuguacacuaugaaugcuggcuucaagauuauugaagcaaacguuccacacgauagcauccagaguuggggccugccugcuugccuggaacaucuuaauucuucugaagggguguguguguguguguguguguguguguguguguguguauuuguaugcgugugauaucuauauguauauauauuccaaagguauauaacauaucuuuaaauaugaaaggacagguugaaguuuugagcaaugaagacggucgguuuagucguuuuguuuucuugauagaagggaggauuauugacugccuaccuauaagccuuuugcuguuuuaggcacuuacugauuaugucucucaccauuuuccuuccccuaucugcuccuagggucucuuccuuugcagcaaagaguagaauauauuugcuccuaugcaccuuagggccaugaaccugcaguccuuaagaguuaaauuaaagucauaauuauacagauuauauguaaaggguuugggggagacauacagauuuauaguguuaaauagaaacauauguacccuuuagcuuaauuuuaaaagcaagaaaauugauaacacugaucauuuuaauucuugaaaccuacaaggcugcuuuuuucuuauuccaaggauuuuuaaauuuuauuuauuucuauguguaugaguguuuugccugcauguaugucugugcaccaugugcaugucuggugccuacagaagccagaagguguccugugacugaaaucauagacagcuaugagcugccauguggguacugagaauugaaugugcuccaacagaaaaauagucacugcuauuauccauugaaccauuuccccaacucucaagagaucuuuaaggauacuuuuuacuugauuuuacagggauuagaugcuuaaaggauuggggaaggagcauaaaauaugauuuguccucccuacuguucaccaugugggguuuuccuuuuucuuuucuuuucucuucuuuucuuuucuuuucuuuucuuuucuucucuuuucucuucuuuucuuuucuuucuuucuuucuuucuuucuuucuuucuuucuuuugagacaaguucuuucuguuuaacccuggcuguccuggaacucacucuacagaucaggcuggccucaaacucagagauccaccugccucugccuccuuaguguugggauuaaaggugugcaucaccaccaaccugcugggacuuucuuuuugauaagccaauaugauacuuuauucugaguaugaguugcauguguauggggaguaggacuuuccagaccuaucauaaaaugguauguuuacccuuugagauuucuuugugagcacggaauccaauaacauuuugcuaacacauauguaauaugaacauuuccagaguuagacuuuugaguugggggcuuaagcaaaagaaaagcuuuggguuucuaugacauggacaaaaaaggguuaaaaauucccuuuauuacauguguguuuagagaaaaucauuuagagugauucauaaaguauacacaaauauaaaaugaaagauuacaucaaauauuuuaaaauaaagugcuuuuuucaaauguaaccaugcucuaauuacacagaugccuuaauuucaaagggauaguaccaaaguaaaagaggagauaaggaaacagaacuauuuauacucuuuuguuuuaauguuuguuuucaaccgguguucuacaugaaauuaaaaauaaaaaggucugcugaugguaacuauaaauccagugucuaagauccuucuuaccauuauucagguaugaaaacuucaagaguaaaauucuuucaacaaacacccaagacuuccugauuggcaggucucccuaagccacauucaggagaguacuuaacaggagguagucuacguaguggcucucaucugccaagcagagaaaauugcugauuugugcuuaauaagccaaguaugcauaaauuauuuuaauuacaucaaacaaggggcuaaauuuagcugcaaucgugcagucuuuaccuuucucaaccaagggagaaugugaggcaacuagaaaaacccaggguaaaauagucucuaaauaaacaagaaaccaaagcaacaauaacaacuuuggguauaacaaaaaauuuuuuacaaaaguuccauucugcuguaaccuaggauaacuaagaaagacaaaguuugauaaaugaucaguaaucuaaccagaugcccacuaaaaauaucuuauaauucuagaaaagggaccuugggacucuaaugugaagauucuuuugagagaaucaucauuaugaaagaaaaauuaguucaccaagcuuagugugguagugaauaccuaucauaccagcauuugggaggaugaggaagaaaaacugucaguuugaagcuggccugagcuauauaauuagacucccccacucaaauggaaucaacuaaauuucaucaaaucuauacucaagauauaauauuauggggguggggauuacucccaaucaucgcauaucaaagaaaacaaauuuuaaaguacaauuauuaacauuucucaaaggucacugucauuucuccauuauaccaaacauaaacuaaucuuauaaagggauaguacguaacacgacaacauaucaaauacauaaaaugggcaaaggcagguuuaugcuggccuauacugaugcucugaugaaagcuaauggaaaugaggacagcacagcucuuagcuccacaaguuuaacuaagaaggcaguaguuaggcagccaugaaaaucagcauacacuuuugcucugaaccaaacggaacaacaacaacaacaaaaacauuuaaaauaucucuuugcuccuuuuugaguuauuuuguuaaauuuauaugacuuuggugguuauuucaggcauguuauugucacaaggaaaacagucaugcagauacaaauugacuauaaguuacucaucacagcacauaucugcaagugauagaaauuuucauuuauuucuucagacgaaguuccuuguguucuagcaauggggaacuaauaaaagaggugagugggguaaagagaaaauccauuuuaauugaccuguuugauaccacagagaaagggggaugggacccucacagaugugaagggggaauggguugaagaacuuugggaggggggaccaggaggaggacaacauuugggauguaaauaaagaaaguaauuaauuuuaaaaagaaauuucuauuugaaugaaacugucauuucaaugaaaacuuuucucuaaaacaacuuguaauuuuuaaaguucaggaaaaaauguaaaaugcuacuuuuauuauaggggcaauuuuuguucccauacugccugaaggcccuuuuuagaaguuggauaagucagaugauuguuaguuguaaagucauauaucucauaggacauaugaauucuauccacauuagaggaggcucgccuuaacauaaacauaccuuuaugaacauuaucuuacaguuuacacgcauaucuccauagaguaagcaccauucuuuuuagccaaagaagaucaaugucacauaagccacgaaacuucuuccuucaacccuucaguaguccuuugguucugauucuauuuuuuucuaguaaacuaguuaaucuuccuagucuacuuccacccuccucucucaacccagcacuuuaaaggcagugaccaaaauuauaauucuagcacaaagugguaccuuaagauugcauauaugagacuuuauaccccaucauagguggaaucaagagugguaaggcaggagugggugauugguugaaggagcacccucauagaggcaaagaggaggggggcagggagauaugggauaaggggguguggaggggaaaccaggaagggggauaacauuugaaauguaaacaaauaaaaugaucaauaaaaaaagaaucucagaagagaaaagcaguuuaaacccaccauaaaaaaaaaagauugcauauaugaaagaauuugaucaaugccauccaacaggcaagagguaaggauaugaucaaaauucagguggucagauuuuugcuucuucccucuacaucacccuccccaaauuaagcugcuccaccacuucaaagcccuaauaccaaacuaagaauuaccaugaaaaacagcucuugucucuccaagguccaaauuuguaaaaagccccuauggaagacuaaggaucuaaaaacagccuucuuuguaaucuucagacauggaccaguuuugaauuaagauuaacaacugugggagacuggcuuagaagaguugagucuccuucuuguuuaauugguuugguuuacacaucuuugaaagaaggggcagagccaaacucacuggagagaaauguacucuuagaagaauacagggauuccaaggguugaaaacuuggauauagcaaaagacgcgaaacugagaggaggugaguaauucugagggcuacuccuucacuuccccagcaucaagcagccccaugccccgacccaaaucucacuugcagccucucucucaaggugugauuggggcacuucguucuccuuaggauucccauguccuagcaaugccccucacacacucgcacucacucccuaggguggugauuauuuguauagguuuuggaaaaaaaguuaaguccacacccgcgaacccgcucuccucgccugucuuaacgggacuagucuagcuagcgcacugcacugcccaucagcccccuucgccaugggaagcgacccaucagguacuggaaacccccuuagcuucuccuaucgcgguaagacccaaagagcaacugggaguccugugcaagacagucaggacgcggugguagcagaggaaaggugguggcgggagcagaauuccccagucagucgcccuggguuuaagaugaggcagcgggcagcgacgaguaacuguuugccuugccaccuauucagugacagcggacccagcccuaacgcagguguagcuggccacaaccucuuaccuguaagucccccuccuccuucuuccccguagccucgacgccuuugcaggacaaaguacucguuggaucuuuccaucagccacagcuucagcgcauuuuucaacagcacuuccucgggcuucagccacaucuugaagaacuuugugccgccucgggaacggaggcgaccuauuuguccuccucaccuccacccucccagccugucuuuaccccucuacuucuccucccaccaagucuuccguuggcggcggcgccuccggagguuuuccacacuucccccaaccgugccuucucucccacguaggcagagagagug

SEQ ID NO: 9763 - RNA, 2724 nt, Mus musculus
gguucugagaacuggaagagcugucuggcuuggugucccaaggauggaccccgcugccucuccugcugcugccccuccugcugccccugcugcugccccagcugcugacccugcugcugacccugcugcugcccucccuggccaggccuuggcccaagccccugcccuagcacaaaucaauggacaagaaggugcuaggaaugaacgguaagugcaacuuagccuuugacagucugaacccaggcuuagggagcugcgggcaggagaaggugugacgcccaugguggugucugguucucuuugaaggggagagacaacagagagccucagcccuucuucuauaccuuuggcuggaaauaguuugccucacguaucauuccaggugacggggaagggcgcugagagagagagagagagagagagagagagagagagagagagagagagaaagagagagagagagagagagagagaacauugccaaagcuggaagccaaguagccugagcuucauagggaguccauacaauucacugagggaacaggagaggcuacuguggaagcuaggcuuaacgcaaccuggacuaugggacccagaugguagcagguaacauagagugacagggccaaagucugaagaggccuuuuguuggggggggggguugcugccucuguccugagcaugccacguuuccuuuuccuugucucugagagucuagaggagaagcaacaggcccaggaguauucgaaaccauuucucuaauuaggaagauggcaggguucuguucucaauucuuugauaucagaagcuggcaguaagauagauccucccuauacagcaggcauucucuucuuccaaacauuucauguucacauucaaucaacauuugcucaagccacuccuugcacaagguaauguacuagggcuuggcuaggggcaaaugugcccauacauaucuuucaucuuagaagggcuccaucagacaaugacaaagcagugggguaagagcagcgaugacauuguuggagcagagaggaaggguaucugucccagacuuggcucaguugucagggaaccagaggaguccuggagcacauggcuugugagucaaaccuucagaggaagccuguguuuacaucuuguaccaauuuaucucuuugucacagggcagcuuaucuuuggagacccuggcuguccucuauaaacgaccagccaaggcaggcgaggagucugguggacugggugaguuugaugcccugugacauguuugcacagacacuuacagccaugucccuucucagaaauccccugaccccagucccaggauggacaaucugggaaggcauuuugccaacucugcuaacauuucauccccacaguagcucuaggaggaaggcaggaccaaagcuuccaugacaaaugagacuaggagaucaaagcauagcguggguaagggaccugggcuggacucgcagucaguguauuauguauggagcuggugcugggauucaggucccuuggugccuugccucagagcuuacuuacucuucucccugaauguuuuguccucuaagagaacucugcccccuguaucgccuccaaaugggcacugaaagaaaacacucccccaggacuuguuuucaaccagcucgaagacagaccccuugcuguagggcagggcugggagguggcuggaucccaaggcaugccuaaagcauggagauugucagaaccugcagguuucugacuuuucuaugggagaggcaguuaagccacaugcucgcuuuugcuuuggacaggcugauaauagggcgacagcggcugaggcugccaagacugacucugacuuccaucacccggucagguaagcuucuggcguucaaguucagacuaugacaaauagccacaagcacugcauacgcucaugacaaggccaugaugcaggaggaaagaggccaugcgacuuaauaggccaaagugacuugccccugaggcccucccugucccugagcucucagaacgaaauccugugauuccaaccaaugaaagaucccuuaguaggaaaagaggcacuggaaugacggaacuguuagugaggcuggcacuagaguugugaggcucuggggugacucacuguaccacagugguaggccugucagaggugaugucccuuccgggaaccauuuuguagcaguuguaaagguucucugcuaaagcuccuucuucccucucagccuuucacugcagcuggugacuggcuugggcuucuuucuuggcccuacuggcccuucugcauuugagauuugccuaagguaggugcccuguuucuucucuguccacaggcucuacuggcccaagucccacuccuuugacuaccucuacagugcuggggagauauuacuaaacaacuucccuguccaggccaccaucaauuuauaugaggauucugacagugcagacaaugaggaagacaaggaggaggaggaggaggaggaggaggaggaagaugaugaagaagaagaggaagaugaagacaaagaugucaaugagaaugaaccagaaguguguauggggguaucagaggccacaacacauaaggccacagcucauuccccugacccacacucggccuguccaaauugaagcaaucccagauauacuuggcacguuuccaagggcaucgauucgcaaagagucuccagacacagcuuuucuggauugaaa

SEQ ID NO: 9764 - RNA, 3658 nt, Mus musculus
ucacugcccagcauauucuaugcacuuacccaguaacaaaaagaaauucuucaguggaauuugagacuuuuguccaguuuuaaauugguggaguauggguaguuuuaguauuauauaguaagauuucuuugugucuucugaaggcagguccuuuauaaguauaaugcuugcuucugaucuuuucuuauguucuuaauugugucuuaaagcacagaugucuuaaugagguccaauuuagaaauuuauucuguuaguauuuaagcuuuuugguaucuuaacuaagaaaucuuucccggaaucaaaguaaagaaaaauaguucuaugucuucuucuagaauacguacugucuuuaugcauggaaauuuguguuucuaagguaugaucuagguucuuaauuuuauaugaagauuuccuauugauuaacacuguaucuuaaauuucuuuguaugguuuuguugcuuugaucuauauuuaugucuuuaugugucaaaucccuaguggaccuuuauagcgaguuuggcaaucaagaaagaguaacucuuccgacuuuguuucuucucuccuaguucuuauauauccaugcaaauuuugucaacucuuuguugauuuuucuacauaaaugcugaaauuuaaaggagauuggauugagucugucauuucauuuagugacaguuucuccuagcacaugaacacacagugucucuuccuuuauucagaucagcuauaauuucguucagcauuauuuuauauauaauauauauauuuauauuuuauauauuauauaauaaguaauauuauauuguauauauuauagugcaucagaccuauacuucuaugaaauuuauuuuuaaacauuuuauucauuuugacacucuuguaaauaaaauuguucugcuuuuguuuauucuugucugcaaguauauagagagaugcuggguuuuguuuucaccuuauauucaucuaacaugaucuaauuaaauguucuauugauuauuuuauucuagugguuuuaguauggauagcuuggcgucuucuacacaagaaacacgguguuuccuaugaauaaagacaguuuuacuuguucucuugucuggaaccuuguuguuuacuugcuuuuccuucuguuuuccagaaccuucaguacauuguugaauggaaguaaugugacccaguguucuugcuuuaucccuaaucuucuuuuaauguaauauuacuauucauucuuugcuauaaaucacacucaacuucucuggaaaagcagcaaaugcucucuucagggagaaacauguuuuuuaagccauucaucuuagcgcuagguuuucuaugccagcucuguugcaguacauuacuuucuuacgguuauuauaauuaauuaccacacaucugauagccuaaagcaacauagguuucuucuaguacagaucuagaggucagaaguccuaagaugaagucguuaaaaugguacugaagacuaggugaauauuugauagaauucaccaaugaguccuauugaaccugagugguuuuuuaggauagcuagcugauuacuaauuccgccucuuguuaccguuuaguaagucauugucuuuugggauuguguugcuaauuguuauguuuauaaaguugucacucaacauagauuuccucgcucgcucgcugacuggaaguucuccaccguguuccuauggagucaucccucugauuuccacgagggcucaugccuucaccuuuucacuucagucucuuucucuucucuuaaguuuuugcagacggcagcacacagacuuggagaugagguuggcaggauccaauuugugugguguuaagcaccaaggaagcgccaccgguuuugcuuauuuguuugguugggguuguuuguugguugguuuuguuucagacauggucuuauucugaagcuucggcuagucugaaacucacuguauaaaucaggccucaaacucacagagauccgugucccucuauugguuccagccaucucuaaguuccuagggucuuugcucauugauaucaccugagaacccagaauagugccuggcuuauaguggucaugguauaagucucugauuauauacuuuagaauggucaugcaguuacauauuuucaaacaucaggauuuuuaaauccuauggauugcccuccucaucugacuuggauuucaccucuaaugcaagcucauuucaaacucuaaugugauuaaacacuuuuaauauaucuauuaguuacauauuuucccucuuuuuagggaagacucaucagucuuuugcucaauuuccccuugguugccuaccucuguuucuuaaggauauaugcaauuucauacauccaguagaugcacucucuaauuaucuguguaguaaccaucuuaucccaugguuuuucuaucuacucaugauucuuuugcuuauuggaugccuugugccacagcguauguguggaagucagagggcgucuuuggaggaauuaguucucuccuuccacaugugggccacaggauugaacucagguccccagguuuuguggaaguggccuuuacccacugagucauauuguugauguauuuuaugacacauccuaugaucaggaauuuuuuauuuuaaugcagcuguauucauaaauugagucaucauuuucuaaaugacuacaccuuuuguacccuuuuaaaaauaaaauauuuuacuuuugaaauuaaaauauauauuuucccccuugcuuuucuucuagcuccucgcauguauuuccccuuugugcucucucucgcucuuccucucucucucucucucucucucucucucucucucucucucucauucauggcuacucuuucuugaauucacguuguguaucuuaagagauaacuacucuuauacauugcugguagaaauacagaaaaguacaauuaccucaggauggaauuuguuuauuagaaguacacaaacauuuacucuuugucucagcaauuucaccuuuuagaauuuauuugaaagaaguucuugaaaaauaccaaauuaugugugugugugugugugugugugugacacacauaaaaaaaccacaaggcuaauuucagggcauaguucaaaacagcauaagacuucagauauaaaaccaauauuucaggguuuguucauagcaaaauaucuaaauaacuauuauacauacacauacaguaucguguaacuguaagaaggcaaaagaauagcuuuuauauggguauagaauuauauauaggacauaucguuaaaaucaaaagagcaagcuucagaccaguauuuauauaggaaaagaauauaacuaaugaauuucauguauguauacauauaguuucaaaaaaaaaaaaaggaaauccuggaaccauaggucaaacuuaaaaagaaauaguauuuacgaggaccacagggaaugaaacgaagggaucagagauagaaugauacuuccauaaagguauaguagagcccuuuuaaauuuagagccauauaaagguauugcaugauuacaaauguaauaaaaccucucaucagaaccagagggggcuggaagggguguguguuucccaguugagugcuugcucacauucacuaagcccugaguucacucugcagcaucacaugcacccaaaacucgagagagaagcaaucua

SEQ ID NO: 9765 - RNA, 19542 nt, Mus musculus
aacugcacacaugacagacauuuuauuaaguuucuucuacacaauacaguaaguucaauugagaggccaaacggauccaaggaagauaaaaauuaaauacuuaaauuaaucaaaaggcacugcgacaccaccuaaacccaccaccucagagguaguaggcuaaggaaggucgugcuacagcaaguuaccuaaugugaauguuagcaguuacauagcaagaagcaagucuguauuaccgaagauauuguuacaaugaucacugaguccaagauauuuggccaggaaagggucacaauagcuaaagguaaagccaacuggaaaggaauagguguagagaauccaagcgagauagagaagaguuaaauagcaauggaucaggcuucuuccucccaaaaccuaauuacugcauugagcuaccugccccugccuuacaggaugcucaacuauguuuaaggaugcucaggguucuugcugcagaccucugaaaauguauuacacaugggcuggcuuuguugcuaguuauucugaaugacgaaaaccccaaagcguucacaugcaauggaguaugagcuuugccaaucacguccuaaggaccuuguggaauacucucuuaacagucuauacaccuuucaagagcugagcucaacuuaaagcugcaagguucacaaaauaaacaagaaagccaggauacaacaaugcagguugaacauccuagcagcuaauagcaaucugucuuucucccauuuaggacaaaugguaauauagcuaaugugagauggaaaaagcuauacugaagcaagcugggucuucugcucaacucaccaauaccaagaaaaacaaggggugggguugguuuauuuucaaaaugcuucagaaguuauguuauaaaggaacauggcugaacaaguaggagacagauucuccauuguggguucuccugauggcuucugcaaggaucauagagaugucaaucaccuagaaaggcaaaaaaaaugcaccagguuaguauggaagagcagaguuuaugggcuuagcuguagccuauaugagcagccuggaaagcaaacuuaaugaaggaucuagcacucaacuccucccuuguacuauaaucacuuaggaaggaguuaagaugcaaacccugaccugaucauuaaaagagugauucuguacaggccaaguucaugccuagagcaggugaagaggaugguucagcaguuaagagcgcucacugacugcucuuccagaugacuagaguucaaggucagguggcucacaaccaccuuuaacucuagcuccagggaaucugauacccuuuugggauccucuacaugugauccgugcacucacgcgugcacucacacaugugcgcccacacacacacacacaaaguagccagaugguaguggcacacaccuuuaaucccagcacucaggaggaagaggcaggugcagcucugugaguuugaguccagccuggucuacagagcaaguucuaggacagccaugguuacacagagaaaccugucucuaaaaacagacagaaacucacaaaaaagagcaugccuauaaucccagcacuugggaggcagaggcagguggauuucugaguuccaggccagccuggucuacaaagugaguuccaggacagccagggcuacacagagaaacccuaucucaaaaaaaaaaaaaaguuuuaaagaauauacaaagcuggaugugguccagcauacucuugauccccgcacuuuaggaggcaaagccugguagauucugaguuuacugccagccuaaucuacacaaauucuaggucagccagggcugcaguaguaggacauuguaucgaguaaacgaacaaaaaacucauagaaggaagccaggcuuuuagcuacuuucgaggcuaaggcaugauuccaaguucaaggccugccugugcuacacaguaaguucaaggccaaucuggguaacuuacugauacuacaaaguaggacucuggacacaguccuuaucgccaaaagaaaaaaggagcuaaggauggguuuagaaauucagugguagaaugcuuaccuacaggaacaagacuuuggguuccauucucagaacaaaacaaacagaaaacccaaagaagcuaagcuucaguauuaacacaucugacuuaauguuaccaucugcaaaacacuuaauggaaauuugguuuuggaucaaucaccuguaucuuggagcaguguuucaucuuguccuccugagguaugguauugguaacuacuacugcuucaaagcaugcauuguugauucgagaaauggcagggccagaaaagauuccaugcgucaagauagcauaaacucugguagcgccagcugagagaagucuagagaaaaaaagaucugauuaaucugacauucaaauagagaaucugaauugggaagaaggcagaguauuaauuugucauaagagaauaucagacaaguuuguuucacaaacaaggcuaagacaaacaacauaggcgcucacaggaccuucuaguauacagggaaagaaaguauagcaaacaguuucuuuuaauaaggucacuaauccuaucaugaguguucugcucaagaucucacuaugccuaaacaccucccuggcuaaucugcaaaaccacaccuggggcuagaagucaacacaugaauuuuagggggacacaguucuggacuuauuaaagaauaaagccugcacuaagccuuauugugguagacccuuaaaaaauuaccaggaguaaccugugcucuuccuuucuguauggcaaaaagagaaaugcccuucaauaugauaugaaaaacuauacaauagaacuauguaugguuucacaagauugcaaauuuauaacugugaugugagaguaagcuuaagcagaaauacuuaauuugccugugcuuugcugcccagccuagggaccugaacuugaucccugggacccauaggguagaaggagcgagccauucugaagguuguccuuugauuuccacaugcuugccaugguauguguaaaggacaucuagggauuucuaacaaaacagaaagguagcgguguagaauauuauaaauauaauugucauugaauuagaugguuaaaaggguaaacuuggggggcuagagagauggcucaacaguuaagagcaacaacugcucuuccagagguccugaguucaauucccagcagccacaugguggcucacaaucaucuguaaugggaucugaugcccucuucuggugugucugaagauagugacaguauacucauauacauaaaauaaauaaaagggcaaacuuuaccauauaaaaauuguucugacuuacuugaaguuagaauuuuuggacuuuauaauggcacaaacauacuauccauucaguaaaaaacagguguagaauuuucaucuuucccuggucuagcaauaugcaaucaauauacugucuugacacagcuuccaggcagaaauguaaucaugaagggagacaacccagucuaugguagauuguguuacuaaguaagggcuuuuaaaagguaaaguguaugugauggauuuaacuuuugauaacucauuaaggauauccuggauguaaaagcagugucuguuuauaaaaguuaaaaaucugaaaugagggcuggagagauggcucagcaguuaagagcacuggcugcucuuccaaagguccugaguacaaaucccagcaaccacaugguggcucacaaccagcuauaaugagaucugacgcccucuucuagugcaucugaagacagcuacaguguauuuagauauaaaaauaaaucuuuaaaaaaaucugaaaugaggaauacuuacuaaucuauauguuauuaaaaguuaacaugaucagaauaucccaaagcuacuacucuacuuacccuucaguuguguuucagaaagaaucaguaaagaguaguuuagcuuuuuauuucuaacuagccuguacucacuugucagcggcgugacagauuguaccgcaagugucagccaugucauccacaaguauagccacacgguccuucacaucucccacaaguaccaugcgguccacuucauuggccuucuuccguuccuugugaaucaaagcaaaauccacauucagccggucugcaauggaggucacucuguaaaauagauguucaaaguuaggaaagacaaaaauccaaggcaaagcggcuuccaaagcugggagugucauuuagugguagacagcuggccccagguuccaucgcuugugcccacuuacacaaaauaacggaauguuuuuacuguaggagaauacuccuugaaaguaagacagaucccugagcuagaagaaagcaacuaucauuaacaucccacaaaacaaacaauacaaacuggauuuuguggauugaugcuucuguaauaccaacagcaguauaggaauauaauauucaaacuugcacaguccauaguauauagaugggguaggcauacccuucaccaguccugggaagcagcauauacuaagguauauuagcuugcuaacuaaaagcagaagauagagagagaucuuauagcuagugcagggaguguacagauuaucccaauuuccaucauggaagacuugugagucuagaauuagugacaagugaaccugaagguggcaggaguggaguaaagccuacccucucuccccaaauggugguaacagcuaccacuggugguaaauagcaacuguaccugcucaccaaccuugagauuccuucuagaaagaaaauuaagccaauuaaccagacaaacaggguauguuauuauauagccgaaauuauuaucaaaugaagaaaacucacuuuuuucccaucaaaggcagguuagaagacaaaucugacaauaaaguacaauacaguucacuuaugcagaaagucguucaguggcucuuguucuuccucuuuccccuuugucccuucucuccccauucccuccccacucucucuccaugugcucauggcuggccucuacucaucuucucucucucucucucucucucucucucucucucucucucucucucucucucucucuccccuauuccucaacuccccucucccaugcccuaaauaaacucuauucuauacuaaauaaauaaaagaaaacagucauuuaauguaaagacaauaggcuaccucuaugacauuuguacccaggcaccacuguauaaucuuugucauaaagaaaagauuccgccaagcagugguggcccauuccuucaaucccagcacuugggaggcagaggcagguggauuucugaguucaagaccagccuggucuacagagugaguuccgagauaaccagggcuacacagagaaacccugucucaaaaaacaacaaaaauaaaaauaaaaaaggaaaagauuccugcuuuagguuuuguuuuuaaauguggcauugaucaaacuuuagcauuaugucauauuucccuuguaccaaaguuuuuguugaagagaaccugugaccauauaagguucaaaacauaacucuaggcaacauuucuaccugguucuaaacuaaccuuagaccaugugcucuuuaauuacuacuggcuaggcaccuaacaucagagguaaccaguuuacuuggaaugaugacacucaagacaaaugcaugauaucaguuacuuuaaguguuccaaauuauucaugcucacuggccaagacaccaacaaagcagaaaaggguuagaaaaauaaccccgacucccuugaguggagagcuucauugcaaaucaugaucacacuagggauccuuagcuacuccccaacucugccaaggcacuagcgagcaucacucacuccaccacuaugaaguaauuagaaugugaaagaaugacaaagaacaguaagccauuugcagaaaguaguauucuuauaccaaacuuaaaaaaaagcaaaccuuuuugauuauuucaaauuaacuacuuuuuaaguccugagaaagacaugaagauaaugcuuaagaaguuaaaaacagauugugaccacugucacagccgauaacugcucauuaaauggaguucaucaagcuauauauaucuggcuggaugaaccaagggagcaguuuauuaaagagaagguugggaaagaugugaauuguuugaauucuucaugauuuguuaucacuuuuggaaaguucuaaucaguuuuuuuucuacucaccugaguuuuguagcccuucauucuauuuccacaagaacacaugucauauuucuguauguauuacuaacacacaauccacuaagaaaaucaaaggcccuuagucugcaauauuugagcuauaaaguauuguaacugcuaaaccguggcaauaaguuugguuuaaaauuuuaagguauagggcuggagagauggcucaguggcuaagagcacugacugaucuuccagagguccugaguucaaaucccagcaaccacaugguggcuuacaaccaucuguaauaggauccaaugcucucuuguggugugucugaugauagcuacaguguacucauauaaaauaaauaaaucuuuaauaaaaaauuaagguauagacuuuaaaaucccauacuucauuucccucucuguuuaauauuuuaauucaggaauaaaauggucuaaccaacagcuuuguaaaagguuuguaaaggcuacuuuaaaaaauauuccauucuuuuacaucucaauagauaucccgcccccucuccccucuccuuugccucuaugagggugcuccccaacucauccaccccaacacuccagcaaccaccuaugcuaugacuggaccucacucgaccugacuggaccaccagagcauccagggacuaagaccaccaaccaagcaauguaaagcuuacuuauccauuaauauaggguuuaagaauaaaagcuauuccuuacaaaugaaauuuccaacccuuucccauaaaguucagcaguguuguuuuacuaaugugauagucaagcauaaugcaacaacuauugguuuucuugaggcagguuuucucugugacagccugguuguccucaaauucgcucuguagaccaggcuagcuuugaaaucagagaucuaccugccucugccuccaaaauguugagauaaaaggcaugcgccaccacugccuggcacaguacauuauuuuuaggaacaauaguaauuauaaccuuaccuuuuggcuccaccagcaucaggugagacaauaguacaguuucuccacucagauauauucucccguauccacuuuaggacagcuggcucugcauauaaauuguccaccgggauaucaaagaaacccuggagaaaggagauggguuaaguuuugucugauuuuucuuuucuuucauuuaugaaugucuaacaaaauagaugcagagagauggcucaucugaggaagguauuugcuggugaaucugaugucuugaggaguuugcucccugggacucaccaguaaaauaccucuuuccuggcaaaaucaacaaauguuagcccuuagccaacucacaucugaccauagguacagaaaugagcccuuauaaagucagauucagucaaguacuaggaacugccaagccaaauaucagacucacaacuuauacuauuuaugccacuugguguuggugcugguccaacugguaaagcagcuagcguuaguauugcauauaaacucagggccaacuauuuauauugaaugaugaaaucaagagauguguguuuuaauaguuuauauaaaugaguuuauuucucaacuaaguuggcuguuccuuuuuauaggacgaguauacgccucuauacuauguacaucacuguauugccacaggauacaaaugguauuaacugggaguuuauauuuuuaaagcagguuuuauuuucucccugccugggucuuccagaugcuaagauuauaugcaugcacuaccauauguagcagaaaauuucuuuauauaguauaaaauaaauguggcaauugauuucccuugcucugggcuugugugaaaaauccuuaaugucuguagcucuaaauuuaagacugauuauucuagggguaaauccugauaauagcuacuaccauuauuaucagcuacaucaaccaaguaucagacuuaauguuuuaugaccauaauaauaauguguauauaucagaaguaaccuaccaaggcuauaaaguuaacgugcuagugcugguacguugaaguagaagcaucuagacuaguucuaacccuaaagccuaagcucuucccaucauaccaaacagucaaaguucuugcuucaucuuucagucuccagacugcagauauccacuaccaugccugacuuuccucccacccuucuaccucuuaguauguagcuuuaacucauaccugaauuugagaugcauguagauccauggugauaauaugaucugcaccugcuacagauagcauauuugcaacaagcuuagcugagauuggagcccggcucugaauagaaggaaaggaaaaaggaaacaagaugaaaacaauuaauuugcuugagaaacuuaugggcuuaaaugccacauauggcauauaaauucagugguaacuagcuauauugaaugauuauacaagacaacuaaaucuaguuuuauacaaacuuguaguuguucucaaguuguuucucuuuuuauaggacaaguauauaccccucuucccuaugcaugccauuguauuacagaagauccaaaugguauuagcugggaguuuauacauuaagauuuauguaucuggcuuauuuacagaaugagguauuuacauaaagcuuugcaagccucuacuaguuaauaaucauuuuuacaaaugauuaauuuaauuaauaccuaggaggaaugcuagcuuguuuguuuauuaugaucaaguauagaguaaaagcauagacuuuguaguagucuuuuuauaguggcacagguauguugagguuaauaugaagcugaccuucagaugaaucagauuaaccaacuuuauuuugauauagguccuguuagguggcauauaaguacugaguauguaugcauuaaaauauuuugauaaaacaauuuuuagagauaauaugaagacuaaacuugauugaccauaguaaacgcuugaauagauugaaaauguauguauagggcaauaaagauggcucagugguuaagaguacugacugcucuuccagagauccugaguucaauucccagcaaccacaugguggcucaugacaccucuaaaaggauuuguugcccucuucugggcugucuaaagguagggacaauguacucauauacaugaaauaaagaaaucuuuuaagaagaaaaaaagaaaauguaugcauaagaaaacagacaguaguggcacaugccuuuguuccuuggagacagagguacacagaucucuuaugaggccagccuggucuacccagagaguuccaggacaaccagagcuacauagagagacccuguauugaaaaacaacaaaauaguagacuaagacaggaagugguggugcacaccuuuagucccagcacucuggaggcagagauaggaaaaucaaagccauccuggucuacccagugggugcuaggacagcuagggcuacucagagaaacccuaucuugaaaaauaaaacaaagcaacaaaaacaacagcaguagagggauggggucaccaacccacuuucaaaaucuuugaccccgaaauguuucugucuaaaagaacugcagggacaaaaauggagcagagacugaaggaaaggagguccagugaccugcccaauuugggaucuaucccauagguaggcaccaaacccugauacuauuaguaaugcuguuaugcuugcagauaggagccuagcauggcuguccucugagaggcucuaccagcagcugacugaaacagaugcagauacuuauagccaaccauuggacugagcucagggaccucuauggaaguuaggggaaggacugaaggaacugaaggggaugguaacucuauaguaagaacaacagugucaacuaaccuggaccucuagaagcucccagacacugggccaccaaccaggcagcauaccugagcugguuggaggccccugggacauauguaguagagagcugccuugucuggccucagugaaagaggaugccccaggguggggggauacccaggagggggcacccuaucaggugaaggggaggggagauagggaaaguauucugcaagaggggacuagaagaagcaacauuuaggauguaaauaaauaaaauaauaaaaaaguaaagccauacgcuguccguuacaaugccauuucacaguauucacuuacaaauggauuucugugggauuugaauauucuuagcuauaaaaacaauuauuugucaccuaaauaaaaguuaaaacacuuaaguaaaauauauaauauauaugcacugcuuuuaaaaucaauuauauaucauugcuauaaagauagggaauacuuaaggaaaugucauuuuguaaggcagcuacacuaaccacuauaccacuaaucgugcaucuagcaaacaggaaaauauacaacugauagcuaaggacuuugugacuuuggacaaugauccucuuuccccuacauuagaaaagauucugagcugaagguauaacucaguaguagagcucuaggucuaaucaaaacacacacacacacacacacacacacacacacacacacacacacacaccauuccuaccuuauccuucuuaucuuggcgggcguaagggaagcaugggaugacugcaguaacccggcuggcugaagcgaucuuacaagcauuaaucaugaucaaaagcuccauuagauugucauuuaucucaccacacccacuuugaacaauguagacaucuucuccacgaacgcuuucgccaauuuccacacuaaaauagaaaaaaagagaaugaauauaaacaauagauuuuucuaagccaccacuacagucauaggaucagcauuaauacaugcaauggauggguugcagcuacacguggauauuaaucacuucagacuuugagagugcaccuaaggguuagagagagguggcucaguggaagagcaccgacugcucuuccagagguccugaguuuaauucccagcaaccacauggugacucacaaccaucuauaaagggaucugaugcccucuucuggugugucugaagacagcaacaguguacccacacacauaauuuuaaaaagaaaaacaaauaaauaagaaaaaauagagaaagagcaccuaaaggaaccuguauacuagaagcaacuuaucauccaguuucauuacaguucacuguacaaauauucugaguuuauaaaugugauacuggaugaaaaagauugguugauuuuaaaguacuuauaaagauguaauugcaguaccaaauacaguaccaaaucugcuauuaaugguaacuauuauagucuacacauaaggaaaggacgaaaauccucagaaaugaaucacgacuguucuauaaaggugcuauauagagauaaguuugcuaaaguauuaaauacucgcgccaaccuuaguauucuacuaggaauauguaaagguaaaugaaagagaugugggcccugcccucuuucugugcuaacuacucugaauuaagcagaaagucuugcuaacuacuauggucuggagggaugagauuagucuuuuaagaacaugaaguagcuggguguggugguacacgccuuuaaucccaguacuugggaggcagaggcagagagaucucuuuaugaguuugaugcuggccugguccacagaguucuaagacagccagggauacagagucucaaaaaaaaaaaacaaacaaaaacuacaaaauuaggccaguguugguggcauacaucugcaauuccagaacuaaagaaacugagaaagggugaaggugauuuuaaagacaagguagggcucgagagauggcucaguggguaagugcucuuccgauuccgaaaguaagucaggaguuccaaucccagcaaccacaugguggcucacaaccauccauaacgagaccugacucccucuccuggagugucugaagacugcuacaguguacuuacauauaauaaauaaaucuuaaaaaaaaaaaaaagacaagguaguuacauaaaaagagacccugucugggaaaaaaaaaaaaaaagaagaaaaaccaacaaaauaaaaggcuaguuuaugacugagaaaaaaaauacuauugauaacccucuaagauaacuaaugaauacagcuuuguaaguagggaguuaagaggaucugggaggacuugggugaggagaaaauaugaucaaaauguauuguaugaagccgggcggugguggcacacgccuuuaaucccagcacuugggaggcagacgcaggcggauuucugaguucaaggccagccuggucuacaaagugaguuccaggacagccagggcuacacagagaaacccugucucgaaacaaacaaacaaaccaacccccccaaaaaaaacccccaaaauguauuauaugaaaaaguuaggcaacaaaacuagcccccauaacccccagguuaaucugagaauucuaccaacauuuaaacaguaguaaugcucauuuuacagucuuuuccagaaaugggugagaaggaaacagauuccaacucaaguuuuauugcggccaggaaguauuacucagauacuaaaaccugaugaaggcaguauuaaaaccauugaaaagagcaggaagaaaguagagguaaucaccucaaaucccagcacucgggaggcagagguaggcggcggaucucugaguucguucgaggccagccuggucuacaaagugaguuccaggacagccagggcuacagagaaacccugucuggaaaaaccaaaaaaaaaaaaaaaaaaaaaaaaaaaaacaacaaaacaaaacaaaacaaaucaucucaaagcaaauagaaaagacccuuuugcuaauuaauaagucaauaguggagcuuuauauaucuugacuuuuguuuguuuucuucaauuucucuuuucuuuuccuacuucagacaggguuucucuuuguaacagaggcccuggcuguccuagacuuguuuuguagaccaggcuggugucaaacuccaagaucugccugccucugccucccuggcacugugcucaaaggagugugccacugcuacccagccucucuaggcuuuuaucaguguaaauauacuuauuguuacauuauaccauagcuuuacagggaaaccacaauuucgagaaaaaauauaauuagaaaguuauaaaacacugagcaagacauauuuuuucucguuuuuuccaacugcccauaagucuacaacucaaaauucauuuuccugucacugggaauaacauucauuauuuuguacaugcuaggcaagugaucugccagagauacucuauucucaaaacucaaauuuauucuuauuuucuuuuuguggggacaauaaaggacucauguaguaauucacgauggccugcaauuuacuauagaagcgagaaugaacucagacuucugauucuccugccacuuccuccaaaagcaccaccaugcaugcuucuaaauucaauuuugauggugugcacuuauaauuaagacagaguaggcugagggcaguuuaggauagacagugagcuccagggcagucugggccaguuuaugacccugucucaaaacaaccaacuaaacaaauaaauaguaaagaaaagaauauaauuauguaccauuauaccuguguauacucaaguaaaccauuacugcaucuuucaaugaaagcugagguaacggaaguauuaagaaaaaaaaaaaagacacuucugaggucagucaaaaaaaccuacuuuaauucuguauuuuccgagaagcuguauaaugagggaacccggguaacuuccaauuucuguaguuagcauaaaaaauuguccaucucugaaccagguuuggugguaugcacuuacacaucugucccuuaggaaacugaugaaagccaagucuacauaccuugucucaaaaaaaagggaaaauaguuuaaaauauuuucuccuuagcuugucauguaccauucagguuuuuuuuuuuuuuuaauauuccuuggaagcuggaugugguggcgcacgccuuuaaucccagcacucgggaggcagaagcaggcggauuucugaguuugaggccagccuggucuacaaagugaguuccaggacagccagggcuacacagagaaacccugucuugacaaacaaaacaaaacaaaaauuccuuggauauauugaauauauccuuccacuuucuggccucucuaugcuucuugccaguaucuugauuuuuuucuauaacuacuuacccauuuuuaggucuccgauuacaauuccuucucugauaguuuuauaaaauuguauccagagaaccaguaauaauaaaaaagaauguagcuaagguacauauauugaauauagcucaauugggaguguuuccuugguauuuaggaagucuuggguuagauccuaucuaggugugggugcagucuuuaauuccagguugagacaggaaaaucagguuauaaggaauuugaagacagccugaauugucucacaacaaaaccuuuuguaugcauucaugaguuccugacacaugagguucacaaauccggaguaaaucugagcuaagcaugcaaauuugucucaaaauaaaaaagcauuaaccugggcuggagagauggcucagccuguaagagcaccugagugcucuucugaagguccugaguucaaaucccagcaaccacaugguggcucacaaccaccuguaaugagaucugacgcccaccucuggugggucuuaaguauaauaauaaauaaaucuuugggccagaacaagcagggacugagcgagggguugaccugagggagcagagguccaaaaaaaaaaaaaaaaaaaaucaauucccaaaaaccacaugaagacucaaaaccuacaguguacucagauacauaaaaaaaaaaaaaaaaaaaaaaaaaaaaaaaagcauuaaccaggcacuuugagguaugauaggugugagaccagauugggcuauauagugggacucaucauccuuaaauggccaggccaggccaggcuuaaagaauaccucaaggaauuauucucuaaguuaccaccaaagcaacagugacuuuuuaaaauuuauuauucuuuuuuacuuauucacuuuacauccugcucacugucccccaucacacucucccacaauccucccccauucuccucuggacaggccccuagguaucuccccaccccagcacuucaagucucuuggaggcuaagcgagaaguggcuuuuaaaaaggaauucuucaggucuuguuuuccuuuuuagagauagugucucacugagaauuccuggcuggcuuggaacucucuauaaaaaucagguugaccuugaacccugggaucagccugcuuuaucuggcugagacuaaagguguguuuuuugacucacuuuccuugaaagacucccugauuuaaauaaaaaaaaaagugcuucuguuuuguggcucaugcagucuagacuaaguauuuccaacaauugaguaacuucaaacaaauggcuaaaucucacacaucucaccucuuugacccagaucucuguucuccugggggagaguagaaguugggugcaccaauuuccaauaaggucagguuugccuuaugccugguauccgagguuuaucuacggauauaguuucagaaaaggggagaguaucacguguuucacacagauucacuuccuagugucaaauuguuugauuaggaguuagagaacaaauaacacaauuucacaacugacccccuagaaagucugacagacuuaaauuccucaaagcauuuaaauuagaucaaaguggcuucucacuuuagaaagccucaaaugagucaauaaaacccuacaacauauauuuugcauucuacucuuuauuacuuguaaauuacccauccauauaagaacuccgaggaguuuguaaaugcaagucucuaaagagcuguuauccauuacuuaugccucuaucccuuaagcugcuugaaaacaaaagauaagguaacucuaaacuuuagcauuuucuucaaagcucuuggcaaaauuauuagucuucaggucuauaagacuuauaauauugauuuuaacaaaguucuugcuuuuguaacuacagaauauauagucucacuauauguagccuggaacuacuucuguagauuggacuggcuucugacucagagauccugccugucucugccucccccaguacagagauuaaaggugugugccaucacaccuguuucugacccuuaggcgaucugccuuaucuacacagcugggaggucagccuuaucuauagagugaguugcaggacagccagugcuacaggaaaaccuuguugccgcugggcagugguggugcacaccuuuaaucccagcacuugggaggcagaggcagguggauuucugaguuccaggccagccuggucuacaaagugaguuccaggacagccagggauacacagagaaacccugucccgaaaaacaaacaaacaaacaaaaaaacaaaaaaaaaaagaagaaaaaagaaagcuugucaccaaaaggcaaaaagaaccacccaaacuauucugcagucaggcauggugaugcaggcuuaauuauacuuuagggaacagaaacagucagguuucuaaguuccaaggacagacuggucuacacagcaagcucuaaaccacccaggucuacuccccaccuccccaaaacacuuagcaacucacccaacuuuuaccaugauuuguaaaaauuuugcuuaauaaccaacauuucagcuguuuuucuuuuuuuuucucuuucuuucuuuuuuuuuuuucuucgggacaggguuucucuguguagcccuggcuguccuggaacucacuuuguagaccaggcuggccucaaacucagaaauccgccugccucugccucccaagugcugggauuaaaggugugcgccaccacgcccggcuucagcuguuuuucaaaaccaagcuuagagcugaaacuuuagagagccuguuuagcaguuauaagaucacaggcugcucuaguagaggacuggagcucugauucccaggucccacaugguagcucacaaccaucugugacuccagucccaggggaucuaacauccucuucugaccucaacagguaccagccaugcacaauauauguauaugcaggcaaaauauccauauacaaaauaacuuaaaucauaaaaagccuuauccaaguugggcuuaaucaagauuaaucaguagaaaacuauguuguucucuucucccaugaccaccaccacaaauauaaucucaguuucugguguguugcauucugcaaagggcagaaggauuaacaaacggacaaaacaguccucacaucacccccccccaaaaaaaaaacauagaagauuuaaccaaaguggccacaaaaccccacauuaaauuaaaaaaauauucuuauccccuagcuaggcuguucucaaagucuggggcugcucugcuuucuuugaggcccaggaguaauaacggucagagauaaaaacagcagcuugcacaccucuuuugacuaagguauugccugguuacagaugcuuucaguguuugcacugccauuugcaucacaauuaacagcaugcuaguccuggaagcagccauuauuacagaugaacuuuaacuaacacacacagaaacaauuuaaaggaaagacuacaagacguuuagaaauaaucagaaagaauaaaucuuauguaauuuaauugaucauugguuuaaaaaaaacugaccccuaacagcugacugaaagauuguagacuguggagguagugauggcgcaagucugcaagcccaguacuaagcaggcagugagaaaagcaagaggauaaauguuugaguccuguagacuaccccccaaaacaaacaaacaacccuaaaaccaaaauuaaaauaagugaacaaaaaagcauuauuguuaguguucuugauuucaucuacuacaggaaaacaauacagugcucuagaggauccuguauauagcuggaagggggcacuaaaagaagcacgguccaauagugcauguggaugaugacuggggcuaagacaguucuguuagcaauuuuucggagaccgucucacuacauaguccugacuagucuagaguuaacuaugcagacuaggcuugcuucaaacuugcuucuccugcucuugccuaguggcaugcgacagcacaccagugcugggccacgaguuuuauagcagagcaccaaaaagacgacauucaaauuucccuuugcuguuugagcuagcucuuccacugcguuauuauuuugucacugaacacucacguguaagucguucccuaaauccucacgcauuuaacacuaagaaguggcuacaauggaggaggggcggagugcuuguauuauuaugucugccaguagcggaauuggaaaccgucaaaaauucgaauucuacaacuaagguuucccuauuuuuuugggaugacuuaagcugagaugucgaagaucaaggauguugagcucaaagcaaccacuuuaccccaucuacugaauuuaacuuaagggugguuugauuccucgacagacaggauaggaaaagccgacaccgugccagucuaagggaacgugguaacguuuucgcgcccucagaacacaauguuucccaagaccaaaccagaacgcuaccauuuccaaccaaaaagcuuuucaaaucuaggaaaaagaccacgauggggcucagaacgccauagguucucugauguacaccagucgacgcgcggaaagugaaccgaauccaaucuacuggcuccacagugaagcgacaagccacguguccccaugcccaaagcuaagcgcccguacaccuccagacauuccaggaggccauuaccccccgacauuagauccuccauccccaacccccaaacguagcggccucagcucccaucuccaucuuggcuccaccuaaccgcgcgcagcgaggaugaacgcgacccucucgggagguaaaauaacggaacaacccgcgaggcaagcuaaccucugcugccccuuucugcccauccucugcugccaggaaaucccacggccgcuccaucccccgaguugccauggccugggcaggucagguacacucaagguaccaauugcguccuuaccaggucuccugguugcugaauuucuuagucaccaccuugccuagcucaaggcccaggcggucagcgauuuucugggauaaguccuggugggagcucccgcugaagauuuugauauucggcaucuuggguaacuaccucaacgugcucaguggucgccgccgccgccgcugccaacacgggaacggaagucagcaggcagucugaacaccaacaguaccgcguugcuacuccgccaucuuacauucccgcccagcgcgcggca

SEQ ID NO: 9766 - RNA, 658 nt, Mus musculus
uucuucuuuucuucuaugaaugacacuuuauucagucauuuucuuuacagcugaaacucuggaaauucaaaauuaacauccuugccugugagcuucuugugcacaccagaaaaaguuccgaucuuguguuccacguugcucugcugugcuuugucuaagagagcuuuuaugagccggcugccauccgguuucacacggauccucuuacccacaauuucacuugggaagacuaaguccucaaggauggcgucgugcacugcugucagggugcggcuucugggcgcuucugcuuauuuuucauacggcuuucgggguuggcuugggcagaauccuccucugagcaaugaagaccucgugcuugccacugaacuuuuucuccaacucacgaacuagccggacuuggauuuucuggaaagauuuaagcagaggaacugguacaaaaauuaugauggcuuuccgaccaccaccaacuucaauuuccucggcugcggugauguugaguucccgcagcugugccuugagaucggaguucaucuccagcucgagcagcgagcagcgccugagagaugccagacucaacucguccggcuucucaccauugggcuucaggauccuggcgcucgagcugaaaauggcuugguccugacggagagccggc

SEQ ID NO: 9767 - RNA, 658 nt, Mus musculus
gccggcucuccgucaggaccaagccauuuucagcucgagcgccaggauccugaagcccaauggugagaagccggacgaguugagucuggcaucucucaggcgcugcucgcugcucgagcuggagaugaacuccgaucucaaggcacagcugcgggaacucaacaucaccgcagccgaggaaauugaaguuggugguggucggaaagccaucauaauuuuuguaccaguuccucugcuuaaaucuuuccagaaaauccaaguccggcuaguucgugaguuggagaaaaaguucaguggcaagcacgaggucuucauugcucagaggaggauucugcccaagccaaccccgaaagccguaugaaaaauaagcagaagcgcccagaagccgcacccugacagcagugcacgacgccauccuugaggacuuagucuucccaagugaaauuguggguaagaggauccgugugaaaccggauggcagccggcucauaaaagcucucuuagacaaagcacagcagagcaacguggaacacaagaucggaacuuuuucuggugugcacaagaagcucacaggcaaggauguuaauuuugaauuuccagaguuucagcuguaaagaaaaugacugaauaaagugucauucauagaagaaaagaagaa

SEQ ID NO: 9768 - RNA, 2149 nt, Mus musculus
ucuaauccacuucuuccaugcucgaggcauucucaucaccuuccaguggggggaucucaucaggaacagcagcacugggcuccucugcagugaccucaucuucaucgaugcccaggccuaguuuaaucaugugguagaugcaguuggaguggguuuggggauccucaagugagaaaccagaagagagcagagcaguuucaaacagcagcaccaccagguucuuggcagcuuugucguuuuugucugccucagccuucugcugcaggguuuccacgaugggguagucaggguuuaacaccagguguuuuuuggccaucauguagcccaucguagaguuguuucacagugccagggccuucaugaucugcuccauguugacuguccagcuauaggugcuugucacaaugcagcagggugaagauacaagccuauuggagauugucacuuuuucaaccuucuucuccaagagcucuuucaggagcuugcagagauucucaaacuuuaccuugcucuccucuauuuucuucuucucuuccucaugcucugguagcucccggcccuccuuagucaccgagaccagacucuucccaucaaacuccuugagcugcugcacacaguccucaucacuaggcuuagucauuuacaccaccucaaagcccuacuuccucacacgcuccacaaaggcaguguuggccacuugcucuuugcucucuccagugauauaguagauggacuucuuggucuccuucaugcaagacacauacucugacaggaaagucauaucaucuccagacugagaggugugauagagaaggagcucagagaggcagugacaguuaguggaaucuucaugaauuccaagcuuuaaauucuuggagaaagccucauagaacuucuuguaguucucuuugucuucagccaauucagagaagagcucaaggcacuucuucauaguauuuuugugggugacuuucaggaucuuguucugcuggagcaauucucuggagauguucagacacagguccucagagacaaccacaccacagauaaaguugagggacucagauaucagcucauuacagcugucuaugaugaacacacagcggacauacaaugugauguuguuguuguucuucuucucaaaaaugucaaagggcgcuagcuggggaaugaagagcaaugcccugaauuccaauugaccuucuacagagaaguguuugagugccaacugguccuuccaaucauuguugaggcucuuauagaauucaccauacuccucuugagugaugucaucuggauuucugguccaaauaggcucucuuguucagcuccuccuggucaauguacuucuccuugaucuucuuuguuuucuuuuucuugucuuugccacugucaucuuccucaucagaucccacauauucaaucuuaggcuucuccucauccugcuuaucuuccuccucuuuuucaccuuucucuuccucugccuuaucaucacugaucuccuucucccucuccuucuccaaauagagggugauuggauagccuaugaacugcgaauguuucuucaccacuuccuugacccuccucuccucuaaguacugucugaucuucuuugaggugaaggaucacuuugagccaaugggcucacgauggucugcauggacggugaaggguccaccagcagacgacucccaggcauacuguucaucaucguuguucugugugaucacaaccacuuucucugccacuagauaggccgaguagaauccuacaccaaacuguccaaucauggagaugucugcaccagccuggagagcuuccaugaaugccuucgugccagacuuagcaaugguucccaaguuauuaaugaggucaugccaaugcugguguccaccaaagucagcgugugcuccuaaggguuggggaugaugugaauuuucagcucuuuccugcuguccaacuuggaagaguccaucaggcucuuauacuauaucuuguccagggcaucugaagcauuagagaucaacucucggaggaaaaucuccuuguuucaauagaaaguauugaugaugagggacaugagcugggcaauuucugccugaaaggcaaagaucuccaccucuuuccauggugcacuuccucaggcauc

SEQ ID NO: 9769 - RNA, 1745 nt, Mus musculus
cuuuuuuuuuccaagagaauuaaaucguuuauugaguacacaugauaauggauacauaagcuucauucccaucuguuauuuuaucugauaccguuauucaauuuugauauugcauagggugugccaacaaccauuuuauaaccaaauugugaccuugcuuggaugacccuuucaauggugaaacucauuaaaaguuacaauaguaacuggcaguuuaacaacgucaagguuuuugaagacaauggcuucuccacccaagcaaccauaaauaaauuccaaauggaacuuggcaccacccugaaggaauucuaacuucacacuguuggggaaguuuaccaagauggcuucagaauagacuaacuuuacacagcacauuaaaaaaaaaaagacacauuuauucagcgucaugaucagacuauuacauuuagcaaucaacagcaugggugaaaaaggucuacaguaaaaccuuuuguuggaaugcuuuacacuuuccacagaacagaaacuaaaauaaccuguuauacaauuagucauaaauacaguccuagaguuuuugcccacacacaugaguauugucuaaaacaugucuucuuuguagcagguagguccugccaccacugugcuuggcugaguucacaaaucuguuguaaccuguagcuucccugucacuucucuggcucuccucuccugcuaagcuuuguuuccuggcuguauguaacuagaaccuccugccacugccauagcuacugcugcugcuggaacugccauagccaccuugguuccgugguuuagcaaaguacuggccuccaccaccauaagggccagagcuccugccuccaaaguuuucucgcuucaucggcccaaaauuggaagacugauuguuguaauugccaaaaucauuguagcuuccaccaccuccaaaauugcuuccaucauugccaaauccauuauagccauccccacugccaccauauccaccaccaccacggcugccaccaaagccaccacgaccacugaaguucccuccucgacaaaaauugucauugccaccaaaacugccuccacgaccaccaccaaaguuuccagaaccacugcgaccucucuggcuggaugaagcacuagccaucucuugcuuugacagagccuuucuuacuucacaguuguggccauucacaguaugguauuucugaauaacaaucuuauccacagagucauggucaucaaagguaacaaaagcaaagccccucuuuuucccacugccucugucagucauaauuucuaucacuucaaucuucccauacugcucaaaauaaucucguaggugauguucuucagugucuucuuuaauaccaccaacaaagaucuuuuucacaguuaagugggcaccuggucgcugagaaucuucucuugagacaguucucuuagguuccacaacucuuccauccaccuuguguggucuugcauucauggcagcauccacuucuuccacaguggcauaugugacaaacccaaagccccuggaucucuugguguuuggaucucucauuaccacacaguugguuaguguuccccauugcucaaaauggcuccucagacucucgucgguuguuucgaagcucagcccuccgaugaagagcuuccgcagcuguucuggcuccuugagagacuuggacuacuuagacaugacgguagaguuacaagagccuucagcgaugcuuccucggcagcgucaaagagcagaaagu

SEQ ID NO: 9770 - RNA, 1551 nt, Mus musculus
cuugagcuacugauuaacaaacuuuauuaccugccuguaagauuccccaagguuacagagcuagggaugacuggcccugaaugaagcauacauacauugcaguaauaacugaaccaauauaagagaugcauuugggauuauuaaggcuaagcaacuaguaaugauuauccaagccagauguccaaagcacuaauacucagaccauugggauggcaauuagggggacaggaaaacaagaacaccauaccccugggaccauagaucuuccuuucccauugaaccuucccuccccuucaguccauucuaugccacaauagugucucccuaauagcccgcugaaggaaaagaugucugaggucucuucgugcucuuugucucuguccccaaggcaacagaaagcuugagcugcugcagcgggccuggcagugauggcuaaccccauuagcugugcagacugagcaguccuuggcagccccuggagcagcugccaguuaaacggccccagaguucugcuagacuucguugcuucgauucaaugccaaguguuggacgugcuggauucuguucccagaaggcuagagcaugguguuggggcuggcugaagacaagaaagcagaggcaguuuaauucgguuggauaugcgggguaggggugccugccggcauggaagggaggggagagagaagguggucgggugugaguaaggcgcugcuucuucuuccagggccuugccuugaaggguucugaccucucaucaucuucugggccucggguaaagcgagcucuggaacggcaguaaaagcgcgggagccaggcccagggauaagcaaaaugaggaggacagcggaucuagacccucucagcgcccugagccagcgcaggcagcgccccugcugcgagcugguggccgcccucagccagcaagcccuggccauucuccgggucggcagaugcgauggcagcggggacccauuccugcucagcaacacaggccagggguggcucauccuuggccucgacgagcuugcgggagcggguguaggccaggaugaggccuccggcuaggcaggcauagaagaucaugaugaguaggauguagagauaagcgucguuacccuuggcgcuggucgccucgcggcccacgaaagggucagggacgacccccaugcccaugcucgggccgguuccgaugcccaggccgcuggcguugccacgauggugcagcuccagcagcaagcgguucaagaggguuugcagccguuggcucucgcugcaguucauagcuguuggagaguggcacggaggcuccaggacgcaguugaccuuucccccuggacaaggggaagcaagcgagcaaggggagcaagcagagcaggcagggugcagagacuucgacagcgagguggcacccagcuccccggcaggcgcucagugacuggggccucaggccgggccuuccuuauccccucaccccugcuccuccuccccuuccccaccacgcccccuccagcccgccgccgccucuuuccaggcucagacugucuggccacu

SEQ ID NO: 9771 - RNA, 273 nt, Mus musculus
caugccuuggaaaauugaggaaaucaaggauuuucugcucacaucccgguggaaggaugccaagucugucaagaucaagaagaacaaggauaaugugaaguucaggguucgcugcagcagguaccuuuccacccugguuaucacagacaaggaaaaggcagagaagcuaaagcagucccuacccccugguuuggcagugaaggagcuaaaaugaaccagaccucugcgugugacuauuaaaaacccugaaaaguccaaaaaaaaaaaaaaaag

SEQ ID NO: 9772 - RNA, 918 nt, Mus musculus
ccgaggcugcuuugacuuggcacagaaacguaucuuugggcucauggagaaggacucuuacccucgcuuccuccgcucugaccucuaccuggaccucauuaaccagaagaagaugagucccccgcucuagggaccaccaguauccagcucagcguucgcaccaagcggagcgggcucccugcccacccgccucccuucccugugacggagggggcaaguaagcccccagaggcugugucuccagaccagcagauggacauuugaaauggaggccuggacugagagagacccaggccacuacaggaaguaggaggaccagccgcaucagguccuuaacgcccugguacgaggggaccaagggcccuagcaggucagggcccuggaggagucagaucaggagcuguggcucccugcuuuggcgauauggagacuucccgcugaccaaguuccuuugagaacuggcugagguggggacaggagacccagaucugggcucuggguccaucagggggcugggggggugcuguugggccucacagcucagaccuugccccauugaguuuuauuuauuuaaauaguaguuggaugcuuggcacaugaacugaaauaggagagcccucacccugucaguuuucuuaacuuacaagugcaauaucuuacccaaggccuuguaaaggccaccuguagggguggucaccauccuauaguuucagggcauuuuuccggucccaggaaccagugguggcaguugggccuucuagacugacaaggccuuggggggaugcugcagaaaucuggcacucccccuucccugggugcccaagagaucugggaaagcauagcgcccucuggccacacagaaaugagugcugaggcaaauaaaaggccugugauauucucaaaaaaaaaaaaaaagac

SEQ ID NO: 9773 - RNA, 163150 nt, Mus musculus
uguucuuuccaaggugggguuaggaagcagcugcgcucucucugucucucgcucucugugucucucugucucugucucugucucucucugcgggugggggacggggguggggagggaaagaggucaggagaaucuucuuuuccuccaccaagucuaucacugaagguucgcuguggucggaagggggcggagaggaagaaggacggcaggagggaaggagggagagagccagcaagguuuguguaggguggggggaggggggagagagagaaaagcaucagagcuggguuagaaggaguccgaggagaaauccucaaauuuaggcacucaagaagaaagugaggcugugacaagaaggugagcaauacuuuuauggucuuuuuuuuuuuuuuuuuuugaaucucccauuucaaggccgaagggaggaagcaggaaguccauacucagcacacuccccaagcuaaagccuguccaucaguuucacagccuuacuccuagaaguuagcgaggaccggcugagugcccaguauguggucagguaugcaaaguaguggcccgagaaccaggucaacggaggaguuaguccgccaggcuuagguggggaggugaauucagucacaguggcgaaagagcaaaacugugcgcgagugcacgcuuggagugcagaagaccaggcuggagaaggaggaggaaagaggcggggauggggccuccgaggguagcagggugggggcgggggugggguggggugggguggggagcagagaggaagcagggcaggaggugggaagcgaggacgaaguggguaggcuguggagggaaggcugcgaggcggggcagugguggcuugaagacguguguauguguguguguguguguguguauguguguguguagggagggagugaaguggaucggaggaguguguguguguguguguguguguagggagggggugaaguggacgggaggagggccgaagguggagggaguuggcgacgaggggguggagagagggaggggaaaccggaggaagcgagcggcggcugccgggggaggaaggcaaggaggaggagccggagcggcggcgguggcggcugcugcugcugcugcggccgccuggggagcccagccgagugccgccuggggcugcggggagugaggggagacggagaguucgguggagcccgggcagcggagccgagcagcgggugaguggagccccagggggacucggcggccaguccucggggggccggacgaggaggagcgggaagauggagcgguggcggcggggcggaggguggcggccccauggcccggccccuggcuggccccgcguccccgcccucccucucggcuuccucccgccgcccgccugcgccuggggggcugguccggagcaggcggagggcugaggguggcgcuggcccggagggcgggcgugaggggccaggggggguggagcuggggguucggggguguacccaggggcgggaggcuggaccgggacugcucuaaauuggcuggagagggggccccgucggcggcgaaguugcuagcugggggcagagacggccacgcgguugcaggaguaagacccccccccccucucguggaguggcugagacgaggaguccggcgucccugcccuccccgucgcccuccccgccugcccagcccugcuagcuucucuccuagccuccgcguguccccucucucucucacccccuucugccucccgcuuggcucccucggcagugccuagugccgggcccccuaggucccaguccugacccucuuggccuccaacuugccuucacccgugcuugcuuggccaccacucccguuccccuuuucuucccucacuaguuaccccuccccgcuucguuaauucccgugcaauugccucuuugagaccuuuuuuuccucuccuuccuuuuagauuggccaacggcuccuuucaacccugccucguugguggccacuggagaagcgcggggggcuccccagacagccguggggacaaguuagagccagcacuuuaucccgggccucgcguguagcuuucccuccccuguucuaggugccccaguguccagaggggggugcgggugugcccuccuuacauguuccaccgcccgggcaacccuucggucucguguuccaucucgcucuugcuuccuguaccguagucaaguggagccacuuugcaucaugucccgguauagcuaccaaagucuccuggacuggcucuaugggggcgucgaccccaguuuugcaggcaaugggggccccgacugugcugccuuccugucuuggcagcagcggcugcuggaaaguguggugguccugacccuggcccuguuggagauccugguggcccugcggcacauccugaggcagaaggaggacgguagggguggccguagcagccagccacagcaggugacccagcggccagaggaaggcaaggagagccugagcaagaaucugcucuuaguagcccugugccugaucuucgggguggaggugggcuuuaaguucgccaccaagaccgucaucuaccugcucaacccuugucaccuggucaccaugaugcaugugagucuguugacuuuuuccugggcagccuaagugauaagagucauuagcgugcucaggacacugguguguagagcacuucguucccgugggaagugggacccuuacaaaugcuuuuccaaccagcauccgcuuuugugcuaguaaacuucagcauugcacaacaggucagccccacaguggaggugaacccuagaaaugacuugcacuuggagccccaugccccucccaucucagcucugcuggggccuggccuuuucaccagcaggaaguccagccccagcuaggugaccauucaggaucacaucuguggcgcauggccagcacuccugccuuuuguaguaguuucccaaggggccuggugacaggcuuuccuggaggugguggucacacaagcuucuuugucuccacugugguacauuggggggaauaguuuuagggguuucucuuaaugacucuuucauuucagggugucugcucucggggugaggucagcuuuuagguuguaagauacuugagcaaccuaauuuccucacaggcuggagaucgcgaucccgugugagagggguuuuccuuuuuucaaacuucuccaucuuaccacuugaagucuccguccuaugcuccaaggguguucaagaaagcugacuucuuuugcuucccugaccucuuacccauuaagcuaugcuaagacaagcaaaugggauugauaggggaaguugccagcuggguaccaguaaucuguucuuuccuaggccugcucagggaaguucugaggcucuaacuuccugcagcuugaggagaaaaggaagaaagggaaggcaaucaggacuuuuagauuccaggcuguggaaaacuuugcuuguuugacucugacucggaguaguuuugaagccugucauuagcaucuuuauugcuuuuauauuuguugaagguuaugcucaggugaauugugacaaccuugcauagggccagagagguugagauuauuauccucacguuacagguucuaggauagaagucacuugccucaagggaaaaaaaaaagguuuagcaucagggacugacugaccucaaacccacucuccuuuggaguugcaaaucuccaguccuaaaccaggaguggcugagggugaugaggccuuccuguaagauuuggcuguguauuuguagcucagauaucugcuaguucccccuuccuaaauauccauuuguuuacccauucuuggccucaguggagaaugaccuugguccuuuggcaucuuguagagguguagauaacucuggaauaaaagggaugguauugauugggucacuaaaagcauggaaaagagauggggugggcagcauuuuuuugaaaaaaaaauuuuuuuugagagagcgagagcuucuugggaagggggugccauucacagcaaaggccagggcugucuugcgcaaauuugacccguccucuuucuuucuuuuaaaugaauggccuuuuuguuaaugaggggcgacaaaacaucugagcuucuguugugugugccucuucaggcaggagugcagguggugggucagaggguaccucuacaaagaggucuggaggccucuggcaaccacagaucuagaaggucaacaaaggguuaaauucagccucaguggggcugcugcuggggugaugaccucaaaccuggaugcgccaugucuuuuacaggaagauuuuagaggcucuuaaaagacucaggaggccuggaguuaauuaguuguauggcuugggggaaaguacccuuucugagccucaguuucucuacccguaagaugagacaagaguuggacaccuagcccuugacagucuguucugugauucuuugcuucagaaccguuggguauaauaacagagacacuuugaaaggcuuuugaccuccuuaugccaaaaaaaaaaaaaaaaaaaaaaaaaggaaacugguccccgaggaacucagguagcuacccaguucacucuuagcuuuugccccauauggcucucaguaaaguaaaauucuccaggugacccuugguggcacauguuggggggaacgacuagcagcugaauuuuugccaccccccacccccaggguuuuucccuccucuuagcuuauacccuaaagcuacagagugaaggcagagacuggagucaugcugauacauucuugcaguguccuggggauuguauuccuuuguccucuauccccaaccacugcuuuguaacccacucagguccuaggcuuugaugcacccaacuuucaaugcguucuauguggcucuuccuuagaagcaggacuauggauuuuuuuuucaaguugaugaaagucaguuaaaaaaagaaacauuaacagcagcuguuugcagccaguguucugccuuagaugcaaaaaugacuaaugauaguuuggaagacuacuaacaccuuaccauacuacuaaugucuaccauuuuacugcucgaaaagcacuuuccuaugcaugaucguauucaagguugugauagaucagcuaaggccuggagaaugagauguuaaaauguuuccugugagugccucuauugcaaaggggagauauucugaaucaggaaaugcuuuuugcaaaugaauuagcugaaauuaggcuauaacauaguaacagauuguagagaugugaguugaagugaaaagaaguuucaccgugaucaugcucgauguuugauacuaucuguggccuccaguuugguuuuguagaaagaucuuuucuaggagagucucuuuaaguauguaacaagggcuauguuacuuuaggccaggaaguaggggaguuggagggaaauugauuccuuucuccagcucucauuuuucagucugcaaaauauucauuugcaacgccuuguuacaccgacccucgucacagccaugcuacauugggcggcugccaacuguaguaacauaaggaaggccauaacuugugucuggauucucuucuugauuaacauuccugcuguugcguuucuuuuuggucucaugugauuucuucgaggucugaggaugggagacuguuaguggcuuauaggauuuguagugguaccagcucacagcucugcucuggcuggagauacaagugcccagguuagcucagcauuauuaaacucugugcuaaauaucugcucugccugccaacuacaccaauaagguuucuucaagcaugaccacucaauccccuuuugcccaugauuuuuggcagguaugaauuauggcgaggggccgggagaggauggacuuacugagcuauuggacuguuuaccagaaaucucccagcaacuuaguggcacagguggcuuuaacucucagcugccaccgugagaaucugggauuagucagaagagauucuuguagcuguuuaaaucuggggggaauaaaaaacaaacuacaguuucucagcagaagaguuaaaauaaaugccagacaaucuagacaugauggcaaaugucugaaaucucagcaccaggagguuuagguaggaggacagcaaguucaaguccagucuggccuacauaaugggacugugucaaauugaaacaaaacugucuggcucauuguguuguaaggaauagggaucuacuacuaacuuuaacuuagugauucuuuucuuuucuuuucuuucuuucuuucuuucuuucuuucuuucuuucuuucuuucucuuucuuuuguucugaacacaacuuacuuuauuuuccuugaauccaauuaugugguguuuauuuuaagaacuuaaugaaaagaucuccuuuuccaugcuuuguuuaauugcuaaauucuugugggcucugcguaugucuguguuaacaucugauuaggcacugaacuuagccagguacaacauacgcaguuuaaucuucaaugccuguacacaugaaacaggccgggcauuuaaccaauuauaauuugugauaauugaccuguagcuucuagccaguacuuaaaaaaaucaguuaguaaugcugagcuuuuucuuguuuuguagauuuauuuuaauaaguguguguguuugugugugugugucuauguggcuauacacacauaccacagugcauguauggaggucagaacacaacuuccagauguucguuauccuaaacauccacucuagguccuggaaauagagcucagauuguccagcuugcacagcgagcacuuuuauucucugagccaccucuguagucuagcugucucuuuuuagaauuguguuuguuauuacaugcucugucuuuuaaaaacauaauauaguagaggguugauuuccaccagauaggacuuuccugccuuggauuugcuaaaugcuauuccgacccccuucuuucugucuuuuaccuuucaauuuucuuucugucuuuuccucccuuccuccccaccuccuucccuccccuccccuccccuccccucccucucuccuccuccuccuccuccuccuccuccuccucuuuuaugacacaagaacucaccauugcacucuugcugaccuggagcucacuuugaaaugaagcuggucugaaauucacaggccucugccucccgagugaugagaauaaaagugugcacccccagccccuccccuucuaaaaguaugcagugauuuuuagucaccgauucugagcuuugggcugggcuggagcccagucagaagaguacuuauuuugcaugcauggcacccuagguucacucuggucccuagcacuugauaaagcaggcauggucgcacaugccuguaaucacaguccugaggaggugcacccagcaagggucagaaggucaagguuauccuuggcugcguagcaagacugaggccauucugggauauauaaaacccaucucaaaaaugaaaacagaacaaaggccagcugcccuuuuggugguagcgucugugacuugaauccucacugguacauucuauagacugauggauuugugugggagaagagaaacccugacacagaguugagauugaggacacccccccccccccccccccgcuugacuucccaggagacacagcuccuaauucccagucuguugucuggagcacugguuacccuuccuauaugggauugauguuuguggguaauggguacagugagggauccagcaaucugcugauagcuuaucagaugcucuguguccuuugucgucagaccaguaugaguacgaguacggcacacggcaccagggaauuaauguuuauaugggucucggcauugaggcaugacuuuguuuuaguuuauuuuauucuucucuccagagaagauugcagagaauuuccccaucuuucauugucggcagucuuuaggagacuacauuuaugauuaaacagaggugcuguggauuggugaauuaagcaucuccaucuaacacuggaguugaauaguauugaugcggauggcuuucugugggaaccugaacaaauuauuuaaccuuuuucuuucuagcucuuuaccauaaaaaugaauacagggaaagcaaagcuuuuuuaaucugcuaaauaccugugcaaucacuuaaccagagaagcugggcaaagcucaucaaaauggcuagugaccaauaugguuuuacuuuggacucgacuccuuuuuacuguucccaauggcuaccaagagccguuuuucuaauaaucccuguugcuuuucucuggauccuugcccggguuuccaugcccuuauaaugcacagccugcaaaacugggcacuguaacucuuugaagagguccagcccauacuaagcagagaggaaugcguuucccucugagccuuuucaugccaugcaccugugaauacaacccaaggccguccugcuugcuuucaaauaagcaggauguuucuggcuccugcucaguucccgauuguaggcuuacuggauuuuguuaacuuaccucgcacgcacgcacacacacacacacacacacacacacacacacacacacacacacacacacacacacacacacacgcgcgcguauacacacauguauacacacacguacacgcacacagagaaccuucucagucuucacgggguuugcuuuggaucgucucucucucuuaaguucuccucugaggauucucuccuuugaaaccuuucuagaugauccugaccugacuccaguuauucuugucauucuauuaaaauccuuuguccuccuuucucaacccucucucucagcauuucgcagaauauugggaaagggguugggguauagcuuagaggcagggugugcgcuuaguaugcauuuuguuuggugaggguucuguuuuggcaugcuuccucaguuuccagcguuguaggagcagauuuuuuuuuaaauuaaaaaaaagcauguaauagcuuaucuccaugcagaccugaguauaccgauguugugguccuggguaauggaggcagacuaagugacugacagacuugauguuuugguuuccuuucuuucuacccugguggccaguguucuuuugagaucucacagacaugguucaugucuguuuugccccaaaagugagucuucugauaggucuuucaaauggucagaggauagaggcaggcuugguuuuauagcacacacaucuuguaaaauuuccaccacaaagagcugguuauuaaagccauggcccgcucugcauccaauguguaacuuuucuccugaggaggaaaucauccuguuggaccuuugucuuuguccguuuguagacauuugggcauggcaauguuggugucuuauuuuaauauauaaauaaaaagaguggucuuaggccagugacucacuuuucuuuucucucucucuuguauucuucagugauagcucauugucuuugugucuacuugaaauauucuuagcgagagccaaguuuuucaucuuguccuugucuuuuauaucuuuauuacuaucauuuauucugaagugcuggggcacggacuacauacuuuguguguacuaggaaagugucauaccaaugaguuauaccaaagccccauuuuuccuuuuucuuuccuuuuugcuaugcauauguuuuguuacauugaggguacgccagucucaaaggucccuaucuggccaggcuggacagacaugaagagagguacgagaauggagaguagugauugucuuguuauaauguagaugccugacucccuuuauaggcaccgaagcagguccaagguaaggauggcaguaugauguuuugauuuucuuucuuucuuucauaaccuguaaucccagcacuccagaggugaacugucucucacgaaaacaaaacuacccccaaaguaaacaaaacucuccuaguccuggaucccauuuuugggagcugcuugguggcugaaauaguaaaugggaagaugguucaagcacuucuccugauuguugugaaacugggcagccugugggcaaggcagcuaggcuucuggcagugguguauauggguuaccaguauggacuauguagguaguucuuguaguuauguacuuuauguaguucguauggcuuaagugacagaauaaggucaucagauuuuuguaaggugaugucauuagaguauuucaaguaggauuuuaucaucuucuaguucuucaucauucuucuccuuugaaccaguaaguucagccuggcagugguggcgcaugccuuuaaucccagcacuugggaggcagaggcaggcggauuucugaauuugaggcuagccuggucuacagagugaauuccaggacagccaggguuacacagagaaacccugucucgaacccccccucccccccaaaaaaagaaaaaaaacaguaaguucuuccaacuuccaggacgccauuuugacaccugguuauuguauccuaacuguaugugagacucuuauuuuaagugauuguaagaauuuauuccuucuuaauuuuuuuugagauuuuaauuuuauguguauggauacuuugccugcauguaugucucugcuucugguaugucucggcaccaccugugugccccgugccugcuggaagccagaagagggcgugggauccccggggacuugcaguuucagaugguaggaccuacuaccauguaggugcuuggaacugaaucugcauccuuugggaagagcaacuucugagccauaucaccaucccaaaauuuauuaauuucuguauuuauuuaauaaacauuugcaaaugccuauuguaugccaaccauugaagucaggcacuggagauucaacaauaaaugauaagcaggguucggucuuauaugguucauaguuuagaugagaaagauaagacaguagaucaacucauuuacaguguuuauguguagagucguacauaaaugagacauagaaggggaaagugguuuugagaaugcauuuaaggaaauauuucccuuugaggugacauuugauuugagcuggcucccguaggaggcauguuagcuuuaugagagcaggagccuuugucuuguucucuguuuacugaggcccaacaaaaagggaaaggaagugaauucuagcuauaagauacaauguaugggccagucaugggaucauaggcccuuuaaucccagcacugaggagccagaggcagguaguuaugccuuaaguuuuaggcuagccguucuacauaauagguuccaggcuagccagggcuauauagagagagauccugccuuuaaaaagagagaagaaagaaaagaaggaaggaaggaaggaagaaggaaggaaggaaggaagaaggaaggaaggaaggaagaaggaaggaaggaaggaaggaaggaaggaaggaaggaaggaagaagauaauggaugaaugaaugugcaaaacgcugagggugccuagcauguucaaggcccuaaauuugacccugaccacugccaaaaagauuguagacauacgcugcugcccccuccaagugaaacuuugagaguguuuuaucauuucuuggccauugauuauagucacagauguucaugcacagauguucauugaagguuguguucccugccaucaaggacagcuacccagaagaucauugagguaaguuagcagagauuaguggagauaacaugcgccccacgugcaaccuugaugugauuauuuagcgcuucaugagauggcugcccucuugaaugagcuagcuucccaucgggauucaccauguaagccuuucuccucccucccucgcuccuuccuucccucccuccuucccuuuuuucaagacuucuugcuuuccuaccguuuucauagucuucucuauuucucugucuuuuuaucugacaacuccauuuaaguuggccuccuugaggaguaucucaggcucuaucgcaaggccuucuacaaugucaaaugcccauuucaggacuggaaaggugggucagcagguaaaagcacuuauccccgggacucugaugauggaagaagagaaccaaccccugcaaauggucuucugaccgcaccaaauaacuagauauaauauaaacaacucuccauuucacuacacaaugugaccugccagggggagcuggggagaacgacccuccgauuaaaaggggccacugaagugggacuggcauguggauagacuccacuggcuaucugggaaagaaugaguuuuuuuuuuuuuuuuaaauuguguuuuucucaaguuuuucugguuuuaauauauuaccuaucaaccuuuucuguaacuuugaauuuuugcauauuuuguuuuuguuaugugugugucuguguguggguaggugcggggaucagagggcagcuucgggaguugguucucucuuccugcuaagugggugcuggagguggaauucugguggcuggguuugucucacaugcugaacugucugucucccuagccagucgggaugguggcauacaccuuuaguuccagcccuggggagccagagggaggcggauuagugugguuugggggcuggccuggucugcauagugagcugcagguuaaucagggcucucuggugagauacuucucaaaaccagaaaagaaaaaauucauuuuuaaaaaugaagaaaguuguugcauuauuuaucuuugagagucuccuuuuguguuggacugaaaguugagucucuuugucuuuagacaaaggacugagaccauauuaaaauaaaauacucuugaguauaaagaaggaagacagccuuuuaugcauagcugcuuaaaaggagugggaccagaaaccccuuugacuccguguguuuauuuaagacauucugcuugaagaucugaggcucugggcucuugauucuucuuguuuuccgcuauuagugaaaacagaacugguaacuacacacaaaaaugaauauaauuauuauuccucuugcuaguuacugcugucauuuuuugauuauuucuuugugugaauuuguuuaaaagaaaaaaaacaccuuuuaaaauaacuauuuagguuuaaaaaucaauaaaccucaccacggggugcuggcacaugccuuuaauacccacacucaggaggcagaaggagguggaucucuugagucaaggccaggaggccaggcuggucgacaaagugagcuccagcacagccagggacaaugcagaaacccugcuuugaaaaacaaccaaaccaaaccaaaaaaaaaaaaaagaaagaaagacagacagacagacagacagacaucuaggccugggaggcacacacuuuuaauuccagcacucaggaggcagaggcaggugaaucuuugaauuugaggcuagccuugucuacauaaugaguuucaguauagccagagcuaucucuauaagagaccaaccaaccaucccuugcaaagaauguuuuuaaagaaaaacaacgacaaaaguuacuuacuaccuucccccuggccuaguguuuuugagcagcuggccuuuucuguguuuuuuguccagggauuguguuuugguagcuagcaagaauugcagcuaucaauaucuuuuccugcugguggaguauacuguucuguacugcuugcuuccaaaggauguggacaacaggaggcuagaggugcuagaagugugcguggucggcaggaagugugcagacccuggcccacgguaggugcucagguguguaggagaaggaaccugccaucaucaggaaggugaagguagccugagccuaucaucauuccaucccagcacuuuccagcccccacucccaucacaagccagcauugcugucaccuugggguauauuuugccugugaguggaauggccucugccaguucaccagcuguguuugcagaaaagagucuagcugacuagggucuggcuguugcuagcagagacauuucauucaggugcugauuaaauaaggcauggagccagauugcacauuaaggcccuuaacuguggcucugggagaucugaaguacacauuuauuagauggucugggcauagcauuagcagaggaccacggggaggugguaucuucagacaucgggaugaaggaaaugggagcuaggagacacgucuagaaguagauggguccucuuuuccuagaguuaaccaguccugacuguacacgggaggacuagagagguuucuucacuggcauucacuugcugagacccagcaggauuccugacuaaguagggcaauggaaauaucuccuuguccucauguaaauugggccuaguagagagagcuuuugaauucuauuuccugguuuuggguuugcguuccauuacuacgugaccuuaggcguacuauugaacuacucuaucaguuuugcucaucugcuaaggaagaguacuaacagcauuuaccaaacaggguuguugugaaaguuaaauuaagucauuucaaucaagcauugagcagaaguccuggcucgcugcgagcaugccaccagaagguaguuuuuuuuuuuuuuuuuuacuggcagaaauuguaguacuauguauuucaaggcagauaugggcugaggugcuauggucuugaauucaaauccuuuuagcuauguaacccugggcagcuuaguuuguguuuccacguuugugaaaugaaacgacccuguaucaauauagcaggguuguggaaagauugagaaaccauugguaagucacugacuguauaggaagugacacguucauaguguucauucagugugguuuagcugugauagugaugaggagggugacaacagccagugacugccaccacugucaccccaacuaccaugaaggcaacugaaaugagagaugccuuccugauuaucauugugacugcugcugucucaggcuuggcugccugaugggagggauuugaugcuggauuuagaauuuuaacuaacaaagcuuccccagaaucuuugugucgggcaugcagugggcagaaacccuggcuugcaggaagcuagcuccuggcgauaaugguugugggcauucugaaaguuuccguagguuaacuagucuuuuggaagaaugggggucaggagguggcucugaugguuuuccagagaccucuuggcuuacuuauucuuucuuucugucagugggcugacuccauggugcaagcuaucuugagauugguagucuaggaaaccagggaggagaugagcaggcgagagugguuuucggugggugggguagauaaagacaggugaauggauuucacuuugacuuuuuucuuaauaucuuuugauugaggggcaggugcuuguucacagagaaugaaccacucacagggcuuagagaaaggcaaguuuauuucuuccuuuuuauuuuguuaccaagcuuggggauagaacccgaggcuuugugcguacuggguaaguuuuuaccacugaucuacauccauacccaggcccagaaaagcaggguuaaagcagaccaguaucuuagcuaaugggggaagcacaguguagcagaaggcuugcugcucaggagaucagacuccugaugcuuuugcuaacauaccagcagauagcacaaaaggauccucagcagcagcagcagcagcagcagcaccagcagcagcagcagcagcaaaucacagugccuucuacaaugcuaguauuugguaaaccccucuuuucaagaaccgcuguuuuaaaaucgacugugcucugcagucuaagccaccagucccaagaggaagagccaauuuaaaugcaguuucuaagccuuauaccccuucguucugugacuugucagccaugggauagggagaugccucacccuuaccuugaagauccuucggucuauucacaggcguugaugggugauaggcacuucuuuaggugaggacuggggagcacagggugcuacuugugauaguccuagcucccugggacagcuguuuggagcacauguguacaagaaacagcaacccaagggaaggacagacauuagaacuuaacuuuuccagccaaucggugcuagugcacaccuuuaauccuaucacccagaagguggaagcaggcagaucucaugaguucaaggccagucuguuucacagacugaguuccaggacacccagggcuacacagagaaacucauggggggggggaggggaggcggggggggggcaaaacaaaaugagaaaagaaaaggaaaggaaagagccgggcagugguggcacacaccuuugaucccagcacuuuggaggcagaggcaggcagauuucugaguucgaggccagccugucuauaguguuuacagagugaguuccaggacagccgggacuacauagagaaacccuguauugaaaaacaaacaaaaaaacccgaaaaaaacccaaccaaccaaauaaauaaauaaaaggagcuuucuccaaagucacaguucuaagaguuaggaaaaauugcaauaaaggguacuguucacacugggacuugcugcggauccacuugcauuuguuaagagauuuuuuuauggaagcuucagucucuugggugugugcaugcgugccuguugcugcacuuuuauucuuucuucuguucacugcagcguauucuccgcagccaguaggaauguugcugagggucaugugcacaaguggcucguuaucuugaacgcuaggaccccagggcugugagcggcugcucuccacucccuuccccauccccccagauauuucuccuucccagcaggaagcagugugggcacccagacgaaagggaugaauuuuaccugugggucuucuguguaacuucuccguccgguucucugaagcuagcagcagccgaggucuuguccuuguuggcuugugagauuugauuuauuuuuucugaccaguaagugaagaaaaagagauagauugaucuagccccauggccauccugucuggaacggcuuuugcccaaggcugaguuggaucugugaggaguaugagggcuguugugucccugggucuccugacaaguccauuccuguuuggucauguuugcucagauggacacacguggaaagcaggcuuggaucagcuucccaaaugucuuacucccugcuuugggucuguccugaaaaacaauuugcagaguacauugugacccacaccuguuguuguuauuauuauuuucaaaauucuccuuuuccagucccuucacuauaaccuggauuaaguuccugaauccugcugugacugcaacugacccccuuuugccggcucuuuaguuucauugcuaauagaacuuaaaaauagagucagagggaaacaacaguguccuaagagauuuuugagcuagauguaaguuugcaaguagcuacagggaggaguaggagggggaacaucagagaaagaaugaagaagcuuagugucagggcaagcauaagcggaacuuccgcuuaggacugcuauccaaagcaguaauaaaaagugugcaggggguaguuauacuuugugaguuagaaaagcagaaaagcaggcagacuucccagcaagugcauugaagaagaggcuucugggagguguaaggacauugucucauuaagaggauaauuaguccucccaucuccuuagcauguuuucaguuuuccugaagguggucacguggcucacuggcaggcacaaguagguuaaugauuaaggguagggaggaggcaauagcauguuuuaugagguuauaaccuuuguuauaacucuagcucaguuuagaacauuguuuccacccugagccagagguuagagcucagaucccauucucaaagcucauacuuuuaagauuuaucaagaggaggcagcuuuccuuuaaugggccucaacaaagcucugccgucucugccuuccuuuuguacagcuuaguaaauuuuaaggcaguuuaauugugauguuucccuuucuuacgauugguguguuaccagaggaacaaggguggaguccaaagcugagccggagugggaggguucauccucaaugaccucccagucugaugauugucugacuggcucucuagcacuuccacuuucuucuugucuucccuugucaacggguuucuucuuuucuugugugaacuuuaagcguagcugacgcccauuugugggauuacaaguaugugcggcaguauaauuggcaagaaacucuucuuggcuuuugagucuucugcagaccuuugagcuacuguaaaccaggaacaggucugaugggcaaagauuucagaggaggagcgcacugugauguuuaucuucuacacuccuggaaacguugacuguaauaauaacacgugugacuuuguauuuuagacaagguguuggucuuuuucuuuaguccagguggucccugcagccaggagccuucugccucuguuucugaguuccaggauuacaggugugcaugaccacgccccacaacaaucuugaacaauuuugagcacacauuaaauaugcggcuggcuuggugcuaagccuacugcucauguauuacuucauuugcagccuuccacaaagucacuuuggauuuaucuaauuguuucauuugcuucucauucauuuccccuuuuguugacuuguaaacguaggcuauuccugcaacacuuucuccccuuguugaagcagcugagugaugggaaaaagagcgaagagaaaccuccgaguguagcucagagguguugauccuccucauuuucuagaugagcaaaugacucagagaagugaaauggcugcccaaaguuggggcagcagaguagaucagcuagcucaggucaaaauuagcauuuaaagaacuccaguaggcugugggaaggauuagaaaccucuucaccgagaucagcauguuaacagccugugcaaagaacugagauguacaaacuugcucccugugacugccccugucaguacagcaggaaugcuguuggccuuucucccagcuccucuuccuucuucucuuggaagugcaucuucucuugauuaagucuuuuucacauccaccuaucucuguccagucucguguucuuggacacaggaaccuaggacucucagcagaugcccaguggauacccaugucuaccuguagcaaaguuacacagcuaaauggaagcagggcuggauuggcucuggauuuccaacuuagcgucuuaacugcaaugccaccuaaggccuccuuacaucuccaacuuuuguggcauaaaauggaauuagacaggaaucgugucuguggccugcaggauuaaauggugggcauuuuacaugcuagcccuuuaccccuaggcuacaucucuagaccuugugaguuuugaacauagucauccauugcaguuuucaaaaugaggguccuuuguaucugguauagugacuccuuugcuguucugccccuaacccuaacacaccuuuuuuccccccuucauuuuuccuuuagagagccaguucuugaugccagcauuguuugcugccugucauagacaguuggugcaggaagcugugugagcaccgagccuguuuguaaagccaguauggccuggccccagaugcuguuugcuuacugucauuauccaugcagcuguggcuacaaacaguccauuccucuuugaaagagacuggcaccugagacccagagcaggacuuagaagcucuguugagcauaagcaagaguggucaaagaagaaaaaaggucaagaugaucuguuagcccaguggacuugaacgaugcacaaagaguacuggguugggggcuauguaauccuggcuccugguuuuagcuuuguuacuaacugguugacaaugcugaguagcuugggcuugacaaguagccugucugugcuucagccuucuuauagaauaagacauauggaagcuaguuauauauacaggucccagagccagacuagcuggcuuugaaucccagcguugcugcuuucuagcuuggcuaaguuuguugacauuucugggcaugguuuauuuuuguuuccuuuauucuuuuaucucgagguuucuaaaucucuuccuuuuuuuguuuguugcuggacaaauauaccugaaguacuugggucuguuuucuuaaccauguaaugguaauaauaccaguaucccuuucaugaaguucuuuucuuuuuucuuuuuugggagggggggggguguuuuuuugagauaggcuuucucuauguuccuagcugaccuggaacucagucuguugaccuggugaccagaauggccucaaacucagauucccucccaagugcuggcacuaacgauauguaccgccacugcccagcagaaucucuuaaguuuauuuuuauguguaugaauguuuuuuuuccugcaugugugucugugcaccuuacauaaccccaagaaaaccagagagggcaucuguuauaugggugcgggaauugaaccccgguccucgggcagaagagucagugcuuucaauccaugagccaucucaugagguucuuuuaagaacuaaguacaugacugucuguggaauguuuagaaugcucaugcgugcauagcaaauguucagagccccccacaccccccauuuucugaaagggaugaaugaccucaguucuuuguccaaauggcaaucgugggacucaaguuaaagaagauauuuguacagccuucugaaaaaugccaaaggaugaaucauccuuuagaaaaacguaauuuuuaguuaacaggcagaauaaucaugaauaaucauggcaaaugcaaccugggucacuagauaggcucugagggcaaggacuaagaaaggaauguucucagaagauuaucauaacagucuaugcuuuucuuuccaguucuuccagccacuugauuugagcugugugacuuuaaaggcccccugaggacauugggaaggcagaaacgggcucagcauuugccugacagccccaaccuugauauagccucggacuccucuuuuuuucucgaguccuuuucauuuuggcuucaauccaucucuuccuuuccuuuugagucuucuguccuaguucaucuaauuuuucuucaucgucaccuuuaucuucaucaucagcaucuauaucaugugucucaggugucguauuacagcagccuccugauggauauucucugcuuugaguaucuuuccuguucuaucuacugcuccugccagaaugauccauucuugaaagcccaucagccgcccccaguugccuuuugcagggauggcagacaaagaggugcauauacuuuaugguguucuuggcugacgaggcuaaucagccauaggcacguuucccagggaguaucugugcagguucaaaauguuuuuagagucauuuucuagucagccacuuaucaaaucagucagagacggcacacagacaggguuggugaauacacaaguccucuagggaauugacaccugggcuccauacauuaugacugaggaucugcugugauuuuguucccaggccuuuccauuuuguuuucuguuccgugcuuccuugugcuuucaggcugagucaugggcacuguaucccuccaugcuucuuuguuuguucaugcugcacccucaaucagacaugcucuuuucuucccguugaaaugauagucaucauucaaggccuggcccaggcgcuccccaugaagcugucuucaggcuuccaaaggcacucuuguugccuuacaucauguacuugguuaugccuucccccuccugagaguuuguguuccuucacugugaggucugguuuuuuuaaaucaauuuuucugugcucuaaauucuggugcacucugggucagcuucccuccuuucuucccucccuucuucucucccucccuuccuccgccucacgcaauccagacagguuuuuaaauuguauguagcuuaagaccggccuugagccuuugagcuuccugcuuccaucucugauuggguuuacaggcguucagggauugcagcuaugugcugcugccagccucagucuguguggugcugggacuuuguccauucucccaagcacugucagcuguggucuaucccuggcuucuuccuucuuuuuuaaauuuguuuuucagucaauugaguuuaauucagucccuuugcuuuucaggugaggagacuggcuuagagaaaaaggucaugagugcguguugggguuuguuuaaauuucagauauuugagacuuugagaccuuugaggcuggaauauucccaaggcaauugaggugugguuaggacuauaaaugucagggaggcauuugccuugggaauauaaaggaaaaagagacaaggggcagccuucaggcucaagugaaaguagaagaauauuguagggaauguuuccuuuuagggacagaaauauggcuugccaaagcagcugucauauuggaaguagaaagacagucaaggaacuggagugagugucgggaguuucaggaaaggcucuggucuucugccaagcaaugccgagccaggaggcccagaaggacucaggaaaaggcuuggccucugucgccaaccacuccacccaccucuaaauauuuacccuauacauuuuaaugugugaagacuuuauuguaugugugugugugugucugugucuguguuuguguguuuguggcucuuuauggcaguuggugaacagagagcauugggaaagaguaucagaagcugaauauuaaaucaggucagugaauauucuguggcuugaaaagucuuugaaacuguuuugaaagcuguuuacuguacauuaauuacuaaaacaaaaagaaacaauugcagaacaauauguauaauuaaaaagcccuuuauaagugcauuuucuuucccuuccuuccuuccuuccuuccuuccuuccuuccuuccuuccucccucccucccucccucccucccucccucccucccccuuuuucuuuuuuuaaaugaguacacuguaaaaugucuggaagaacauauaccaaaggaugcauauuccugaaugguuggaggaagggagauagucuaaccucuuauuuacuaucauccuauauugugugaauuugcuguaagcacagauuuuuuuaucaguaauuaggaaaaauauuaaggcuuauggauguagaacacuuggcucuagcauguguuagguccugggcuccaucuuuagcaaaacaaaauaaccagaacaacagugguaccugcaaaauauuuaaaggaucaaaggagucugggguggagcucaguggugaccgcauguuugcaugcaugaaacuauuuuagguucuaucacuaaggucuacauugauaaaucacuaggaauuaacaaaggaggaggugguugguagagagugguuaucuugaaagauucaauggaugaaagaggccaacuccugagaaaagaguuggcaacugagaaaacaugaguggaagucugggcccugggcaccugggcacccggcugccuguguggugcaaggggugguguggagaagaugcucauuguugggaaggucagccaagaggacaagagcagugagaugcccuagaagcaagcagggacuaagacaguuuaaaaaguaagugugugugugugugugugagagagagagagagagagagagagagagacagagagacagacaacacacacauacccaugaacacagagagacagacaagacacacacacacaaacacagagagacagagagacagagacugacacacgccuuugaaacuggguagagaaguugagaauacuugccugucaaggacaaaucccaucucaagcacugccaggaaagaaacggaaaauccccuuguugagguuuucaggcacuagcccugcaguccuacuaugugcuaagggacugagcuggaaugcucguggcucuuuccaguccucagagccaccugcuggaccugacaccaauuuuggagaagguggaaaacaguauugucaacucugguugcaccucucagucaagugaggcugaaauaaguaagcaaacaaaucugugucuauuccuuuacuccauucucuccucuccucuccucuccucuccucuccucuccucuccucuccucuccucuccucuccucuccucuccucuccucuccucuccucuccucuccucuccucuccccuccccuccccuccccuccccuccccuccccuccccuccccuccccuccccuccccuccccuccccucucgucuuuuccuuuaauucuuuucuuccuuuccucccucuggcuuguucucccucucucucucucucuccuucccuucuccuuccuuccuuccuuccuuccuuccuuuuuuuucuuccuuccucccuucccuccuuuccccccucucuccuuuccucccucucuuccuuccuucuuuccuaagacauggucucuagguagcccuggccauccugaaacucauucuguaaccaguuuggcuucaaacucagaucugccuuucugugccccucaagugcuggaauuaaaauuguuugccaccaugucuggcuuucuacccuguuuuuaaauauguuugggcugaggccgaguuacagcuccucacacgacuccagucaguagacaggauuaggaauccuucacuaguguagaacuggguuaaacacucagagccuaaacugagacaugugugucuguguguugaauaauaucucaacacagguguuuccuucucugcauuugcaaggucuuugggcuccaguguuaguaucaacuguuugccucauugcaugccagugagugcugcaucugucuagagugaggucaggccuaugaugucaaauucaggaguucuuccauaauagucacugccucuguggggccucgcacugagcuaccuuaacugauucacccugaaucauacaacuuguaggaugggcgggguaccagcacugcagcccagaucugcuuuguacuguguaaaggagaagaauuugugcuaccuagcuauucaaucacugucacauaauaugacaaggaacuuuguuuucuugugcaaggcuucuuuguauuaaaagcccaggggugguaaaagcugccauauuuaaaaagucuggugggagagagguuugaggagaccuguuuggcaugcaaaaagcuccucaucugcuaaauacuguguggugaaucuacaucauuuaacaguuauuaaguaauuacucugggccuagcaugggagacggaggaacuagggugcaugcuccugccuccagggaauuuauugucaaggcucauuuguaguccgauuacugcauuuuuagguggcugcuucauacugaauuccuguccagcaaauggaagagguaggagggagcugcgcuccuguaguucaugaccuuugguuuacagaugagaaagaagcucagagaggaagcuacuugcccaaggccacaccacuugggaguagcagaguccugaguggucugucaugccaucacccuuugagguuauaugacacucucucucauuugaaggaugagugaaccuaauaucccauauuaaaaguuuaaugagaauuccauuuugugcuuuaugccuccaggcuuccuugugguuuaggagagggagaagggagacugaaauccccccucccaccauguauguauguguguguguuuaguuuuuaacaauucucuauaugcauguaaugaaaguucucuuuacccaucauucuccuugaucauucuucucccuccugcuaaaacccaucuucccaauaagucccucaccuagguuuaugccuuucugagcuuaaugagagcuccuugcaggagugugggugagagguuauuuacuggagcaugggcaagucuuggugguuagauagcugaggaaaaugauaccucaucacuaggucacuauauccuuucauaaaaccuugcuuggaagaaucuagcccugccuuaucaaagacauagcugcuuuccucuuaacuacagugccuuggaugcugguuuccuaaggcccuuucccaggccugguguguuucuucugauaccaccacuccaguccacaauuggucuaguccuuuugugccaagcauccugaggaauacauagagacaucauuuggcauuuguuacuuuuuguauuaggguuggucgguaugcugcuaaaguaauagaaccuaccacuuaaggaugcacacaacuccauuguuuuguaucugugacaagccuguggacagguuucugucagcuuuuuuagagaacuggucagaagagaucuguacugugggaccagcuguuucaggagaccuuucagcacuugcaauguccaguaaaucacuuuucuucccagagacccacucucugcaucucugagagaguuggggcaggcaguauagauauagguuuucaguugacaugugauuauacuacucgauuucuuguuauugaguagaauggaaaaaccaaacaggaugggggugggggaaccaauuaugucagaaacguaaaaguggggaagaauuuaaugaugcauucuagaugggucagucagaaucacguggcuucagcuugcucagccguugcuuugguuuuuauguguuuuuuuuuuuuuccuaaagaaauggaguuucuuugccuuuagccccaugucagaaaguguuuucauaaaguggcuguuguuauuuaauuucagggcuguggucucuaaagauauuuauaaacaucaaauagaggcuguaaguuaacaggggacuuaaaugcguaugaguuacuccuauuguacugcucuagguuagaaugauaagaauguaguguucuauuuugcaagggaacuuugcuucuagaaaagaaacaagucuaaauaaugggccauguacaugcuuaucuucuugcaagcucugaaggguugauuaacuacauaacuaguucuagugucauuuacuugucauuucucuguuuucuuuuuaacaucacuaaggcuaaauaaucucuaaaacucgacaguccauuuaguuuugaucuuuuguccccccucuguugagacagggucucccacagcccaggauggucuggaacugguuauauagccaagcauggcagugaaucccugcuccuccucaguucuaccucccaagugcugggauugcaggcgugguccagguguauguggcaguagggguggaauucagugcuuccugcaugcuagggaagaaugccacauuuguccccagacccguggcuuugauuuaaaggagagaauguuguuaucauugugucuuucugcuuguaagucccuguuuuuuuuuaauagaccaauuggauuuaggaaguuuaaacuuuauaauaaaggacugguuucagaugugucaguccaucauggcagagaggguggacucuuuucuccucucuugcuaucuucaggcucuuuuuuuuuaaagaauaaagccaguagguugucaggagaaggaacauuaccuccaggggcuggggaaccagucauggaagcccauacagguggguuccaauaaagagcuuucuggcacauucugaaggucugucucuccaucagguuacuggggaacugaggcaaugcuucuuuguacaauuuuaaagauuuuuuuugaucauguguguguguuugucugugaguggguuugucugugagugcacuggagcucaggcggcuguggaguccagaagagggcauuggacccccuggggcuagaggaacaggugguugguugugagccuccugacauggguguaaggaaucaaauuugggucuucucucuggaagagcacacagcacacagucuuuauagcuugacacuaucuuuccuagccaagaguuaauguuuuucuaaagcccugaggaugcuaugugauauguauggaguauuaauauaucccaguauuaauauaucccagccccugcaauuagagucauuaacaucaccuuucuuccacuaacccauggaccucacuaugcuuuugucugaaugggugagauaaggcuuuucuuuggauagugaagaguaucuaccaggaagucuggauuucaucuucauaggaaacuugaaguuguugacuuuuacugccaguuaaagagcugguaagauuaggcagaaaucucuggagaguggguguguucugcuaauuacucuguagacagcagagugugugcauaaugaacuguguguugggugugggagcucagugcccacccuuugggaaaacaugggcaaguuuuacugguuccugugacagguggcccugacucccuucccuggagauguuuuggaguccaauagagccauggagcucugggucuaggccuauuagcugcuucuucugagucaccauagcaacucuaguuaucucuuacuuuuugugcuaugcacuguuuuaaguacuuuaugugucuuaacucauuuaauacccauccuagcucuuacagagaauuagcucaucuagagucauguaaguaaugaguuagaacuugaauuaggaaaccggugaccugcacccagagccuagggggccuaaccagauacguauuucuguuugcuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaagcauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuuggcuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaagaauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuaggugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuuguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauguuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagauagauucucuccucugaguuucagugcucagagcacucucugcuggcaagcucucuuacagggaaggugcgcagauaucuuguauuuggaccuccuccuggccgaagaagaaggcccaaaacaggaccuuucucagacaguguguugcuuuggcaguucccaggugguacagacucucaccuaagcagacuaaauuccuaaguuccuuggagucccgggaccaagauggcgaccgcugcugcuguggcuuaggccgccuccccagccgggcgggcaccuguccuccgguccggaagguggccggcuguccccggcccacacagggugcugccucagcgccucugugcuucugccuguuccagaagcugucagguucucuggcgcacccucucaccuguucagacuaauuuccuaaguucggcgggucucggaccaagauggcgaccgcugcugcuguggcuuaggccgccuccccagccgggcgggcaccuguccuccgguccggaccucuguuugcuuuuaacuggaguuuaauuuugucaguuguuggugccugaaaauaugauugauuuuuguucaugauucuagcuauaaaccuugcuaaguauuuuuaaguuaacgagaauuaauuuacuuggggauucuuuugaguuaucuguguugguaaucauacauaauugacaaaugagacaccuguggcuucauuuucagcuagucugcguuuucauauuucauguuuuuuaaagauucauuuaugaauaugaaugucuugccugcauacauguaugggcaccuugugcauaccuguuggcuucccuggaacugggguuucaggugcuugugagccaccaugugagugcugggaauugacccguuagccucuguaagagcagaaagugcuccuaaccaccgagucuucccuccagaccccuuaauaucucaccauguugucuuacuguucugauacagugcuugguagaaguagcagcuacugacacccucauucuugccuuaaaggcuaugcucugaguguugucccguuuuguacgguguugcuguugauuuagucagugauacucacucgauuaaaguggguccuuuuguucugacuuugcuaagauuaaaaaaaggaauccugaauggauguuguauuuuaacagacuugaucuuuuauugagaucuuauugcuuauuuuuuuuuuucuuuuuguuuuaaaugugguggauuacauugauugauugucuaauauuaaacugacuuugcauuccuggaaucaaguccccuugauuaugauauauuaccuucuuuauuguuccuggauauggcuugcuaauguuuuucugguuugauaacuggguuccugagugaauuuuuuuugagacaaccuuucucuguguagcccuggcuguccuggaaauugcucuguaaaacaggcaggccucagaacucacagagaucuugcuugccuaccccccacccuaacccccaagugcugggauuaaaggugugcgucaccacggcuucagcuuuccuuuuucaucuugcuuugucagguuuugguauuaaguuuaugcuauuagcuucauauaaugggugugguaaguacuuccuccuuuucuaaauuuggcacuaguucgaauagguuaagaaauuuuucucuugguuuuuuucuuuagaaucauuaaagaaauugcucaguuuagcaaccagugggaaagcuguuaacauuuacugccacaaggguggguuuagccauuucuucuuuggaucaccuuuaacuguauguauuuuagaccuauauuaguagauguaauaaguuaguauucacauuucuuuugccauauccauuuauuaaguauuccauauaggaaucucauaggaccuuggucuguagaagaucaauauggcggacauggugauaacaaaagcacccuccuucuagguggggcuggguaaauuggauuuugagccccaggggaaaaacacauuuaaagucaaaauugcacauuuucaguuaaagaauuauaguaaauuccuaaauuugacaccaccaaacaaaauuaaccugcacauauucuccaagugucugggcuuugcucugccuuuagauaucauugagagcugguucugggguugagcauagaguugggggagggggaccugagcuuuguuguccaugagccuuaaugacuuuuggagggcaagacaggcuucuaggcuucuuccuguugcuugucuguuuggggggaugauugacccaaaucuugugacuucucucucuuccuuuuagguuuggggauauaauuauuugacaggugugagggguggaaagauugaggcaagacuuacauugguguucuaaauaauuuaucucuucugaucacucuacugagaaagaaaaacucucuacaaucuguagaagacaaguguucacaaggaccaagcgacagaaaugaucgcaaaucacugucucuuuucauuagaguuuugaacggaaucagacuaugugaagugggaaguccuacugagaagcaaauugcauuugggcacauccgggcggcaauggagguuuucaguuccagcacuugaaccuacauggugcugugaaaucuuauuuucaggcucuguuagggcagcuccuaguucugauuacauuucccaaauaagcucuuccucgucaucuuccuuuccaugcagagagaauuuucgagaagcaggagcaggugagcccgugucuuuuuuuuucccgugucagcacaaugauccccccuuucuggucucuugauuugugugaagugaacauuucuuuaguuuugauuacagaaacaaaaugaucauaaggaaaaguagaagauacaagaagggagacgcuccuggaaagucugucuauuuuuucccuauugucucugccuuggcaaaugucacuuugcauuucucauaaaaguguagugugagaugaaaaccaucuaauuugauagaggggaggauauugcggauacuaccuaccauggcuacaugaaauaaaguucaggccuagaaggaacagcaauugaaaacaacagcuaaucaugcauagcuuuugaaacaguggaucaaggcagagaauaaaguuguagggacacacacacuccaauccagcugucuuuggaugugcuugugggggggggggggggaugguuggccaagagguagaauucaaguuagaucacuuuggugaggccaugccuuaagcuaugacacgacccacacauacaugauuaccauucacacuggcacugacugguaugugaucucucauuugucugauagcaucauggggccguugcacaaggcacugacaaaauagccugugacucugucguuguaauuccagcagcuuauuuauuuaauuguccucauuaccuuauuauauaacacaugaaaaggacagaaaaucaaaacucagccucaggaaagaagggacagaacgagugucacuuccucuagugauguguacagauaaggaacuuacuguggugcacagcgccuugcccugccuugacuacaguaaaguaagcaacagcgcucuagauacuguaaaagcuggguaauaaggccaaggauggcugucaucaugccuuccacgauuggcugucacccagugacuuugcugugauaugcuugcgggcgguuccugagagguccgcuaagccccuuuucugugcaggugccaggaagugccguagaaauacuggcuccugaugagaguaaaagccaggcagcuaaauuuaauaagacauuugucaagaagauagaagauaaugaccaauuuuugguagacagauaguugccugcugaaacaaagcuuguauugaacuauuuuggaguagggagaagcauugcuaugacaacaaauuccuuauauuugauuuagaaggagagccgugcagcuaaaugguucagaaagcucaugagaacaauuguugguacgggucuguguuaaaauauaaaaugguaaguaugaucuguuaaauaauugagcauguugguguauuccguaucuuuucuccuuucaauaaaauauaaauaaaauuaaaugagaaaagugagcagaguuacaugcaaauuguuucacuuuuuaagaugccccaagugaaaucugcagcguuacuuuguugaaauacaaaaaaaaagguguuucucauuuucccaaugauuaaucuguguguguguauguugguguguaguggugugucuauuugaaagaaaaacugcuuuucggaucauuucugucccuuuauugugcucaugacugaugugagucagaugcuugugcaaugcagcaggggaagugggccugggcaagugggguaggcauggcggaucuaggggaaggaugccuguuaauauggaggcuuugucucaugcagccagccuuugccauucccuaaaaaggaaacuaagcggaugaggcuggacuccuuugcugagaacagguuucagagccacugagacuggguucugccuguggguagaucuuagagcuccuugacagcucuugagacaguaguuucaaauucauuuuuguucucccauuuugccucuucucuuacuuuacccagagucaucuucgcaucuucccauucacuucucgauuguaugguagaagauaagacaaccuuggaaguaggcuuuacuucuggaagccuggaacaucacaucacccugaacuuuaaauugccucuccagccagagcucacaaauucacauauccuuucuccuucuuuggagaggaaauuccauugcuacagggagcuccuugcuauggggaggaggcugugucacagaguucauucaaaggaugaagcaugaaaacaauaacauacuaggcccuaagcugaccuccaauaaaugagcggcccuggauuauagcuguugaugaaacagagacuugcuagguagaccauuuaaacucugucuuccuaaauggaagguauagagguuuaugggcugggaucauguccuaucaugucccaacuucuucagaaacuucuuuuagucucaagugucuaucugaaauugugacccuguugcauaaaggccgucacaaauuggaaauacaccuuuuagaaaaggacuaacacaguuauuauagagaauuuggaaaagagagagacuugcaaccauuuccuguaaugggcuucaguaauaaacguuacaaagaaagauuugugggccaggucacgacuacucaacaguguuaccgaagcagagaagcagucacagguaaugacaauauguaaaugauuguagcuguggcugugcuccagcuacacauuauauaaucacucagcgagucagauuugauuuucagaacacacuuucccaguccccagcauacaaaaucaaaagcaaucaugagcucaucacagagauuugaagccucugucccuccuauguccauauuauuuuacacgguuauaacuguacugcgucuuaucagcuuuggccucacuuuugcaauuauuauaaauacuuuguauauugaaaacuuaugacuauuaauucauacugguuguagaguauccguccuuguguauaacuagaucauuguguacuugguaauuuccccuuacucuuugucguuauaaagaacauuaugaaaaaguucuuucuguauaaagguuugcguucuggaugacuucuuaggacuuuuccacaaaacagaauuacugagucagaggaugugaaagccgagaagcugcucaguguuguguugaccauaguaauggccauuaccacucccacagaaaugagaacagacagggccugugcuaucuucccucugucaacacuagcuauucuaaaaacaaaacaaaaaacaaacacaaaaaauccucaaaacgccaaaaaacaaaacaccaaaaacaaacaaacaaacgaaaaacaaaugcaaccuuuuuuuuuuauuucuuucuuuucuucaagacaggguuucacuguguagccauggcuguccuggaacucacuuggacaccaggcuggccucgaacucagaaauuugccugccucugccucccaagugcugggauuauaggcaugggccaccacuguccaaaaaagcaaaaucuuaaaaaugauuuagauuagcguguaauucuuugauuauugaaaggauuucaaauaaugacuuuuugcaguuuuauugggcuuucuuuuccaaaaaggcaggcuggcucuaacuuacuucuuuuccuuguguauuuuugauacuuucauccuucuaccucaguuuuauuuguccuuuaguucccauuccaguucugaacugagcuacagucaggucggugaagcccucccucguuccucccacuugauaugaucuuucugcuuuugaacucugcaguacaguguauucucucucucucucucucucuccccuggcauuucucucuuucugcccacuuuuguguuuaucuguguacugacauuccccaggagggacugggcugcgguuugcuuugcauggacgccaccccccagagcuuaggagagggcauaguaugcaguggauagacuagucucuuagugcuuuguuaaaaaguauucuaaggucuuguugcuuguuccuuuuuuauaugccguguugcgacuacuugcaacauguacagaacuuacugggaucagugauaggagaugggaucuaggcugaugacuuaagcugggugccaucuagaugcuggcuacucuuuucuauaaaauuggauuaucagguuuaacaagcaaagaaaaaaauaaucuaaguauaucuugagacuaguguucaaucucacauauguaaacaguuuguguuuucgaauggggcuggguuugaugacugucuaugaaucccauuuauuuccuguuauuguguguuuccuguggcucauggacacggcagggcagcagagacugcugagcucuugaccaguggccgagagugauugccucuguggaaggagguagcauucucuccucugcuugcuuagucaccuugguguuuugaaaggugggugacuucaggaacaaacugggcacccacaauucuuuucucguuugccuacuucuuuaaaaguuauacuuugggaaauauuuuaaaaucucauuuccauuuauuauauauauauguauauauaugaggcagggucucccuguauagcccuaacuagccuuaaacuugaaguggguaucuagccucagucagaaugcuaggauuacaugcaugcacuaccacaccaggucuaauuuauuucauuucuuaaccuugacuuggucaggcauuuauauaucuacuuccuucuacguacuuuuucuugcccucaccuuuucuucauuacauuucuuauauuuccauaguugugucgugacguuaacacaugaguuuaauaauuaacuauuagcccagagagcucuaggauccuucuuuuaaaggaaaugucuacuuacccacucucucuguauguaucacaguguaccuguugaccugacccagccaaugccauuucuauuguccuuguccucagcacuugcuggcccugcuuggcucagggagacugccuagucaaggaacaagcuguuuuuugggaacuuuaaucagaccuggaaauguucagaaacaacuugacccagaaggggccuugggacacagcuagcaguugaauagccaugcucuagcauaccucccaaugguuaaguggguuguucaguggcccuaucuuccuuccuucucuggagagagggcugcaacaucugggagaagcacuugauucuuuuggagacggaagcagcuuccuuaaugaggucucuuuggaagaaacaaguuguggacuaaguugucauggggguggugggauaggaaggaagggaaauacaaaacgagacaaaacacaacuuugcagagggcagagguugucuggagaugauagagugcuuuccuaguaugcacggaacucuggguuugcuccccacaaccacauacaacugcaguaguggcccaugccuguaaucugagccguuaggagguagagacauccaggaucagaaauccaagggcgucuuuggcuucauauaaguucuggccagucuggguuacaugagaaccaguauaaaacaaaacaagaaaacuaaauaaauguggaacuguauguacaccuaugauauuuagcaaaguugaguauauuuguauaguuucucugauacucauggaaaugcuuaaggguuagaaauguagacauauauaaaaaaagauugacucuuacaagguaguccagguuaguuuucaaccagaggucaucaggcaaugacuguagguauguucuacuaugccugguuguugcuuaauuuugcuagguacuauaaucagauaucucuuguuauuuguuuugaaguugaacaaauuucuguacuuuuuugaaccucgguuuaccucauauaaaguggggauaacaaugucugucuuguaugguuuuugauaagagcaguuuuucaagggcagaccggaggagcuagccucacacaugcuacacaaguacaauuaugaaguaccaacaaaguucuaugguugggggucaucacaacaugagcaacuguauuaaagggucucagcauuaggaagguugagaaccacugcuuuaacagguuuggacuguagauacucagugacucuggaugguaauuuucuguccucaucagccaaugcuuguaagagccagguauauggauaugggaggaggguauauggaugugggaggagaacacuguuucagaggagggccauggaucauugacauggagauaugugaggcugugggaguuggccuaguggggauuuuagaaaagaaagacaggauuaccaugacucccccccuuugagagguauauuucuaaauacaaagugauuguaacuuauaauaagaucagcaauuacaaccacugagccauccauccauccccucucugugaaucuuaaggagguuuauaguuacagcauguaugaugccugguucugaaacaauaacugaauguauucuugguguaggaccucuuggcauucaccucuccccuuugcccauccuucucucuagagucuuggucucaacuccugaagcugagcaacaguuaagccuauugcuuaacaggcucucagggacacacuucaaaacugaugguuugggaccuucccuuuccuugccagugcucuuagacucccagaauauuaacuaaccccaauauauuguagaguaagaucaauacuggguagcaaugguguauacuggggaagaagaaacaggaggcuagccugggcaacuugcugagacuuuuaaaaauaaguaaauaaguugguacuacucagugguagagggcuuggcuugccaaagcaucaagcacaauguaacagcaucuugcaagugucucaugauugucaauugauugcaacacugucuccccucaguggaaaucagaauggcuacuguacuugguacaucagccauagacaggaugagcuacuugccucuaaccuucuggaccuuucuuuguugguuucugguguaccaagcacagaacuagaaaggguuaaugauagucuuuuccugauuucagaagcacaugcauuuguaaagagaauuucaguaagucagaaaauggcaaaaauagaaggugaaaauccuccauaguuccaccugccagggauaaugauuaguaacagcuagcgcuuauucuguuagggcuuuaucuuuacacaguaaaaaaaauggugccagggccucuuuguuaucugaaacuuuucccuuugauaauagacuuggaguguuuucuaugccaggggaaaauaaauacuucauuucuuuuaacagcugcauaauuuccauuguaggaaaagaaagguaagagauuucaaagagccaguuugcagaaaggaugguaggcgacauacagacuggauagaaaggcugcugacugcuguugagggugaacagagccaccauaccauccauuuuccgauacuggcuccuguaaguuaccaaaugguugggauggacucaggaggccccaccucucccugaggaugcagagacaauuggugggggaaggagagacauuuuauccauugcuggagcaaccaguaaguuguuauguuucuauaagccacccuaauuaaacucagagucaugaaaagagagagagagagagagagagagagagagagagagagagagagagagaaaggaaggaaggaagaaaggaagaaagaaaggaggaaaagugggacuagcugggaagaggaagggaaaccagucggagggcccaagagaggguaauagggcuugcauauggucaaaauacauuuuaagcaugugugaaaaugucauaaugaagcucauguguauaauuaauauaugcuaauacaaaucuuaaaaauuuaguuaauacaguuaagaguuacagaaaagcucuuuaaaacuacucagggauaauuaagagggaagacugcacaucaaaugcacauuaaauucuuucagcaucccuacccccccccuccacuugagacagcuucuuaugcuggccauauugguuuuaagcucacccugugcauccaaggauggccuugaacuucugauaccuccugagaaugcugggauuacagcuauacaccaccaugcugggauuacagcuaugcaccaccaugcugggauuacagcuaugcaccaccaugcucaguuuagguggugggguuuuuuuguuuguuuguuuguuuuuguuuuuuguuuuuuuguaacaugcuggaaauuaaaacccagguuuccaagcuaaaaugacuacaaauagauugucuuguucauuucuuaugucuguucucaaugguugucaguguuucuuuguccugggcaguugucacuaguaaagcuccuauugagucucucaggaguggcauguguuauucugacaucagggaauugaugggcgagaagaagguuaucugggggaaggguuaacggagagguaguagaaguauggacagcuauuauuagguggcugucaacauagcaugcuuuacucuuuggcuugucucccuccugggaaugaaauaauccaagaaugauaagcucucaauugccaucugucagguugugaugcugcuugccuccuucuaguuaacauugaacacugaccucagaaggcaucugggggaacuuagaggaagauaagaugaucauaggguguaaagcaaauggacugagugcuuguggagagaugguauaaaaggccaguggugucaguuaucagcauuugucugucuuaugcucuuauuccuuucuuccuuuggggaagcugagagcugaugugucccccuggauucaacuuguauagauuuuuuaaguaguuuaaugagacuuuaauagggaugaagaagagacuuaauuuucagguuuggggugaaaggguagauuuuucuuuuuaaauuaagaauguaagauuuagagcucuaugauguagcuuagugguaggaugcuugcccaguguacauacugcucuagguuccauuccaaggacaacaugcacacgggggugggguggggguaggggagaaagagugagagagagcgaaagagacagagagagaaagagacagagauagagauagagagacacagacagagagagagagaccaucucaaacccauggggugguuuggagggacauacuaagauuguagguguuugaaguucaaggguaggcacaccauuuucucccaaauuauuuguuaggcacugagcaugcagauauuucacuguuccuucuggccgcauucccuucuaagguaaacugugugccagcuggguugggguugaggaucaacaggcauuugugccagagagccugccucccuggcacgguucaauugaacuaagagugggccaccuguuucuuugauggccuauccaucauguggagaggaacacaggcuugacaagaugagccugugcaauuuguauuccucucccaggaaauuagaauuguacucuaagaggcugaugguggcaguuugugacagggacaaaagguaaacuggaagacaagcaaucaugacaauccacgcccaugcuggugcucugaggagacaagccaugagugaagagagggagagggcggaguaaaaaggaaccucaagagacagggaagcguuuccccauagcugucaaguucugaggcaguggaauaccugcauucucaccacagaucuguccuuuccgaagccagcuugcucuggacuccaguuucuuacaauaaaaguaaguagucagaugagauccaagccccuuccuucucuccuauuggauugagccaacagccgucagguaucaguuggggcucgcaugaacugcugacggcauugaagguauugcggggaagaguggaaaaacccaggcacaugauuauuugucuccagcuuaguacugaugcuugaagcugugaggccuuguuccuggcaaaacagcgcgaaugaaacgaggcggggauccugacuguucauuuauuaccucacagcucccaccaacagggggccuuccuuaucucauuuaaccucucagcugaggaggauuugccguuugcucguuguucguucacauacuccucuucccagccaagucuugauuauucauguauuugagaaaaacauuaaugugaauuauagaagagcggcccaccuuggccucuuuucucugucagaacugcucugagcccuggauauggaaacagaaauggccacaucuagcgaaagguaagaagaggcugagaccaguuggggugggccuugcagauuaacauuuguaaccaguuuucuucccuagcccuucuuuugagaugcucccuguuugaaccuccuuuucugguaucuaacaggagauagcaugaacacuuggcucuuagcaacuguucucaauucaggauuccgggcuugaauggcuaaaauacgugcaguggugauagucaguggcuagcccuuugacucuuggcuucagagucucucuggguguuuguuaaggaugcugauuucugagugcuacugcagaccuggugagaccagaucccagggagaaggaagcaaggcuggucugggaauacaguauucauuaauugaaaaaaaaaaucauuuggcucuugaguccaccuuggccuguaaugcaugcagccuccggcuuguuacaauccacuugccuccgccuucugaguccugggauggcaggcacacgucacugugcuuggcggugaguauggauuuuaauccacucuucuccaggugauaauuaugcacacucgcuuuggaggagaaucacugugcaaucacccgaggacugggaggagggugguucugggggaaugaagcuuaagaguucuguagcauuuacuacugguguugggaguggggagcaaaaacaaaacaaaacaaaaaaucacauuccagaugccaaaggggauagcuaagggaucguuagugaaagaagagugucacacaauagagaggccucucaucucugccuaauuaaugcuuggguaauugagaguugauugggcaagggcacaggaaaacugugucaguuaauggacuuggcggucaucugugauaccuucaaaguuauagcauccucuucucuguuuugauggugucuuuauuuacagugaaaaaggccagucacccuuaacauaauuggccaggggggguuaugguaauuuaauuauuuuacaaaucaacaugaggauauaguguuuauaguguuguuuuuuuuucuuuucucucucucccuuuuuuccuuuuuuuuuuucuuuuuccuuuuggggguuuucaggacaggguuucucugugaagcccuggcuguccuggaacuuguucuauguaccaggcuggccuugaacucagagaucugccuguuucugucuccucagugcugagaugaaaggagugccccagguccagcuucagucucucucucucucucucccucucucucucucucucucucucucucucucucaauacugucucuguggagcaaagugagguccuguguuucauugcuuuccagacauucucuaacaaccauugaauggauuuguucccaaaggcuucuuuggaaaucuguuuagaauucagauugcacuuucccauggacacaauaguuuucuggugggucagguucccagagaagccugcaaaagccuauuuaauguggugcaaaguccaaggacagaccucccacaccuaauagaaguccuagauggguuuuaaauggagaaaggagccaguauucagccaugugaucuuacgcacaugcccuaccuucucucucagaagaaucauaggacuuuguugguggaaggaacaauuccaacuuguucacauaguggccucuuagguuuugugugaccugacagcuucaguaucaugucuuaacccuauuuccuuggcauugcuuugagucuggggggaaaaaagcuacuugguauucucugaguguguuuuuauaacuucugcaccauuaaguuaagcuuuuaucuacucuuauggucccuucccggaacuucuccuuucuugcccucuucacagugccaaugcuucaggcuuucaaaacucaccacagguuuccccucccccuuugguuuuguuuguuuguuuuuuauuacaggaaaaagcagauaccuuuucuguuacuugcuuuacuuagcaugaugucugguaguuaacucuaugugguaggcaaacaaauaauaucuaguucugggguuuucaaccuacuugauauauaugccugcucacuuuugguuauacaaacucucuuaauucaaaccuuuucucugacucaagaaaacauauuuggaauacacguuaaaaagguuuucaucaucauccuggcugcccccaaaaugcagcucuuaccucaauaggaauaagagauaguuuauucuagagccaacuauaagcaaccaaggcucaggaggguggggcuagguuacuccagauucuauacugcuucguggaaacaguuucauggacaaagaaaaucauaaaucaaggcaguuugaaagugugaacuuuguaccugaaaacaucauaccaugaugucaaaugguuguacaugucugcaaguuccaggagaacuuguuauucugguauuugaacuugauucccagggauggcauuuucuucuagaauuguauuucuucauaaguaaagcuggaagguacuggagccaauuaauccacauggggauguuuuccaauagccucaaacacuuggcuagcuaggguuguuaccagugauggggaagugcaaauaggaaaaugcaacaguguagaaagugucuccugacauucugcuuugguucaguuaaucuugagcuuugaggagagcuauaagagaaguagcuaaaccaaggcauugcuuauacacagcaggugcuuuuucuauuauucuaggaugccaccucuguaaagaguguagaacauuucugcaugcuuaguguauauauccuaauugugugcuugccugacaugacucaguguuuugauaacaccauuuggaauuaauuuuaaucagcacaugguuugauaaacuucauuugcccaugaauaauagcagugguuucauguaguuccuauagagguaagaaaauacauuaggucacuugcuucagcucucaaaaaauuaauauaucuugagcauccguaauauggaaaacugagugcugauaagaugcucaaaacguuugagguuuaguguucaccuaguagcacauauucuaaaauuggaaugauagaaaauuagcuugguugucagacaaggcugacaggugccagugagaugccucaggggggugaaggcacuuucugugcaauguccaagccuagugaccugaguucaauccguggaagccauguaaagguagagagagagagagagagagagagagagagagagagagagaaccaacccgcacacgcacacaaaugaauaaauacauuuauaaggggaugcugggcaaaucagucauacauucucuuugaaauuccuauucuaaagaauuggaagcaaagauuucaaagguauaccuacacaaauagauaauaaauguuuaaggaggugaacaugcuaacugcccugcugucaccauccuaccuccugaauauggacauuuuaaacaauuuugagugaggcagacaaauacacaugaagaaagauguuuucagcugggugugguggugcacaucuuuaauuccaacacuccuucugagguggaagcagaaggugagguagagucaggggcaggggcaggggcagggguagacagaucuugaguuucaguuuagccugaucuacauaggaguuccaggccagccacgagcuauguagggaggugccaucugaaacaaaggaaaaauucuacaacauuuggagcaguuugagugucuucucucucaagccugucugagaugucuuucuuuugcugagggcacuggguuacuucccuacuaacgagugauggacggugauuguaaugccagguuuccaagcuuagaauucaggucucugcauuuauggaagaaucugaaaacaaucgguuaucugaacuguucauggcgccuuaccuugaaugcuugcugccaaaugcuguuuguuuucuugcaguaguuauucaguuugccgugugcagaauagaauuugucaguagauggcauaaagccuaacagaugaccuuuggagagugcaaaggcauuuaugaggaagacgcauuugaagagagaauaauaucagcagccccugaaaguaauagagagggccaaagagagggccacguugugacuguaggcuggggauugacaguuggccucccguggcugauuugugcugccucgggaaauaguucacaucuccaccuggcuugcaguaggauccacaccaggaauuucacaccacacugccuuuucucccuguagugaagaaacuaguuagcagagauguaaaaaaaaaaaaaaaaaggaaaugaucuuaagucccaaagccaaugugaagcgcuugcuugugagagccaccagcauccuucucucuggucucacaaauucuuucauggcuggugguccaguaggagaauaaaggagagaaccauccagcccucaagcuguauugguaguaguacagaucuaugugcacuucagaccagauacaguuugcucuaccacagacuugcuucugugcuccuuccuuaauggcacccugaagaaacucucagccagccuggaagaaagagagggaaucggaaaggagcuucccuuagaaucacccauucgcuucucucacacagcugccaaaccaccaaauucucguccauuugcauccgucucacuuucuccucauaacacugcaaaaauacgauccaguguuggguacaaugugaagcuacccguugugaagcaaauguggaaagugcuguaauuugaggugguuuucagaaggcccccuucugauaaaaaaggcuucuuuuuuccuuucuuuucugucuuuuuuuuuuuuuucauuuaugccucauugcauuucauccaauuucagccccucccugcugggauuuuuccuuuuaauaucugcuuucuagaauagucccugccugggagaaaaaaaaaaaaaagaagggaaagaaagaacgaggaggaggaggaggaggaagaggaaggaggauaaggaaaaggagaaggaggccaucuccccagcuuucaaugugcagccuacccagcccuuucaucccaugcuuuggggucagagcacaagcagagggagaauccuuuucaaaacucaaggccuuguggguuucauauuucauugugaucuucuaucacaguuggguccaggaagcgugaguaccauugagggcuaaauggaugguuagcaaccucugcauaggcuagaguuccuaucuuuuuaaaaaauaaguuugcucaggaagacagcuuuaagguuuuaaagagcgacuucugguugcuuuaagccuguugggcaucaguguggagauggcaguuugcuggggggaaucgagcucgccuaacacuggugcgcuuucucucugaggacccuuuuguucucagguuuccuucucaguuuuucugcagcggucuuuuaucucucuuuuguuuucugcuaccauugguugcaaaucacagacgaucuaucuuugugcuccuaacuuauugucuugauuacagacuugccuuugaggggaaaaucuugcuuaaagacgauuucuuuuuuaauguuaauuuucucauuuuuauuaguccuuugagaauuuuuguacauuguauuuuuaucauauucaaguccuccugaaucuaccccacuuuuuuccuuacccaacuuuguguccucuuuuguuuuuuuguuuuuuuuaauuuaguaaauucacuuugugcugcccauauuauaugguugaucuacaagcugucucucccuccuccaacaaauaucaauagcuccucaacgaacuuaggugggacuucaugucuaccuacucucuccaagacaauccgaggacucuuucuuucucugaaggcacuggguugcuuccuuacugaggagugguugacagugauggcaaaauggaaguuacugaagguacuuuuaaaauccugacauccaggccccauugauacggaaggauguugagaugugaaucccagggaauugcuguuuuuaaauuaaacuccggagguaauucucacguucacugaagauuuagaaccccacugaguuacacagccgagccuaacagccggguuccaggcagucugagucacauaugagaauuacaaguaacuuuauuuuuuuauuuuuuauuuauuuauuuuugagacagguuagcucacuguagcucagcuuggccuacaguuuaugaguuuucuguacuguaauguuaucagacaagcagacaagacaccuaaagcuugacaaguuaaagggguguggugugagcugacgcuuguacuuacugcacccacagagaggcaacaucccuucuagaauauccagguacccagcauucaugguaucuggagucuuaauagcaguuuaugacagugucagggauuaaaugaaaucauucuaguugcuugaaagauuguaaguguaacuuuuauucuccuguaguaauuguuguuuccgaaggucagucgcuaaccuaggccuaguccuaguccuggaagcuucuagcccacuuacaaucuuaucuaggccuggaauguuuuccucagccucugagacuuacugcuggguaaauucacccuuucuuguucuuucugagccuuggcugucuguuucaacucggcugcucuggcucaaacuccuccagacugacugauucaauauggcuucucucucuccgccucuccugaauggcucugcuuggccucauacuaacuuuggcaauagguucuaaucuuuugguccuucucauucucuggcuuguucuaucuuuacgugugucuagcuuguccucucuucaaccuaucccuguaaaacuuuccugguaaaacugccuucuucccucucccucuccacugcucccucuuguguugccucucuuuucucaugagaguugggcagauauauauaucugucaaaucuuucucugauucaucacuuugucugccauucaauucaaacaugggugcuuccuucuaacaaacuaacuuuaccuuuaugguuugagauuccaaguguguauuaagggugugucuguauaccagccagagggauuaaaggugugugcuaugggcugagccauaccacaacuagaaacuuuuuuuuuuucaguaaauaacauaaucucaguguucacagugugaucaaauauccugcaauagaguguauugcuuggaaugguuugcccagaacuuucuagguauuugaaccugugccaucuuccaguuaacucucuucucauccucucaauggcauaguuuuauuuuucuuugcuuauuuuuagguaggcuucccguguagucuagguugacuuggaacuccuaguccuccuggcucagguuccugguugcugagauauaaaaaugugcagacacacauccagcuugguuugagcucugaauggagcugaugcaugcuaccuuguguauuucucuuuggcuagauaugguucaaagguucaguuaaaaggaaagaggcuagaaugcacaguggccuguuaugccucaacuugcuaguucauuuccacagaaauccccuuuauugcugucuuggaaaucuugacaaauaccagauauauuggaaaaacaaaaugucacaaauauuuaaaaauacuuucugacuagguguucaagucuauccauuuaguauauauauaaaauauagucugcagacacauuggucauuuagcaaguaucugaugagcauuuugucugauacauaugcuuuggacauaugaugugagaaucauacacaaccuacccuccaagagaugagggguguuuaacaaaaaggcagcugccuagaaguuagaaaugcuaguggauguugugaaagaauaauuuccacacgucauuucugcaguaguaauugacggaauucuuuuucaucccuggcuugugucccucccccuuaccacccuccucucuguguauaugcaagcacauguguguguauacauguuugugugcaugcagcuaugugcgugcauuuguauggagacaagaccucacuaaaccucaagcccauugauugguagacugacuguccagcaagcuccaggaauauacccacuguuccgugcuccucgggauuuagguaaguuguaggugagcgcugcuuggcagcugugcauggaagcuaucuguagugaguuucuugcccauaggagcuguguccugcaucucucuauguguccaucacacaaacugccucccucaauauuggguaguggucauaauauguuugguugguuguauuuuggugcuuggguccaacucggccuuguaguugguaggcaaggccucuacuaacugaucuaaauccaccaccucuuauuccgauuuuucugacaaguuuuuuaccuacugaguucuuuccugaguucuuucccuaguucuuugaaucagaggucuggauaggagguuagcaccaaagccacugaagcaaagggaauuucccaccacagcuaacucauuuugguuagaaauuuccaccuucuuuucuaacagauaccuaucagaaugaguugucauuguugauuugucauuguugguuguguuacuuacuccagaguggaaaguccuuugcugggcauucuaggcuuucuguagacaggagcuaugcucuggaucgcuuguguaccuagaacacaaacugcuacagguaauggguuaucuuaucgucucuugcuuuguuccuaggaguaccacaagugauagaaauucucguaaaaaaaagauuuugucuuauuuuaaaauugugugugugcaugugugugaguguguguguauguguguguauugugugcacaugaguguagguguuuguagaguccagaagagagauguuagauucccugaggcugccauuacaggcaauugugaagcaccuuucgcaggugaaccuggguccucuguaaaagcaguaaagugcuuuuaaauaacuauugagccaucuuuccagccccauggugggugguuuuauucuuauuuuaaugcuuuuuuucuccacugcuggggaccaagcccaggcaagagaucuaccacugauuaaaauccuaaaaccccuauuucuauuuucaaagguagaaucaacuuggccucauguuugggaauggagccuaggugguagacugcuugccuagaacacacaaaacuugguuccuaacuccagcaccucccggguggcacacaacuauaacuccugcagaugagggguggggcuagaaggauuaaaaauguaaagauucagaucauccuuggcuauauauggaguuuaaagcuaaucuggaaaacauaaaaucuugucucaaaaagaaaauaaagagaaaaaacccuuaaauaauggaaaaagaagagaaagaagccugaagauguuggaaaaaccucuuuccuuugucuauacauuucccaccgcacaccucaggcuaaaaacaaaacaaaacaaaacaaaacaaaacaaaacaaaacaaaacaaaacaaaacacacacacacacacacacacacucaaaacagaacaaaacaaagcaaaaacagacccuucacuaguguuucacauaaucagcuagauccuuguugucagaacucugaaaauguucuaugugccugugacccugacccaguuggucaccuuccugcagggggacuggacaccauccaucucuccuacagguuggcauagccuugguuacuucagaacucucuuaaaguuccaaggcauccaggucauuucguuguaaauauuuuucugggauugagguccaggugucagcgggauauuucucaagugggucagauggaggaggacucuguacacucccuggaagaugcaguucuccuucccuggcugugcucuggcagugguguacucuucuugccugccacuguugucggcacuauggagaauggaacaaauuacuuugugguggagacaggaaguggugauaacuauaaacgugaccuuugcaauuagguagcuuuggagacugaagucuggcucuuuugagacagggugucauguagccagggcagacugcaaaccucccaagaagccaaguucaggaugaccuugaacuucuacucauagccauaacugauacucuacucauagucauaagucauacucuacucauaagugaacacaguagcuucacaaguaaaaaaaaaaucauagccugcacaucucagaggaaagaagcauuuuaauaucuugcuaacuuguauuucacagcuuccaaagaugccgugcucuucugcaucaaaggaagggugagggauugauauuggggaggcaccuugggugggugcauuccgacuuauguacauacgucugagcaugcuaaguuaaggccaucauucaagggaaaaaaaucagggcaagaaagagcucgugcagagaaacugaagugaugcuguaaaggugguggaaccuucugcucacaucuggcuugcaucaucagucaucgacaacugcagugggcuaggacggagaagacaaagcuugagccagccggacuugugcaagagcuaaaacagaggcccuagcugacuaagcuuuuccccuaagccccgccccugguaguaucugcuugcuuguuucuuuccuuguaaccagaaacaguccucaagcugcuucuggcuuuuugaaucuagugguauggucuuagggaaguuucggcuguguggcucaauuuuucccauaugccuacuggggcaggguugggggagggguuaaauaucacuuacagcaacaggguugcuuugaggaauacucaaaauaguaccgguaacauuuuagcuuucauaucaggcacauggaaagugcuugguaaugaauaguugcugcuguuuuuguuacuaacaaccuuacaguaacaaacauaaguuuuucuuugcgugcguuuucuccuuuugcaguuuuaaucaccucccgucaauugugauccaaaaguauuaaauggaaacuccagaaaugaagacuugauauguuuuuaaauuguguaucaugccaaggugugagaugcuuucugcuuuguacuucucaggacaccaauccauuuguccagugucucauuugucuaugcuuauuguauuuuaauuaucguguuucacugugguuugguuugcuacugugucucacuauugaacuaaaaccuaucauaacaggagaaaagcaccaucucuaggauuuggcauuccuuggcaguugcaggucuucccucgggagggaucuuagaaugagcuggcaacugcuuuugugaacaguacaauuuugggggaguuccuguuuucugaguccaaguacaaaacuuacuuaccauccauccuuucuucaagacuuucguugccaugucuuuuuuucuuuuuugaacaggguuuuacuguguuauccaagccgguggaucuccauguauagcccaggcuggucaggugcuccugaaccucuuggcucagccucccgagugcugggaucacagguuuguaccacaaugcccagcuuaucuucaugauagaauuuggaaguaauauuguaaaauuuuucuccuuaaaugcucauucuuuuuuaggcuuuauucccaaauucuagguguguuuccaugaagggccuccaggaacagcuauguacugcacaacccuaggagggggugccauucacauagaguauaauugaauggcgccacuaggguugugcaguguacagccuacacaacucuacgcggcgauccuggcagaacgaauuaauaauguauuagcgcugucuucgucgacgguguggucuggggaacaaauauagggugguaugauucagaaguguucccaaggggucugaaacagaagcugcugcuguaaccaggaaaagagagagagagcaggggggagagggagagggagagggagaggggagggagagggagagggggagagagggagggagagagagagagagagagagagaauaguuguuguuguggugggguuauuauucucuggcagagacagucaaucaaaugggaaguauauuuaaaguacauuuaccugucuuugugcagcaaauaacguuuugaggguuuccuauguaagugcugagguguggagaagggcuggcauaagagagcauuggcccugggccuugugaaggaagcuggguggaaaccuaucaggauagguaagagacuugcccugggcggggguaguggaaggaaauauggagguugugggugaaugagcaacgguaaaugguguagcuuggcuauaugggaaugcaugugaaggggauggggagcaaucaguguuuuggaggaucaagugaugaaggcaguaacuugguuguuaaauggaaagcuuugccucuauucaccaacuacauacagagcagcucuuccaaguguguggccuuuaaaagcagcuuuauugagaucuauucacacacucuauaaagcacucacuugaagcauaccuuugagcucauuguggugguggugguguauuccuguaaucucaacacuuggaagaaagaccaaggcaggagaauugagagcucacuaccugccugggguacaagaaugggacccugucccaaauagaaauaagugagugaauaaauaaaguacacaguugaaugcuuuucaguacauucauauggauauguaacugucacuguaauacaguuuaguacauuuucaaggacucgccaaugaaauuccaugccauuaacucucaacuuccuauguucuuccuauacaucugcaaugcccccagaguguuuuuaacuauagauuugccuguuuuugacauuucauauaaauaaaguuauaccauaucuuuuugugguuuuuuuuuucauugugugugugucuguaauuacauggucuuucuucuugcagugcugaggaucaaacuucgucucauucaugcuaggcaaagggcccuuuuacugugccucaccccuagaccuugguaugauauuguuaagguuaauuaaugcuguagcauauauguugguacuucauuuguuuuaauccaauguaauauugucugguuuggauagguauauucuguguaccuuuuuauucagugaugagcauuguaauuaauacucucuuuuggcuauuaagaauaaugauauuuuaaccucuauuagauuuugggugggcauauguucucguuuuucuuggcuauagaaguaggauuaggggcuggcacaguaguucagagauuaagagcacuggcuacucuugcaggggacccagguucaauucccagcagccauuuggaggcucaccaucaucuguaacuacaguuccagaggaucugcugcugucuucuggccuuccugguaaccacacaugcauguagugcacagacauacauguagaccaaacucccaggcacauaaaauaauagagcaaaauuaagaaagaaguagaguuguugggucauguauaugauaaccauguuuaaccucuuggaggaauuaucaagcuauuuucuaaaauggccacacaguacuacaucccuacuaauaguauuggagggccucaauuucuccaucuucuguugaauacuaauaauuguuauuuuaaaaacugauaugaugugugugugugucugugggcagguguguagugugcauguaugucugcuuauuuaugugaaugaauguaugugcaugugagugcaggugugugcaggugccacuguuacuauuuggaggucaguggacaaccauaagugucauuccuugccuuccacucaguuugagacagaacuucuuguaccuuguacgcugggcuagcuggccuaccagcuuuuauggauucuccugacucucccccucucuugguguaagugugcgggauuaccuaugcauaccccugcauccaaguuaauguaggccuccgggaucugaacacagcuccucacccuuucaagggaccugauacugggucaucuucuugguucugauaguuuccuuuacuguaccuaugcuguucuuucgagagcuauuucauuguggguuuaauuugcauuucccugauguuuaguggcacugaacaucuuuuuuuuguguacauauggaccauuuagauauuuuccuuggagcagugucuauuuaaacauuuagcauaucuccucuuuggauuuuucuucuuucugcauuuuauuuuacaauacauaguuguacuauuaucuccuguugaccucaaacuugcauuucugugguguuaaaacuauagacacuauaccacuaugcugagccuuuagcuuacuuuucaaauuggcuugucuuuaaaaauuauucuacugauuuauguguguuugaaugugcauauguguacauacauguguggaggucagaaggcaacuugcuggagucaguucucugcuucaagcauuugugucccagggauuggacucaguuuuuaguuuugucagcaaucuuuauagaccuggauacuccaucauugucauauccaugaccuacagcaucacaaccaucuauuuguuucucaauauccuuugaaauugaaaauauuuuaauuuuugaaaaguccauuuuacauuuucuauuguuucccaaguuuuuaguauaauuuaaauuuauucuucgaaaauuuucauauauguugggcuggguagauggcucagcagaauacuggcuacucuucuagaagaccuggguacaguuccuaacauccauguagccacucaccaccaucugugacucuaguuccaggaaaucaaauguuaucuucuggugucuauggucauaggugggguacaacuccaccucuagaggaccugauggcuuuggccauuucggguaccuguauuuacaugcauauaccccuccccaccacauaauuuaaaauaaaaucuucaaagagaaaaauuauauauguguauucuguguaguuggucauacucacguucccauucacccugcaacuucuuccagaucccugcaagucucuuuccccauuuaaugucuuuuuuuuuuuccgagacaagauaucacuauuguuuucucugacugauguagaacucacuguguagaccaggcuagccucaaauucagagauauccccuugccucugucuucugagggcuggaacuaaagguaagcaccaccaagccuggcuuuaaaaaugacccacuuagacccgcuagagcuguccauauguacuuggguguggggcuauccaauagaacauggacaaccuagugccuauaucuguagaaaaguugcuaauagugccuuagcacgaggguucagagaaccuuuucccugaugauuguguuuugaugucauaucauaucauaucauaucauaucauaucauaucauaucauauaucauaucauagagaugucaaauccaaggcauugacacauuccuguuuuucacacgcuucaaaacuuuggcucucacagcugcuuugacuuugaguaaggugguccauggucauuggcuacauucuuucuaccuuuaaauguucuuuucauucguguugaaaucuguugugaagguuuauguuaagauucucaguucugucucaucaucugugugucucugauguagaggccaaacugcuuugguuccuguugcuuugguuggaguuuuguagucagguacugugaguuuuacuugcucuucuuuuacagguuguuuuggcuauuauugucaugugaacuugaggaucagccugucacucuuugcagucaguccccaggauugugauaagaacugcagcaaaucugucgucagaaauucuuaaggaguguaaugugaccagauacuguuucaagaguagaaauauggcaguacacugcacuaggggaaagagggacagaugguggauaccuggagguuaguaaggaaaacuuacauagcuaggauagggacaaaaguaggaaaagauauugaugagggacuccagacccacucaaaagggugaaguagcaaagggaguggcuacauuugaggauaggaggcaucaggauggcucugagguuugaagagaagcugacugaugagcuaacagauucucuuucccccuuuccuccucuccucuccucuccuccccuccccuccccuccccuccccuccccuccccuccccuccccuccccuccccucccuuccccuccccuccccuccuccucuccuccccuccuccucuccccuccuuuccuuucuucuccccuaccuccucauucuuuuuuccccuccuucuuccuucuuucuuuuauuaaugacagggucucucuuguauguaaaacuuacuguacuggaacucaccauguggagcaggcugaccuagaauucccagagauccaucugcuucugcaucucaagugcugggauuaaaggcauacaguaucaucccaccucuuaauuuuguuuuuuaaaaugauuacaauuuauagaaagguugcaaagguaucugauagcuguccuguacacuugccaucccgcuucuaguguuaacaucccuguguaauuauaguacaaugucaacgcuauuaguguuggcauaguauuuuuaacgaagcuguacacuuuguucaggucccagucuuuccacaaaccuccuuuugcuucuccaggauccaaucuagagucucaucaucccaaguggcccugucacuucagucucuucuaagccucuauagucuucccauucucuucucugacccuggaaguuuuggagaguacuggucauuuucuguggaaaaguucuucauguuuugacugggauuauguaauuugaguccgauuuucaccaacaugacauauucuucucucugugucacaagagguacaccaugacgcaucuugauaaugugaugcuggaugugauuucugucaggcuuccccaagguaaaugacuauuuuagaaaugguaucaguuuucuuacuaacuacugggucuuucagugcuucuugccugcagcaguuacggcugcaguguuggccgauuggcaaguuuuuguuucucucaucucuucuaccuuucucagugggaaaccuaccauauggaaggaugagaccauugcuccuauuuacagaaguugaauagacagggaaggaagguaacacgauuuaggcaugccacauuagacacgccuguauaccaucugcaugccaaucucuaggaagaacuggguacucacaugaaaacaguaguugaagcugugacaggggaacugugugccacuugugugccauaauucuuuuccuuuagagaggcaggaauggagguugaguaaaaaaucgcagcacacccucaucaggaagucacguuggugauggccuugacuguaguacuguggccuuguucaguggcucauuauuggaaggcagcauuaauaaccagauccgagcuuucauuuacugugccacuaugugcaacugugugauaauaaagagccauuuaauaucccaaauuaaaugaaucuacucccaggcuguuggaguagaggggugugagggagggugucuggaguuauuggagaagacuugguggaacacuugccuugcacuuugguggaauucacaguccaaggacaaggggaagggauauucaaugaggaugacacucuucauaggucacacugaaguuacauuacgccauccacugaacucaguaacccagcauucaauucugacaccuacucuaugagagaguacuauugcaaucuccauuucacagaugagggauuugagacuaaaugauuaaguauuuucucccuuuaggcagcaggacaagggaagccaaguccuauaccagagugguauuaaugugagcaauugagaacaaaugaaguagagugauaagguauugcugguauaguucaccuuaggaauggacuuuucccauagaaaucagauguauagcuacuguauuuagggcaggcucugcuaggcauugugccagauacauuugcuuguuuuaccauguuugaaccucucugaaucccugugagauauagguccuguuuucaaucccguuuuacagauuaaaaaauaauuccucuucucucucuucuaagaccacaggacuaaugaguguuagaaucagcguacccauccaaauuugccuuaccagaaaaccuguacauaagcaguaucccagcaucuaggagccugaggcaggaggauuaugaguuagagacuaaccugggcuauuuugugugauccuguaaaauuaaaaacaacaacagcaacaacaacaaaaacccagccuuuuaaucuggguguauuugccaguuguaccagaaaacauuguuugggagccugggagugacuauuguuugaguauggucauugcuaaacaugccuuuccacuuuuuauuccacacaccuguaguuggccagacaauccugauaauuuuucagagcucacucaaagcaggucacagucuuguccuucaagucucugugcuuauucccauguauccaguuguugagagaaacuucuuuguaagcuuuuguuuuuguuuuuuugguuuuuuuuuuguuuuguuuuuguuuguuuguuuguuuuuguuuuucgagacaggguuucucuguguaacccuggcuguccuggaacccacucuguagaccaggcuggccucgaacucagaaauccaccugccucugccuccugagugcugagauuaaaggcgugugccaccacgcccggcuuuucuuuucuuuucuuuucuuuucuuuucuuuucuuuucuuuuccuuucuuuucucuucuuuguaagcuuuauaaauuuuugaaaaugauaaauucuuagaaagaaguaaacugggagggcugguuugaggacuuggcauucagccauggauauguuauaugggaguuucccaggggaaaugguauuaagucugcauuugcauaguaaaucagaaauaguuauaagauggaaagguuuccuuggagaccauucuggaauaguuuguagaacuaccaagggcaguuucuugguguugcagauugaucaauugauugauuuaggacaauguuucuguaucauuuccuuuucuauugcugugauaaaacacugggaccaagguaguucauggaagagaguuuauuugggcuuaugguuccauggggacuaagagucuuugaugucagaggaaaccgagggcuuacaucuugaaucauaagccagaagcagagauagagaacuggcaauaggugaggcuuuuuguuaaaucucaaagacugcccccagugacauacuuccuccagcaaggccacaccucucaaaucuccccagacaguggcaucaaauugagaccaagggcucaaaugucuaggacuauggaggacaucuuauucaaaucaccagcuuccagcuucacucuaucguucacacugccuucaaguucacuacaaaccuagacuggccuggaaugcaucccucucuguuuucucauccugggauuacaguugugagcuaccauacuggcuaguauugcggauuuaaaaauuaaaacgguaaaaaauauuaggaaaacaagaggugagucauuuuauaaucccagagauguaaaaggguuuuaaaauauuauauuggagauagaagucauaaaagaaacuauauauguguguauauauauauauauacacacacacacauauaaauggcauuuacauuguauuggguacuauaaguaauuuagagauuguuaaaaacauaggaaagccgggcgugguggugcaugccuuuaaucccagcacucgggaggcagaggcaggcggauuucugaguucgaguccagccuggucuacaaagugaguuccaggacagccagggcuacacagagaaacccugucucaccccccccccaaacaaaaaaacaaaaaaccauaggaaaacaaaaauagaugcuauguaaaugcuaugggauauuauauaaugggguugaccauccccacauauggggaucugaaaggggucuuagaagacauuccacauggcuugggaggauugacuaguucuauuucuguggaccuaguaagucuccuguaacuggagacugguaaaggaacuggguaaauuauugaaugggcauguaauugaguauggugaagcuguuagagauuaggcuguagauggagcuggaaagaugacucugcaguuaagagcuggcugcugcucuugcagaagaccugguuuaauuccuggcacccacaugguggcuauuaaccugucuauaacucuagcucuugggaaucuaaugccaucuucuggccucuuugagcacugcauuuaugugaugcacagacauacaugcagacaaaaaaagcaauaguauacuauauauacuauuuuauauauauacauuauauauguaugaauguauguauguauuuuuaauguacuuuuaaaaaugaacaaagaaaugaagccauagaagcaugcucaggauacaguucgcaaaaugcauauuuagauggucgauggaggcuggggcacagaugcucuuaucugcugugcuuuccuuuaggcauuggccagccuuggaaggauuucaaauggcacagcagaguggcauuguagauaaaucguucuuguaacauuguaccugguggugguauauagggaagagauagucacaauaguccaaaaagaugaugagggcaugaaggcauggacaggaggagugaguagagcuccaggaaagacuuggcacaacccaggaauuugaucuucccugugugaguguuacccacuuccuauguuaacuaacucacaugcauguguucuuaggaauccuaagauaucugggugucuucauugaaagcggaacaaggaaaacuggagccagaggucuaggaccuaaacgcuugugugcuagacuacaugucagucucaguggcucuuacucuucauuuccauuugauggcguccaagcaugucccuucagugcuuaacugguccagcagcuccuuuaggguggccugugguaaacgugagggcuaagauaauugggggcaugaauggggaguaggaaaaauaaugguugagaggaugaggagcuggggguggugcugguggugguaccuagaacuauagugguuaagagauagaacaugaacugugacaacaaccagguaacuggacaaaguuaaauguacuguuuacugggcuggacuuguauggcgggguggggggagcauggggaauuaagacuguuuuuuuuuuuuuaauagcaucugggcauuuuuuuuuuuuuuggaaugacuagccacaaagaauucaguuuuauaaggcuuugugaaucacauguaaccaccagaccucgggcugagaugaguuugagcuaaaaugagcuugugugggcauugcuggaucuguguggugggcugcccuguuggguguguuuugauauaucucauggugaucaaaauagaucucacgaauguaugguaguacuggcauaaaacuauugggguguucucugugugaacacagugaccaggcaggccuauaggggcagaaugagcguagguggcaaguacauugaauugaguuuuuauuagaaaugcuuuuuccccagucucuucaucugugaauugggguuaaauaacuuggccccaccuguguuaggauguguuguucucuguaguaaccauucugcuugcucuccaguuuugcucuuugcuucaggggcugagcuguuuggaauauggauagagagucggugcugagauauguuggcaucuguucucaugccucaucuuuuguguuuguacuucuaggugucuucuguuugcagcucaagaaaugcuuuaguuuuccaucuggcaguguaaaacauacgcugucaaaaauuuggaggugucuggagccauccagugaaggaaacgaggacagagaaggcaaggcuagggauccuugggcuaauagguuaagauguuauuuuuauaaugcaugauugaagaagggugauuagaguuguaaccuuagcccgaccuguguuaggauguguuguuccuaggaugugagguucaauuucagaaaucuuucuaguggcugaaggaaacuguggguuuccuagaaauggaaggaguuaaauauugagguguuuuuuuguugucuguuugcuuguuguuguuguuguuguuguuguugcuaauguauucacuguauuugacucaaagguuguuuguccgcaaacccccccuccaaaaaaaaaauucuccauccuggugauagguauagacaggcaaggugagaaaggcgggaaugucagaaaauuuuggcccugugaaaguaacuguuggugagcucaucuagaaugaagacuagauuagcuagcugucucugaaugguggaguggauuggaacuggaggcuuaauccugauaguaaguuccugaacaucugcugcacagaaggacggaacuagucaaacacccaugugcuuguucccucuagggugcccacacaggaaaguaagacuucauucauucugaggcucucuugcauuuuuaguuucuguuuggcauguugcaagugucuggguauuucagaagccaaggagggcugcuggcaugacucucugggggguauuccagaugaacuggagaccuuuccaaggugguuggggcauggcaugcucucuguacuauagcuucaaaguauaagcuuuggugggucugaugcuugguuugugcagucgccaaauugguccuuugccuaaggugaguaacuuuccuacugugucugggguaaaaaaacaccagcuucauuuaauucuuucuugaacugcuccugagggccagacaaggguguggggaggaacuaauauuuucagagucaaaauuucaaguacacaauccuuauucaaaaggaguagaguuaaauguaguucagaaaaucagcuuguuuugggugucuuaaaauggcaacacaauggauaucuuccauguacucccaguggggucuggggcagcaccucauguaaagagauauaucuaauuucugugcgaaauacaaugaaauuacccauaagcagaguaaauaaagugagauuuacuuccuuucagauaacacaguuauuuggacaagcacacaguuucuguuuuagaaccccuuggauuugagauugaccaacagaggauuguggacccgaaauuaucauugagguugcacuuuaaucaaauugacucacaagagaagaggcauggggugggcacugguagcugacuguuucccuggagggguucucgaugggguaagaggguugaugcguuccaacugguguucuuaagauacuguuuuuuccauacguccuucuuuuccucuuagcaggaaugcuagcugccaagcagaugucuuccacauaguacagacuauauucucacuauagguuccaagugaauagaagaacaaagcacacauauuuggcaaagccgacaagcccauaaugcaaauuaucagcguuuucagggacagcuacugaugcuuuuuaaaccacacaaugaaaucaguguguacaaaagaacccugcaaacauaagguuuaggcguugguuaauccucagucccauggaguaguuuagucuaagagcaaacacacagcauggaauggcugaccucauuccaucuggaacuguuguucagcaugcacauguggugaggggaggucucaggguugcagaucagggugcuguaucugagaaucuaggaaucgcaugguuagcaaauuuuauaaaggcuguuuuggccuuaauggcaguuggagaccaaauugugggucuucccagccuggaguccaggccuaugucaccccuaaguucaggaagcugauaaaccuauucaaaugauaagauucuuuuggcuuccauuauucuugucaugauaacagcacuuuagaaaaaucacuuggguagacguguagaaacaaacaaaauccaagugggguuuagagucgaggguggcaguuuguuagaguuguagggaaauucagaaugcccaguuacauccaauuuucacauaaacaucaagcaaaguuuuaauagaaauacguuucaugcaacacuuccagccuacuuacacaaaaauguuauucauuguuucucuggaauugcauuuuaauuugguguccuguauuuucauguacuaaauuuggcagcucuggguauugauaagcccaccuacccucaugggaggcaaaccagaugggauucugugugcaugguccacaugcagagucuauuuuuaccugcccuggguuaaagcuucaaagacuggcuacuuauggcauauugaaguugaacuacugaaaauuccucucucucucucucuuucucucucuccauauguauguauauauauauauauauauauauauacauacacacacauauauauauauguugaaauacugaaaauucuacucucucuuacacacacauacacacacacacacaaauacaaauguacuuugguaaacuaucuguuugcuuuguaacuauacaaauuuuaaccaaccacaacacauaaaucuuaccuuuucuaucuucuuuuuuaaaauuuuuuguuuuaaaguuuuggguuuuaagaauaugauuaaagcagcaccaagucacuguggugaguguuugacuuucuaaccauucuuaauucuucauugcagaucuuccuccuggccugucccccauguccgggagcuaccgucaucuucaaguaagagaaaguuguguuuuacuccaugggacuuccuuuucaggcaguucuuugcauuugaugaccaaggaugaugcggugucaagccuguggccuguacugcguggucccuuggccuuugaugaggcauacaucccuguuaggauccacugaaguguccuguacauguuguauguggguuauagcuguuguugagcucugggaaaucacacugaaccuauauuugugauuacacagcuaaaacaggguggcguggcagcuuguuguccugcuuaaauucccuugggagcugcuggaggccacauagcuucaguccauagccucuacuaucuaucucuucauugaggaugugcuauugaaggccuuuguuccugugucuuuauggccacuuuucuuucaagugcaaaaugaagugacagggauucugggaauuuaacagggcuauaugugugcugcacaggguucuacuagucagccauauccguagcccuauaaaucccaaguuucuuuacaauaucagcgagcauuaaauccauuaaaguauacucaagcaaaccauguuucucugaaggcaggauuacuuaaauuaaauuaguaagagucccagaacccucauuuuagccaugaguugugaucaucucccucaucagaccuuuuauuagaguugcuaauucgaagguaaauuggcugaauuaauuuccucucccccaugcccacccccauguuggagcuauuugugaaauggccagagggagggaacaggaaguaauaugccuagcagaugcuaggauaguugagaguagaguaaauggcuuucugauuuacuuaagucauuagaguaugagguagggggaaaacuaccccauuugcuccugcaaacagcuucucagaauagccacuuagucucuugccuuaggugaguaccuuucuucagggugacuuuuuacauuuuauguggacagcucccacagaaaagggcaauuuaaccucacuucccucccuugccuuuucaaaaugagcucagucauucagugugaugguuuuacagcaacaugcauugauuuuauuucauuaggaugaaagcgacaauucucaucagaaaauaaacaccacuuccauccuacccucaagagauaauuuuggcuauugccccccccccucucuuccuuucuuucuuucuuaagcagaaaucauacuguuuacucauauuuuuacuacuuauuuccucaacuuaauuuacuuauuuuauacucauacauauauguaaauaugauuacuagauuucuucauagcgguccuuugcauuuuccuuuuuuaacuugguuccuaguuuacaccaguccucuguauaugaaaccaauguguaucuuucugcaucuuccuccaugugcaugggcaagcucauguggcuugcagaauuuuuuauuaauuguuugaguuaguucuuuaguaccaccugcuuuuucauucaacaauauuucauggaaaucuaucaaagucuacuggcauguccuauauaagaagggcugcaaaauauuucauaacuauacaacuuaucuugguauuuccuuauuaaugacaauuuaguuucugagauaaccauuacuacauacuaaccuacuaaccuugaacauugucccuuucaguuuaugugcgugcguauauaugugaaugucuugccuaauuuuuccuuucuuauacaaauauuauucuuauauaacuucugucuuuccagcucuuucuaaaguugcauuaucaaagauggauagccauuuguacuagaacagcacauuauauccucccugcuuuuuccuguaaacugaacauccaucauugucagcuauuuaauguuuuauguacuagucucgaguuauugauucucuguucucuuucgucgguuugugugccacgauuauauucacuugauugcauuaguuuaaaauucauuuauuacauucuugucaguuuuuccuacuuaugcauuuuaaagcuuccuuuuacucgauauuccauucgaguucuacuaagauucuaauuagacucacguuacauuggcuugaacuuuuuaauuaugcaguucuuuuuagccaagaaauuguauuucuucguauguucacaucugauuuuguguuaauuagaucuauucuuuucuucuuaucuacucuaugcuuuuuuauauacauuucucaagaauuaauagcuuuuuccuguugggacuugaauaccuucuucaucuccauugcuaagugcuacuugcugucaagaaaaaaaugauuauugauuuuuuuuuuuacaaauauuuagcuuauguucagcuauuacucagauucucuuaauucugguucagcuauuacucagauucucuuauuucugguaaauuucauuuuucuuuuaucuuuucaauacuuaacauuuuuguuguauuuuguaggaauucagauagcuaaagaaaaauaauguugauagccuucucugacuaaagauuuucaagucggaauauuuucuuuguuccuuuuauauuugcuguugacacuuguuuauuugguucuaaauuuuuccuuuuuuuguauuuccucacauuuacuuaugaguuugguugcuguauuuuauugguaucuggcgucugaaauuuugguuuuccucuaaguguuuucuuuuucuuccugagcugcaccccuagcucuccuugauuuuuucaauacagugaauuuucuugauagacuuucugguuuggagacacuucuauguuacugaaguaagccuacugauuacaguauguuauuauuuugauucagagcugaaucuguuuaucuguauuuuauuuagaauguuuuaacuauucauaagugagauugaagauuaaugugguauuuuauuagauuugaagauuuaauauaagauggguaacauauaguauagaaaaaguuucuucuuugacuuuggucucuauaauauuuuaguuacacuuagaacuuguaaagcucaucucuuuucauuaugguagaccccaaauuacauuuucaaugucuuuuauaggaaccaaaucuagucaaaucuuuuugcuuuaauuguggucauuuguguugguuagggaaccaucugccuguucuuuaucuucauauuuguugccauaaguuucaguauguaguacucaugaucauuugaagaaugugucuuuaugucgucaugcuuuguugguugaacuuaaucuuguauguuuucugugagcucggcuguauuuaaauuuguucagcaaguacauuaucauuuuuuuuuuauugcuauguagaauaaagucuuggauuuuucucauccuuccuaucuuccuuuaacuaccacuauguuauuccacaggucaaacaccucaguguacacagauaggcucugcuguaggcucacuaacaagcccucucuacuuauuucuuauuucuccgcuggugcuuugcucuagcagucguuuguaagucugcuaccuucucagcuaaacagagcauggccuguucuuugcagagauaugccuggucacugcuucaaaaggguuaugauguguacagcaagcugcauaguuccacgcugggcuggggcugacaguucuuuuggugauggagagaggacaggauucuccauggggguuucacggucuauuucacaggggagaacgaaagcuugccagugucccagcuggguucugaccaugucauuuaugugcaccuuugcugacaugugacuugcuaagugcugcuacuggagccugcugcuagaaaggcugccucagcagaaacccugugucugagaugucgugcuagaauuagcaggguuucuacguggcucaccacacagcaaccuugggcacgguggucuuaugaacuccagucucaccaacuucuggaauuccauccugguagcuuucugcuucugaaagcccccaaucuccauauuccuacgcacccuucucuauggaugcucaacuagcaacccagcauuguuuguuuuauuguauuuauacaugcaaggcuguucuuuaucucuuugaaucugagacacauuccuuugccaauuuagaauggcuuuuuccuuaggagcagucuacuaguacuuucucuggccacccuauagaauacauuuucucauacagguuugacuaaaaucaauacauucugcccuauguguggagguuucauguccccggauucaaccaacuauagacugagagguuuguuuuguuuuaaauuguaucuguucuaacaggagaccauuuuugucauuauuccuuaaacauugauaguccauagaagaaauuauacaaauguauauaguacuuacuauacacagguuuccaguguucacauuguaugaaguguuguuacaacuaaccuagagagaacguaagcacuguuuauugguagguuguacacaaguaccacaccauuuuauauaagggacuuggaacgcacugaggguaugugcaagggcuucuggaagauaacuuguauuugaguguaauuacuguucuacuaccaacuuucaaguacauacugucucaguuagcauuagggaccuuauccuauccuauuauaggaacuaguuggucuuuuucuuccuuuugcaauauggucccacuguguaucucugacugaccuccaacguacagagaugcaccugcugcugcuuaggagcacggggauuaaagguguggacaaccuugcccaacccacagucauaaucagauuucccuuugauaaagaaaaggagaggacagggcaccauguuggaguagucccucagcuguacuaagcacucacugcggcuuuuuucucaaacuuuucuuuucuuuugucuccagauauaugcauguacauuuauucucaucuguccuuuacacgcuuguauaauuucuucuguggacaaccaacucauguuacuaguuuuauguaagggcauuucucauuuuacuugaauaaauuauauguauaugaggucuagaagguuuuuaucuuugcaguaaauacuucuuuugccuuuuauuugcguuuucuuguuaauuuaaaaagggauuuauuguagcccuaacuuuuuagcaaccuauuuuuaauaagguuccaaccucuccuguagcccaccacccagcagagguaguggaagagagaaguuaucaggauggggggaaagugaaccuguuccgcaauaguucuuugggggugugcuugaucuucuugggcagcaguucagucccauagcagaacaccaaauaggauuuagcaacugcagaccaguccuccaggcaggcagacaccaggcaugaaccagcagcugcagaccaguccuccaggcaggcagaugccaggcagcugcaguucaauccugaagaaaccgccaggcucuucagccauccugaggcaggaccucagaagcagcaagcugccucaggaaccucacaagcaguuuuugagccaguuucucucaauggcaguugagcucaacgaggcuaggcaugucuuuagugaagaauaacgagguggagcaaaccacaccaaggcucagugcuugucucccacuguuuguggggucauauuuacacgccuucaucaagcguccuuucacgugucugcuauguccaaacauccucucaccugugucugcuucaggaaaacagucuuucacguguuugcuuuagcaagacagccuuucaccugugugccccagcaaaaccaucauuugacauaacuaacuuuccaaagaacuagacaauuccacuucagucuccuggagguaguguuacaggcaguugugagccuccugacaugugugcugggacuugaccuacagucugcuacaagaacuucaagcucucugaaucacugagccauuguuccaggucagguuuugaaguuuaagacaggucuugauauguaucucagauuagucuguaaaucacuauguauccuaggcuggacuuggacuggagaucacucugcuuuagcccccacagugcuggggccauuuaccaccaugccuugcuuacaugcuauuauuauuauuauuauuauuauuauuauuauuauuauuauuauuauuuugagaucaggccacacuaugucgcucuugauucuugauggccuugggcucacagaaaucugcuugccucaacauccuaguuaacugggauuaaaaacauguaccacauaccccacgccuuugaacuucuuaaugaaguuguugcuaaacaacaauuuugcuuuuuuucuuuagucauguugauuacuccuucuuucagaccaugacuauuucauauauauguauguauguaaguauaugagacagggucuuaccccauagcccagacuggcuugaaauugacuuuguaucccaguacagccuggaauucucaauucuccuguuucauucuuccugccacagcaagcuuucuuccugcauuuuuaugccugaaaagauauuucuucauuguaagauuaguuguacaauccaaugcuauacuuuuauucuuuucuuucuuuauuguucauucguuagcacagagaaucuuguguuaguagacucuggaauuucccuugaccuuucugacuauaucuuuccagugcuaggauuagagggauaugccauuauacccagcaauguuuucucuuaagguccuuuaccucaaaucacucuuuaauaaguaugaucuccuacguguuaggaauuagcucaggggacuguuuuacuauucuguucaucucuuggguuuuaaaccagcuucaucaucuuuuuaaccccuuucuuuuuauuauuuuauuuuaugugcauaggaauuuugccuuaauguaugucugugcacgacaagggugcuccguguccauggaagccagaagaaggugucagauuccccgcaaccauaguuauaaacaauuuugagguaccauaugggugcugggaauugaacccagcguuucaacaagagcagccagcacuuuucacugcugagcuagcucuguaggcccacaagaaguuucuugaugggaagaguagcacggaguaucauggcugggcaaaggcuaaagcccagcuuuaugguauuuacuuguagcagcagguagguagagcagguuucccuuugccuucucagucugcucugcugccuacaguuguuugucuuagccacucucaguugcucuucuccgguucgccuccuaaucugccagggguuuucugcauuuacuugagcucuacaauugcacggauaucaucacaguguugaaucuuuucagccaggauaaaauguaaaccauucuuaauuucuugaaaucuucuuuuauauucugcagugugugugcgcaucuucgugcaugcgucuuguguguauguguguuuccuacauauuucucaacaaggucauuuuaaaacaguuuguaguuuauguacuuuuauuaugacuucuguuaauacucaugauacaugggaaaagauuucuaguuuguuuucuauuggggcauuacacuuaauucuuauuuauguaauaauucuucagaucuuaacccuuggaucauuguggaaauaucaacuucuaaaugguaaauguaacuccuuuuaaagagagaacuguguuuuuuuuuuguuuguuuuuuuuuuggcucaagcucaguuguauuugcuaugguuucuggcaucguuuuaaauaauacuaauacuggcagggcuccuaaucuugcuucugauuuuaguggaaauauuucugauguuccauuuacuuggaauuuuuuauauuuuacauuaaucgacucaacgauggauauuauuggcuuagguuagauguuauaauaugacaaagaaauuauuuuguucuugaguucacuuaaacaacaaggauuuuaucuaucuaucuaucuaucuaucuaccuaucaaucaauuaucuauuauacugcuagggcuagaacccagggcuuuuggacaugcaaagcuagcaugcuccugcugaauugcauuccauccucagcacauagguggcuguugaguuuagccaaugcuuucuggguagaagaugugcuuuuucucugugaccuccucauuugguauauuacagugacagaauuccuaauugcaaccuuugcaggacuacugauguagcgucuucuuuucauuuaugugcuugcaagagagucagaucuggcuuccuuccuaugaauuggauuuuacucugucaccccugcuaugacacuuaacuccuugucauucuucccugcuuuuugcagacuucucuuuuugccacagcuuguuguuuuuccuucccacugugccuuuucaaaaucccugcuuccuagaguccagguuuccuugcguacuauucaugauacacucaguuuuuaaaaauccuuucugguucguacucuaaauucggauguuuaugcuucuccaagucuucagaaugauaugcauuuccccugugcuuccagacauuuuuuauaggaaccacgcuggcuuuuuuguaugucuaugcauauucaaaggaggaucuguuauucgucaaagccagauuguguauacugccuuuaaauaguuuuauauucucuaugggauugguuaggaccacuucgcagcuccauucuuugcuggcagguugaugaacacagcuuuuggcaugcuucucacagucuaguaacuauucagauuaucuacucuaaucucucagaugcucugcacacacacacacacaaaauguguguaaaaauucauagucucccacagguguaacucccagguuuuucuuugugacacgcugccuucucaguauucaguuggcuagcaccaaucacaucguguucuauggguuugaucuuggagaauugauuggagccucuaaacagauggagcuggcggcuuccagacaucacugauuguuaccugcaagcaguagacaugcuggggaggcacagcucuccgauuugcugaucacuaaaugaacuuucgguuugccagccaugaggcugaucagagcagaaggauuuacuagcaucucccuacuuucaagucaggcuucugcaggacuuggccacaggaucccccccucccccacuuuagcaucacccauguugcugaugaagauuuuuuuuuuguagauucuggguaucacucuguuuggccaucaguuuuuacuguuugggggaauuggaucuuuuuugguacuauagagauauuugagaagcugggagaggcuguguuagugguugcuagccaugcauuauuuuaaaguagaaacuuaggguauauuuugguuuggggugacuuuuuuuuuuaauagaacaaagggcuaaauaucaacacuugagaccuuagagccucaugacauagaucaauaaaaauucugaccuugaacaacuuuuuugauggugagaaaggggccuagaaauauguaaagaaauaaauauggcuauguucuaguaaaguuuaguuauauaaacaggaggaccagaugcaagaguugcagggguugcugaugguaacagugguccagugucauuacucuuaaugcugacuuguagaagaaaaacagcuaauagaggggauucaugguagauaucuuauuauaccaccuaaagcaagaguagaaccauaauuugcugacccuaauguuagaagaauuaggucuagcauacagaaguccacacuugaaggccagaaugaguuuuggacuguauaacagaagaguagcccuguuaaucagaugguaguagaugauuucuugucuacuuaaaaugaauuccacgaugauggauaagggguucuugagggauaagccgaaggugcuccuggugacaccagccuaugguuguuaaagcuggaguuagucuuccugucuucugauguaagccucagagaaacuucugguacugcuacagucuuccuaucacaggagggcaucuuaaaacacaaacagaggccuuugagaugucucaguggguaaaggcacuugcugaacaagcuucccagccugaguucaauauccagaacucacaccaagguggaaaggaagaacugauucuacagaguuguucucuggccuccaaacguacaccauggcaagcaugcaucccaucucauuccacccccccaguaguuaaaguauuuuuauaaaaaaccucggcccguccuucuugauugguaauaauacuguccguauaugaucccaucccuucucuaggcaggaaaacccugguucuuaaguuacugaccauacuugauacaagaacacuagauaaaagaacagacacuggcuggggccugguuuuguaagcucaaggugaagucucacuuguaagcuggagaccugggcccucuacaucuggaaauagccaugcccuucagagcugacugcuuuuaucuugaagccguacaaaggauauucucuaccucucagugccaagucuuugcugccccuauuugauuaacaacuaugaacagccuacauuucugcugcauucuccagcuguccaggaguuaaaaguuggggaaauagggcucugguguguuuaauguuguuccuggaacacggaagauccagguguauuuuccacuacccuugugauguuggaggaaggcuaagaucucagggcuaggagccaaagacgucaucaggaacuccugugaauguaagcagccuggaaccauauagcagcuuuugagcucucugucucuguugggugugauauagcuaggcuaaaggugcucuuaucaucacaugguagaaaguuuuuacagcuuuuucugauugcugaagccuauugccacagauggaugucauuuucagcuuguuuuuuguugcccugguuuccauccauccauccauccauccaucacuugauuuuguauaguuuggccaccaauacaugggcucaggugaugcgccccgccccccaaccuccccaguuucugggacauaugggauuguguuuguuaccuuggucagcugguugcucuauuuagaagguuucacaaugggcuuggggcuucuuagggaaacuggccauguagaaccugcucuuucucuugggauaucuugauggaauugaugucaugaauggaaaggggaauggcagcuaagaguuucccagcuuugguuuaugaucugacaguuuccuugcauugugaggacucacuccuuaaugugaggggcuauccagaugugcaccaagagugggggaagcucaagcccuacaugugugagcugugaaguuuggauggcuacagacuccuccucccauccuguguaggaaaaguagcaggaggcuuaccaacaaccucugcuucuggaagccuauguaugguacgcccccccccccccccgcccggcucugcaacucugaaagcugcucauuuuccugagcacaggggaagcagacacgcugugaugugagugugauuaucuggcccugaggaucugcugacucagucuggggaggcuuuugaaugagaggagaugaaauuucagcugugccacagggagcagaggugcacuucuggguggagaaaggacgauaggccaggugugagucaagguaggugaggcacgugugggggugggugaggauaaggaguagaacagccugacaugucacauggauggcauugcaagacugagaccccguugaccuuugggccacauggcauuaggauaauucuguaaucugguggaacucucuuuuuuagaucccaccuauauuuuguuguaaucucugaauugauuguuuuugaagucguaauauaaguauuaaauuuugaauagcaugcuuuccuucaguaagccucguguaucuguaauugcucugagacugugagauggauuuguguugaaccuguugccuguuuuucuuccuuucucuuccugucuuucuuccccccucucuccucuuuuuccuucucuuucuuccuuuccuuuccuuuccuuuccuuuccuuuccuuuccuuuccuuuccuuuccuuuccuuuccuuuccuuucuuccuuccuuccuucuuugccuccacucugccucucucuuucugucuuucuuucugugacucugucuuucugugacucuguuucucugucugucucucuguuugucuaucucugucucugucucucucucucuguauuaaagagugaaccuagggucucaugcuuuagagacaggcauuucaccaccaagcuguagucacagccccaaccuguuauaccuuaacguauuagcguuguuuuucccugugcucaucagaagagcuucugcggaagcugagagauuuggaacuggaacucagcuuggagucagagauagcauuuaaaagaagcagcuuuaaacacuugccacggagguggcugauuuggagcuuagcuuuggacucauuaccgagaaugguguuuagaagauggccucugcccugugcagcauaauuaagacuuggccucugcaagugagaagaagcuguacagaugaauaccaugcauuuaauguggaaggagacuagacaccuagaagauuacuaagaaaauuucagggaaaccauuuccucuuuggugugauacucagguaccuguuuuccugagaccuaauuaauugucuggagccuacuuauauucacaauacauucuuuccuuaauguuuugaggcgugagagaccuuuccaguugauuagaagacucuuuuccccucccuuguccacaacauaaacuauuuucuucuccacauaugcauauucaguguuaucuucuacaaaucuccuggcagugcuuugugcgcagagauuguuucuuuuucuucuuuuucucucuucuguguagcuaugcuuuaaaacacaaaagaugauggcuaugcaucauauuuaggaaaacaaaaggcugucacucagaaaacuuaucccauauugugaaagcaaaguguggacucuuuucuguuauguauuugaaaaaaaggacaauacagauuaauaagauuuggguaaaguguguugaaagaaugaaaaaguggagauguucuuucuuucuuucuuucuuucuuucuuuccuucuuucuuucuuuuuuuagaaaaguaguguguucucauuguauagaaaauuuuaacauuucauaaauaaauaaaaugguaagagugacagauaauuccuguuaguagguugauauaauuuucuuccaguuuuugucaugcauccacucaaaaaucaugauuauucucuguaugcuuuguaauguuuuaaaagcuaauagacuaggcguggugguacaugccuagaacaccaacccaggaggugaaaucagggggaucagguuauuuagcaaguucaaaacuagccuugucacaaacaaacaaacaaacaaacaaggaaaacaaaacaaauguuaguaaccacaauuaguucuauauuuuaguaaauauacuauaauuguuucccuaucuuauuaaagcuucucuagaaauuauuucuaauggccauauaacuauuauuuggauaaauaauguaucauaauauaguauaguuaauauaaugagugucuaaacagcuuccuguuaauucagcauuuaucuucuuggcuagguagagugaaggagucuuggguaaugcagugaacuuucaugaccaggacuguaugugugcuucucuggucuuugcuuuuugaucccgaaugaagaugaaagccucagcuuccguuccuucauuugugaagaauguauuaaugugacucacuccuugaaugcugcaaacaauuagagcugaccccuaaaagucuuuuagcauggacuaaguacucaguaaguguuacugauaaugcauagcauuauccuugucuuuagccuccagcaccucacuuuuagacuuugagaaugaaaauugcuuucauuuagauaaguacaauuucaaaauggaaauuacuuucagcuaaggagccucuuuaguaaaagaguaaguuugagcaucuuccagauggaagcuuaugucacuuccauaagagggcgaaauguucuggaacuuuuuccagaaugagggaguggggaucccacuggcugcaagcaggggaauggucuuuguacccacaggaaaagccaccucaacuuuucuccuguaccuaucaaccuuuuaaaaaaucuucauguguggcuuuuuuuuuuuuuuuauguuccaaguuucauucugaaaacuuuugaaacuuucaaagaaguuuaccagaacagaaugaacacauccaaguccugacugauauuuagcauuuguuaugcuuuuugaugugauuccuaaaauacagaucaauguagcauuccucacuagaugauaggcauguacugugggaccuaacauagcugaccaaaauggaguguucucagaugcgagcuuagugaaacagaaggccagcguagaaggucccuggagucucuuacaauagaaauaggucuauuuuuuuuaauuagguauuuuccucguuuacauuuucaaugcuaucccaaaagucccccauaccuacccccccaauccccuacccacccacucccccuuuuuggcccugggguucuccuguacuggggcauauaaagguugcaaguccaaugggccucucuuuacagugauggccuacuaggccaucuuuugauacauaugcagcuagagucaagagcuccgggguacucguuaguucauauuguuguuccaccuauaggguugcaguucccuuuagcuccuuggguaauuucucuagcuccuccuuaucuguaauacaaauuguagaaaguaaaucucaacauuuguggucaaugggaaaacaauaaauuuguauuuuugaauaugauaauggaaaaauauccugugaaccaaaaaaauauagaaccaauuuaaguguccuuauuuuuuuaaaaaaaauggcacacacauaucaugggaaaccacucagucugauacagccagcaacauauuuuguuucucucaaaaggccacaugcagaugagguggaucugcauguauggacagcgauaauuagaauaagcuguguugaauaaaaauguaacuugcaagaacuauuaucauacaauauuugugauuccacauauguaaccgaagcauaaaacaacgugguauauaguuugugagaacauacaaauguaaaaaauauauacaauauaauaaagaggguuuucagauugcaguucuuguagguaggagugugacagacaagacuauucagaaagguauagagauggcaauugcuauuuuguauuuucuaccaguuagguguagcuagaaaagaagcugaagagaacaaaguauuuuauuugaaggaucuaguauuccaaguagucacauggaaaagaugucaagaugaagcagucaagaagaaggcagaggcaaagggaauguuuaggccaguugucuaugggaagggaagaugaggcaaggcuggguaaaggguucuugauugacuaguuugaauccuuucuguaagcucuaacuguagggguagauuuuacuugcauggaaccugguccucacauggcuaagguggaggagcguaguacauagaggaaacagcuuuggacugguuauguuacaauacaaagaccugcccacaacugagcccuucuguuucuaagaccgacccucuaaaggggcauacauucccuagucagaaacauaauggaaaguaaguguguguguguguguguguguuuguagaaaucagggcugcauacacacauacauaaauaauuaaaauauuuuaaaaacgcaguccuucaugauuauaauacaaauagcaacuaaugaaccaaugauacaggacguauguaauacucgugccauuagugaagaugaguacaguggcaaaaauguagguuugaaucuugacugacccaugugauauugggcgaauugucaguuauuugaaguuuugguuuucucagguaugaaaugaagaugaugaccauuauaauaacaacaagguaaacagggcauggugguauacaccuuuaauuccaacacuugagaggaagaggcagguggaucuuuaugcguucaaagcuagccuagucuacaugguaagacccccagagcuauauuguaaggcuuugucugggaaaaacaaaacaaaacaaaacaaaacaaaaaccuaggaggauugaauuagaagguauauuuaaauacuaaguccagugguuuucacaucuucaauauuuuuguauuauuuauacaaguuauuuuuauguauuacauauaagaauuuguucuuuacccucugcccacacaauuuguauagcugaauaacgagaacuccaaacaaagcuugccuuuauauggacuuuuuuggcucuugauaucaauuuuucuuuuuuauauugucuuuaugugguucacuguaaucuacucucucaucccuauaucuuuugauaccuaaaugucuaacuggucuuauacaaaugucaucuuacccuuacagucaguggaaaagccugacaccagauuuuaguggcacacggaucauccaugugacuuuuccucucccaucaugaaucuaugcuguggcugucagagaaaugauaauguuaggccagagucaacuuuacucaagaccuaaaaucaguuuuucagagcacagguuaucuggcuagccuugauaacuuagcugcucagccugagguaaaaggccuuggacugcuucaggcugucuacucauacuaagcugugugucuagagagacuuucuaaaaaucacccuagggcagaugauauaggggguagagagaugccugaaaccaaaggaagggcagaggugcaucuuagucuucucuggaagggagggagacacugaaaaaaggcaacaagaaugaugugaguuugaagucugauguaagauaagauagaccuggguaugagucuugucacugacaaggucaccuuacuuuucuaaaugaaccugguuuccauaucaaagugauggacaagucucagugccuauuuagaaacuuacuaucagaauuaagugguuaauuucauaguucccuaaaauguauuaggugcacauugucaccaucauugaggccuuggugacaaagaauaggagaaagaaauagauucacagggaugaaaagcaaucucaggccuuccaugccguccuguggccugcacuuuaacuuaguuguugggccacuuuugugagcucuaagagaggaaccaaaugucuaugugcauguauugaaacguuuggugcuguaacacagcacuggcaucuacagaguucuccuuugaauaccauguagcugaguuaaagaaacaacagcaaaaauaucaucauuccauuuucagcuuaugacuuuuuauugugccacauucuuaguuauauggagcacauugaacucaagggccaaaguuggacaugccuuguaggagucuucuuuaagauauucuguugucauagggugugagugugagugugugugugugugugugugugugugugugugugugucagagggagagagagacacaugcacacugagacucaagucaucuaacaucuuacucugcugugucuuauuuggcuagugccuuuacuguugugugucugagagacacaguucagggacaguuguucacaacccagcaaaucaaccuuuuuucaucgggagccaacucauucuuugccccucucucaaguaagagccuugagccuggaguggugaagaaagcugcuuaaaucccuccucagaguccucacaagaaggcuuuguuccuggguugguuguccuugacuuaggauguguaaugugcauuuuaaugagccugguaauggaagugggcaacacuaugguuacuuggcgcuugucuugucuucccucccuuucuguccccucuucucuaacguuagggguggaaccuagggcauugugugggcuaaucaagugcucuagcaccaagccaagguccuagcauggcuuagcuuuuaagcuaccagaauuuauauauaaaauaaauccgagaaagccugaggguuugcgcgcucuaccuugagcagcaacuacuagaggcauugcugagacgugggggaaacagucugcaucacacugcagacccuguuaccuuuuuccgcugugcuaauauacaccuacaaaaggaacuuaagggaggaagggguuauuuggcucacaguuccaugguguagucccucgguauaaagaagucaagguggcagguccgugagagaacuggucagauuacauccacagccaaaagcaagaagcaguaaauuaauacauuugcaucucuauuuuccacaggcuaggauccugggccuauacagauugguccugcucacagucacggugggccuuuccaccucaccucagcuagcccaauuuugacaguccaucacaggcauucucaaguucaccuuauuguagauaguuccucacagguguuccuggaagcuugccuccuagaggccaaguugaggguaccgacccuuacagacagaucccagccucuucuguccaggucuuuggccgaaagacuggcugugccucuguaaacaagcaaccauucuaauuaauaaacaggcuucuauaggaauagcgagcacuuugguguucacuuccuguuuucaaacgcuacagcaguuagagucauugguuagggcugacuuaaauguuuaggaaacagcuucguauacagugaacuguuguaaccaaagugcguucaggcaguguuuggggaauguggaggcaguauguguuccagguaauaaacauaaguauauacuuauuuucauuuacuuugcaugugggcuguuuuccaccgagggucacuucucgcacauggcuuagcucaaacauuuucucauccaucgugaccuguugaucuucuuucuccuccagguuacagaugcacauguugaauggagcucuucuggcauugcuguuccccgugguaaauacccggcugguaaguagucucucccagcaaugcaacaucuaaaucagggucugauuacuucauuccuagccaagguuucuccuuacuuguugcccugaagggugugugauuugacuauguuucuguuaaugcugauauuugacacagucaugccuggaguaagcagaggcuuaugggaauaguuuguuacacuucagcuacagcaaggguaaaugucugagcccuucguucuuggucuugucaaccuggaaccuuuguacgcuuugcaaaaaacaaaaacaaacaaacaaacaaaaaacggacgggcgccuucuuauuuuaugccaaguuuuuguuacagauuaauuuuucccuaaaacuacuucaaaccaaugaaccagucaauaauuuuaagguucuguuuaaauguaagaauuccaacuuacagucuauuaaaauucagcccuaaaaugaaacaaacaaacaacaaaaagaacucaaagaaccaaaacuuagggguuggagagauggcucagugguuaagagcacugacuacucuucuacagauccugaguucaaaucccaguaaccacaugguggcucacaaccaucuuuaaugggaucugaugcccucuuuuggugugucugaagacagcuacaguguacucauaaauaaauaaauaaauaaauaaauaaauaaauaaauaaauauuaaaaaaccccaaacuuuauguagaaauuggagugauuugauggaaagaaauggaucuaggaccaaacccuuaggcagagacuucuagauguuuuaaggggcauaguggugauguuagggggcuucagaacuuguuuauuuuaccaaggaaccucuugagcuagcauaauuuuucuauauccacccaaauccaccggccagagcaggccacuuccuccaccuucaggagaagcuggagcuacaaggcuugaggcacaguaaauugucuaaacucuuacauguggggcucugagaaauuaaugagucauuuauugaaagucuagggacaaauuaccuauaaagauggguaguaugguuuuauccuuuugugacuuaaauuugucuccuagaugaaccuuauagguuaacucuuccuuuggauauaauuuuguagcuuacagggucucucucucucucucugcucucucucucucucucucucucucucccucucucucucucuguguguguguguauaugagagagagagagagagagagagagagguagguagguagguagguagguagguagauaggacaguuauuauagccucuuguuucauagaggaagaaacugacucaggauaucaccugaauuauaaguggcucuuuagaucagaaucugagccucucgauccuaaaaaugaagccacacacugccccuucugaagaauguaaucauuuucucuccacagauaucccucaauaguguaaguugugcuacucuagauuuauguaauauagcaguagaaauuaaaagugaaaaguccaccuaaagcaaugauuuuggaaucuuuucacuaugcuuucuggacccaccccauuaucagccaacugggcugugguuuuagcugaguacuagaauaugccuaacauauucaaggcccugguucccaucccuggcgcuaugaaacaaagaaacaggcaaauaagaagaugcugggucccacccccuagaacaacugauuggcaggacaguagccaaccaacacucaaguggugcuccuuggacuguucccagagaacccauacauuaagcacucaaaaguuaguuacucuaaguauguaauguaaaguguggccugaaauuaaguaucaacuggguguugcuuguuagaaauguuggggucaggccucaccacaguauuauuguaucugaaucaacuuaaaagcuagcuuacaugaccuagacucuuugcuccaaggaacuuccuugugaaccauuugggcuugugugaaaugaaaggugccaggcagugcuguugcugauuuaauggguagcauucguucugaucaauguucccuugugagauggcuugagugugcacaauuuacaucacaggcacuauugcucucaucucuaugccucccuucccauaauagaauuugccugacuucaccugcuauauucuagaauuagaacucaugccuugggcuuccagguguagcucaaugggugaacacgcuccugguauacaagacccuggauucuuuccgcagcacucaacaaccacaagacaccccuccuuuggucuucagaacggagggcaucauguaucauagaaugccauggcuagcccacaugaacacacuaaauuuguacuuuauaaaaauaaauuugaguuugcaccccuuugcuccugucuggccguggcucaggaauguggaacucgaguuguccucugccugugguaagaacagcuuaggccccaucucucuccucaccugacuacagcucccaggagaggcugggcuaaagagagcuacuaaauacauuuuccucagcucucucagcucccaggaccuguacagcagacgaggaccccucagaaaaucauucccuaaguuaagggugacagggauucugaguuuguagguggccagcccagagcucuggucaaccagcuccugccauuugcagaucuguccccagggaaaauccaggaaccauuuuuuuuucugguaguaucuugagcucuuggcagaaguuaagacuaccuaccauuacacaacuaggagaaugagagcaccaagaggccuggucacacaccugagagcguuucggaaaccacaggugagguucucauugagacaccguuguuaagagcaacugaguguguugcaccaggucuccggauguuuuccuaagccuguuaucuacagcaaccucagcagcuccugugugagugccugcucuugugccaggagcugcuguaccuguuuugccuaaguggauuuaguuaaucuuuacagcuuuugaggcuaaguucaauuaucaccuccaaggucaagaugcuagcaggacuggcuucuuuuggccacuuuccuuggcaugaagaugccagccaucauaugucuauuuuucucauuucuuaguguggucaauucuuuaugaagacauccaucacauugggucccagcucauucuaguagccuacuuucaccuuaaucucuucuuuaaaucccugacuccaaauauacucacauucuaagauauaagggauuagaucuuugauauauaaaggggguuuacaaagaaccuggugggguccaugaugccuguacuaucuuauauagauaacauuguuucuucccugacacccuuggauuuuuuugaaucucccugguuucuuuccucuacccuuucccccuuuucuucuuuucuuccuccguuucucuccccucaucucuuucuuuccucccccuuuucauaacauggaucuguuacaagacacagugcuuucuaaacaaaugcuuaucaagaauauguaucacuuuacgcguugcugaaaguuuuuugugggcucuuuuaagaagggauucuagccacccuaguaaauuuuacaccccuuuucuaaaauaaagcugaacaaagcucauaucuccuucugcacccaucuuugcaauugguauuggucuggcucauucauguauuugggguaccucuugaguaacuuuggccugacuucaaaugggacacaggaaggcuagaacuuugugauuaaaccugaugauccaauuaagcagucaaagcagcuuugacuucucuuuugccuuuccuucuuggcccuuuaucuucuuaaucuuuuuuuccucauuagcaaugaugaggaagcaagaaaaagaacuaauuagugguacacccaucccacgacauacauauacuugcauacauaaaaacagggugagagggaguuagagggaguugcuugccacagucagcuaaacgauuugagguuaucagugaauuuccaugcaaacucuucuguccucuggcugauuggcaccaggauuugcagaccagcuccugccgaugggugucucuuucuucaaaguugacagccuaaaaaguaagugcccuuuauagcuaggauccagcuuaagaugaagcaucuucaaguuugcaguagcauguccucugcuacuuaaacagaggaaacaccucauaggaccacuaguuagauuagucagguucucaaagcuuguguaauuugauuuuaucuucugguagggagauuuccuuauuucuucucuuccuccccuccuuccuuccuuccuggugccccaggcuucuuuauuuaagaagaauauguugagugauuggcucaugaccagugacaucacugaaguucauauuuccuucaacuaccucccccaacacuuccugucccucaccucuuguuuuuuuuuuuaauuauuauuauauauaaguacacucagagcuugaagcaccaaaacuggacccugagggcagaggaaaggauagaggcuucccugggaaaggagacccugaagcuuccuacugcucuucacugggaguaguuuguccgauccuuugcucuucuggcaauuacagaaccacauuaggcuauaaccuucucuaguucaagcugcuuguggaugaugcucaucuacaggguaggcuuuggacaccacaggaacauguuaucuggguucuuuuuuaaaaugugguucuuggcucuccucugauuucucuugugggccugcaucagggucuccaccuuguccuucuucugaaggaucucauuguugacuuucucagcccucaacuccagcaggaaccauagcugaagcuugcucuuguaacagagcuacaggagagccuccaaguggcagaucugguugaacuauuccaaagacaacaccuaagguaauaccuacaucagccugaguguacucccaaggugacccucuucagcuuuagcaucuuggcaaauugcucuaucucuuucuguacggcuuucaugucuugagauuccucaggaucuggcuucaccuccacuggauggacagagaguauaggacucagggcaagccccaucugacuugcucuccacucuagcucuugccuggcccucaggcuucaaaaugucaggcuaacuuggggcaguuggcccacuacaaacugagguccacaguaugccaucccucugcagaauuccuacuguugaagaaauagggaaaucccuacauuuccaagccuggccaaaccccugaccugauucuggggccacccagagggcuuuggaagcuuugaggucugaagguccaccuacccuggcuccaugcccuggugggagugagaaagccaguucuaaagccaggcgcugugcucaugucacacccucgacccucucugccuguucucccuuuuguccuuuaaggcccgugguaguuucuucucagagcaagguauucugaccugcagagacugggccuuagaaaacgagcuuaagacacucuuuggccaguagaagacacuagccuauuuugugucuguauuugcagacuucugucuucuacucagauuaugguaaugcucccuuucauccagcucccuuuucuccaaggcccaaagucuccaguguaugauuaucucauuaucagaauuucccauuguugugcaucuuuguugaucuguuagauuuuggcuccuucucuaccccuccccgcuuuucccaguuccucuucucuccaggugauucuuuugccguucuccccacucucagacucaacagaauugcugaguagugcuucugucuaguuaggacugcuccccgccguucagaaacauugucucaguguucuugggaugcagcuuuucugcuggcauaccuuguccccguguggguugcugggacagcuuugcugucaucaaugcaaauaagcuugagaaucccacucugcuaauuggcacauugaaaugugcuaauugacccugaaggguuauuuaugugauuaacaaaauugagcuguuuuuaaaaguuauacuuuggauuuuagacuugagcuggggacagaauauccuuucgguuucuugaggguacuuaaaauaucaaaagcuugauuucaaaagaggucuugaauuacugaaacauggacugaggcaaaauugugacuucacuuucuacaaaggaugauguguguugaauucgauaaaugcaaugugucugagacaugggguccggugaaaagggaccgggacucccaaguuuagacaaauucuaggaacuguccuuauauauggguuacaaguauaauaaugcuuauuaaaaaccacucagaagacuauaaaaagggaaauugaaguaaauucuauuaaaggcucaugugucuguacuuucacacgucucucuugcucauauccuguagauaaagauuuucauagauuuuuugguuuccuagauuauuugaaauuaaguuucuugcccacuugugauuuuauuauaaaccauuuuccaguguacuuuuucuuuagccugaaaccaggcaguaaauaaucuuauuaggcacccacauaauuccuuuccauuagcugcucaaugacuggggauucucuguaaggguggacagugucucuugcuuuccgccuaauccuugcaggaccuuauguuuaaaacaccauagauaccacaaauacgaaugauugacuauuccgagccugggaauacaggccugugugaggcugaggcaugauggccacacguuuaaugucuguuggcuuauauucugaguccaaggcuagucugggucauuuagugagacccugccucaagguaaaaauuaagaagaggguugacucagaagcagaaugccuggcucccaugugggaggaccuagguuuaaaccccaguacaacaaacaaacaaacaaacaaacaaaaaacaaacaaaaaccccccaaaccucaugacauuggagacuggccgaagaaauugauuggagguagauaugaccauauucaucucuaaaauuuucaaauaauuaagaaaaauuuuaaaaagaaaaggauaaaaagaauccaucaucaaaucuuccauaauacugagagaaaguccagggguuucuuuuguguccugggaucugggguuugaagaaaggugguaaaggccuuuuuccagccccuuaaaagccuguuuauuucugccaaugcaaugaaagacaaaguuuuguuaccgaaaaugcaugcaauacagugaaacauaaaugucacuaccaauguauaguuaguuucccccauagauuaaaaacaagaagaagcaagaggccauugucgucuauguguguguguaugugugugugcgcgcguguuauauguggcuguguuagagauuaaacuuuauucugacaagggcacacauaaguaaugaaccuuugagcuacauccuaaaacuugguuucuuuguuguuauucuuuuuauuuuguaauaggauuuuacucagaaaaccagguaggauugaauuuaggacccuuuuguuucagccuucuuaguagcuaggacuacaggcuuggacacucuggcuuggauauaugauuuuuuuuucuauaagcauagcauauguacagugcagagaaaaggaaaauguagaccaaugcccaaaucaaacugaaauuauggggaagcaaugacugcuaagauuguuugcugcauguucuagaagggccuuuuugccucuguagacauuaacaggucacaagugcacucuuuggagccagccugucuguagauuucuagucaguucugguguguacagccacaugaccuugcauaaggcaguggccucgcuauccccguuagcuuaucuguaaguuaugcuguucugcgugaucacgugaggcacacacuuaacugagccuacaccacaggaagcaauggagaaacaccccacgggauggggcuccuacuauugcuaauauuaucucaaaaugguugaggaggccuccuguuagugugccguuugugauguuauucugcagagcuuuggccucagcuccuggaguugcucggcaccaugaagggggcuuuguuucugaauuagccuugcugagugagauuaaaauucccuggcagggauucuugcccuuuuuuuaauuauuauuuuauuauuuguguguguguguguguguguguguguguguguguguguguguguguguuugguucaggggcaguauguuugcauaggaaacugggcagcccuucccacucucuugccuccugaagguaaauuaggcccacuccugucugccugccugccugccuaucugucugucugucucuuucucugucuacuucaauccccccccccucucccuuccucucucuaaaacgaaacagaccuauuugguaggucagcagacccaagccagaggcugagaagccuauucagggacuggcacagugggagacacaugugagccugcuugccuucugagcuucuugguggcuugccuuggcucugcagaacacaguccucuccaauaucuuugcucuucaucuugagcuuuuauucuaaauguugauuguuuuuugggggguggggugggguugguauaguaucuuacauauccuagguugaucucaaacucacuaugagcuuagaauccauuuucccaucccaccucucacaugcugggauaauagccauauacuaaauaccacaccuagcuaagagauaugucuuuguggaauaaaaguauuauuuuccaaguuacuuucuuuccagucucuagauugcuggguaucaacccugacugcacaguucagauuuccaaagcugcuuucagaaugcaccagggagaagcugggcuguggcucaguuggacaaauguuugccuagcacacacgaagcccugcuuuugauccagcacuccaauaaaaauaaagaaagaaacaauggcaaaaugugacacaagcccuuagaccggaugcucaagaugaucauauguuuguggucaucuggagcuucgauauguguucagagucagccugggguauaggagacccugucucacaaaguaaacaaagcaguacaccaaugaccgcuggcuaguccauugagcagccagggcauuuguguuguuuuagucccauguuaucucugacuggaacuugggucuuuagagcauuuuauuuuaccaaguaggauuggugauaccugcucuuuguaccuuauagauaugguguagaggaaagaauauuaggaauaagaaaagaacaguagguagaaaaggaaggacauuggaagguugaguaucauggaaaggacuucuuggccgccuauucucauucaguaauauuuuuggaacagggaauuaauugagauacaacuuacacauaauaaaugcauccuuuuaaagcaucugcuaagugguuuuuaguauauucaguguuaugcagccaucaauucuguuugauuuuagaugcuuuucaucaucuauccuccaaaccaagcccuguaccugguaccauucacugcuucuccaucucuagacucuggcauuuaguaaucaacuuucaaucucugugggguugccuauccuggacauauauaaauuaaauccuagaauguuuuggguuuuugguauguuuucauugaggauguuuuuaagguucauccaugcugcagcaugaguuaguacuuuguauuugugagcauauaauaucccucugcaggacaugugauguguuaaauagauacucaggcauugguguuguuuuuuucgguuuuggcuaguaugacugauauuucugugcauauugguuuaagaauguaugucucuuuagguauauacuuuggaguuguauugcugcaucacaauguaauggccuuuuauaggccugggaggaacuugccagccuauacuguaauauggccauaccacuucauauccucagcaacaaugagucauuuccacacuguacacauccuugcauuguucuuguccuuuccauuagagccuuaaggaugagauguggaauaucauugugccuuugcuuuccuugauaagcuaacugauguugaauaccuuuucauguacuggguggcuauuuuuaagccaugguuggcguuauuuucaauuuucuuuccauuuuugaguugcuuuuuacuaaucauuucuaagaauucucccuaaauauuagacccauaguagacauacgaauagaaauauuuucucauagccuauuggcuguguuuuguuagauuguuugguuucuaaauuuuugagccaauaucuuauguauccuaggguagccuuggaauugccauguagacugauauugaacgccagugccaguguagauagacagugaacucaucuuucuacuucaaucauguguuuaccaucacaucuaguaucuaugcauuuucuugauuauguccauuaugcccuuugaacuguacauuuuuuuuuuaauuucaagaggcuacuuauuuuugauuuggcuguucuuugaaguguacuuuaauuuuuuuuaaacucuaauaucuuuacauuugguuugguugcuuuuacuuucaugugaaacauauuuuugacuaaaguaaugaagagaggacauuuaagagccucauaagguuagcacuuaaacauuugcauguauaauuuuugagugaauuuuaaaauaugguaugaguugucagucuaaaguaauuuuuuacauaugcagacuucuuauugucuuugugucauuuguugaaaugacugccuucucauugccauccaugucaaaaagucagccaaaaggaaauagcagcuuuauuucccaauccucaguuauguccugguuaucucucuugccugcuguacacgcccucugcugugacaaucacuggagcauuguaggaggcauuacguuguuuuguuuuauuuuguuuuugagacagucucucuguguagucccaacuggcccagaaauuuuguuuuucuugacucuuccaugugcuugggcuaccaauucacaccaccgugucuggugaugaaaaguucgaaagcugggacauauguauuuuccaagaugguuuuggcauuucugggacccuuguucuaucauguaauuuuugcaaagcagccaguagagcuuuugauagagauuguauugaauguagauuaguuagagaaguuugugcaucuuaccaauauuaaaaccugcaacccauaaauguaagaugucuaagcauccggauauuuaauuuucaguuacuuaguguuuucuucuucuucuucuuuuuuuuuuuuuuuuugagaugggguuucucuguguagcccuggcuguccuggaauucacacuguagaccaggcuggccuugaacucagaaauccaccugccucugccucucaagugcugggauuaaaggcaucugccaccacugccuagcguguuuuauucuuuuuguuuguuuuucaagacaagguuucucuauguaguccuggaugcccuggaacuugcuauauagacaagacaggccuugaagcuacagagaucugccugcccuugucuccugagugcugggauuaaagcauggacuaucaugcccagcuuuuuaguaaauggaauuuuuguuuuugagacaggauuucacuguggagcucuggcuguccuggaacucacucuacagaccaagcugccccugaacacagagauccaccugccuuugucucccacgugcuaggaguagcaccaccgccacguggcacguaaauagaguuccucacuuuauuuuauuuauuuauuuauguauuuauuuauuucauguacacugucgcugucuucagacacacaccagaagagggcaucagaucccauuauagaugguuaugagccaccaugugguugcugggaauugaacucaggaccucuggaagagcagucacugcucuuaacuguugagccaucucuccagccccuugacuuuauuuuagauuacucaccccgcuacucuguagagaugcagcuuaauuuucauacugcuuuuguaucaccuuuuaaaacucacuuauugccccuaauuuuuuuuuaucugugggcuucugaagauuuuuuaugacaaaauuaugucaccuguaaauagaaauaguucuacuucuuucuuuccaaucaggaaacauuuucuuguuuuuuuuuuuuuuuuuuuuuuuuuuuuuuuguucacuugugccuaaaucuaacaguguuaaacuagaaguagcaaaagcagacacccucauaucauuccucaucuuaaagggaacccagucuguccuucggaccauuaaguaacuuagguggggaguguuuguagcuaucccuaucacacugagagauuccucuuuuaauaaacauugccagugaauugaguaugauguuuacuauggagaaagcuagucaaugcugaauuuggaguaggugagaaaaugucacuucccugaaggggagguauuaugaugcuuccaggaucgcgagcaugcuguguucagauuaacauguggaagccugugugaacuagugcugcacagcuggaaucuuggcacuugggagacagaggcaggagaaccaugagcuugaggcuacccugggcugcauaccaagauuuuguuuuaaaaauugauauuguagggaguuggagagauggcucaaugguuaagagcacugauuguucuuccagagguccuggguucaauucccagcaccuauaugguggcucacaacuaucuguaacuccagcucuagggggaauggcaucuucucauguacaugguaggcaaaacaccaaugcacauacaauaacgaaaaaaccugagauauauaagcauauguaaaugauuaguccaaacuaauagcuuuugugcaauauugggauacuauauuccuaugagguauuuagggugaaauaaaauguuaccucaggacuagcaugcaguugauuucaacaaaugguuguuauauagcuacuauguuuuaagaagauguaugagucagcuuaggcugccauaaaaaaguagaauaggcaggaugguuaaacaaaauucuuuuacaauuuugcaaguguagagaugugcuuuuucacgugacaucacaguaaaggcuucaucuggcuuacaggggggcuaacuuuaaacaguggaggaaagaagucagcaaaaacaagucuuugaggcuuuguacaaggaccauaacccuauguuagauaucuguguuaggucucuguggcagaggugaaguccgugagauaaccaucuuacaaaaagcauucauuuggaucaguaguucaguagugugaguucucaugguuguuuggcucuuuugcuuucaggccucuggcaaggcagagcaucaugaugacagaguguggaggugggagaguuugcucaaugcuuggcggcuaggaaggugggagaggagagagggaagagaaaagaggguaugugaaggagagaaagaggagggggaaaagaaacuuaauauuuucuucauauacuggccucuaauuaccuaacuuccuuucuuuuagaccagugauucucaaccuuccuauugcuacgacccguuaauacagaacuuuauuuuguggugaccaccaaccauaaaauuauuuucauugcugcuucauaaucguaauuuagcuucugcuaugaaucauaauauaccuaucugauaagcaggaugucugauaugcaaccccugugaaagagucuuucaaucucccaaagaggucacaacucauuacaaagagaaccacuacuuucagcucaccuccuaaggauuccacaaccucccaguacagucauagucugcuaacuaagccuugaacucaugagauguugggaaacagaucuccaaauuacaagugauguauagccuguaaauccuuacucuuacauuagcacuuuggacaaguguugucccugugucccuguugugugcguacuggguaggaugcucugucccuuacaucuaggaccuaaagccaagucacuugagacucgaguacaaacuaaggcuuuagaaagaugaagaggauagaagucccguccauauccuaguacugcuuaggaaccaaugggaaagacuuuguggugguaugaguuaagguccaaggaacugaaccaggagagaagagaaaugugugaagccaggaagcccuagaaagcuauacagauuaaaaacauggauguuuguguguaguauugucuaucucuguuuuuuuuuuuauuuaguauuuuaauugaaucgauguacgggaugcaauguaauuugauaauguguaguaaugguauguaaugaucaaguuggugugaacaauauuuauaucucaaauauuuaaaaaguuucauccagguguggugccauaugcuuuucauccaacacuagggaggcagaggcaggcagaucucugugaguuugaagcuagucuggguguggauaaagugaguucuaggacugccaagguuauguagagaaacccuaacucaaaaauaaagaaacaaaaaaccaaaacacaauaggaaaaauuuaucuauuguuauauaaucauauauauauuucugugguauacuuuuaaaaauacacacauauaugauguguauuuaacauuuucuuaucacuuucuguuuggagauuucuauuauagaaaauuuaaaguauuuguaaaaggagagaagauguauuguugagcauauaucacgugauuucaacaguugucagcucggcucauuuguuguuucaauaguauacuuuacucuccucaaaucuagcuuuaaccaacaaaaaucuaacacugauuuuuuuuaaaugcauguaauuuuagcugaaaauauuuuaucaaauaucuaaaauauaaggaugcauccauauuagcauaccacaagcaauaauagcaauaauaauaucuuaauaucauggaauaucuauuugucaggcuacuguucugagcuuucuucuacagcaccaauaacuuucucauagccagccuuagcuuguaaaaaugaugaaaauccuaugauucuuaauuguucaguaaggcaaagaauauaagguauauauuuauauugcaagccucacacacaguaguacauguucaauaaagauuacccaaagcuauuaguaagacaaaacacaugaacuuccauuaaggcuccuuugugguugauuuugauuuauaaucaacagucauacauagagcagagcaaaaggauucuuuuugaaaaugguaauagaaauuuuuacaaagugaccccccuccccccaaaaaaaaaccuaccagagaacaacaguuuaaauugagaaguagagcuagaauaaaguccuuaucugcugugugugguucccugccuccccugggguuccuguucaccaugguaguaugacgcagauauugaaaauuucucucuuuuccuggaagacagaagagcguaugagcaugggggcugacaauacuggaagcuauuuaugguaggaaagaucauugcauuugaaagggugggagaucgcagaguaaagcuccaugcucccacuacccaugggccuggagugcucucugugagucagccuggcauggagucucuggaugugaggcagauugacguuguuguauuguccuuggaaaucccucuugcacugagauggccuguucuaggcaucagccgagagcuuuuuaauaaaaaugaagcccaaaggggaaaugauaagguaucugauuuuaacccaaagugagagaacagcagauguugcauucugucugagggucugagggagaaaaagcaauuagcagcugcuacugauuuagcaacagacaccugcuaaaugaaaaucuguaaacccggccaggcuuggcaucggaagcguguacacugcuucucaagcauuucugggaauuguaaauuaugcuggcuuaaaauggcaugcggggggcucagagacgcucaauauguacaucuggaccaggagauuaauuuucuaagauggcagcaucuuagaucuggccucuuugauuacuggacagagaacaagagauuggauauaacagcuagacaccugguuacucugugcuuuugaccuggcuauaggccaccuuuuaggaacauccuguaagaacagagugcugggaggggcugcgagcucaccaaggaaaugucucaaaauaggaugaagacauaacucuggguacuuuuauacguacucggccuguuauuauuggcucuucccaugauucaagcacauauuuaacuguugcuuugacuuggcugggaaggaaguuucuucauggccuuuugcuuucccagagucuuuuccaagugcguuuuaacugcugaucuccauauccauuuuccugagaccuacaguaaaaacaacccuuaggaacauaaaacuccaugaagagggauuuagggaccugcagugugucagguguguauaugcauguuggagagaaggauggagggguagucaagauaggaguuaacuugaaagaaggccaacuuguuagggugucuacuuggugauaaaacaacugggugacucccauuugugccucauucacauucacuguauguaccugccauuucugaacuaagauagaagucaccuguaacuaggacaaaagucauccauagauagguggaagggaugagccuguauuguuuccaggcuuaagggcuagaaccuuaaagaacaagucaaacacggcuguguucccacccuacccuugacucaagccuuuguggcugcugccauucugaaaacucauuggcgauagaauuacaguguuucuuuuuagaauggaagagcugucucuacugauuugagacuuccucugcuaaccagagucaugaugccuuguuauaaacaugguauauucugagagauccugggugauauauagccuuuacuaugcuaugcuacucuucuguuggccugaugaauauguaagagaaacaguuuaaaaugaggaaagauuuaguuuggcucaugguuucagugugugcuuggcugaauccauuccuuucugaacuugugguaagguaggguacuguggcagagaagcauuguagagaagagcuguucaugaugacuacgaagcaaaagggcagagggagaaaagaaggaaaagaagcuagcagcagaguuuaucuugccaggguguauucccagugagcauuucuucuaacuaguucucacagcccagcacuguauugccuguuaucaaggcauaguagcugaauccaucagacuuagcagaacauucggauuuuaauccaccugauggggaccaagcuuucaacucagggagcuuuuggagcauaguuuuuaucuaaaccauaacauaugcucucuguucaugaacaagguaggcaggucuagagccauacuaaguucauauuccagcacacacuaaagagcaugcucaugagauuacaguggccaugucaugcccagaagacaguguucuguaucacaccacgccuuuuuccaguucuuacacucuuccugcccuuucuucugcgauguucucuagguguuggagggggugaggcaggugacagauauggauuuuaaguguggccuuuuaaaaguuugguucucucucucucauguaugggguguaugcgcgugcguguguguguguguguguguguguguguauguauguaucucagugcauaaauauauagaggccagacauuguacucuaucuauaucucucuaccuuauuccuuaggauagauucucccacugaaccagaacuucgcuuuuucaguuagguuggcuauggagcuucugggcucaaccuguuucugucuucuaauacgugggucacagacaugugcagcuguguccaguuuuuuaauguugauaccugggaucugaacuuguguccuugugcuuauauaguaagugcucugauccacugagucaccucuucagcccagggcuaaauauugugucaucucuucagcccaugacuaaccauucaaacauucgucacuuugaucauuuaugagccucuguggucaccauugcccacuguuucuuugaccaaagcaucagcaguguuuguuuagggguauaaacagcugugugugugugugugugugugugugugugugugugugugugugcgugcguguauacauacacauauguaacuguauguauauacacacacuggaaagauggaucaaugguuaaaaaugccuaguguuuacauuagggugcucauaacccccuguaacucccuguaacucuagcucuggggcuucugaugccuucuucuggccucuguggacaccuauacuuuuguuuaaaugccuuuccaucaacauacaaauaccaauaaagaauaauuuuuuuggcuuuuugagacaguuucuuugugucacccuggcuguccuggaacucgcucuguagaccaggcuggccucgaacucagaaauccaccugccucugccucccaaaugcugggaugaaaggcugcccacuaccacucagcuuaauaauaaauccugaaaaacaacuaaaagaugcuguuugugagcacacaugaccacuguauguugaauggacuacugcauuuuaguugggaccuuuuuccuguuuguuuucuuuguaguugugucucccccccccuccauuucauggucauaugcccuuuaaauaaacugacauauuugcagugcaugugagucccacuaugugagucugagggauuaaacucaggucaucaggcuugguagcaagggccuugaccccauucgccugcugaaccaucuugccaguccuuuacaagacuuucuuagcaauugcuuuauugagauaaaauucacacagugaaaucuaucaacuuaaucuaaagguucacugcuuuuuaguauacucacaucuguacagacaaaccacaauauaucuuagaacauuuggaguggccccagagaagcccauuuccuuuagcuaggguuuccauagggcucuaggaucucacaagcuugagcaacagcuagucuauucucugcgaauagauuagcuguaaggcugcuuguucugugcacugugugcagaugguaucauguaguauuugcccuuuuguucugccuuccuuucacucagcaugcaguucucaagguccauccuuugcaauuauuaauaacauucaaucaaauggauauaccauucaaguguaugaauauaccaugcguuuucauuugccaguuuguggguaucuucauuacuuuuauguuaggcuauuauaaaggaugcagcuguaacuaugguaaccuuuuagggauagauauuuuuagggggguugguugguuuuugucuuuguuuuuguuuuuguaucuuuuggcuauaucccuagcaguguauauuagguaggaauuuaaucuuacugauuuacauguaaacucuauaauauuuagccuuaacuuagaucuuuguuuugacaaauaguuuuauucucuauuguuuuagcuuuucuuuccuuuuccuuuuaacauuucuuuuaaaaaugcauugcauugcuuuauauaaucaguggucauuuaauuaaucaccauauuuuccccuuuuuacucauuacuaugauuuagauaugguuuggagaguuuccuucccugaaccaaggcuuugguacugagaguuaauccuuguuacgcuauguugggauagugggaauuuuaucuggcugugauguagguguagagcccuuggaaaauaaguaauuuuugguacagugcccauguuugaauuuugauggcuucauaagaagaguaaagacuagaacacuccucugucccugcccuguugcuugccaggcaaaccuaugucuugugacucugcuagcaagaaggccaauaccacauaaggcgccuaaaucuuacaucccagaucuauuagcaaaauuaagccuguuuuucuuuaucaaguagcccacuccuaguaauuuuauuacucaugaaaagcuaauauauuugccauuucuuacugcaucucagaccuuuuugcuggcauuacuuuaugcuuacuuaaaguaucguuuuugaauuuucuuuggugauguucuacugaugguaaacccauaccugcuuuuuuguguguauguguauauauauacauagucuuccauucuugaaguguuuuucuuuuuuucuuuuucuuucuuuuugguuuugauuuguuuugcuuuuuuaagacagaauuucuauguguagcccuggcuauccuagaacacacucuguagaccaggcuggccuugaacucagaaauccgccugccucugccucccaagugcugggauuaaaggcgugcgccaccaaugccuggucuccccauuucuuaauuuucucauauaauucucuccugacugcugucuugaggucuuuuucauugcuccacuuuuucuagguucauauuucccuguuaaaaugaaauuguaauuuuccuauguuguguuuuuuauagucuuugcuuugaaaauaaucaguguaaacuuguacuaaaaucuuuucucuuuggucacucuaaagaaauucucuguauuggauguucugcaguuuuacuaugguauguugugcuguuaaauuuucuuccuucuggguugaguuuucucuuuucuguuuuuccuucaccacuuccucccuucucccucucuccuucaaucccaugaaacucaggacguggcacacagcagaccaccaaacuguacucagagcuccucagagcucugcaagucucugugcucaugucuuuuaaaagguuucugagcagucuaggcuggaagacuuucaagcacugccuuucuauucugaaacaauauuugaggagccuuguugguuccuguuuucccagcuguuagucuuucguuuugguuuguuuuuacuucuuugucuucccauacugcauuuuagauaauuucuucagcucuguaguccaguuccuauuaaguuaugcccaaugagcaauucacauauugaguuuuuauuucaguuacuauguuuaauuguuaaaacauuaaaaaguauacaagucuaucaugugaggugcugaagugauccuucgcuuauuuccuuguguguuuagguuuugucuuuaaauaguacuguucuucuacugggcauuucuucuguuccuuaggauccuuauguguggagaguuuuuugaguguugaguuucucuagagaggaccugucuuaguucuugauagucaugugaggacuacuaguuuggagacauaccaugugauauucucauucuaugguuuuugguuuacccaaguaguguguauucagacugugaggcaggcaccuugugguuugaggguguuaauggcgaagccuuuuggcuccuauugaccuaacucagcauuaaaauaugagacugggcuugccuucccacugcaaaugaagagaugguuugugguuuucuuguaccucuauagugauguguagcucuuugggcagggcgugucuuagcuucuugaagguugccucucuuagacucucugcaaaauauuuguccauucuucaugucuuguuagucuauuaaaaacccuaagcccuaacuuuccuuuuguuugagaguuuucuuuggaugcuacuguugauccauccuauggccucaugcaugcucugcaguuaggcuauaccuucaucuaccaauaguuccaaguguuuaaaaaaaacaauucaaacaauguuuuaugcaggacuuuuucaguggaaggcaucuuuaacaacuaauauuugauugauuggaaaugcguguguugaucuuguuuuuuuuuaacccuuucaauccuauuuguauagccuuguccuucuccuccguccuuguucugaaauagguaugcuguguccaguauucugccgcauucugucagauaucagaaauuccaguuaaccuauuuugcaguuaauggaauacuaauagcaguggccuugaguccuuaaaacaauaaugacuuaaaccaaaucucuacauccuagaaauuagcuuuuggcacaaggcaaggauaagugguugucguaaaguagacgcucaauacauauuugcuaagugaauauguuggaauccaggaggcauggagauagauuccagugcugaucaauucccauagaaguagauaucuuaguucccaugguugggggagggaaagaauauauagcaaaugcaaaaccauuguguccuuuguaaauuaaguuuagaugcauuccucuguaccaaaagaaggcugcauggaggugguauggcuaagagcauccacuccauaguccaguugucuaguuaccuuacuuacuguuucuaugaguaaccuuggaccaguuacucaauuaaucucuccuuucaguuucacuguauagaaaagggaaaauuucaaaccuaucugaaggacuugucuccagccagugccuguuggcuuaaugcuauguagcaacaguucuuaauugucauuacaguaauucugacuucuugguuguuuugagcacugcucacaucacuauucuaaugaauucauuuuccuggcagcugccuuccauuucuuugugauaauucucuagaguuuccacauuugccauucagagauuaggagcuuuuauuucucuaagugcacauugaacacuucugcacccaaauauccuuagggagguuuaugaaaauaaaaacugcuggguccuauccaaagacgauuauuuuggugccaauuugauacagauaaaaauuguacacagucuauguugggugagccaggaucuacucagaguuuaaauuuaacaaccgucaguguugauagagaaucugggaaccuuugaagccugggaggagauagagaaugggagcaaggaguaaaggaugcagagagaagugaacauagucugaucaugccaggauauauauagccaagcaccacucaccucuuauggcuucaagagaaugugauguuugacugucauugauauagagaguggugggauuggcugaaggucauaguaggggauauagggugaguuaagggacacaguuaagauagcaaggccuggaggccugcaucacaaugaaugccugccugaaaaaaaguccccuuccccagaaaugugucuccuagagaguagaagauuaauuagauccccugcuuggcagcuaugggguagagggcaggcuggguguccuugagcuguuuugacaagacguagaaacuuugguccuugccuuugauuuagugccaguguacugaccuuuucucaagccacucgaugcugaaguccuuugaagucacuaaacuauggaagcagagaguaccauggauggccugggcuaaugagaacuggcaguuuagcucuccacggauuuaauggagccugaagcaggacagaaugauguuugcuuggugagugguggggaaauucccccuuugagguccuugccacucuacccaagcgugagggccagccuuggacaggucagucuguauguguacccaggccucuacacacagucugacuggccuuugccuugcacuuuuccuccauuccucuggaagcccuuaaacuaucucugguuuuagccuuuccuuugaguucugcugagcgauacaaauagugacuuucucugcuugugugaaaaaucaaacgaguuuguugcuugacuuccaagaccuguacucaaaagguugccuucuagauugcaucacaguugacccguggcauuguuuguaaacauuugaaaacaugguaaauaugaagaugggaauuaaaaaaaaaaggauuuauuuauuuauuucauguaugugaguacacuguaacugucgucagacacaccagaagagggcauuggaucccaauuacagaugguugugagccacuaugugguugcugagaauugaacucaggaccuucaggggagcagucagugcucuuaaccacugagccaucucuccagccuaguaagccaaaggaaauuaccuucacuuuaaaaaaaaaagauguaguuguuauauuuagaugaguacacuguagcugucuuuagacacaccagaagaaggcaucauauccuguuacagaugauugugagccaccaugugguugcugggaauugaacucaggaccucuggaagagcagucagugcucuuacccacgaagauggggaauuucaaagccucuguguccacuccgugaguagugccuauaucauagucuccagguaggacagucauuugggucucacaggugacucuaacucuuuucuaucaguagagcaguguagggaaugagagagaccacuaugguagagaucaugcauucagaagucugauuuuuugaguucaaaucuugacauagucauuuaacaagccuuaaaacuauacacaagcuaauuaacugaaccugugcauuccuuucaaauagaucuugggugcauacugcuuaggugauaacauugacaauuguggguuuguaacaucuccaccauucauccgugcauguuuucuguucauucuauuugugaaugcauuuguuuauaggcaaugcaguuucuauaagucuaccauaagaacuaaccugugugcuauccuuccaauccugcuggcucuauccuuaauggccccaggagaaaaccguuagcuugagucaggguuaguauuccugugcuuguuuuaaaaacuaguuucauaggaaagcauuucuagaaggcaggcauagugugcacaugcagcagaaacaguguucgcuggccgugacagggcgauggcacacauagucacaugcacagcagcugggacaguaccuccacaagaucaagcagccaaaauaacagcaugggugcaagcagcccuccugaagcccccauccagucgccgagaaacuauuggccauugauagcucuugagggagggaaaguauauuuucuucauggaugugguugcugaaagguuggccaugcuccugucuuacacccaugcccauaccgacagcaccaccuaaacucaguggguuuccgaagaacagagcacaugaaaaugggagcagaaagugaugggggcaugcaggaagaauuggaguguagggaauuugaucaauacacauuauaugcacauguaaaauucucaaaagagaguuucaucucucagaugugcagauauguucauaagcaugacuaugcaguuacaauuuccuaaauaagaugucauuuggguuucguuguucauuggcuuuuaugaagacgauaucauguguaugucguuuucugggacuuucuuggucuauacagcaguucguuaccauguauggaaugccuguaacuauuguuacauuuuucagugugacauuccauugcuuuaauagaccccagaguccuuuucuguucuaccugggcuagccauuugguuucuaguaguuggccauuacaaaaagggaagcagucucugucucacauucuccaugguggagagugugucucuaucugugacagcaagaacaugggacagcugucgccuugcauccaguuaggaagcagagggcagugaacaccgcuuucagcucucuuucuccuuuuucccauuuuauuccgucuagaacagcagcccaugugauagcaucaacacucagggaggaucuuucccuuucagucaaacaucuuaggaaaugcaugcacaggcagcuuagagcagcgguuuucaaccuaugugucuccaccaucagaaaacacauauauucaauagucugaggaacugagacacuacucaguagccaaauuacaguuaugaaguagcaaugaaauaauauuaugggugggaggucaccacaacauaaagaacuguauuaaagggucacagccuuaagaagguugagacccacugucauagagguaugcuuucuagaucauucuaugucuagucaaguugaagacgaagauuagacaccacaauuggccaggguauuaauuggcuaaggcugcugucauaaggacauucuucauagguguaagagcaagcugaaucauucucacccgaggcuucucuuugauuugucgauggccuuccauuuuauuuucucuguuuuaccuucucucuagaggauguuggguggucuauugaauuggggccuagugauaauuacagccuaccuguauuauugcuuuaaaugcucugcuucuagauacagucauguaauaagguauugggaguuacaguguuaauuugggaggauaguugaauccauuagaguuuggaaguaugagugguuaagaucguuauguucauugcucuucaucauuaagacucaggaaaaugcaacagauuuuguuaugguauauauccuaggaacacuccacuguagcugcuguuacuacugcuccaguuguuaugguuuuuuaucacuaagcaucauuauaccaccagagcaucuucuuguuucacccuuccugucagauaugacuucagguaccaacaacaguuacccagagugguguuuggguauuucccauguggacagguagcaggcuccaaucaguuacagggggaaggacaggaauuaagaguucauuuuaaccuugguuaaaauaaagagcuagguaaagccuugcagaauaccucccagcaaaaagagcuaaaccugccacuccacacaguucuaccagccuguucaaacaagguaggcaggucugggcugcuaugucuuucacaccaggaaauacacaugccaagguugcugugucaucagagcaaguagcaucuuuauugggcucaaaauaccuccuuugacacuaaggagcuuccuguggucagccauuauggcaaucauaacuguauuccugguuacugagagucagaauacaaagaagucagggauaguccugagggaaagagcagugcuugugccuggacucauucauuccaccaugucagaaaagggagugaggcggauugcaguaugccuguuuuacgaugugggcaucugaccucaaaagacacgugaaucaucaggacagauacuaugguaccacaggaucuugggggagucgggggaggucugcccuuugcuauuuuuuuuuucugugcugagaucauuccuaagagcuugagugcucuuagcaagcaaccucuccaggucacaucccuuacauagaaacuaauagcaguuauuaguugcuagggaagagaaaauuauucuuuuuugaagauguggcugcugauagguuggccaugcucuaguggauggccccacuuccgugcacuuauaggcagcacuaaaugcauuuagaagacgauuacuuuaaaaacgaggaagaggacaugaacuugagaguuuaguuacuguaguucuccaagccugaaaguuuauacaccaagagaaagaacuauaaaaguaagagaaaacgucaacucuaaucaucauuaguaacuuaauucaucuucuugccucccucccacacaaacacaaacauuuuagcugguugucauggcucauuccuuuaauccagugguugucagccuuccugaugcugugacccuuuaauacaguuccuccuguuguggugaccccaccccccauaaaauuauuuccuugcuacuuuauaacuaauuuugcuaucguuaugagucauaauguaaguaucugauaugcaggauaucugauaaaugacccccccaaaugguuugcagcccaaagguugagaaacacugcuuuaauuccaacaggauauagauucauuuggaucuuuggacccucaaggucagccuggucuacauagcaaguuccauggcuacuaguacugagcaugaaugacagauauuguauauuuucucuuguaugugguccuugcauuuuauguaauaacagaaaagaagaaggcauagaaaaauagaagaaaaauuaucuaggaggaaaaagggaacaaaugggaaggugagagggagagaagguuggggaagaauauguucaagaugcaauauauaucugcauagaaaugaaaaauacccagaaaauacaagcguauucuauacccuauccuuccuauuucugcuaccaacaaucacauucauguagcacuugcuuugccaugucuggcuuauuccacuuagcauaauguucucuagauucagccagauuguuuuaaacaacaagccuucauuauuuuuuuuuauuuuauucauugagacuuucauauggguauacaaugagauaugaaaaauggucaucuaaccucucauuucucccuccaacuccuuguagauuuccuuuccauguguaccucccaaguucauguccucuuccucauuuuuaaaguaauagucuucuaaaugcauuuagugcugccuauaagugcauggauguggggccauccacuagagcauggccaaccuaucagcagccacaucuucaaauaaagaauaauuuuuccuuccccaguagcuaauaacugccauuaguaccuggagagucugaaugcuauccacugcaaaucuauacuauauuuucuauuuuuagaagauguauuuuguguguaugugcauaucuugguguguauaugccaugcuguguagaugcucaugaaggccagaagagggcauugggucuucuggagcuacaguuacaggugguugugagcugcuuaccauggacacugggaacccaacuuagguccuauagaaaaucagcagucuccccauacccaauauacucuauuuuuuuuaucuuuacaucuguugaugggcacuuagguggauuccauaccuugacuaucauggaugaugcugcaauaaaauaaacugcagaaaaauauauacugagaaaauuccuuuccugcuagaccggcaguugcuguuaacagugagaaaguaucccucuguugaacuuuuuauggcuuuaaaauauuuuaguuaugcuacuaggacuuggcaacuuuuuauuuacuauacaauacaccuauaaaaucauaagaaguccaaagucaagaucucaucuucccuuuacaaacuauugucaauccuucccccugcucagguuaauggguuguacuccagucuuuucucuaugcauuaaccaucuaccuaaaggcauguuuacagacuuuucaauuugccuucuauuaagaaggaucacauuuuauacaauaugaagucguucucuuuuaccuagaaaugcuuaaugccuucuuuaaaacaugcugugagguaguucgucuuccaguguauuuccuauaauuucccauugguggucaguuagcccgacccuuucuuuuuguguguuuacuuucuguauuuuggauugcuucuaaaauuuucuuugggagauagagagauggcucagcaguuaagaacacuuacugcucuuacagaaaaccgggguucaguuuucagcacccauguggugcucacaaccauaacucuaggcccaaggcaacuacugaugccaucuucuggucuccacaggcaccaggcacucacauugugcacauauauccacacaggcagaauauucauacacauaaaauaaaaaauaaauaaaucuuuuaaaaaauucuugguaauuagaucuaaguuaccauacauuucuagaggggagaugaccauuuaaagguuuuuuuuuuuuaaagauuuauuuauuuauuauauguaaguacacuguagcugucuucagacacuccagaagagggagucagaucuuguuauggaugguugugagccaccaugugguugcugggauuugaacuccagaccuucggaagagcagucgggugcucuuacccacugagccaucucaccagccccaaguuuuuuuuuuuuuaauaacaguugacaaauuauucuccuaaaccaauuuuaucuuuuucaucccccccaucacacaguuuugcaauauugguucauguugauauaugucacucaaguuuaaaagaauucccaacauguuaguacgcaacuauugaaacauugaaaucugaaauaauaauagcaccaacugcucccuccacauucacuuucuaagugucuccuggucccaaacuugcugacuguuacagacaaguuuauggccauuugaucuguuucugccuuccauucuuaagaauaaguaugcccucuugcauagccacaacagcauaaccauaccccagaaaaucaauaauucucuuuuaauaauaacuugauauucaaauuugcucaguuauccaaagaauauauauaacauuuuuaaaaacuuccaaaugcugacaccauugcauacacuagcaagauuuuguugaaaggacccagauauagcucucucuugugagacuaugccggggccuagcaaacacagaaguggaugcucacagucagcuauuggaugggucacacggccccuaauggaggagcuagagaaauuacccaaggagcuaaagggaacugcaauccuauagguggaacaacaauaugaacuaaccaguacccgggagcucuugucuuuagcugcauauguaucaaaagauggccuaguuggucaucacugcaaagagaagcccauuggauuugcaaacuuuauaugccccaguacaggggaaccccagggccaaaaaggggcaguggguggguaggggauuggggguggguggguaugggggaccuuugggauagcauugaaaauguaaacgaggaaaauaccuaauuaaaaaaaaaaaacucaagugcuguggacaugguucaguggcuaagagugcuugcuaugcaagcaugaggaacugaguucaaauccccaguacucauguaaccagucaggggugcaguggaugugauggugguacugguaagauaggagaauugcugcagcuuguugguggcuguguaggccagucgaagcaaaacaaaauaacagcaaaaggcuggugaucuccauguucagccagagacugucucaagggcagagggugaauagccacaaaggaagacaccuaaacucuuuccuuggucuuugcacuuguucccacuugugugcugugugcauauucauauacuuacacacacacucucucucucucccucccucccucauucccucucccccccccucuugcucacuaucucucacucuccagucuagucagaauauaaauauugguuugauuauucugugucuuuaguuuuuauggauuuauuuucacacuaagacuacaucauccccuucuucauucaugauauggcuuuguguagucacuuuaugggacaguccacauucuggauaugguaaggauuuccuuaauuuuaguggucuuugaaaguacuguugcuucuuuaccuagcucuuuuugaugacuaucuagguuguggagcuucuuuuuauggcuccucuaacagagaauuaguuccaaggauuuuguggccccacuuugccacauaaagccugugacuaguuaaugaggacaaacuguuccacagccaaauguuacuggaaggauuaaugccaagagcaguuauaccuguggcuauauccuuuccauuuuaaacggcuauggauaaacuuuuguaacauccuggugucagacccagauucuuuugccauaaaauuauuauuauuugggagguuuuuuuuugguauguauguaugggguugaagguguguguguguguguagggcagaguacaguuuucagaauuuggucuguucuggggauugaagucaugucaucaagcuuagacagcaagcaucuuuaucugcagagcaaucuugccagcuuuacacgcaacucucuuaguaacgccaagcuccugaaggcuggaaugagcuccuccagcacacaacauggagcccaccugcaagcaguuauucuuauccccgucuggcuuuccuuaucuccugguagccugaggcuagcgcuuugcucugugcuuuggacccuuugcccuccugccugcuuccuguucucuaugucuagugccuuuugccccucuugcuguuuccucuucucucaguccacuuugaaucuauaaauauauuuaggcuuucccagaguuaacaauuaugucucuauauugccagugccucuuaguuaaagcuuucauccuucuaucuauuugaacuucuugaaagagaacaguuucuggaagguguagggcaucugguguuauuuuggaguucuugaagaaaguguuaugaguucugugcguuuuagaauuucaaccaacauguuuguccauguugaucacuugccuuauuucuacuccaacucucuugcaggauagacccucauucccguagcucuucuaggugaggaacacugaauagcauaaggcaggaggguucaccaucauuugagaggguugugaggacaacagcaucuucuuggagcuacugauguauuucuuaaaacaagaagggauuggauuauccugagaagaauuugugauaugagagauugcacuagcgauggacagggagacccacagaauagagggggaucucaaaaauugggaagggaugagaaaugagacagaugagaaggaugggcagagacuuagggaaguugggauucaggcuaccugggugucuuggcugucuuuuggcgacuguaguaaacaugacugggggaugcaguggacuaggccugcacagcagaacaugaugguggggccaucagguuuacgagaugggaggaagcagguuguggaccuugcuauggacagagucuauguauguuucuaauguuuuguccaguccagcuucaaaggaccagauaauuuucccuuucauguuaaaaaucaucuugacuuggaagugagaaaaaaaaguuagcgauagguuuggcucaaauccuuguuuuauugcucaugacuuugaguugcaucuuucuaagaaggucggggcugcagcccccggauucguguggcugaaaaagagccauuaaguuuuuauuaucugucaaaugugucuaaccauuuccccacgucuaaguacuucaugggaaauuugcacuaauuaaauguuauaauaaugcagaagaguuuauuuaauacaucgcuuagugcuuaauagacgggcuuaguaaguauaauuuacuguuagugauaagugcuggauuuucagcugccuuuuuggcucucuuuuuuuuuuuuuuuuuuguuacuguguguguguguguuuucccuucuuccugcuacuaauauaauggccuuauagcucucaguucucuucucccuuucucuccuuauucucccacacuuucaccuuuaugucuuuuacccuaccuaacccuuguaauuuggcaucuguccugaguucagcugucuuuguggcauuucaucauuggcaacucuugaagcaaggcaacccucacaggaaggaaacaggugggaacagugucuuguguggguugaccucauugaaauaauuaaguuaaauuuuuuuuuuuuuugcuucugugccuuggguuugucauuugucacaggugauagauuucauaaauccugguauaaaaauauugaaaagcauaaagcaauacccuaguuaaaaccacugucgucaucucuaaacauuagggaucaauuagguucacguuggagccucuugggccaccauaccagccuucugcuagugaugccauguggcagauggcagaaccagcuguagcauauucuaaagaguacuuggagccuuaucuuuuuuucuggcuuuagacauuccugugugaacaucaaguaguagcuguguaucaucuuguccccugggaaauuuuccauuaguuguaaaauucuguagucaagagccagcgccauugucuguguucaggguccacaguuggcccagcuaccauucugggagcacugccagcucuugguuucagcucuuggcacaagguggccuuggguuccuggguuuuggguacccauaacuguuugcucuuauuaguacacagucuugauucuguacuucagcugaacugagcaaggaagcaccgggcaucuuuccuggagucuugaugcccgggcuugccuuggagucuguguguaccuaccuaccuaccuaccuacauaccuacuuaucuaccugcccccucccucccuaguaugcuaggggaacccuagcaaaauucuuuuuuuuuccuccagaguugguuagucuggcacugagguuugucuuuuuguuuuguuuuggucuuuuaaaagaguaauucuuugaggacuucauucaguguaucuuuaucucauucuuucccauccucuaagcaccucuguuuugaggaagaugcuggauauugggagggcaaggaagaacuuuuugguaaaacauagcagaauuggcccggcuuucuauuaguuacucuaaaguaggguaaacccuccacugacauccaaguauccugugggaaaccucuguccuuggaucaaucuggacuugaccagaccuaggauucuuuuuuuuuuuucucucacagggaagaugaguuuacugcauccuccuuugaguguucuugucagacgaggaguccauuugaaauucucugccauuugcugucuaggaguggaacuguaccguugcuucuucgaauguauuuuccagaguguuauuauuuauuaaugauuaaaaauuuuuuuuucugaaagaaacacuugagaaaguuccauagcagccguguuaggguagcuucccucuuugcagaaaucacugaaguccaucguucacuaauggucugccuggugaaccucuugaguacauagcuguaugcaacauccauucaauuuuaauacgcuuuuaccagccgagugcuuuccauggacugucucuguaaauuacagcucgagaggugucaguugagaugagaaguauauucauguuguuauuuuuuuuuuccuugaauugcgaagggaggugacuggaugaagugauggaguuaucccaccuuguggcuccuacaggcuaaggggggcuagguucugaacugagucuaaugagaccacuguucugaaaugccugucuccaucuuauccccacagcuccccuuugaacuagagauuuacuacauccagcaugcuaugcucuacguggucccugucuaccugcuuuggaaaggagguaaggccaguaaaccagaugccucuggcauccccacacucacucugucuuucucuuucucccucugucugucugucugacugucugucucuggaggagucacccccucuugggugccugccaggaucuugagguggugcuuggcugaguagcuacagcaugcuuaaugccagucuccaggcacuggggaagugggcaugaguguaaccagcaaagaaccaccccuuuguaaucgagcaugguaucacugagugccugucuuaggacccaggguuuggguuuccgguucuugguuggugguguccuaggguuugcacagcagccggaacacugugcuguucuuauugcuuccgccucccccugggucaggguguacuucagaguaggaaagcaggaagcgcuccaucuucuccggagagagacuuugcauucuugcuuuuuaugucugugaucucagaaccggagaagcuccggaaagggugagaagggcacagaauaggagauaguggaauugaagagaggcagaugaaagcaucguccuccauauaagaaaugaguacgucugucccugucgcuaagacggagguagcgcugaccuggcagaggcaggcugcaaagggaacugaagcucuggugcucucugcuggagacugaaggcugucguucucuuguaucccgaaagcguccagaaguggaggcuuuucucugcagagccugucuguccagguugcugggacuuucugggagacaaacccuuuccuccugcauuucaggcagccaaguuccauuucugucacuuuaaacauggccugaggccacgugggcccuugggcucaccagcugucguccccuugcaguauuuacugguccugucagaccaguuuuuccaaacuugacuauucuuugaggcugcuuuaaccuaccacuaggggucucaagcugcuaaggaaaagucgucuuuuccuuacugagcuuccagagacuucugacauuccuacguccaggagacucuugccguuucccagcucuggcccugguggcaugggcagugguuuaauuaguaauagucaaacuuaaggacgacaugcauuccgaauggaaccaggcccucccccagccccauagauagcuaucuuauugguacuuucuucugagaugggugcuuggaagugugagcaaauccacaugcuuguuacugaaaugauuuuguaccuucuuccuucuggggugggaguggggggaauuaaggggaagacagccuaggaugggaugccagcucuaaauaggggugauuuucugcagccuucuguugggucaguuucuguguucuuggaggcaggugagcugaggaauuuggauucugagucuacauggcuacucucuuucuaguuuaaaaaaaaaagauuuauuuauuuaguuuauguauaugaguacccuguagcugugcagcuggcugugagcuguuugcaccucugcucgcucuggucaacaccgcucacucuggcccaaagauuuauuuauuauuauaaguacacugucgcugucuucagacauaccagaagagggcauuggauuccauuacagaucauugugagccaccaugugguugcugggauuugaacuuaggacgucuggaagagcagucagugcucuuaucugcugagccaucucgccagcccccucuuccuagauuuaaagacuccuucacuuccacuugaggagaagcuguggcaccagcaacggugaucaaaaucacaguaaacaauaguaacuaccuuuuuugugagugcuucuucugugcagaauauguguacuaugcauauuuuguuuaugcacacuguuaaauagucuauucauggauccugcuauggacaagaaauuuaaggccaaguacauuagauacucacucaguccauugcucuaaggaacaaagcuagaauucaaaggcuagccaaacucccuucccugacuaagacuuucucccacggacaauacuguccagagggcuagauguuuuugucuuuaccacagcagccuagaaaucccguuccauguguccuuucuuuccugcuucacuucaacaauuuauucaguguggacucaucgaaugccuccuauguggcaggcauuccuaguugugaauggggaacuggggaagccagagcaucgcaucgcaucgcagcacagcauaguaagugccacagaguggacagaauguggaaacaaugcuguuuccaaagguuaucuguacauuccugcaccauuuccaggaagauaauuguauaucccuagaggaaaugaugcuauuaucugaggucccuaacucacgagaugcaaaauaggaccauuagaagggguggcacguucuuuuaaugcuaaucccgcauugucacaugagcguggggugaggaucuagcugacaagacacgaagaaugacgucccuuucacuccaggucccggguuaaagcaccuaaccaaccuauagaacuagaaggcccuuuaccuucagugcuaaugcuguagagcgguuucccugggccugucuggguuuuuccuaacucuuugcugccaucugcuguucauguggggauugugagcacgaagagaaaacacuguaucucuuccaaaguaaagcuaguguugcuuuggguccuuggcccugggcucuaccccuucgggaggaggcaggaaucuggagagaugagaugcuaagucccuuggaagccaagaaaacaguuucagguuccuauucucaagacucugagacauuuccugaaagaaacgcguggugguuuuaacucaagauuguuauucuguacgaaugucuaggguucaggagugcuguauggcaggaacacaaagucccuguuccuggagcugggcugucuaauguuaaguaggaaucccauuccuuccucauuuccaccaaccaucccaggccacauggccauucuuguccacaaauuucauuuccugccuggcacuuccuuuccucccaacacuuugccuuuaguuuccugaauuaaauuucccuuuaguuuuuuugguuuguuuugcuguuguuguuguucuugucuuuguuuaugucucuguucuuguuaauguuuguguguuuuucuucauuguaucuugcacccugcaaucguauaugcacauagggugagcugcgauacugcauaugcugcagaaagauugaagaauaaacgauguagagagauugaauggugcucaucaaaccaccuggccagcagcucuuagcagaaccaagacuccuauguuuucuccaaggcugugccguggacccugcccuguguguugccuggcaacuguacuguccucucuaguuaauuguuucaucuccacuucggggaaaugugcuuucucuuuuuucaggcucuccaccccucccccucccuucaugcuucugguucucugaccuccaccuucugaauguggaaugggaggcgccuaugccuggcuucuguagcaucaggaccaaauucaggaucuugucuuuacuaggcagcagccugucaacugagcugucuucccugcccaucucuccucuacuuuugaccacuacugucaccugauuuguuguuguuauuguucaguucccucacauucucugaaguguguggccuuugguucucaguauuucucuugcagagucaggcagcauuccgagaaaacuuuuauugaagaauauguuaguagcaucccucccuucucaagguuugggccuguugagcucuagcuuccaaacgucaucaucguuguccucgucgucguugucguugucauugucguccuccuccuucuccuuuuuuuauuggucauuuauguaguucagugaaagggaguuuguguuucacuuaguugucagcaugguuacaauaauuuuuuauuggugcauuuguacaaaguggggcaucucaguacagcauuuacacagacacguauauguguauauguauauguauauguauauguauauguauguaaugggcucugacuauacuugccccuucuaccacccucaauaaccccucuccucuuccacuuccccaccucuucugcaucccucguacuucacguuuaguuuccugucuucucccaccccuagcuuccucagugagagaaaaauguggcauuugucuuucuuauucucauuuccaagcauccuucuuuuuagcuccugggccuuguuuuucucugaaauaauaaacugcuacauccauuucuuuggaccgugacgucauucuuuucaacuucuucucuucccaguuagcuuguaccaccauggccagucagaauuuuccuuucuuuuuuuuuaaaacaaugcuguucaacacucuauucaugcuugcuuuuuuuuuuuuuuuaagauuuauuuauuucuuauaaauaaguacacuguaacugucuucagacacuccagaagagggcaucguaccucguuacagaugguagugagccaccaugugguugcugggaauugaacucaggaccucuggaagaguagucagugcucuuaaccacugagccaucucuccagcccuggaauauuccuuucaccagcuccugagaaugucauaucccccuauccccucuaacaggagcacuuuccaguuccuuuguagugugcccagccuuagcccaguggagaaaaucaagugguucugacgaaggccauugaggcauaccuauuacaguguaacagucagcaccauuuucugucuuuguuuagauccuccacacauugccccaaguaaugcugagguacaaacuuuccccaccuucuucaagcguccugcccacuauauucaaccuuccuauucuuuguaugcucaaaauucugccuguccccaugacugcaaagccagaagucaacauacggggauucuuguaaugcugcucuccauuuccuucaccucuuuauucacgcggagucacauguuucuucugucacaucuuuccuacccuccacaccacuggagaaccgccucauuuuaucaggucaggguuuauuugucugguuuuugaguuuuguuuguucgggguuuuauuuugguauuuugagacaggguuucucuagguagccauggcuguccugaacucucuguagauggaauuggcuucuaacucagaaauucaccuacuuccuggaauuaaaggcaugaguuaccacugccuggcaacaguguuuccucccuccuucccuccuucccuccuucccuccuucccucccucccucccucccucccucccuuccuuccuucugucuuuccuuccuuuuucccucccucgcucccucccucccucccuccuucccucccucccuucuguccuuccuuuuucccucccucccucccucccucccucccucccuccuucccucccucccuucuguucuuucauccuucuucccucccuccuucccuuccuuccuucuucucucucucccucccuccuuuccuucugucuuuccuuccuucuucccucccucccucccuucuuucuguccuuccucccuucuuuccucccuccauccuucccuuccuucuguccuuccuuccuucuucccucccucccucccuccuguccuuccuuccuucuuccaucccucccucccuuccuucuguccuuccuuccuucuucccuuccucccucccucccucccuccuuuccuucuguccuuccuuccuucuucccucccucccuuccuucuauccuucuuuccuuuucccucccucccucccucccucccucccucccucccucccucccucccuccuguccuuccuuccuucuucccucccucccucccucccuccuucccucccuccuguccuuccuuccuucuucccucccugccucccucccucccucccucccucccucccuccuuccagcaguuugucgaacacuuaagcccugcucagcucuaucugugcaucuuuguucuucucaaacauccaaaaacuuuuagacuuguccaguccaugcucggcacagaaucauaaacguaguuaaaauauuaugagucuucuuuguaauggucuuuugugacuugguucuccagcaugaauuuuguagaaaccacaguaucaaaaggcuaagcauguauagcuuaaacuagauuuccaaaacuugucucuuuugcuaugaugaggguuuuuuuugggggggggguugccuuuuucaugugaacaacuauuauucugaaugugauauaugucucucaaucuauugaauuuuauuuauauaaaccacaaaauaugacuauucuuaaggcaaccuucauaauguucgauaaagcauauagcuuugauuuccuggcuauuuuuagacacuugcaaucuauaucuaugucuguauaucacuauuaaaaugauuuaccaccagaaauccccuuaugaacauugugcacuugcagaaaacaggcgucuguuuggucugagucugcucuguugaguaucuuugcuuacaauagugcaauccgacaucugcucuuuugccagggucuucacagaaaugucacugccaaagaucaccaacugcaucgaucugaccaaacgucauaaucagccuuucucuaccucuagcucuacgucaguggagauagugggugcccuuugacacguucuggauuuagccuucucacgucuaccuuuccucugccuggucuccucacugaauaugcuuucacagcguccuuugcaggaccccuuucuguaguccucuggggugucuuuuucccaagaggucugucuguucuaggcacauucucccucgaagauacuggaaccauuugguauauuuucauagcugaacuguccauuggugugaggccagcugcugccaccauccacagcccugauuugcauauggaggcaagaaaguaacuuuugggaauggcucucuccuuccaccuuugugcagguuccaggcauugagcucaggcuucaaggccugccugugggggaagcuuuucaccugcugagccaucaugccagcaagucaugaggcauagguuuuagaaagcucuaccugacuauccccagcaugccugcuucagccugacuguaccuuuucaucuaccucuccaguguacuaucuuucauaucguacccagugacaucacaaagucacucuagguagaaucuagaaagauuccugcucccaggauuccaccuccccauccaucuacucuguauuuagugcuuucuuucagacacuuuaguacuggccacuagggcgcgcuaaugagcgaacuucagacagugcugcuucccacucggcuuuugugagccugugcccugggagaaaagaaucaguuauaggaaggaagggagcucacgcuugugagagcaugggacaaaacaagcugaccuagccugggggccugagggagggauggagggagggaggagagagagacagaggcacacacacacacacacacacacacacacacacacacacauacagagagagagaaagagagacagagacagagagauccccucugggaagguaacgcuuaaauggagauuggaaggauaagugggaaucuaccagacacauagagcuuuaggggccauggacccucguggcuggacagaaugucauauucaauagcacuguggcaagguuaggagugaggaaggggaccgugugacacuggacccaagccaagcgacaggugaggucaggaauaaaaggcuuugugaaccauucuuaguauuguuguuuauucaacaugggaagaggcagugaaaaguuuugagauaaggcuggcuuauuuuacacguuaauuauguuccugcuucaagcuccuuuauacaauuuacaaaccuuaguuuaauagauaacaauaaauuuuuaaaaagccccugauauuaaaagccuccuuucuacccccacacuccaccccuacccucaguauuagagguagccgccacuuuggguuuuggcuagccuuccucuguuccuuuccuaaguuguccuucuaugcccauggguucuguugcauuguuucuuuaugugcaugcauguguguuauaacaugcauguggaggucagaggacaacuugcuggauaugguucuuaacuuauaccauaugacuaccaaccucauguccucggugggccuucacccacugacccaucucaccgacucccagguuucuguugcucucuccaucucuugguucagucaaacauuauuugaaaguuuuuuuuucaaaaauugucugcacugaacauguacagacuuuuuucucauuauuguucccuaagcaauauaguauaacaauguuuaguauaauguuuauauaguauuggguauuguaaauuaucuggagaugauuuaaauuauguggaagguuuguguaugcuaugugcaaacacuguuccguuuuguguaaucgucuugcgcacugcuuauuugcguauugauguggauuccuggaaccaagcccuuuggauaucaagggauaacuauacaaggaaaugaucaaaaaauugacuuuacuccuuacgccaaacacucgaaaccagcaugucugcgcuugccuuuggagcuguugcuguguuuuagcuuagacacucguuucugcuaggcuacacaguaucuuucccuuugucuuuuuuuucaaggcagcuuaauauuccauaauacugaugauggaauauaguauaauaaaaauggcaguacuuucucuaucacauaaguaaugacagguauuccuucaaguguuagcucauuugaccccaacaaaacuugucaggaggcgucccugguaucuuccauacgcuugggaggaaauggaugucuagucaacggcagguccaucauuugcacucaggaccguggauugagccuguuucauuuuacacaguaacaugggguuauaagaguaaaccauaauuuuuuuguugaugugcauuuggguuguuuucacacagauguaguagacaaugcuuuuuccacucuugcauuuuugucugucuggugggugaaaaccaaaccaaaucaagccacaacaaaacaaaauaguacagugaacuuggaaugcagccgagcacuuuagagacauguuucucgucugccugucuuuccgugcucgagacagagcccacgacugaugugcggcaugcacuuccccacuaagccauacucccagaaccuucuuacagauguggcggauuauaucugcuuccccagucuuugaacuccaugcgucuccucagugcucauguuucucuucugucuucagaugggguugcaguagcuccuuuacauguggauauuagggguuagcagguuagcagacauggcccccagaauugucuuugaacuuuauggucuuauuuaugcagauuuuuuuuuuuuuuguaauuuaacuguaugugucuuuaauuccuuggcuccuggauuuugaguuguguuaagaaguccuuucucccuccacggugcuauauaaacacaguaauccuccaguauuuaucugugggggggauacaguccaaggcucuccaggugggugccuguagguagcaucaaaccuuguauacacuugugguuuuuuuuccuuugauaaugucuuaaauuagguuuaguaaggggcuaauaaauaauagcuauuauuaaaauaauuucaaacuguuaucucuagagccacucccaagggguccagcuuuggcagucaucacguucagugguggcaguuggcuccuugugguuuuccauucaccuuaacagccccauuccacuagauucuaaaguacuaaauacuuuuaaaguauuucccuauuuaggaacuuacagugguucuccuuauagccaguggcccaaaagaccccguguaacccagccugugacuuugcuccauccccauuuguuuuagucccuuccuugcuguguaacaucuugcugauaagggaauccuuugugguacccgagcuuccaguucccaucucugcaugugcuuccagcccugcagcuucugcucugacuagucauuucccugucagcccuuggccuggacaauauucucuaaacuccccucagcuauggccuucuccauggaagaggucccucuuucccuccugcugcccuccuccuggugggcugccuagcaggcgucuuuuggcgucuugguagccagcagccccuggagcccaggggguuuccuuuuuguuguugguuugagcacagaguggaugagugaaagcucugcucagacuguguucaugcacagacacauacauggaauaggagcugcaucuucuaagccaacuuuuaccaucuaugugcggcacauuuuuuuuuccuuuuuccuuugacuuaaagaaucuugaucucauuuaauccccacauguacgacuuaugagaaucuaaaccgccuggggccaacaacuuugaaagaaaagaaaaaguauaaucauccgcauuaacuguaaggaaagugagguguuucagucaguuauugaauaucaacaacaaacuacaguuucuacaguagucaagcguauuuucccuuaauguaaaaucacugaucuccucguauauuacuguugcugcagguagcucaaaaaugcauucguauuuauccgugccucaacuuugacaugcauauuugcuagucaagaauauuucaauaauuagauuuuaauaugauugguuucuuuuguaacucucaaagucuuaugcuuaaaauuuuauucaagccuguggauauagcucaacugauagggcuugaccuaccaauauaugaagcccuggcuucuaucgucagugccauaaaaaccagaugugguagcacagguuuauaauccuggcacuuggggugguggagacagaaggauaaggaugucagggucaucuaugggcacauaaugaguuuccuucuagcucugccuagacaucucucucucucucucucucucucucucucuuucuguguguguguauaauuugucuuucgacugugguuuugaucaugcaaauuuucuuuguaauuuacauuuaucugccucuaauucauugguuccuggauucuggguuguguuaagaagucuuuuccuacuccauagugauauauaaacauguagcuauccucccuuacuuaucuguggggacacacacacauacacacacacacacucauucugagagggaggaauaguuaugccaacugcuacaggccuaugacauaggagcuagugcguugaggucucuuugucuuggucacaugcaagcuaggguaguacuaggaccuaccuuccugauugucaugagcaugacaaguccuuaccacccccccaccccacccccaccccugugcaugcauggugucuccuuacuauagcgauuauuauucaccacuaauucucuugccucucaugaauuuauauaugugucucuuuacuagacugugggcuccggggccgugaggauuuagccuugaucaauucuaaagccacaaaccccugcagggacagauugcaugauuagcuguggauuuagcagcuucugcucccuucuuugagaugcugauuucuccccagggccagaugcuccuccagcuccuguagaacuuguugcuugggccccucugcuuugcccaucuuggaggcuacuuuccuguggacaggcagugaaaucugagagcacuucaaaggaauauggcccgcaucaaauuccuucuuuucagagcccuucuaacuuguucuccuuccuugucccccauugcccuccacuucagcccccuccauugcuucguguuccccacuuaccaguucagaaguucugacuuccagcuccucuacagugcuagccccuuuuuggcccuuccuccccaccuccauccuucagccuaguggaguuucucauccucuaacaugggggcuacuucguucucucacuugcauccuggcuucucccauacccuuccugucaaccauccugucuguucaccagaucaucagagcaagcagcucugaucggauuuuguccacugcguguaacucucacauuggauucuguccaugcccauuccuucacaccacaugaaagcucacuuacaaucugaccuugcauggcuccaucuucuuucccauuacucggacucugacccauuacacuuaguccuuugaaagcaacugaucugcuguucuccacccacccacccuccuugccacacacacacacacacacacguuccccuauaacccuauggacuccaggcucuccccaccccuuuauaauuuagcuuuauaauuuagccuuuuguuccagagaugccucgcccugaggcgacuggaaagcacacuuaccuuuaagugccuuuuuacugugugcuuugaugguagccaucgccccagcgaggcgaugucuaucuguguuucaccaccagguggcagcagucacacauuuuuaaucucaggagcuaugacaaguuuggcuauuuguuuauuuguuuuaaaucacuaaaugaauaauaaacauugauuaaguuaauaauuuuuuuuauacuugagaugcugugggagcaagagugacagugacgucaaugagucuucuaggauuuggguauaggugacagggccacuaacagagaaggcauauuuuuaggaagugacuuauuuuuuucugagugcuguaacaaaaauaccauucuggaggcagggaagcccaagauccagguauuagcaaucuggugagggcccguuucuucauggguaccgcugucugcauccacacauccaugcaugugccacagaugaacaggucccuuuugacccauuuuauaagugugcugaucucauuuauaaggacucuacccuguaaugccccaccuucucgaaccaucacauucacagugagguuucaacacgaauuuaggggauacauguucaaccuguagcagaaaggacauggucgagcuugaguaauuccuucuaaccuauucaggcugaguugucuagaagacagcaggaaagaaaguucuagaacuguucagggaauucugggaagggguugacuacagugcuguugcuauagaaguagugguagaagcuuuguaauggaugagguguuccagggaagcuagguagccuggggagaggugggaggggaaccagggcguggaacccuugggauaaagcaacccugagaagguggacaaagaagaaaaugcugucgggagauugugggaaggguuggagcaacaggaggacagcugaguuguccugaagcaaaaccaguagaaauuucacuuggcuagcaguagcuaaaccacaugugaucugagaagugcugcaagaucaggucucuggagaagagugcggggugagggucugugagcaucgaaaaaccaacggaagagguuucccuucacagcacucccguuuuccucuccucggcucuccuuuuccucccuuccucccauugucuccucuccccgggacuggcuccauucaaaccccacaacaagggcaguagugugagagaguguugaugguauugagaaacaggggucggugaagugcgagguuuugacacugcugagauggugcacuggaaaugacagugacaagaggacuaggcaucgaaaauggaagaggagucuagguuuuuugagcaccgcccauaaaauuguuuugugcguguguucacguguacaugagugagcaggugcauauauacaauggauguguguacaggccagaggucaggcucuaguguuguuccuuaggugccauccacuuuguuuuuugagaaaggcucccucuucuuuagaguucccuaagccacuuaaggagaggggggauuugcuggaaacaucucauuuaggacugaguguucuaaagucgcucauucuucucacauuguccagcugugggucucuguauucguucccaucugcugcagguggaggcuucucugaugauggcugagcaaggcacugaccucugaguauagcagaauaucucugggaauccucuuauugcuauauuccuuuagcagaacaguaaacaccuguuuuguuuuguuuuuuugcauauggguuuguaaggccaucuuaccaacugagcuaucucagaacucuuucaaaaaugauuuuuauuuuguauacaugauauuauuuuauuauuuuuguguauauagguguuuugcaugccaaguaccuguggaguccagaagagggcauuggauccucuguuacuagaauuacaggcagauggguacuggaaaccuggguccccuggaagagcagccagagaauggaaggugguucuagcuauagcagguccugucuuccucccuguccuggcagaggcacugagaaggcacugaguagagagaagguauacaggucuguuuguccaaaggcugucuguacugauaugcgcaugauagaggcgcaugcugugcacuggguaguuagauggccuguuuucaaguuuuguuucuauuccauggcaguugugugagcagucaaguuccuuaacuucucuguacuccccagggccagaugcuccucuugccuggcucuccagcuccuguugaacuugcugcuugggcucucugcuuugcccaucucagaggcuaguuuccuguggacaggccgugcaaucugggagcacuucaaaggaauauggcccgcaucaaauuccuucuuccguugcaggguuguaacgaugcaguacgugcaucgucguguagagcguuuucaauagugccuggugcauaggcagugguggguuaguuguucgguauuauggggauggcuucugcuugccaguguacaaaggcccugccuacucacccaauacaguugaguguccaugguuucuuccgcucccaccguuagcaugggaugccuugggaauuaccgacuguaguucuguaaggagacggaugaaaagucccuucuguccacuaggccaaacuuaagggcuggugccagaggcuaaggucaaaagaguccaagcugggcugaacagaagggaggucuggagagagcagaggaacaaguagguauugugaguguguguguguguguguguacguguguguguguguguguguacgugugugugugugugugugugugugugugcauuaagggcaacaagggaguugguaguuuauaaggaggucuaggagcccauacacuauaaggaugaggacaugaaagcugaacccuuuggagguuguggucagauuuuccucucggagguggagcccguaagugugaugacagauggcaggcugugagaaacaagguccagcagaccuguggagggucaagaugccacaaagugagggcucuggaagaggcacccacgcggauguugaaauccccccccugaaugcuguuaggaaagaagacagugucaaaaggagggcugcuaucuagggugaaguucauggugacccugaggagagcaguggugacgugcgaccugcaagagugggaucuugaaaggcacagacacccuguugccccugccaagcacuaggugucugcucuguuaacuaugucugugacuugguugccacuggccaacacagucugcugccuguuacaucaaaacagcugcagaccccuccauauacugccagugcucaucagcgcuuugaaauuagggugauuugucagauuugcugauaaaccuuacagcaugcaugcauuuauaaagaaacauaccuagguuacaaaacaauagagauaauuugauaauuucuuuuaacuuugauaccuuuuauaauucuucguucuuuacucuauguuuuucaaacauaaauguagaaaauaagaggugucuuuuucuaaauaucccccugguugcuggccccucuuugccuggucuccaggcugcaggaaaucucucuuguguacacuagagggcgcucuagcuucagaauuaucagacagggucuuucuguucuuuucagguguuaacaauucagcagcccuuggguccauuucuggagacugggguuuaagaacccugguguccugugaucuggaaaagcuacuuccccauuggcuuccaguuuccaguuucguuaucaaccugagaauugaggcacagccccucugcugggugguuucaggacccaauagaaccaaagcucuuuguuugccuugacauugacccuaagguccuucaccucaguggcccauccuggcuggcaaagguuaagguucugggaaaggucuuagcauuaggauugaguuggcggugaauuggaguggggagccaaauggagggauguaaauugugaccaagggcugagacuuacacaguagagcagauaggagagucuccgaaggccauuggcuuuucccuacuaagaaggaugccacugggguuuugugggaaaagcuuaagucacggguuuucugccauaguuuuaucaccuugcagguucccaccuggcuaaauuauuuguuccuuuacuggugauuuucuccacuagagcuucaggcuccaggguucucccuacgucaguggaccuccagucuugucacaaaccccacauuuuacaucacccuaaggugcuuguuacuuaaguaggaauugugggauccaccccuaccuccaggguuugagucccaggaagcagguccuaagaaccugccugcauuucguacagcuuccuccgggacaguguagcucggauaucagcagcaucaccugaaccagggaaccugcuaacaaugcggguccuccgauuccagauuggaggccacuucucagaccgacugaauucaaaacuguaggcugguguccagaaaacuguguuguaaucagccaugcaaggaguccugugcuguggaagauugaaucuccacccucagaauggcugagacagaaugaacauuaagccucaaaugauccaggaguuggccuccccuugcucacagcucacucaccagggacucaguuugugcgcagugccuaacagggcuuuauagugguguguuagguuuaaguagcacuucguucgguucagcgucucugagacagagaucgaaagucagucaggggcuccugagucuucacagccccaacuuccauuuagccgguaaugaaaaccugccaguuuuaccucccgaucccuucugauccgucuguacuagacucucugaguucagauuagaucaccccugcuccagcucuuguuguagcuuccuccacggucucccuacuucugccuucccuuucaguuuacaaacuugcugaucaaaggguacucugagccucagaagucagagggagcugucgagaaaugcagaggcucugaccuacucuccccagaccacccgaaucacucagccuccauuuuaauucagucccagcaugaucugugauucuccagaccauauauaaaguaggaugcuguauuguugaacuggcccccaccccuacucugucucuaucccacaagucuaaugaagagguagacuauaugaaguacuucaguucggcacgcuggcuugcacaugccauucuuucaacagauauuuuugaaauccccacuugcugucuggccguguaguagcugccgagaccgaaacacaaagagcaaacccagucaguauccucgcuuucauggacagcacauccaugugggaggagauggacaggaaagaaauagagaaaugcuacauaggguacuuaaauguuaagugugaugcaagaggcgaucuuacaaaggaaaaguaugugaugcugccgccugggcacggagggcugcucuuuugaaugcaauggccucauuuaaaggaaagguuucacugacaaugugacauuugagcaaaggcuaacuggcaaaaaaagcaagcccuuugaucucuaugggaacgauauggcaagcuggggauauaacaaguguaauggccaugaggcagaaguguuuucagauuauuccagcaacuagguauaaagcacuguggugccagaggaaggaggggaaacuagucggacaugagguuaaagaugauaaccgcaccaaaacuagcuaagauaggugguugagaggucguuggaggaggggaaggccaaugagucuaauguaaaguuuuaaaggguugcuugcuugcuuuccauaauaaauuagggggcagaugaugguggcucaaaccgggaugcaguacagauaggaaacagguguuggguucugagucuguguuaaagggccagccaaccguuuguggauagaaucaaguauaggaugagaaagaaaaagaagaaagggucaagagugaguuuaaccuuuuugaccugcuuaaugaaaugaauggccauuuacuaaaauaaccauaaaggcuuuggggcuuguguauugcuuugcuguuguuguuguugugguggugguggugguggugguggugguuugguguguuugugugugugugugggaggguauuguuucaguuaaguaauguuagguaauaccaucccuaagacuuagugacuucgaauuuguucuugcaaugugggagcccauuggccuguuguuuauggacugaucaucuaagaucauuuguagauugaagcugugccccacaaugugaugcugugucagauuugggucuuugugauguaguuaggguuagaugaagcaagaagauauucuuucauaauggaauuuaugccccuguuagagagcagaccuugaacuggcaccccugcccucuugucugucaugugagggagacauagcaagaaggugguaucuauaagaaagcaaccaccuaauacuuugacuguggacuucuuagccuuccaaaauagaaaauaaaaaaaugaaaauaauuuuuguuguuuaagaugucugaucugugauguuuguuaaaacagcuugaaaugaccaagacauucuucuggacccagcugggacccugaaaugguugguccucucuguucacccagcuguuacuggcauguggaccucugaguaguauuucaaagagggcaauccccaggacccaaguacacaucaaaccuccuauugaauuuucccuguugagguaguccccuuggcuaaaaccugauauaaguggguuucacagagagcaagaagagacaaauuugggauaaggaaaauagagcagaguauuuaauaaaaauaugugaguuaaguauauaauuucagguguucauauucacacuaaaaauacaaagacaaacagguggaacuaauauuagaaauauaccuuauuauauauaguuuauccaaaaaacuaccauucagaauaaccaauauaaaauuauggcugggcuauuuuaguagauauacuuuguaccaagagcacagcucaauucaaacuagcuauauuagcuauauuaggagcucugggugacacgugacuaggagcaaccacuuuggccaggccagauauagccaaugcuauauuuguuguaaagauauucuaucuuuguuuuaauggagagacaagcaguuacugggagcucucaggagcugucaagugcuuguuuucaaaugagagcaaucucuacauuuaguuuguuuucauggucaccagacuuauccaguaggaaagaggaagcaaguguuguaagagaaagaauuguggagugguagguagauggaauaguaucagggucccaaaaggaaagucuggccuugacugagacccucucuucaugauucuucuggguugcagagaugaaggcagagcaaaacuggcaaguguuaauguguggguguuuauuaaaugugcuugugagggcucaggguguuuuguguaauucucuuuuucuaggcgaagcaggaaguacccaggucauuguuugacagugaagccaggaggaaaguauuagagguucgagaagagaggagaggauauuaaauugugaccucagaaagcgagagagugaaugggcaggggaauauagugugauugccuggcaacaugaaagaugcacuucaggucugugaugacaaauugggcaugaggguagucagugccgcuguuuuucuccagccaugcuaagcuagguagggacaggcaagggaagacagagggugaauuuaaccagggcagaggauuuguuuuuuucuagccauagugagaggagacaaaggugucaaggaagauaaucagaauagcaggacaugggauuuaagaaaggaaagaagggcuggaauccuagcacuuugggaggcaaaggcaggcagaucucuguacguucgaagucagccuggucuacaaagagaauuccaggacagccagugcuguuauacagagaaacucucuuaaauauaagagagagggagagggcgagggaggaagggagaauguugauucuuuuggugucaaagaccagguggagucaugguucgaagaagugaucgggaagggaagacagugauggcuaaaggggaaauguuugucuuugagcucagagagaggauguagcuguuccuacucacagggucucaggcuugcccgugaaagugaaugacugaaguguggucauggagacaagaccauggaauugaguggaucccggaggauucuuccagggacccggagcagugagcaagaauuaggaaggcaaagguuugacagaguggcaccaagccagguagcaacauuuucagagcgaaagggccacuguucaucaucuguaguugauggcggaaggcagaaguacuggguaucacacuggcagcgguuagggguuagcagucuggaaagagcaaugaaaagcaagcaaaugagcaccgcucuaucgagcauggccccaugggguuagggaaaggagaccuuagagggcugcugaggcagcaggugacucuagagggacagguucauuggguaaaaacaaaaguucccaagucagguguggugcacaccuauaaucccagcccuugggaggcugagaccaggggauuuucugccagaaagaucagccuugccuuacaagauccugucucagaaacagaagaaaccaaaccaaaccauaaaaggggcugcucagggcauccagagacaagaccaagagggcaagggcuuuggcucauuguuucuauguggcuuuauagccugacaccuuuucccagaauuuacugccuuguuuugucacuuugcuccuccaaagcuccuucccugaaacugucauagccaagagcaccaguggcaugcacguuucugaacuucguggaauauuugucuugacuuugcugucccuccccccugcccccgcccagagaaggauauccucacuggaauugugugugguuauaaaagugcuuugugucugcgcugucuaauauggcagucacuaggcaagugugaccagugagcacuugaaauguggcuuauaugaaugaggagacaggucuuugauugaaugcauuuaaauguaugcugcucucuaugucuaguggccaggacuaaaugagaguguguuuaacauugcugcucgcucacucuuucuucuuucuuucuuccuuccuuccuuccuuccuuccuuccuuccuuucuuucuuucuuucuuucuuucuuucuuucuuucuuucuuucuuucuuccuuccuuccuuccuuccuuccuuccuuccuuucuuuucucucucuccccucuaucuuucuuuucuucucucucucucucucucucucucucuaaucuaugagugcucugcugcauauacauccaccugccugaagagggcauccuaucccccuauggucgugagacaccaugugguugcugggaauugaauucaugaccuggaagaggagccaguuuucuuaaccacugagccaucccaccagccccacugguccuucuuuaauuguguucucugaacuucuagaacacuucucuucuaacucuauggcugcuucuguaguuuggucaucaagcucaccuuaugggucuuuuuuuuuccuagccacuggaaauauugcuguuuuccagacccguguuaacuauguuuuguggacucuucuuuaugacuuuuagcuacauaccaaacuguauucucaaaccguuuuucuuuuccuagcucuagaccuuggccuagcucuaacccuauggaggcaacugcugggauagcuuacagcauucagugccauacccuaacccaagcuccuuucuucccuaaaccugucaauuccugaagucauagaccaggaaguuucuguagauggucuuccuuuaugcccuggccaagggccaagccaucugugugucccccccgccccccgacgcucccagccguaucugagucugucuucaguucuguuucccucugguccacugucuccacuguugccagaggcacccagcuggcugaaacauagaccugaccuuuucaucucuuaaugaucguucaguggccucucauuguauagaggauaaaggccaaguucucuggccgggauaacaaggcucuuccuuuaugagguccuguuuucuugucucucuagcuacugagguaugacacaugagaccucuuacauucuugugcuccccuggaacaaggaacugcacguaauugcccacagaucgcaugccucggacaucuguauaccuuuucucaggcucugccuucggccuagaauguuccuucugucaaguccuaccccaggugcuuccuguuguuuaaaucuccugaucucugacccuguccaguuugcuucccuuccucgggguacccaguccugaccaugaucccuucaccaugucaggcuccuccacgugucaguugccauuugucaacugccgcagauugucaaggacaggagcuagcccagauuguuucucuacuuuuugccauugaguccaaugugcaucauagauauugccugagucgguagccagaguaagucagugagaugaaggaagcagcaagaugggauaauagcaggcuacccaacccagcguuugaguacuuggugguguccucugugagaguggaggaggagggaaagauccuuuggggggcccucuggggggucuucgcuacugcuggagcaauugccuagguucccaguacucuacggcuuccuucuggcagaaaugaauuuuacagaaacucuuauuuuguuuuuuccccuaccuuuacucaugaugugcuucuagccuccugggacagaagaugcuagcagaaaaaugucacacacuuucuuagagauggaaaaaaaaaaaagagguuuaugauguguugaauuuucccaaaagugauuugguuucugcuuuccuuuugacaaaaacugguuuuucacuaggauuaucccaagggccacauccagguaucccgcaaagagaauuauguggguuuguguacaguuugcauauaucccuaugggcaggguuaucagggcuuuuuuuuuuuuuuuuuuuuuuuuacuguuuuucuuuuuugaggaaguggaauauuggauuauauuugccacaggcagucuccuuucacagaggagguguccauuuccccagaauacccucaucuuccugucugugauccucgggaugauaguagguccaugcuaggccagcugcuggaucuguuuucuauaaugacuuauucccugucucagcccuuagaaguggauguuugcuucuuguuccuacacaggaacacaacuuugaaggaagucugauuugcucagggucauuccuguggggaacaugaggcugucugaccucucccccgccccaaccuccaggccuuuguuuuuuaagauacuacauuguauuuucuuucauguccuuacuguuugauguucugccuuuuauauuuguuguuauucgcccaggacugguuugguuucuucaugcauggacaaucugauugccacuugaauggcaggggacguuuacacaacauggaggcaauguaguuuauuuaaccuaucuccguaguuggcuuauuuccuguuucucaacauuauagagaaaacaaguggccauaucuuuugugcagauaagggugcuuuguggguuggguuuuauaggaauucaaagauagucuucaggguacuacuaacauugaaccaacguucuauuuuacguuuccuuggcaacucugugccaccgcuuggccgaguagugagcauugcucggguguccacucugcauccagggaugaggugaaggggagcauuagggaaagcuccucccccuggcaacagucagucugguuggcacagaugaugcagguuagaagcgagagcgccagcauggggcucugugaagggucagugagaacacugagaaacauguccccgauaagaucccaauguuccuuucccaccacaacacugggagaagcacagggaaggaaccgccauccucuuucccaaggucuauggcuccugaccuugcuccuggccaaggacacacacacacacacacacacacacacacacacacacacacaaguucauuccugcacugccauuuugguaucugaggcaugccacuggugggcagaagucaaagggaaugaaaagacagcugagaaagugauggauggaggcuuugcaguggaaugucugaaagccugggccccugucagccuugcaggucucuucauccuccguguguccucagaaacuggggcgacagcaugguguccaggucacacccccuuaucagacagaccaguguucacacucccaguauacugcucagugcauuguuaccaaccaagugcuguguuggcuguuguuggaaagacauagaagguccuuggcuuuguggaacauugggucccaaaggcguguccaacccaugggccaaauguggccaacgauagcuauaaauauguccugauacaaaaucacagagcgcagcuccuucagccuguccacaaugaacuuuccgggaucccccuggcuuuugucacuuauuuccuucgcccucuuccccuuucuugcuuacgcuccuugguuucuugcuuuuggucuucuuacucucucacugugcacauguguuuccaugaguucauuuucuucuaugugcugaugucacccacccuuguauauucaacucaucgucuucauggaguuuguggcucgugucauaaaaauaacuagcagcucuuaaaucccugguaccguaccacaccuuuauuacgucaucugacuaacagcacugugaaugagguggugccuuuuccauuauacagacgaauaaaacagaguugaagagauacugagauuugccuaaagcucugaaauccauaagugcuagaaccaggauuugacuaccuccacguucuaggcuccaggugcccccagugucacccaucauguucuggguggucacuacaggaauguccccauguggcuauuucgcagacucggguuuucaacauauauaaauaagauggacuucaucauucccuuguccuugcuccucucuacuguugccucuccuuugcauaguaauaaaugacauuccccaguccagugauggacaagcaauuagcauaccccugaguugcugccauccuccuucucccucagcuucacccuccucucuucauuuucuaccuugaugcuuuugaccuccagaaagcaccguguucucuagguuccuggagcaggcaggccacuugccagcacccagccuuccgucucucugccucagacucccugcagcuuucuguggcucugucagaguacagagaugacuucccagggucugaaauccaucuggaauacauggcuuuguuuaggagaagucauucaguaauugagaaauggcccaagcacuggauaaaaccauuuguaagggcucuagacuuaaggaugguaggaagaggacacugaugugcacugagccauccuguuauaccauaccuuggggacacggcuaaucagugguagagucaaaauuugaacccaaauucauuugacuucaacaucaacauuuucagcuacccugucagacuauuuagaaauacaaggaaauaaauauagacaagaagacaguugccaauacagguauagagaacuaauucaaacauuaauuuuaaaaaugaauccuggggcacggagaaaauggcccaggaauuagugaggauucuacucugguggcugagugcuagggacgcuuucguccuuugcuucuaucuucuuuccaguuuugaaaaauucuaaaucacaucucauaaucaugaauuacuuuuagacuaaaacagaaaccccucuaaugguacaacaucagcuggcagaaacagguugggggggggcucucaugguuccuggcuaagcaccaggacccuugggagaugcuguuguugauaagugagagacaccaagccugcugcagcuguggcugugaccucagcaccugcaccccuugugaaaagaggagaagugggucacuauuccucucggcucaccaucuccccucuuccuccaggugcuuacaccccagagccccucugcaauuuccagugggcucuucucucgacuggccucauguucuuuuaccacuucagcuuccugcagauccucggccugguaaguuugcugagacucccccuccucuccccuuugucuggaguucuucauaaaucuugauuaauccugguuggugcuguuguaucauuuuguuuugaaaaauacacggugcuaaaggccaggacaucagauuguugugucugggaugcugauuuaugaugcaaagccuuggccucuccaaagacgcuuccgaaucuugcaauaauggccauuccuucacuucugggaaggcaagcauauccugcacccauggcuacuugggucugaagcaaugaccuguaacuggcaagugcuuugcuguggaccuccugggccuguaggacccuuacuugauugcccugggcuuugugauggccucugauauguuggguccauucugggugugcuuccagguccucggggagaccauucagcuguauggccaguggaugugagguguugggagcccccagagcauucuguaguaugagaacugccuggaauauggaaaauagcuggccucaauggccagaguccaauagcgucgauguugcauggguaucuaaucagugucaaaagugaggacggaaaguuuauugcuggggggaggggagggaagggaguuuuccacgucacuguaacaugauccaaaagcccagcuuccaugagagauggugggggcuugucuuuaaugugagcaagcucuuaagagcucuggaaggcagguguuacggcuguccuuggggcagagaugccauauuugguuuugugcgguuggcauuaauguagcguuagucauguggagccuugugcgaccuugcaugauaaggggccuggaacuggauguccccagugccucuguugaagccuucacuuuuuucuuccuugcuccuuuugguuugccggagguagccuggguucuuugccaguagugugaaugcugccugugcuugugggaagacucagcauguuucugcccugcacacccauugcuccuucccucucgcugcucccccacugauaaugcuggauuccaggagugucugcgugcucacgucauacaugcuguguucugcuacaccucccaccaggaaagcucuacucacccacuccucccauuaacccuuguccauuuucucaugaguccauucaagcgccacuucccucgcagcaucuucugugugccccucagaccuccucguggcaugucaagcuuaggggccaccgucuaguuugaggucggaugcagucagcugauugcccuugcuacuuggagacaggaaaccaugcaguuaauggauuuaaaaaaaaaaucccauaauaucucuccaggagcuaggcacacacaaugaacacuuaggagugacaauggacuccaggcccaacuggaaagcaagacugagcacagcuaaauagcuuucauccaggacagcgacccgucacccacucagaaagccuagggcaaagaagccccuuuaugaacaggcggggauuggucaaucccuccuugucuagucaccccuagggagagauggcugaacuggcaguagccagaggcagccucgggauggcgaacgcucacucuaccucccuugucccugcaggucaccgaagugaauuugaacaacaugcuguguccggccaucucagacccauucuacggccccugguaucgcaucugggccucgggacaccagacucucaugaccaugacccacgggaagcuggucauccuguucucauacauggcugggcccuuguguaaauaucugcuggauuugcuccggcuuccagccaagaaaauagacuaaaggugcuugggguuuuguuuuuguuuuaguucuguuuguuuuuuuguuuuguuuuuguuuuuguuuuuguuuuguuuuguuucuuccugaggaagcaaauccagacuugacucagaauacucagcucuugaugaaaucacuggagagggcagauagagugcuugguuuauuuccuuuccccuccucucuggcccuuuccuccacuacucuuccuuccccagcuccuccccucggaugacucuugguacccagggaaggugcugggggcuggagcuuacuccuuuuccuucccuggguucugggucccuuguguggcccaccccgucugcguggccuuacccagggaaaugguagucagcggccccuuccauacggcuugucggugcuuuugacaacagccaguugaggaaggggaggacaacgagcaguaguucuuccagcaucccagcaaugaaguaguguuggguucauuucuccacugccagggaccuccaggcucaugcugggauccccuuucaucuccagcauagccccccaccagaaggggaccaaggccuugcuucuauaccagccgcaagcccagagccaagggacuucccaguucacagccaaaauagauucuuucagugacuggugucccaugacugaaagcagggagucacccagccacuccuucuaagggagcugccuggggcggaugaugauagcagugugcagccaacggacaagauucuguacagggguguuagggaucuguugccacagugaaucucaagggaagaugauaaaggcguacauaguaccaggcuggacgaccccccaccacagaaaaccaaccaaccuucccuaugaaagcugagauuagauccacaucuaaaaugagcauagaaauuaagaacucaacuaagucaaguggcaacuugagaaagccacaauaugaaucacacucugcaucacauggauaauaggcaguguucuagucucagcugacccggaaccauccucauugucuguguaugugccugucuguuuuucugucugaggcagcuucauggaagaacgagcugggcuuggggcuugggugcuguuuggcuguuugucuuuuggcuguuugaaaugggggaaccgucacauuucucaaagguacucucgagccauuccuggcacuuaggaggugugucuaugguuccuggagggcguuuucugaggguuagauuucucuuguguagcucgacucugcugaagucgacaucacugguuuugaggcuugauaguguccaaaacccauauguagguugaaagggaacucucaguggaccugaggcccauagguucaaguguucugaagggaggcgcuuugguuggaagguacuugguuauauguggaccacaaaggggaccagugucugucuaucugcugacuccuugucaacaucuaguaggaagagauuugcuugggaauagaaauguuuguaccaugagcaccccaacgucucgugccagaugcaguauucaaugugaguuuguggguauuaggccucagcugaacuucagcagcucaguggccauguuucuagacaauggacuuucagggaaaguaucugcaggaaagcacacgggaacucagaggagccauugugggacgggcugccuggccaugaggugaucaagucugagguacugaaagcagggaagaacucuaggcuugcugcccuugagcuccuguccuggcaucuucgccuucugcugucugugagggcuaugcugagcuucccucucugacucuucagguacugacucgcccugcccacucauagaaguugguggaugaauagcaugcagggaagccuccuuggccuggggcuucucuguaaggaggcaucauaggaggggaguccaugaggcccgaaacauggagcugcuaccugcagcgguggagggccucagcagaggggaccaacuccagaaugucaucgaggugggagugccacacauacuccuuucccaucugaggcuucaugguccaggucgccgguaaucuuggguuucccugcauuggccugccuuugcuuuggugccagcucgguagguauuuucuggugcucagaggaagaguggaaauccaaagccaggauaccuggcauggccaagccagagucaaacauacgugucaggaaagaggaagugaaggggacacgcaggggucgagguuggcuaaggaagcugaaugaaacagauuguggcuccuucaacagacuccauagggaggcucagccugggugugagauguuggggagcaggggaccugugagauguuggggagcaggggaccucuucacugucuauauaucgugguccaaaccuacauggcaagagguaaccugccuaggcucuuagcacuuugcugugggaguugucccuaggucuguccagagccuacccucuacugccugugguacagggauggagaagacaguaugccuugacuuggcagcuccuccucgggccugucguucccuaccagcaugugugagcucugggccugggcaagagugcucagagaggugccuaucaggaaggaacaaagucucuucaagcccuaauuguccguggucagggggcugcgccaauaaguacaguuggcuaagccagugucucugcuuagagguccuuccugcccccaguauuugguuuuguguauauaagacuuggcccagcaucuucucagaagccuugcagcauggucuucugucauccugugacaugcugugggauuggagagccaccuccuccuccucuuuaagucugucuucugucuuucuguggacuucuuuguaccuguggggguggucuauggggucuaugugcacuuuaaucuauggugccucugguagggguuugcuauaugugaucauaugggugauucaguguuucaugauguaauuacaaguuucucauggauagcucagugucaacaguggaacuggggcuggguaauguccugagcuggguguuuaggagauggcaccgggccccuuuuaacucucugccaaauagacuucccugggaauucuggcaccuguccucuuugggacaaggguuucuuaaugguuucuacuguaagggaggccagaagcagggggcgggggaggacaagacaucgcuucugguuuuuugugagccaggaacagguuucucuggcaacuugggaaguccccagacuaggaaggagcauccugucuccuccugguccagcugucccugagguaaaaguccauuagaggagucagucuuccucugguauaugcagugugcucacugugugcaggaagaccaaguggcuugcuguugcccucgucugugacacuuuuguacacugauuugccacucauggcacugagcagacauccaucccuacucagugaaaaaccagucaaaagcaaaaguccuuugaagcagaaguugaugcuuuggaaaacucuugacuuauuuuggugucaacauuauguuagauuugaaagcauucuucguguauuugauguaauuguagcgaagagagcaggauugaaugguguucaguuauuucuucugggacauggaaagccugucccccauccuucuucugaagccgagucugcuguguacuguuacccucgagggagcgcagggcucuucugagagccggucucugaacugcugcuucugggacaugcuuccccaccuccuccagucuaccuccccucuugggguguuuuuguaaugugcuuucucuguuuuguaaaaucccuuugauuguaaugaaguggguucugcagccaccuuuuggaaauaaaugguccuuaaauuguguacuuagcauuuugaaucuuagccucagguguuucugcuguugaagauuccugaaugaaaagaaacccuccccaugggacuuauuguuacaauguuuucuucauuuacuguuauuaaaagauuuaugagaauucaggaguccuggccuugcuucucagaacucucucaagaaggcuuugcagaguagacaaagagaucauuuguuggcuuuguguaucauaaaguagucaacucccacccaagacagggcagcugggcucucaacacagcuugguccugauggacagaacgguggcuuggccuugacuuccugcacacugccuacuuccaccaaggauccuggggaccaucaggccauuugcucgaauggggagcuuuucugucagggacgugggcucucuaugcuaggcuagauggcucaguggguaaaguguuuguuggacaagcaagagccccugaguuugaaucaccaguacacaguccaguacaaauuuaaaccccucccuugucgauggagacagcuuccagagccuugcuggccagucagugugaccauaugggucuaaugagagacccuguucaaaaauuauaguaacaagaggagauauaggaagauauagauagauuauucaucucugaucucugaacacaaauguauacacacacacauacacaaacacacacucacacacacccauguacccaagaaagaaugcaacuuugaaacauguugacucuuggcccacagcccucauuuguccuucaagucagcugugucccugcugggucagccuguccuugaagaaugaacaagauaauaguguccuuugggaacagccaacugugcuuuucaaagguccucugccuguugcgcugaugcugccacuucuagaaggcaggcaaagucacagucagugcccaugcauccccuccuucccucucccacccccgcacagacacccccccccaucagccagacacuggcuaugaagcauggaucuuacuguccuagccuagaaauaaccggcuugguuauuucucuauuugcugcucagguucucacucugcaaagcacuagcuauaacucugucauaggcccccauguguuaugccucuccaugcuuuccugaacuacucccccucccccacccccugcccugggaguugacuggcaaugguuccugcauacagaaagaaaccgagucaagugaggcucaggaauaagcaaaaaucuagacacuguuagcuacuccucccgggcaccauugcccuuuuggugugcuagauugccggggagaccuuggcuuagggacccagcucucagagaaaaggaaggagaggucuggggagaugacucaguggauaagagcuugcuguaaaggcgcgaccugaguucccaugucuagcaucuuggcuagauggcccuguaagcccagcacugggaggaaugagacaagaagacuguugguguucgccauccugccagccuagcugagcaaagggugaguuccagguucagcagacaugacaaagccucauucaaagacagucggacuggucccucccaggcaggguugugcacauuguugagccagucccucugagauagcuaaguuccugggcuaaggggcuucuaagccuuccagaaagguaguaggagcuacuucucaguagacaccuuccacagcagacucccuaaccuugauccugggauuccuuguguaucagauagcuaggauucccagcaucuuacaagguacaucucaguaauaaagauggacacugcccauccugccagcuucuaaggacaauagcaugaaccaucgggcuacucuauuguucagcuccaucccagccccaccucuguaccagccaccagcuuucccugccaacuucgcuccuuuaccucauuuuucucaggggcuuucagaggugguacuacccugccucugcucuguaucgaguuucuucuucccuaagaggcaagaacauaacuucuucccucuuucauuucucacaaacaucugugcccuccagcauuauggcucauggggagcucaggccuuccuauacauucuuggccaaaccuuauguucagcgugccagaguggacagguucacaaaugcuauguaguuaugguuugagugggcauugguaggggccugaggguugggaaucaagaacaucaaugcugaggucugacucaagcccguaacuccaaagcaaacuuuucuguuguuguucuuacuuuaagcuucuagggccugagucaucucuuugaccuggcagaccauaccagugcuuuuaugaaaccuuuuaagacaucuaaaaggcaccaagaauaacagcuaaauccaacuuaagggagugaacauuaccagugcaauuguagcucuuccuccagacaguuagaaaucauucucccacaccucauagauucugaggaaguaccuuagagggcccuuucuggggaugagggauagggggcagaguaguuggccucucccguucgucauauagcucguccucagaguagcuauuagcagcuccugaaguuuucugcacucacccgcugugcccuuaugugcucuguguuguggaagucugugggagcauggugugugugucgaagagguggucucuucguuuucgaauggcuuuuucucuauuuugucaugucuuaauagcccuguaaugcuggauguaccuaugaucgaugacaugcaaccccuuucucuuucagugguguaaaauaagagacaucuuaaaacuuacuaaagcacuuuagcgccacuuuaaauacggugauuguuuccucuuuccgccuccuucacagaaguugccuuccugcuacagaaagcccguauguggaaaaacuguaaacacacuuuucguacguaacaucauuguaacacuuuguccuagcuugaugucauagcccaagccugauaucccagcacuugggaauccucacccuugggaugcugaggcaggaggauuguaaguugggaggacagccuaggcuacauagcaagaccccccaugucaaugaaaaaacacauaaacccaacacugucuuauuucucuaccagcauccacaaggccagacaagcuuucugcuugucugagggguucacucuggugaccugucucucaugacaggugguuuaugggauacaacagcgaggagaccaagugugccugccucaggaagacagcugugccaaaugaugggguggggggcagccagaccagaccaggccagcgccaaaggcuucguuuguuuguuuuuuauuuuuauuuauuuauuuauuuauuuauuuauuuuuugcuuuuuuuagguuuuauuucccaaccacaaccucaaaaagagagcucagucugguucccugaggaauguuaagguuagucaaugccagacaugaggugagcuggcagcagugggaacacaagggagggcagcuuagucuguccagaaccugcuagguugacguaagugguuguccugcccacacacaggaaggcaaugauuuccuggcuuuucaagguggaggaaggcccagcggcccuuucaaggaaaagcaaugguuugaccugaggcagcuugaacccuggguauuuccaauagcuguuggcaacggcuaacagccuucucucaguccuggcugccuugcaaguuaagcuuggcccauuauaaccaucaggucaugcucuuccagaaggagaagggcgugucuguggccaaccugggauacuuggagucaagaaacagcuuuuggacauuuucccccuagaggguuuagcaagaucugaucauccuggauuagagcugcccucacauaacuggguuaaaguguuggccuacuuaggccccuccugcuguggccuccuucaaagcugaugaggccgauuagggggcuauuucugagcacuagucauguacccacaagcccaggagcaaucguccccugacuagaaagacaguaaccauggcugagacaggguuggccuugccggugggaaaucacugcuuucagacacaccuugaguccuuggaaaagagaguagcuauaugucaggucugugcauuuugaucuuaguaaaccagaccaaccuaucaguuuucggauacagaccuacaaaaccagacuaaccaauucauuuucaggaauggaguuuaguccuacaucuuucacuaucgccauuugucaagagagguggugggucaucaacagaagguccucagugacagucacuagucuccacucaguagagucucugcauuuaaggaagguuguuguuuuacccuaucugagccucaguuuggucaucuacaaggaauaacaacaguucccacuucagaguguccucuaguauguaaaacacccggugcacugucucgcagcauauuuuaagaacugcuuccaucagcgcuaagcaucaccacuaccaucgccaccaccauaacugccaucauccucaccaucaucuucaucaagaucaagagugaaugcuauaaaucucaaucgcuggagcucaagcagcuugauuugaacccuggccauguauaagggacagcuuguuugaaugucacucuuacuuuguaaaauggaaaaugugauuuuuaguuuacaagaagcauuugaucgguguuggcuuaucauuguuaaaagggaaugaucaugaagaguugugcuaaauauuuauggcuguggguaugacuaugccaagcgagggauacuuuguguagugaaaucauuucauaugaugauuugaugguggauacacaucccaauacacuugucaaaccuaaaggauacgcaaaaccaacaguaugcccuaauguaaacuauucgcuuuggcuaauaaguaugugacaauguaguuccaucaguuguugcaaaugguccaucauucuggcaugggaugcugauagugagggagacugugaagggguaaggggagcuuucuucucaaaugugcagugaaaucaaagcuauucuaaacaauaaaauauguuuuaaaggaaaaaucaggaaggaaugauuagcuagauauuaaacauauucccaugauaaucacuaagaaaauaacuaaacaaauagggaaaaaaugaaaugaggaaggaaucaaaggaauauauugcaacaaaaaacaugaaacacaaaauaagggaguaacaggaaaauagagaaacaaacaaaaacccauauaaagauggauagaaaaaaaauguacaauggcacacugcaua

SEQ ID NO: 9774 - RNA, 3663 nt, Mus musculus
caggagcgaguggaaaacauaguuucaugaguuucgguaacuaauguguuuuuaaaccauuuuggagcgauuaauccuuaaagcuuaggcccgcuaauacuauuaccuacuuuugcccugugcuagagaaguuuuauaagacugccaugauaacugaccauaugguacuugccucugaaguuaguaagaguccaggguuuuuaauguucuuauuuuuuguugguuuuguuucuuugguuuaaagacagaguauaaagucgguggguaagguucagggauguaucugagagcgguugggugagguaaacuucaaaauauauaguaugauuuuuuucauuuaaaaaagucuuaaauauugagaauaaauuuauaagguuugagagagauugccauaagguucauauagaucuugcuaagacaucugggagauuaaggaaggcgaugggauaguuaauugaguacuuaaaguuuuauacgucucagguauauucauagcucuggguaaaacuacuuuuuuugaaguacauaguccaagcauguaguugaaauugaggugaaugaaccauuagguuuuacuauuucagcacuuuauaguaaaaacuuuuuacauaggaacuauagaaauugagauaacguugcuucucagucggacuucagaauauuuugaacuacaguagucuucuguuaguguuuuugcagguuaaauuaucauuugaaacccaaugcuguucaugaacauuuauuaauagguauaaaugguuacauuggaaaaggaggaacaaacaccuuauuucuaaauagccauacauuuugugggagggcaaggaaaugcuuuauuuuucuucauacugaagcuaaaaacacacgaaauuauuauacaaguuuuucacacauuucagguugacacuaacuucacacuucuuacagaaaauauuuagauaaaaguuguuacucagguuuuuagcuuuuaaaauaauccagagagccaaaaugccauuugcacaaacacugaaauuucucucccuuuucauaaauuaaacucaggagguaaaauuuuaaccuuaauuuugacaaacauucuauguugauguaagggacuacgcggagaaaauuugauaagcauagccucuguuuucuaguuuuucuuuccuaucaacuguuaggcuguagcuccaaauugcaaucagucacugacuagaaagcaacuucuuaucccccuuuuauaaaaucuugaagaaauagaauccguaagcaguuagaauauuccucucuucuugaauauuaccccuagugugcacaugaaagaauaaaaacauauccauguauuuucucuggagaaaguuauguuuagucuuaucugaacugaaaugaucuuggacaaggucuguuauaguuguaccacugaaauauaagaacauggccauauuguguuuaaagggagaauucagauaguuaaauccgaaguuauuacuuuaugaaauuauuuccuuuaacauuaaguaaacuaaugugguugacggccugcguuuagaacucuccuuaugaaccuacacuaacauggauguuagugccauugguucuagaggucauaaaaaccauuuuaaauucugacugcugcuccuucccaaguaugucaggucuaguugucauuccuauugaauacaggcaacugcccucauuguuuaaagacauggugaaguuguaaauaaaaugguuagaucaucuauagaaauaccuacuuugaacauaguacuuuuagaugacuugagaauucaacuagcugccuuucuauuugagcccugucucauuacaucugcuacuaugaauguccgguccaaaaacugucuucuccauuuuuuucuguagaaucuugagggcuuuuuaaaaauucauuuguccuguuaauccugcuaacagccuacuuguagaauguguacaugauaaaauuugucuuuuagauuacugaagaucuagaaagacaguugucaguuuguuuagaacuugggcuauuggaacucuugauggaauuugcuauuuaaauauaaggauuucagggguuaaauuuugauggcucccuaaucaguggagggucucuacuuaagucuguuguccuuuaaaauuucccuaggaggcauuguacuuauccuuguaaagcugccacuacuccaagcacauugaaaguugauuuuaaguugcaaaaaucaauucugagugugaagaugauguagcaccuuagcuuguugccuguaucauucuaacauuuaauucuucuguuucuucaacaccccacuuucucaaaguaaagcuccaaagccaccgacuaggaccuucucugaacauacugacgagcugcuaagcucccguggcagcauuaggaauuguaaugucuuacguauacaauaagucuauguagauuuucuuugccaaaguguauauauuccuuggguuaguuuuuucuggucuaagugucuucuguccucagaaguagaaaagcuaaauuggauagcuuuugcuuuaacagcucuacagaggaugcucuuguggcuauugauuuuagcacaugccaggaaaaaaguacuaaguuaauacugcuuccucaccauucaaaauucccaaguaggauaacagcaaggucagaggcccuugaacuagaguuacagacagauugagcugccauuugggugcugggaauagaaucgggguaggcccuuuguuagacugagugccuuuaagcaccaagccaucacuccagcccccuuaaaagaaaaaaaaaaaagguacugcagacagaacucagggcugacuguuaaaguucucuaucccugaaauguuuuuaaacaguagcugauuaacaggguagaaugaugccuuucuccuacuugguauuagcuuaaaguuaauauguugcuaucaccuauaugguacuuagggcaaucccuguuuaguuuuaaccuucauaguaaaugagaccucaacauagcuaaugauguccuaaguccacaucacaaacaugauaacccugaggugaucuguacugcaauguguucccaggaaauaugggacuagugucuuucaguagcagagauuggcuguugugguauaucuguccucaccuuucagaauauaauagacugcuuugaagcaugacuucauggcuugcuacccuguuuucugaucacuagaacaguuaugccuagaucaucaguaguugguguauuggugagaaaaauguuuugacuauauguuuuauguuggcuuuguuggcaguaugaguucggauuauaguuuagguuuguauauuuucuauacaguauuucucaagguuuauuuauuuacuuguucguuuguuugcuuauuuauacacaguguagcccuggcuguccuggaaaucauucuauagaccaggcuggccuccuccugaguacugggauuaaaagugugccccaccaucacugggcugaagggucauuuuuuuaaagauuaauuuauugauuuuauauauaaguacacuguagcugucuucagacacaucagaagaggaugucagaucucauuauggaugguugugagccaccuugugguugcugggauuugaacucaggaccuuugaaagagcacucagugcucuuaacugcugagccaucucuccagccccauuuauua

SEQ ID NO: 9775 - RNA, 4635 nt, Mus musculus
uacugguguuuauucauuuauuuacuuauuuuccauggagcugaagguugaacccagagucucacauguaauugcaaugguauucccacagaguacaccuuuuaaaacuauuaaaacuaauaauauaugaaaccuuaugaauucauuguacgcagcauauaaaacuaaauacacuaguauugaagguauuaaauaguaucaaaccuacaaaaaauuuaaaugauguucuacuaaauaaaaaacaagagucaacucuccauuuagcaacauuuacaaagccauagauaaggccaugcuacaaugauggagacacuggaauauguucucaaacaaaggaacuuggaauucuguguauacaauucugcuagacaaauaauuaaaaggauggcuuccguguuggagagagaaagccaagaugacuuaccaccccucagaauaguucuauuuggagaguuagaagcaucaggccauagagcagccaucaugagguaaugaaggaaaaagccuuccguugcaaacaacaaagggaauuuuuccuccuacuggguuaggguuaaggggaggagauucuaugccaggugaccuaacauauaugccacacauuaugaagacacgcaaggcaccugauaagaauugaggcuuuaauucacagccacuuugagcaugcacggcacuggggaaauggucauuggguaaaacucugcagaagcuuagauuuucuuuguagcuugcagcugucuaggggagagaaauacucugucagagcugcaagcucauaaccacucuauauagcugugcucugagaggaaggcuacagggagugugcucuaguuuggaggaaauagcagauagagagggucuguaaccuaaccuccccauauaagacagguuaucuaaagcauggaaauggcuuguuaacugaguuauauagaguaccaggcauggaggcccacgccuagaaucccagcacuuuagaggccacccaggucugcauagagagcuccaguauagccaggaccacauagaaagacuuuuucuuuaaaaaaaaaaaaaagagugcaguguaguggggcaggcuucaggguggcagccuggggcaggcuccaggugaccaaagcauggugcagugcagacccaugguaaucagcacugagaucagccacaagauccagagugccauuaagaggaaauuauaagaauuaggagcuuacaugagucaagaacuuccugauaauuacauuaugguggugguggccaacaagaggaccuguuccuguuucuagggaacaacacaauucgauucacuguauggcuccauaguguauuagauaaacuucacucuguuacaacugagcacucuagucuaaagucuccugauaccagcaucuuugauagucacgugccuucaaacaagagcaguuuuaguuagggagaucagaggaggcacaagcugccaucccuccccuugccauuucucgcucuaaaccugaaaaaaggaauuccagaguuucuacaaguucacaggagcagaaaucuacuaaugucagacauucauaugaugguagagcuuccacccagcuaaugucaacagugaaaccacagaaggagccagcacccucugaagaugugguugauaucaagccagaaccagaugaucucauugaugaagaccucaauuuugugcaggagaaucccuuaucucagaaaaaaucuacagugacacuuuuauugaaucuagcccuucuauugaaacguaucgaccaccugcacguagaaaugcagacacugguacucucuuaaacaggcugcaacuucaucagcagcaaagcagugcucacgcugccaagcaguuggauguacagagcagucagguauaugaagcaggacuguuguguacuguugugugaaccaccagugcuuagcagcguagaagacacuuauagacccuucuucagaagccacuuggauaaaguaaguauugagaaaguuaccugugguaaguucaguuguuaaaguaaaaagauuuagccaugauugggaaaagcagggagaugaggauuaugggucccagauaggaagcuaacaagaaucuaauuuugaaggcuuucucugaagcuguaacaaaaacaaguuucuguaguuucacagaaauagacacuuccaguugcuuccagaacucaaacuucucaagaaaaauugcuagcagaaaugcuccaggggcaaaauaagaauaagucccccuguuaaagaagaggaagcaaaaagagacaauacaaaaaaaaaaaaucaaguaacucaacagaagcaguaguuauugcaacugcaaauuaaucuaguaauggugaaacaauguagaugagucaagauuacuaugacauggaauuccugauccaucaagauuacuaugacauggaauuccugauccaugcagacacaagaucauuuauuaugaagaagccaaagcugucugagaaaauaguagugacaccaaaccaggauuuggggaugaagacugcauaugcccuuugggucuuuucaagacaccuuaugcagacaagagaccucguacaaccagauaaaccugcaagucccaaguuuagagugauacuguaugguguccccagcuccccccaggauacgcgugagaucaagagaaggggaugggcuuugaaggaaugaaacccauaaaccaaacuucaaacucaaacaaggagcuccgaggucuccuccacccacagcagcugcauuugcugagcaggcagcuugaggacccagauggcagcuuuucaaaugcugagaugacugacuggaguguggcacagaaaccagaaagacuucuggagcgcugcaaguacuggccugcuuguaaaaauguagaugaguguguagcucaucauccaaucucaacuugcaaagccuuucccaacuaaaucugcugagaaauguuuguuugugcauccaaauuauaaauaugacacaguguacuaaagcagauugucccuucugucacauaaguagaagagccccgguacugacuccaaaaccacugguggcaucgccagcaucguuuucuuuucuaauggccagcucugucaaaacuucccugcuuguaagaaaacggaaugucccuucuaggaccugugaugguuuguauaugcuuagcccagagaauggcacuauuagaagguugucacugugguugugggccuuaauaaccucauccuagcugccuagaagucaguuuuccauuagcagccuuuagaugaagauguagaacucucagcuccuucugcacgaugccugccuggaugcugccaugcucccaccuugaugauaauggacugaaucucugaaccuguaagccagcccaauuaaauguuguccuuauaagaguuaccuuggucaugugucuguucacagcaguaaaacccuaacuaagacaacagccaaaacacucuaaguuuaauacucaguguacaagaacagacugcacauuuuuaucaucccacuguugcuguaccaccaagacaugccuugaaauggauucaaccucaagccagugaaugauacccuaguccugccuggcagaagaucauguaguuugaaagcuucuaucuucugaugagagauauucuacagaacuugucacguuuuugaaauuuagaauauauugcuuuucauaauaugaauuuugcugcccaacugaagugucgaauuuuuucacauuuguaaguuuauuaagugguuccagcaauuuuuuuguuuguuuguucgucucgacuacgaaaaagacaguuuaaagaaaagccaaauucuaugaaaacauuuacagcauguuuguacauugcuguuugacaucauuuuuggugcugguacugcagcuaagggcuguagugcugugggaaggccaguguccucagaacugaagcacuuuuuacuuuucccaaagguaaugaaugcaguguuuguaacccagcaaggaaacaguggccaggcuuuaaaacugaggcagcuuuggaacaacuagcuuaaauuuucuuuuuuaaugucuaaaugaauuugcucugagaagcauaauacagacuuuuauuuuugagugcuacuuugguagagugcacugaggucucuugugagagaccaaacugugggaaacuagauccacaauaacucucacccugaagaucuggcugacccuuugaagggaauuaugucacccccuccuucauugucuccaccuggcgccugggacugccagcuucacucccuccuucaugucuccacuuggcgccuagaacugcuuagauuaaggcagcuuccccuccucguccaugucuccguuuggugccugggacuguuuauggcacuccaagauagcuacaagauguuugauggcuuccugggacugguuagggcugacaccccaagauaaacugcagaauguuugaaggcuccccgggacuguuuuagggccgacauuccaagauaagcugcaagaagccugcaaucagcauccgccccagauguccaucccuuuucucuguauuuuauuaugcccucucgaccccucccuguucuuucucauugugugcuuauaaccaggcucuuagccuucauuaaacagaccuugacaacucu

SEQ ID NO: 9776 - RNA, 4635 nt, Mus musculus
agaguugucaaggucuguuuaaugaaggcuaagagccugguuauaagcacacaaugagaaagaacagggaggggucgagagggcauaauaaaauacagagaaaagggauggacaucuggggcggaugcugauugcaggcuucuugcagcuuaucuuggaaugucggcccuaaaacagucccggggagccuucaaacauucugcaguuuaucuuggggugucagcccuaaccagucccaggaagccaucaaacaucuuguagcuaucuuggagugccauaaacagucccaggcaccaaacggagacauggacgaggaggggaagcugccuuaaucuaagcaguucuaggcgccaaguggagacaugaaggagggagugaagcuggcagucccaggcgccagguggagacaaugaaggagggggugacauaauucccuucaaagggucagccagaucuucagggugagaguuauuguggaucuaguuucccacaguuuggucucucacaagagaccucagugcacucuaccaaaguagcacucaaaaauaaaagucuguauuaugcuucucagagcaaauucauuuagacauuaaaaaagaaaauuuaagcuaguuguuccaaagcugccucaguuuuaaagccuggccacuguuuccuugcuggguuacaaacacugcauucauuaccuuugggaaaaguaaaaagugcuucaguucugaggacacuggccuucccacagcacuacagcccuuagcugcaguaccagcaccaaaaaugaugucaaacagcaauguacaaacaugcuguaaauguuuucauagaauuuggcuuuucuuuaaacugucuuuuucguagucgagacgaacaaacaaacaaaaaaauugcuggaaccacuuaauaaacuuacaaaugugaaaaaauucgacacuucaguugggcagcaaaauucauauuaugaaaagcaauauauucuaaauuucaaaaacgugacaaguucuguagaauaucucucaucagaagauagaagcuuucaaacuacaugaucuucugccaggcaggacuaggguaucauucacuggcuugagguugaauccauuucaaggcaugucuuggugguacagcaacagugggaugauaaaaaugugcagucuguucuuguacacugaguauuaaacuuagaguguuuuggcuguugucuuaguuaggguuuuacugcugugaacagacacaugaccaagguaacucuuauaaggacaacauuuaauugggcuggcuuacagguucagagauucaguccauuaucaucaaggugggagcauggcagcauccaggcaggcaucgugcagaaggagcugagaguucuacaucuucaucuaaaggcugcuaauggaaaacugacuucuaggcagcuaggaugagguuauuaaggcccacaaccacagugacaaccuucuaauagugccauucucugggcuaagcauauacaaaccaucacagguccuagaagggacauuccguuuucuuacaagcagggaaguuuugacagagcuggccauuagaaaagaaaacgaugcuggcgaugccaccagugguuuuggagucaguaccggggcucuucuacuuaugugacagaagggacaaucugcuuuaguacacugugucauauuuauaauuuggaugcacaaacaaacauuucucagcagauuuaguugggaaaggcuuugcaaguugagauuggaugaugagcuacacacucaucuacauuuuuacaagcaggccaguacuugcagcgcuccagaagucuuucugguuucugugccacacuccagucagucaucucagcauuugaaaagcugccaucuggguccucaagcugccugcucagcaaaugcagcugcuguggguggaggagaccucggagcuccuuguuugaguuugaaguuugguuuauggguuucauuccuucaaagcccauccccuucucuugaucucacgcguauccuggggggagcuggggacaccauacaguaucacucuaaacuugggacuugcagguuuaucugguuguacgaggucucuugucugcauaaggugucuugaaaagacccaaagggcauaugcagucuucauccccaaauccugguuuggugucacuacuauuuucucagacagcuuuggcuucuucauaauaaaugaucuugugucugcauggaucaggaauuccaugucauaguaaucuugauggaucaggaauuccaugucauaguaaucuugacucaucuacauuguuucaccauuacuagauuaauuugcaguugcaauaacuacugcuucuguugaguuacuugauuuuuuuuuuuuguauugucucuuuuugcuuccucuucuuuaacagggggacuuauucuuauuuugccccuggagcauuucugcuagcaauuuuucuugagaaguuugaguucuggaagcaacuggaagugucuauuucugugaaacuacagaaacuuguuuuuguuacagcuucagagaaagccuucaaaauuagauucuuguuagcuuccuaucugggacccauaauccucaucucccugcuuuucccaaucauggcuaaaucuuuuuacuuuaacaacugaacuuaccacagguaacuuucucaauacuuacuuuauccaaguggcuucugaagaagggucuauaagugucuucuacgcugcuaagcacuggugguucacacaacaguacacaacaguccugcuucauauaccugacugcucuguacauccaacugcuuggcagcgugagcacugcuuugcugcugaugaaguugcagccuguuuaagagaguaccagugucugcauuucuacgugcagguggucgauacguuucaauagaagggcuagauucaauaaaagugucacuguagauuuuuucugagauaagggauucuccugcacaaaauugaggucuucaucaaugagaucaucugguucuggcuugauaucaaccacaucuucagagggugcuggcuccuucugugguuucacuguugacauuagcuggguggaagcucuaccaucauaugaaugucugacauuaguagauuucugcuccugugaacuuguagaaacucuggaauuccuuuuuucagguuuagagcgagaaauggcaaggggagggauggcagcuugugccuccucugaucucccuaacuaaaacugcucuuguuugaaggcacgugacuaucaaagaugcugguaucaggagacuuuagacuagagugcucaguuguaacagagugaaguuuaucuaauacacuauggagccauacagugaaucgaauuguguuguucccuagaaacaggaacagguccucuuguuggccaccaccaccauaauguaauuaucaggaaguucuugacucauguaagcuccuaauucuuauaauuuccucuuaauggcacucuggaucuuguggcugaucucagugcugauuaccaugggucugcacugcaccaugcuuuggucaccuggagccugccccaggcugccacccugaagccugccccacuacacugcacucuuuuuuuuuuuuuuaaagaaaaagucuuucuaugugguccuggcuauacuggagcucucuaugcagaccuggguggccucuaaagugcugggauucuaggcgugggccuccaugccugguacucuauauaacucaguuaacaagccauuuccaugcuuuagauaaccugucuuauauggggagguuagguuacagacccucucuaucugcuauuuccuccaaacuagagcacacucccuguagccuuccucucagagcacagcuauauagagugguuaugagcuugcagcucugacagaguauuucucuccccuagacagcugcaagcuacaaagaaaaucuaagcuucugcagaguuuuacccaaugaccauuuccccagugccgugcaugcucaaaguggcugugaauuaaagccucaauucuuaucaggugccuugcgugucuucauaauguguggcauauauguuaggucaccuggcauagaaucuccuccccuuaacccuaacccaguaggaggaaaaauucccuuuguuguuugcaacggaaggcuuuuuccuucauuaccucaugauggcugcucuauggccugaugcuucuaacucuccaaauagaacuauucugaggggugguaagucaucuuggcuuucucucuccaacacggaagccauccuuuuaauuauuugucuagcagaauuguauacacagaauuccaaguuccuuuguuugagaacauauuccagugucuccaucauuguagcauggccuuaucuauggcuuuguaaauguugcuaaauggagaguugacucuuguuuuuuauuuaguagaacaucauuuaaauuuuuuguagguuugauacuauuuaauaccuucaauacuaguguauuuaguuuuauaugcugcguacaaugaauucauaagguuucauauauuauuaguuuuaauaguuuuaaaagguguacucugugggaauaccauugcaauuacaugugagacucuggguucaaccuucagcuccauggaaaauaaguaaauaaaugaauaaacaccagua

SEQ ID NO: 9777 - RNA, 3166 nt, Mus musculus
uaaacuucuauuucaauuuaugauuugauuuucugugugaacuugugaugauaugccuguaggccuaggaggcugagcaggauucuaguucaaagccagccuggacuacauaguuaguugcaggccugccugggcuauaggguaagacccuguuucaaagcugaacaaaagcauuaugaacucauguauucagucauguaugaacagacuuccauccauuacaagugucacuuuauugagguucagcuucaauucucuuuccauuccuugaagguuggcugaguucuuaacacucuguuacucuccuugcugucucuuacagcaagcuuccauguugaauuuauuuccugcuaugaaccagagaucagcaacucucuaagaguuaugccugcaaagaggaucuguuguucaaggucucccucagcuacaaugcaaggucaaagacagccuaggcuacacaggacucugucucaaccugcccccauuuucauuccagaaaaaaacuucuaaggucggugucugcuauugaggcugccauuguuugaaggagagagccaggaaacagcucuaugcuuguuguaaagauaaaaauggccaggcaggguagccaugguaguccaggaugacuggugacuagagacccucuugcuucagccuccuguguguaagggcacagguauguguugccaugccugcaauucccuauuuucaaaaacaguuggauggugccaacguuuuuaugcucuacccucucccuuuuauacuccaguucuucaaguaaugugcauuuauuauugcugucacuuuucacaugugauucuuuaauguuacauucagguuacuuacuaggauuuccaucuuggaauuaagaaaaaguaacaaagacuagagacaccaacuccugagggugaaguguuauuugacuuaaaaauaccuuuuggaaagggcuggcaauauggcucaguagguaaaggcacuuccugccaaaccugagagucaguuugaucccugugaccacauucgugaaggagaacuaacucccacaagugcaagcauaauguguacucccuccucacacacacacauaagcacaauacagcuuauguuguaauuguuuauaagcaucaucuguugcacaucaacauugucauaaucauggugccaugauuucuucccucuuuuugagacagguucucauauguaugccuggcuggucuggagcucaguguguaaagcagacuggccuggaacuucaagugaucucccugcuucuaccuccucgcccugggacuuagaugugggcaauggcuucuaaaguuuuccuagugaauuauccguaacugcuuugauauugcuacuguuuucuccucaggacaagguuacuauauauaacaccagggagggacagggcuuccgggcagcccuugcauucccuggauuaacuuagguguugugucagaccccggaacuguggucgcuaaggccagugcuggaccacauccuugcuuucccuacugacuucaaagucgcucuucauggcugcuaacaagugacagacuuuugcaaccucucugccuccagucuggguggaugauacaauauaugaaauaaguuguauuaagaagugaucaucagcccguaaaauacaguacaguucugauuauugguaacuacugcccugucagucaaucuagguuaacuuagggcaauaugaaagucaugaguaaguuuagaaaccuacugggggcuggagcaauggcucaacaccuaagaguacuggcugcucuuccagaggacccggguucaauucgcagcacccacaugaccacucacaccugccaguaacuccaguuccagggaaucugacaccccccacacaagacacaugcaggcaaaacaccaguacacagaaaauaaacacugacaagaccaaaaaaccaaaaccaaaaaaaaccaacaaaaaacaaacaaacauauucuggauaaauggaauggcucaguagguaaaaauacccuuugaguaaggcuggcaccuaagucugucugacccccccccccaacugaaccauaaaguuuguccuuucagaucugcacaugcacuguggcaugcucuugucugaauucacacaaaaagaauggggguggggggagacaugauaagucagcaguuaagggccuugcuacucacuaggauugaggucucacucccauguaggacagcuugcugcagcagcccucaucuggcucccacugguacuuggaacacaggcacaugcucacaaauauuuaaaaaucauaaaaauaauuaagaaacccaacaacugcguaaauggggcaaggugacuaaagccucuaauaccagcaauugggagguagagacacaaugaucaggagcagcuuaaggccagccucagcuacauagcaaguuuggggcuggccugggguugguuacaugugauucuguguucugaguaguagguucaagugaaugaacagacugggaauccgacccacagcuuuuuucuuuauuugucuguuuuaauuuugccaccuagaggauaaguuaggugcuggccaccugaguuauuuuguauucugaauugcuuuguuuugaaaaugagacgaagauauaauuucacugugcguuuaucuucuuuaaaaaaaaaaagaauuuaauucauugcuuuaaaaaguaaaaaccaguacucaaaguuguugaucaucaguaagaaacuuucaugugcuuuuuguaaauacugccuaaugaaacaacuggaccaggggggaagaugaugcuguuauuuuaaaacuaaguucuccuauacuguugguagaaaacggguugaucguggaucagugguaaagaguuggagcuccuaagaaccccugacucugguaaugucguuuccugcugucacuggggacuaggcgugcuccauuucaaagugagccuacucuaguuuuugaauguuucucaugauaauuuguaugcuuacacauugaagguauuuuuuugaaguacuaacauucauucuuugguucaaauguaaaaagaacuugugaucagaauuuaaaguguauaauucuucuucuuuugaaaacuguauuaugagaaauaaagaguggcaggaccauugcuuucauuaaaaaaaaaaaaaaaaaaaaa

SEQ ID NO: 9778 - RNA, 7978 nt, Mus musculus
ggcugcggaaaggggcugggcugggcugggcugucugcagcucuaguccaggaggcugagacuucgagagggacugagaggagcaggcacacgcaucccagacucacuggaggacaaggugagggaacaacauugggcuuuccuggugagcagacagugguucuaacuaccugaaaccuauagcugggcaggugggcaauucuuauuugaccacuauagcuggagcagaagugcugcauuugaugcggugugagaaugagaacgaccaagaaaguaguaagcuguauaugaacuggacagcagagacuggcagagguggaggggagaaaaaggggaacugugcaugcuuggaggagaaggaagaauauggggaaauaagaaggggaaggcgagauccagggacaagaauaggggaugcagagaaggguuaagggacacuggggagggggguugcauagguaacacagagaaggauguaaggaaugggaagagauuucuguagaguaaauaggaaaugcgaugggaaauagggaguccggaguuaggcaagggaauagggagggggggaauaaggaguguugaggggggaggggcagacgggcugggacggaggcccccuagggaggcggaaaggggcgggaccacuuccggccuuuaguggggagggcaguaucugaguuucggaggggcuuggagagaguggacacacucgggaauuguaggaggacgagguaagucaugggccccagcuuuggaugagagccugcuaggggucggccccacccucugggaucuggagaaaaccugccuuaagagccaaaucuuaccgaauccauccagcuaggaagggaggggacuggaccccguuuggcugggccuaagauggaaucacuaguucaauccugaguugaggaggggguguuacagggaaggagccaaaccaauuuggguuuuaccguuuggaggggggcguguuaggauaaagggcgggaccuggaggcucugugaaauugauagggugguugugaguaggggaggggcuaggaccaccagacacugcgacaauuuggauggaagguuuguuggggagggggcggggcugaacagcauugcggaccuggagaggggcguguauaggaguugggugcuggacugagaccguggacauugcgcaugcgcuuuauguauagcuagaaaggggcguguugagaagggcucgcagagacugggccagcugcugaaugcgcaugugcacgguggacuucaaagaacggguuuguacugggaaagcaggcgggguugaaagggcgcugcagaagacgcgcaugcgcacucuaagccugcggcugggggggggugcgcugggaaaagggggcgggguccucagagcugccgcgcuggcacaucuuccuggaggaggggagggugcggcugcagagaacugagaccuagagacagaauuucuguaucugagcaccuacugguuggggcuccgggaggggcugggcuuuggggcccuaaagaaggugaggaucagcuucuaggcagaacaagggauacgacguucagcgggcucuccacuugacccaggccuucucuuugaacucagcuuugcuaggugaacuugagacaugucugacacaagcgagaguggugcagauccagcucgcucucagguaagaccgauacccccccccccccuuucuugcugcuugccuuucaagccccuuuugcugcccuaaauccuuggagcuucuccucccauccuugucauucuccacccacuucuuugccugggugcauccccucuccccaguggaggggaggccaagaggaagggagagagggugggcgggcccuugguucugucauuacuuuuuaacugggaagccuguuuaggcugggguggucagagcacaccacagguaagagucuuuacaggucagagaaguguagccaccuaauuuugggaccauuugccuuguugaggggugggaagaaggucagugaacuuccuugcuuucccuugcagggcaaagcuucagaaaaggacagcggcuccgugaugcaggaccuguugaccgugacccagaacuuggaggucucagaaacaccaaaggcagaaaaggcaccagagguuucagaggcugcaaaggcuccaaaagccucugggaacccaaaggcgacagaggucucaaaggccccagaggcgucugaggcagcugccacccaggccucaccuaccacacagcugagugagacccaaguucuggcaacugaaaacaagaguccagcagcugacaccaagacgcagaagucugaccugcaggcuaugacaaugccuacaaccccgaccaaaaaggucagcugugguaccgauccaaaggucaauacaaaggcuccggagacugaggcuccugccucucaggcugggacagaugaaccagagccugaggguacagcuguccagguucaggagaaccaggauacucggcccaaggucaaagccaagaauacccaaaagguaagacauacccauccuugcuucuccacaaucuucuuguucauuugucugccaaaauuaaaacaauuccuguguuccugaaagacccagcgcacacuaacaggagugugucacaguucuuguauccacagagcucacaggcugguggggagaugaggcaggcauauacauagcuucaugcugacuggaaugcagcuuuuuauauguacagaguagcuguacacuauagaccuugagguaggcuuauucacauguguagucucauaucugaaaguaacuccuuaugguaccauucuguauggcaggaaacugaugcccagaaagaaagaggacuggcucgucaauggugcuagaagcagagucaggucagggguggaugugggaagacgaaagccucaggccuuauuucugacuuguuccugauccacucagggaggaaauucccaacugguagucagugauaagcccaugacucaggauggcuaguguccagugaggcagagucuuacuacaagggcaggguuguggggauguauccuagaagagacagcguugggugugcuuuccagaagagacugaguuaagagaaagagccaccugcaccacuugcugauauugaccuuccccucuuucgaugcaggggaaacacccggauggagaagaggauggcaacagugaccagagucaggcuucagaagccacagguggucgaagggucucaaaggcccuaauggccuccauggcucgcagagcuucaaggggacccauagccuuuugggcccgcagggcaucaaggacucgguuggcugccugggcucggagagcuuugcucucccugaggucaccuagagcucgcagaggcaaggcccgaagaagagcugcgaagcuacagucaucccaggaaccugaggcacccccacccagagauguggcccuuuuacaaggaaggguauggacuccacccucuacgucucaccuuuucaauuguguugccugaugucuucucuguugugcuuuggaguuuucuguguuuuguuuuuuuuuguuuuggucuuuucaucauuuuucuuucuccuaggcaaaugacuuggugaaguaccuguuggcuaaagaccagacaaagauucccaucagacgcucagguagaguccuacaaacacgugcucucuccugagcucugccuucucuugucuucucaccagugugcuggggacagccuucauucucacgcgccugucccuuuucacaaaguucuccuaacagugggaucucuauugaaaagcccccccacaacuugguucugccacccauggcuuggacaacaaagggucuguugauugggcaucaggguuaccugguaucucuacagcacagaugcuugcaacacucucauuugcagauaugcugaaggacaucaucaaagaauauacugauguauacccugaaaucauugaacgagcaggcuauuccuuggagaaggugaagggacagcccugggggaugggugcacuggggaagcuuuaaacagaagaaaggcauaugagcacccuccuggaggaaagcagagaccuacugcauccucaucacuguagaguugagcacaugguggccuagggaggggcagccacugaccacacagcaagucagcuguggaaacacagcuagugcuaaagcugugcagcuuaguccuggcuucugccugcugcuggauacaccaucucauguguugcagaugcucaccccucugucucccuaaauucccccugauuacaaagaugcuauggauaaccacccuauguuuguuauguguauaaauagcacauaacuaugugcuuuauauacaauaguccauuacuuucuuucacacacagacacacacagacacacacacacacacacacacacacacacacacacacaaacacacacauucacaugugcagaaaacccuuagcuauaaaagaaacuacagaagcccuggaagcugaauuuuaugauuuuauaaguuuuucuuccuauccauagguauuuggaauccaauugaaagaaauugacaagaaugaccacuuguauauucuucucaguaccuuagagccaacugaugcaggcauauugggaacguaagccgggaaagugcuagggugggaaugggccucugcuuccacccauccaucccucucuccauggccuauuagaagcucaggaaagaaggacuaaacaccccuguccccacucccacacacgcuggaucccuguggguaguagugguauuagacuugcuuggguugacaggcauccuuccauguccuaacccuauguaggaguagcauuuugguguguagagagcuuggcucaagagggaaugcauccugccuuaggucaggcugggaccauagaguaggcugaauucucuguaucugagggaucuaggagagggcagccuagcaagcugcuuuacagaugauggcucaugaacguaaacuuucuuuaucuuaggaccaaggacucaccuaagcugggccuccucauggugcuucuuagcaucaucuucaugaauggaaaucgguccagugagggugaguggaugggcaugcaguugaauagguagcuguugccugaauuccagaugcucaauuucugucuuugucuccuucuugccuccucuugcagcugucaucugggaggugcugcgcaaguuggggcugcgcccuggguaugauugggcucucucagcgcuugcuguccguguugucuuuuggcaagagaggacgcucccaggauugcaucagccugguggucugguggagcuggggguggggauucugggcuggguagugggcccaagauuuugacccguguggauggggaaauggcucuugucucugcucacucucucaaccaucucuugagcuuccauggagcuuucucugugcuguaaaucucuuuucugucuuggaauuaaaugccucugccaucaucugggaaguguaccagaucugauuauauuuauuuguuuauuugagcuuucuauauucccaggauucaucacucacucuuuggagaugugaagaaacucauuacugaugaguuugugaagcagaaguaagugucguugucugcuguuggacucuaccuugcauuuugucuauuuugauaauggacgugccccaagcauauguuugcaugggugcauguguauaggccaguggcagguucuuucugggugcagucauagauuucuguuucauacgugguuuuagaacaccucugugagggagggguuauuaacagcuuuguacauauguagaaauagucuaaaugaagugaaaagucauuugcucuggguuacacagguggcaaauaaacacuguguuuagaacauguuuuuuuuuuuuuacuucacuaaguaguacuuuaugaaaauuaacuucugccaggugguggugacaccugccuuuaaucaucaggaggcagaggcagguuggucuuugaguucaaggcuagcuuggucuacagaaugaguuccaggagagccuucaagucuacauccccccccccacacacacacacacccugucucaaaaaagccaaaaaauuccaucaaaauggccuugacugguauccuuaggcagccuaggacaaugcuggguacugacuuguucauuugggaugacuuuuaacuccuggucauccuguuucagccuccugagagcuggaauugaaggcaugagccacaauaccuugacagucuuuuuuuuuguuuuuuguuuuuguuuuuuuuaaaugguagaucuugccagagccugguuagucccccccuuccaaauucuggcaguguggugugcucagagcagggacggugaaaagaggccucucuguuuacaacacacccaacaggaaucuggcaccauguaacaaggagcacaacacucauguccucccugugagcaagugcccugcacguuucucccuaguucuuccauguggcuucugggcaugaccaaaaggauacgguuccauuuuggggaagggcuaaaggauuuaguugggaauguaugcauuuucagccuaacuaguccauucaugagugguucacaacugacccuauaaauagacuuugauucuuuucuuuaaagguaccuggacuaugccagaguacccaauagcaauccuccugaguacgaguucuucuggggccuacgcucuuacuaugagaccagcaagaugaaaguucucaaguuugcuuguaagguaauugaauguacuuggcacaugaaggucauggggugcccugggaugggcauucuauguucagaguguccugaaguuuauaucuggacauuuuaaagcuucugaguuaucaaacagugugacaagcaugauaccuacaucauuuaauccuuacaccugauaaggcguuuuuuguaccacccaugugaaaacagccucagaaaaguuggugggugauguauucaaaucauggauccagcuaaguggugaagaaggguucgaaugguuggugcaggauugcuuguaguacuagcuguacuguuacaugacauacaguguuuaguauggccuuacagacaguagguacuaaauucucagugaaccuucuaaggguuauuacuuccauuucaggugcaaaagaaggaucccaaggaaugggcagcucaguaccgagaggcaauggaagcagauuugaaggcugcagcugaggcugcugccgaagccaaggcgagggcugagauuagagcucagaugggcauugggcuuggcucugagaaugccgcugggcccugcaacugggacgaagcugauauuggacccugggcaaaggcccggauccaggcaggagcugaaacuaaagccaaagcccaaggaagugguggugccaaugccagugcuggugccggugccaguacugguaccaguguuggugccaguggcagugccagugcuggugccagugcuggugccagugguggcuucaguaacaacuccagccugacugccagucucacauuugggcucuucgcuggccuuaguggagcuggggccaguaccaacagcagcucuggugccugugguuucuccuacaagugagauacagguaucugucaugguggcagugagguggcuggggcucaugggggcggcuggguuggagauaagccuggaacgugugcaaagacacugcugugguuuuacuguggcuuguuugcuagauaucaacugacugauuuuuccuuuacuuguguuugcagauugcuaauaaucacagcgucuucuucucaagccagggugcacucucagaaacguacucaaugcagcacuccaggcagccacuaucaaaucaacugaagucgacacucuauauuaaaucuauuugccauuucugaguuuauugccauuuuuguuuucuuuugguagauugucacauuuuaaaaacaa

SEQ ID NO: 9779 - RNA, 9452 nt, Mus musculus
ugggcugccugggagccacgugaucuaaacggaugauggcgggcgccgcugaagaugugcgugugcucuucggagcugcaguccgagcugcgcuggaggcuuggccugcuuuacagguaagugagguccuggcggggggucacgauuaaggcugugacaaaauagaaguugaccaggcgaggcgccagagccauggcugggcgguguaagcggcagacucccaggccccggcaggccacgccguucugguuuccaugcugucaugguuggcuugggccuguguucacagaucgcuguggagaauggcuucgggggcgugcacagccaggagaaggccgaguggcuagggggugcaguggaggauuacuucaucgccaauggugagugaaugugagguguugcugucugucgcaguguggcguggcagagccucgacguagagagcccgcguuugaugaaugaaucgugacuuugagaucagaauugugucuuuagagugccuuagaggcaaugacacucaaaugcuauuaugcuggagaacgcauuuugccuuccagagagucauuuuccuacuuucuaaaaugguuauggaaagauccgacgaaaagaacuauucgagucauaucuuguaacuuaaaauugcuggaugaggggugggggacagcuccguggacaaaggccaacaagcauaacaguccgaauuucauagcugggacaacauggaaggagagaacugguacacgcuuaagguguccucugauucucccuacacaaguaaauauaauuuuaaaauuguugggugaggaguguagcccagugguagagcacuuuccuagucugcucgugucccugggcuccaacccuggugccaccaaaacuaaaagcaguaccucugauaaauaaaaggcagccaggcccuguggugcaggcauguacucucauauuccugaugcaaaaggaccucaaguucagauucaccacaaccuugucucauaauaaaaauaauauaaagacuuggagauauagcucaauggaagugcuugcuuacuacacacaugugaggcucuacacuacucauacuaccacaaaugaauaaaugaaugaaagaagcaaauauuauaguguuauuaaauucauauccaaggucuagcauaugggccauguuugugauucuagcaccagggagacggagacaggggaauugcucuaaguuucaagcuccauauccccaaguuguccuuaugauaaaagaaggggcuggagaaauguucagcuguuaaaagugcguccugcucuuccuaaccugaguuggguucucagcucacaaccaccuguaacuccagcgccagaggauccaaaauguuccucaucuguacacaugugcaugcacauacauguaauuaacaaauaaguaacacagggcugaaaggauggcucagcaguuaagagcauuuguucuugcauuggaccucgguuccguucccagcaccuacaugguaucucauaguuaucuaugacuccaguuccagggguucugauaucaucuuucuguccuuaucugggcaccagguacacacagugcacacacaggcaaucaaaacaacaugcacaugaaauaaauacaacaaaaauccucuuccaaaauauuuuaguaugucauaagaauuaagcauuuuucacuuuuaguauuaaauuucacaaucuggaguuuauuuauuuauuuagguuuuucaagacagaguuucucuguguagcccuggcugcccuggaacucacucuguagaccaggcuggccuugaacucagaaauccaccugccucugccuccagagugcugggauuaaaggcgugcgccaccacgcccggcacaaucuggaauuuuaaaagucuuaguacgucucauuugugaccagccacauucuaagugcuugugcucgauaagcacaugcugcugcuucuacacaaaaguucuacacuuccauuuugucuuggugggguauaaaagaacaagaggacuuagaguauugcaugcuguuuuuuuuuaacucuucauuaacauccuagguuuuuuuaaagauuauuuuauuuauaugaguacacuguagcugucuucagacacaccagaagaggacaucagaucccuuuacagaugguugugagccgccaugggguugcugggauuugaacucaggaccuuuggaagagcaguuggugcucuuaaccacugagccaucucuccagcccccaauauccuaguuuugaggaugguauuaggcagauucacagcucaacauuuacaaucuagugagugauuucagguaaguaaaugaauaguuaaaauacugggugguguguguuaugcuaaagaggagcucagaauucuucaguuaacugagccugaggagaagccuuuuugauuugauuuuuguuuuuuggguuuuuuuuuuuuuuuuuuuuuuuugagacaggguuucgcuauguagcacugacuauucuagaacucuucuguugaccaggcuggccucagacuccgagaucuaccugucucuugucucccaagugcugggauuaaaggugugcgcgccaccacuggucaguaagaggccuucuuaagaguagcgauuagagugaggccuaaggaaugaaaagggggaaacuagguagagaugauaaagcauguacucaaaggaguuaagugcauuauauuaaggggauggaagagugguagagaaugguguguguguguguguguguguguguguguguguguguacagagacacugacuaaaggguaagagauaaaaggccuucugugacuuugcuuauagagauagaaagccagugucuguaaaauucaagcuauaaaagacuugucucguuagauauucaaugaagaaaauguuucuccagucaaauuauagaagcuuuuuucuuccagcugcuauuuuauuccuaguaguaguaguaguaauuggagacaguaucuccuucuauagcucaggcugccauggaauuuauguuccucaugccucauuuuccugagugcaggguuauauaggugugugccaucaguccugacucuguuuuccauuagcuuuuuauggagaucuucccguaaaacucagcaaaauugagcugggaauguaacacaauugguagaguauuuaucuaacauaagagguccaggguucaaucccuagagccacauuaaccaggcauagugauucaugccuguaaucuuagcacugggaggugaaggaaggaggauaaucaauuaccaggaggaauuccaggcuaacccuguauuauauagugaguuugaugcuagccugggcuacauaccuguuauaaaaacaaaacccugaaacucagcaaaauauuuccuaaaggcaagcuucacaauaggugauaaaauucaugagcagguucuaagguaaguaaguaguguuugcuagcuagaaaauucagaaaguaguuaguauagaaaauaaugucuagggggcuggugagauggcucaguggguaagagcacccgacugcuuuucugaagguccgaaguucaaaucccagcaaccacaugguggcucacaaccacccguaaugagaucugauggccucuucuggugcaucugaagacagcuacaguguacuuacauauaauaaauaaaucuuaaaaagaaaaaagaaaauaaugucuaacguaggacaauggcaauggucagagaaaaagagaguaucaauagaggggguuuggaaaagagauuuaugaugaguggcaggguagauagaagccuuucauuggauagaggaaccuuggaggaugagaugcugguuuggaaggcaggauaauaaaccuggcuuuggauauagggaccuguuuaacauuuggacacauaauuagccugaguggaagacaaaauuuuuuuuuaagauuuauuuauuuauuauauguaaguacauuguagcugucuucagacacuccagaagagggagucagaucucguuacagaugauugugagccaccaugugguugcugggauuugaacucuggaccuucagaagagcagucgggugcucuaacccacugagccaucucaccagccccggaagacaaauuuuaaggcuguaagauuugaaugguagguaaaaguagaaguguggaagagcuaugucugggagaaggcauauagggaaaagaaagcuagucuuucauuuaggaaagauagaccauuggcccagaagauaacugagcuccaaagucugaaggcaguauugagguuaugauuucagucuugaaaguagugcaugcagcggaggcuguagcucaguaguuguuugcccagcaugugcuucacccugggguugauccccagcaccaaaaaucaaugaagucccguguccauuucuucuuacccauugcccuugaaucucuggacuccuguauuaguggagccacaguugugaagggucuccacauuucaguacuucagcugugaagugaugcauauuaauauuagggauuuuaucucccuugugacaagcacuguguaaaugaguccucucaacaaacccuccugaaggcucugagaggagcagcuugcucaaggucgcucuagcugagguugguuagaauagacaaguaaaagaggguguuucagugaacaaggggucacuggaccuuuaccugcuaaccagauauagcaggcaaguauugaagaauggugagggcugaugaaguuggccuuugguuaaaggguucuguccuuuccuauuuagcugacuuggagcuggaagagauagaagauuuucuuggggagcugaugaccacugaguuugauacaguuguggaagaugggagucugccccaggugagcuuauggagacagcugccagcccccugccugcucuuucucccuacuguguuagggacaagguucuugugaucauucuuuucuugaggcgcagacauucccuauugcauuuucaaacauuccuuuauuucucuauuuagaucauucucaaccaguauuuuccccacaccccacaagcuggguuggagcaaauuccaucccuauucugauuaacacugcuuacccuggugagaucaucuuucauuuugcaucuucagucccuuucucuuuuuugggggacaguguuuuacucucuaacauggguugccugaaauguacuguguagcccagccuaccucaaauucauagcagucagugugccucagcuuccuaaguacugggauuauagcuuguguaccacuuagucaauucuaguaccuuccuucucuucuaggaggcccucauucaaggcuucacgcccucaccccagcccuugaauugugguugcuucgaugaacuuuguuguugcuuuauuuauuuuugagacacagucuuacuauauauccuuggcuguccuagaauuugccauguagaccaggcuagccuugaucucagagaucuacuugcuucugccuacugagugcugggauuaaagaugugucagcacuuccagcuguuguuuuauugacaguguguuacuaugaggccaggcugaccucaaacacaaaauucucuugccucugaggucucucauuuauaugcauccaccacugugcccaucugcuuggaugaacuucuuagggagaaaaagagcccugaaaauuccaaacccccuucucugcuguaaacaggcugguuuuacgguagauugucugaaaaaaaaucuaaggcgguuggcuauuuccuugguaggugagccaacagcuacagaccauguuccaccacuuccagaagggugauggggcugcucuucaggagaugaccucucagaucaaccaaaaaaagugcaaagucacggcuaccccacuuaugacagccaaagaaacugauguggcugaagaugauguggacagcguggaagaaauggaggugaaagaggugccuguacugaggggcgguauuccuaaauguuuuuaauuuucuagcuagauucacagggaagugauggcgguuguaggugguagugguauuuucaaggauagcucacauagucauggaaaacuuaguagcagagccuggguaauguacuuaagagacuucucuuguaucuuccuuccaggugacagcuacuaaugauggggccacaacugacgaggucugcccacagccucaacccucugauccagacacccagacuauuaaggaagaggauauaguugaagacgguuggaccauuguccggagaaagaaaugagcagggcaguacauguuuugggcccucguuuguuaaauguuaugagacuuauaggagcuguuugggggcuauacaccucuguucuggaaaccauaacccuucuuuguuccccuguccuucccuucaggagaaggaaagcccuaguugugggguugaugggaccuauuccagccccuugaaucuuaagguaccauaugagagcuaagagcagguuucccagcauaguaccuccuaggugcagugacuaugaagacggcugacaagugugggugugguuguagaccagacuuguggaaaacuggcagguacauuuguggaaaggaccagaauuccacagugguaggcuggcuggauugguaauccagccaggauaagcauacaguuggaagagagaaaagauguagacaucucuacauuccccaauguccccacccuagccucccucagaacaacccucauccugcccagaauuugcauccuccugggaaugcucccuguuugaauacccuugagaguuugaaggacuugacuaaaaguggugaacuugagaaaguugggcuguuuuaaguccagggaugaggcuuaagaccuuaauaacauauaacauuuucuuguuuaauccaugauuuaaccuuggaaucagcuuucugcaagcugagcuucaaaauuuggcaagagaguaguuucuguacccucccaucucccuuaguagccugggacuuuggacaaacggacggaccauagcagugcucugaaaguuacuguaugccugaaauaaacuguauuuuucuuuaaaaaacaguauccauuguccucccccccccucccccauucccguccugcccaguggcccugccauggaucuggacgauaaaauacuggauugcuuuggggcuagguagaagcuauaagccaugggaaaggcaagaagggucuagucaccaccccauguaaggucauacaugugaagacacuggcugaggaggaaaggguggguuggggucccagggucaguagcagagcuggcacuugaauccaggucuccugccucugguacuuuuguggggagcuggguggaagugggguacugggaggaaacuaauucaagugagucuagcaauuagcucccgcccucccuggggacagggauuuaaaaaauuaacaucaauguaggaauaguuuuuuuuuuuuuuuuaaaaagcccaccuuuugugaaaagaugaauuaaaaaacccaugacccagcauucgggauugaaagugcccuugaugggaauucaaguauugacugcauugggagugggcuggagcccccaauugaacaugggcagcuggaguguggggcagaaacucccaguuccccccaaacccucuaggucuugucucgggucugggaggcuucaggagguucagcaguggcuccugaggcugccacuggugucuccuccaucuccuuguccucagacagugugggcccugggcagaauguguccccacggcccgcccugccgagaacagccauccagcgccgcuggaguucuucugucucugggcugaaguaccagcuuagguggcuuugugugaucuugaagacaugccuccugucuggccgcucuccugccucaggaggccccaccucaaagccaaugaggggcaggcugcgcugggcuuucacauccuggagagaaggaacagagaacuagugucaucuaggggcuaggcaguauccucugcccagucaaacugcucuguucugcuguuucccucugcugaagaacacugauuucacuguaaugaacaggaagauaucugaacugggacuagaaggcaggcugguuuacauggcuaucuccucccaugcccaaaucaacuauuauagauucaguccuuuggcuaguuccucuaucugccuauucuguucuacuuaagugucagaccuagaggugccugucuauucuacuguuuucuccagaaagccagacuucccaccucacccucauuguccccauaccuuggccuccaaacucuucuaccuaccuauucugucacauaaggauagggguuuuaauuuuccccuuugcuaggcucacccugcccccaaaggacaaggagaggagcagcccagcuuugucagauggcuggaaaaaccugaaggagugggaugcacaccugaggggcuccauagauguacagcaccaaggguucauucucaggaaccacaaaccaugccuugugccauccuuucccacccuucuccauguagugcaggaagcugcagaugacgcuguucucagcagcgaccgaggccuguuucugugaucagagacacaggacagggaacaucaauguugauggaaggcuuugcucuuggcuuuaacagccccauaguguauggacuaugucucagacaacgguagccaagcugugcaaaucauagcugaaaugauuuagccuucaucauggagauaaaacaaagcaaggcuuggcugcugcugacucuuaacaacaaguauaaggggugugcagaucucaguggggacagugaaaugcuggccacucuuaaggcuaagggacuuucacagcuaacccuuuucaucuuucauaauauacucauugccugcucugagaaaguccuucuaacauuaugauuaaugggaugaguagguggcuaacaccaucugucucgauccuaacaauagaugaaaaugcaggacuugugagaagagcacagaggguguuuaugagauugaaauuagcauaagcaaggcauuuaaaauaguucugguacagaguaagcucccuuacauuugggauaccuugguuuuguugaaaaaacaaucaccccaaauauguguauauucaugguccuaaaaagauaggaucaguauuaacaguggcaacuucuggguaaaggaauaugucuuauguuuccuuauccuauuucauaauuuuaaaaaugcacuugguucauuaaaaagaaaaaccuauaggcuagcuuaggcuaugcagugagacuuugucucagauaaaaugaucccuagaaguguuuuucugguuguauaacuuagucaaauauccucucuggguuuuaguuucuuccuauguaaacuaaggguaagaguugagcaguuacuguaagaguuaaguguguaaaguucuguaauaaaaaguauccuuuuaacccguac

SEQ ID NO: 9780 - RNA, 158 nt, Mus musculus
cuuacggacccagcuucguucuccuccagugucuucucuuagaguuguaccugauuuuguuaccaguuuucauccggauccacugaagaauagggugauuuugcuuuuguuucuuggccaggaaucgcuugauucugaaagucuugugagaagacaug

SEQ ID NO: 9781 - RNA, 158 nt, Mus musculus
caugucuucucacaagacuuucagaaucaagcgauuccuggccaagaaacaaaagcaaaaucacccuauucuucaguggauccggaugaaaacugguaacaaaaucagguacaacucuaagagaagacacuggaggagaacgaagcuggguccguaag

SEQ ID NO: 9782 - RNA, 134614 nt, Mus musculus
agugugagcugugcagccguggggguggggggggcuuuguaagccgagggcgagggagggggcugggggggggggacaagauugcuacuggccucagacccugcacacuguugcaggccucgccaagccccugcggcggaggugagcuuaguuccccccuccccucuuccgggaccuggggggacggggcgguuuuagacuccucgagguagggggcaguucccacgggaucuggcucugaggcucggagguagccgcuuuggagagccuuugggaaaggcugcugaagggccagacuggcgguagcagcagccuuccucgaaccccuccuccucuccccucccccaguccucugcggccuccagcagagagcuagcugcaucuuuggggacagcaggacagcggggaagcagcgaacagcgcgcaagagagcggccaacaguggggaugcgagguaccggcauuggcccuggccuaguggcccuagaaaagaaguaaaggcccagccuucaguuuuucucuuaaggguuggaggaaggcggcuucaagaggaaaaggaaggugaggggcgagcaggcaagcuucauggucacuacuaggcgcgcgcgcgugcgcgugcauguguccugauauguauguguguguguguguguguguguguguguucugauauguauggugcugcaggacacacauucauuuuguuucauugcauuaauuuuuaaaacuauuuuauguaucuuaguauaucacagcauucaauugugucccauuuuuacauagcuauauuguaugcuuggacuacaguuuauuuaaccguuuccugauuguuguacacuagcuuguuuucuuugggggagagggggcuauugcaaguaaugaaugggcuuguguauguuucgugcacauguacgaagguauuccuguaggagaaauucuucgagaaguaauagcagaaucaaaacguguauguauuucaaaucuugauagauuuaucuaaaucuccuuccccaaaggccauaauaauuuacacucuccaacguaguacgauauugccuauuuuuccauagcuaugccaacaugaauuguuacuuaucuuuauaucuuuucaguuauacaguaaaaaaucacaugucguugcuuucauuuuacugcuguuugagcauauuuucauuuuucuaauuacaaaagucaguaguuaaauaugaacagucuuguauauaagcaauaaacauuuugaaauuuuaauaccaacccccccacucuaaauuucaagaaaaauaaaaauaucuggaaguaaacuauaaaacuuucaggaauacaauggaagaacguuugcauaaauggagaaggaauaucaggcuucugcauaggaagccucuauucuguaacgauauucauuuuucuauauugauucaagcaguugaugcaauuccaauaaauauacuaaguuuuuggaacuugacgauucuaaaguuuaugagggggggauggcuaagaauaaccaagaaaauguuuuuaaagaugggggugcuuguacaauuaaacuguacucugaaggaagcauguuuaaauuagaauagacagaacaauggauuagaauggaaaagcucacaaacgggccagacuggaucccgauuuauuggagaaacauuguugguuagacaugcaaaaacugccauauuaaaaucuccaagcgccuuucuccccaccccaagcuugaauuugcuuuugagggcagacgccuuuguuuggagaaaaccacuuuauugggucuuuuuuguuauaagguaaggaaagccucaauauuuaaaacuggugacuccggagguagaacuaaugauaugagcuuuuagugaaaagauggauucagguuagccugcagugcggcgaaggaagaaguauggauauuagaggucuuuagauuuuuccccccauguuuugagcacaaaaacuggugugucauuguuuccauuugcauuuguguguuuauuguaaauugaacaucuuuuaugcguuaguuaagacuagcacguuauuccucgaggcagguaacaaugggaacccauucuuuucgcuuucggaauggaguuuggcuaauugguacagcccugcuggaagcgugagaauaaacagguugacuuuuuaagcacuaggcaggcuccagacaccuaaaucgggggcggagguaguuuucaagacauggccgagauuuggcgcugagcugugucaucgcgagguuugguagcaagcuccgcagugggucggaaaccucgugguaagcgagaucccuaaaggacgagagcuuccucccuuuccccgaaaaaacucccagucauuuucacgaagcuccgccuuucuccuuuuuaggagcgugcaccuggucucgcgagaucucauguuuccuaaaggcgaggcgcgggcggucuccugcggugaauuacgaaggucucggcgaggcugaacguaauaucgcgauaguuccuacggcgcaugcgggagccggcggcggcaugcuggcuccgccccguagugcuccgugagguugugcgucauuugcuuuucgcuucgcguggggugagagcggagcgguggcgauuugggguuugguggcaagcgaggguugggacgggcugggcucaguuuuuccugguccgguggagguucuccugggaucacgcgaaggcggcggccgagguuggcuacugagugcaggagcugcggaggcgcgagcagcgucuucuggugcugccguucuuagccggugaguucucgcgggagcaggguuacguccucguggggauucgccggcgguggcggagauaccuugggggugggggggcagugacuagggucgggccgccuguuaagauggcggcggcggcggcugccugucuugcucuuacacgguaccaagggguuagcuauccgcguuugugacgcuucucagguaccagacguuaaggagaugacgaauggcgaaacgucguggugccgguaaauccuuccugagcugaagaccauccuguuucuuaccgguuaaagcgacaccauuucccccggccucugccucgugugggccugccuuugccccaccaaucgcucuucgccucuguuuucgucgucgcagugggcggguugggaagugcgggagggaguccauaguucauuggguagugggcuggggauuagauuaaaaagugggagagagggacgcaccuaagauuguucucauaauuauugcgcgcuugcugcuucucagcccuugcagcgacccauaugaaaccccuaguuuuucuugauccgaggugggcucugcuucccugcucccgcggcuuucgggcuaagguuugagaggucaaucuguagagucauuagaguaccuucccuuucccaaauucugucucccugucaaaucgcucagcuacgugaauaucgggaugcauuauuaaggggagaaguuaaaaaaaauccuaucacuccuccucuguaguccuaauuuagagccuagccugaaucaucuacccugucccauguccuuccguggugcuuuuggcgcagauguuaaaagagcuuaucuuauucccugcauuuacuccaucuuuguggauggaucagcaguaaccuuccauuuuccuagguccucuugcuuguuuaucccugacgcggggacagcguacugauuucuucaacuuugaauguuuugagaccauacuugggcagaacaauaaacgggucaguggucggauaauugcagucuuaguggucuccuucgugcccccacuaggugaaacuuugccuuuccaaccccuuccacgcuacaagcucugggacccgcccccuuucccgccuauguuucuguagucugcuggucuguauaucuuuuuguuuuguuacagcuaaccaacauuuaagaacuaagucucacuucuuaauccuuauauuucucucuuaacugcucuuccucccacccccaggagcugaauccccuagcaaggugucgacccccaguaccuuuuccuuccuccaggaguuuuaccccuaaaacagucacgcuccuuuuaaauuuaaauuuacuuccuuucuccucaaaucacuucuauuauagacaauuaauucccuaucacguguuuccuuuguagauaacaugauuugaauuacuuuuuauuuagcaccaguguugcauagauugaggagaugcugccaacauuuccaauucauaggaagcagccugauuuagaaaguuaguguuugcuuccaguucacauugaacucaugaccuugggcaaauuacuuuucagauuuuguuuguuuauauaaugaggguaguaaugcuuaccuuguagaaaauuugccucagaaaguuugggugccuuuuuaaugugaaacuguauugguagauaaauguuuuugugccauauucuaccuuuauagccugguaagguuuuuaaaaauuguuauuucuucagcuguauuuuucuauguuuaggaauaauaccuauucgcuccugucugcuuuuaauuuuuuccucauaagccacuuuguaugaucagugguucauguuugaauauguucucacuauuugaagcuucuacugguguaagacuuuugaaugcaaaaucauucucuuggaaugaccaccagcuauguuucggucaugaaccacacccaaguguucuaccuuuuggaagggagugccucaucccuugccuacucauuuuugccacuccuucaaauacagucuguccuguccuucaccucacaaaagucuugaaauuucaugccauugccaguuugcaguguuaaagagaacuuaagcuucaaguguuuuuauuucuuucucuuuaccucauuuauuucucuuuaccucuaucauuuuuagacaaacuuugucuaaguugggucaguauggggggcauauuuggcagucuuuuuauuuaaguaggauaauaccuauaugcaagacauuaggaagguugaucuaauuaaauaccaucauuucccccucaaaggcaaccacagaugacucuuugauaacuaccuccuguugugcuuuugccauuuuauauuuucuaacauuuuacucggaaguaguuuuucuuacuacuauauuuuuauuagaucaacacuagagugguuuuuuuccuuaauuauguugguugggugaugggguucaaguaggaauauaguugcaagaaguauacuaucauugacauuuuaguggguaacaucugauaauuaacuauuuguggauuuccguuuugagcuucaggguuugaguuggaagugcuuuaggaaaaugaauuuccucuuucauugaaagacaggucacuuuauuuugagacucuugucuugauuccuuuuacaguggguuaagcaauaaucacuaacucuuguccuuuagaauuauacuaaaucugggaaugaugaucaaggcaugaccuaaaagguuuaauuuauucuagguagaucucugagaagagaggaaggaguggcaguaccaaauaaaaacuuugucuaagguucagugacaaaguucaaccugaauuuccaggauguuuaucguuugucucccaguauggccaaaaagcacuuaugaaggugaaaaauaauuuuaauguguacagcuuuuucuuuucauaaaauauguuuuccuuagugucaguuuguuaaacaugcuaucauuuuguuugaguugaaaacaguuuucagggguauugucuaagugucacuagaaacacuauacaguucuuuuucagaguguuuaguuacugcucaaagcagguucuaaaaaugcaaguuggcauuuaagggcuauugcuucaaaaauaacugauugugucuauugauacagugguuaacuacccaauucuaaugaauaauauacuucuuuuccacaaucuuuuuuuguagguccuucaguagccugaccugaguguuagugcuucagaggaacaaaccaguagaccagaacuuggucaggaaguuucaggaagcuauuggagcaguguugggauuucccaccaggaugacuaugauuggcugugauuuuagguuaguuuuuuuuuuguuuuuguuuuuuuuaagaucuuugcgguugguauuuguauuuuacaucuugaaauggagauggggcuggaauuuacauuuuuugcuugugcugcuuugguuccauuauaugggucagguuuguuuuauuuuuuuuuuuaaauaauuuuauuggauggagcucauuagacaauuaaaaggaauuguuuuaaauguauauugucagugcaugauuuucacaaaauuugaaacauaacugaguaguauguugucuacucccccagguauuuuuaacauuuaucaacuuuagccuuuuuaguuuuacccuauggcaccccccuuucccauagaauuauuuugaaauaaaccucucuugauguguuauuuuuauccauaccaaaaauuguauagauauugagagaguucuugacaguauaacccagaauucauuuucaguugaagaaauugaaaauuuaaagguagaaaaugggcucauuuuaaaauuuccgugauauuuuaaguuugacucaugauccagagaaaaguccauuuaugaaauaguuuauguagacuuuaagucuguuuuauucuucagguuauauuucucuuguuuuuuuuucuccaauuuauuuguuaaguccuuuuugcauuuccucacauuugaaaauuacagucuauagugaugucuagcucauucuuguuaaagaccauagguaaucuauuauaaugaaacaauaaugguaguaaucucuuaugugaucucuuaggugauacugcuggcuuaguugguauacuaaaauagcuagucauggguuccuuuuucuguggcccucugauuugauaccugauuuuaguuuuccauaugaaauauaggccuucuggaagaaaaaguuuuuuuuaauguguauuuguaauauccuuagguuguuuuguuguuuuuaugcucuguuauccuagauucucugauucagagcuuagauauuaagaacugguugaugaauuauuuugcuugugcaguguuagccauucugggucuguacuauggucaaaaccagaaaaugagaguugaacacauauccuucagccuccagccagccuuuagcucauacacaaauguggacagagcaacgguuuuuguuccuaucuuuaaaauaguaagaacugcaaguuaaaggaacagaaaguagaaaagucaugaaugaaaaauuuugaauuauuuagauaaauacgauuaugaaucacuggucagguguucagguauuucagcuguguucaucauuggagaaaauacgauuaugaaucacuggucagguguucagguauuucagcuguguucaucauuggagaaauaagucccuguuugaaaauugauuaaauauuaaaggaauuuuggggagauuccagcaagcucaugcuuucaacagggaaaaaaaaaacgagcauguuagauauagugauuaaauauuaacacuuaaguucuuauaguuuaagcaaaaccacuuagacccaaauccuauuuuaugaaacuaggaugacugguacagaauugugcacaguagacauuccaauauuugaaucacccccuucuuaacacuggaaguucacaauggaaacaguguuggcuuuuuaauucuccuuuuguuguguguuuuuagccaccaguucaaaguaucauugaaaugccaacuugguugcuuugaaaauauuugcccuucacauuccacauugccucucauggaauaagauuaaguuucuaagucuguuguguagcugugaccauguuggacugcuuugcaguggaucacacggccagacaggucacaggugcuuguacucuuaggauuuucuuguauuuuuuuuuugaccccuucaaugacugguuaccaaauguuuauauauguuaaugucagggauaauucagcucuuaagauucucuggaagcuucuuaguugaugugucauagagguugagucgguaaaacuugauguacuuguugaccaucuugguuuucugguuauagaaaugcuuuuaaugaaggaguggcacucugaggaaaacaaguuugagguguuaaccuaauaguuuccaacuuugaguuucuuaaaaaaguaguucaacgguugucuuuuaaaaaucauaauggugacauggaaagugauuuuacagaauguuggaauuugugcuuuuaugaaguacuauaaaaugcaaguuguauuauaaaucugauucagcugauugaacuagguauauauucaucuuagagacuuuguucacauaaucuuaagaguugaaagaaagcaguuuuacuuuuuuaauagugauaaguagggcuggacagauggcucaguggcuaggaaaugcccuuccagagauccugaguucaauucccagcaaucacaugguugcucacaaccaucuguaauggguguaucuucugaugugucugaagaaagcaacagaguacucaaaauaaauaaaucuuuuuuuuaaaaagggggcgggguggugguguuggagaugucucagugguuaagaaaacugauugcucuuccagaggucuugaguucaauuccuaucaaccacaugguugcuaucaaccaucuguagugggaucuaugcccucuucuggagugucugaagacaguggcaguuuacucacauacauggaauaaauaaaaucuuuuuuuaaaaaauagugguaaauaaaaggaacuaaaaguaaaaacuagagggagaacuuaaauuuuuuuuguaauuuaaaauuaaaaagauuagggccuagagagauagcuuaccaguuaagacacagguuugguuucuagcacucacauggcagcucacaaccauaugaaauugcagcuccaggggaucucauaccuucuacugaccucuuagugcaccagauacacacauagugcacauauacaugcaugaagucaaauaaaauauucaugcaaauaaauaauuuuuaaaaaccuagaagguugcuaagugcagauggacuacaaugaaucaccuuaagcaacucagguuuuaaguucuuaaaauuaagcauauuguauuugguaggugcuuacauuuuggaacaguuuuuagagaaaguuuuucuaugguuguuauuugcuaaauuuauuuauuugccuauuuuuuaauugaaguauauacuagucuuugcuaguguuuuuccauacacuucucuuuuccucaccccaaguugguuuuauauguuugugcacagauauuggugauuuagcuuuagcuuugaguagcugaaacuacagguauuugccacugcaggaagcucuccuuucacuguuacagcauucuaggaauugaguuuuuauugguggaaagacuucuuucuauacaaugauaaagaguauucccucaguucaaguucugauccaauuucuuuguuuguuuuuguuuuucgagacaggguuucucuguacagcccuggcuguccugggacgcacuuuguagaccaggcuggccucagaaaucuaccugccucugccucccaagugcugggauuaaaggcgugcaccaccgcugcccugcucugauccaauuucuuaucugcugugucaucucguacaaauugaccucuuuaugcuauagugaaguuguuccuuuauaaaguaaugauugaggcccuuugggauugcaaacuuuauaugccccaguacaagggaaugccagggccaagaagcgggaggugggggggacagggggagaggggguggguauagggaacuuucaggauagcauuugaaauguauauaaagaaaauaucuaauuaaaaaaauuaaaaucuggaguguaaaauaaugauuguuaccuaucaucacauaggauuuuggauaaguugaacuaaguacaugaaucauuaauaguaaauaguggcuuuaaaacuuuagggaacaucagaucaccuagaagguuuauuaaaccagauugcuguaucacuaauuuuugauuccauaauuugauggggaauagauuuugcauuuguggguuuccaggugauaguggugcuaucauauaauuguaguuggugcagaauuuuaucuacuucuguuucuggacugauuucucagagagugaaacacuuuacucuuuagucuuauuuacugucaccuucagcuaaaguaaauacauucuuugagaauuuuacauguguauacaaugcauuuuggucauuaacuaaccacccaguuccugucccaguuucauguuuaaaaagugauuauuguucuuaaugugcauaauguggaucauguguaacuuaccaauguccacuuuucccaaagaaaaaugacuuucccucuacaauggccguuggcugccaguggcuccucaaacuaggguguaggucuugcguguccuuccccuauccaugcuagaauuuugauuagcuugaucuuauacagacagguaaucacagcuacugugaguuuacaagugcaauggaaauaucguauccagaagacauuauuuuaaggcauuuuccccuguccucuggcauuaauguucuuucugccucuuccuauuuccugagccuugcagguuuuuuuuuccaauuuccuuuaauaggguucaaaccucuucuagcccaccacccaccagagguaguagaagagaaaaguuauuacaacaugggggaauuggaucucuuuagaaguaguuguuugggggugaguccaaucuuuguugucuggauaccagccguucaguccaguagggaagaccaaauauaaaucagcagcugcggucuagucuacuuggcagucuccauacaggaaccagcaaggggaguucaauccagaagaaagcacaaagcuuggcaacaggaaggucucugcaaaagcaccaagaagcugcaggaaaccuccucgugggaaguucuuugcggggaaggcgguggcugcugcugcugcugcugcugcugcugcugcugcugcugcugcugcugcugcugcugcugcuucuucuucuucuucguuuuuugagacaggguuucucuguauaucccuggcuguccuggcacucacuuuguaaaggcaugcgccaccaccgcccggagaaguucuuuggagagcuucuuuuugguauggaguucaacaauacaauguaaagcagagcaaagcaagccaaugcuugagcuccuacuguuggcuccuauuuauauucuuucugaacaucauguguccuuucaugcauuugcuauagcaauacauccuuuaaucucuguuuucuuuagcaaaacauccuuucaccuguguuccccagcaaaccauaacugacuuuccaaagaagccagaaguuuccacuucaugguuaauauagauuucccauuuuaggccugagcacuuagucacuuagucuuccugcauuaacuagucacugcaaaaaagaaguuucucuaagauugagagcaguuuauuuaguauugccuucagcuaaaagcaguuuugaaauccuuacuuucuugcacaauggcaacuggguccagaggugugauaaauucagguucguucccuuugguaaacauaggguauauguucauucaugacaucguguuuuaaugaugugaaucuuuuuaauucauuaaaucauugaggacagugaauugauguuucaauaacaacauuuugcuuuuuccuaauauuuuauuuccccuuauuucuuauuugguuacucaaauacauaguugauguagaacagacagaaugaacacucaguuuuuguacccuaaaaauaaaaugguaugugcauguguuuuguaugugugugcauguguaagcuagccauagacuagcauuagguaucaucauuccuuugcuguccacccacauuuacuuauuguaaguuuugaaauaggaucuucuaugccuucucaaugcugagauuauaugaacacccaguugguuugguuuuguuuuaaauguggguucugaaacuuggguccuuguacuugcaaguaagcauauuacugauuaucuucuuaguuccuucucuuuuuaggucuggccuggaauucacuauguagcccagcuuggcuuuaagcucacaguuuuauccuccugcuuuuguuuucugagugcugggauuaagguaugaucuacacucagcuuuuuucuuucuaaacauagcuuuauuuuaaaaaaaugccuaaugccuuuaugcaguguacaugugcuuuaguguaugcaauguacaugugcccauggaggccagaaaaggguauuggauccuuuggagcuguaguuacagaccacugugguucuuguaaccaaacuccaguucuugaagagcagguugcucucuuaauaauugagcugucucuagccucuaaauacagccuuugauaugauguuuugguucccugcuagauucagaagguuauguaaauguguauaccuagguacucauggauauaaacauucugaggcuaauguuuuaaauucaaaguguccauucuucuaacuaggaaaauucuauaauauaaaguugcguuuugauuuuucuugguauaaacccuaguagucuuggguaguuuccuuacuauuaguaugucagguuauuuuaggauuauuauagauuucuucccuagagcuggaaucaacuaaugugauaagacaaaaugugagauugaaggaaauuuucucuuugccaugguaagagcuuuguacccagucucuauuuuccuuuuccacuucaccuucccagguuguuucauuauugguccuacauuuuuuuccuuuaguaaaaaaauuuuugcuagaauuuaaggggaaagguuuguaaaaucuugauaaaaguagaaggcauagagugcaggcaguucuagauuugggacuuuccaaauuacaguuuggcucagucaacuucuuguuucgucuuuggaaauaccuucauuuguuauuggaaucaguuuugugguuuuaauguacugcauuguuugccaugaucuuccccuuuuacaugguucuuuacuguuaauugucuuucuauucaauguucugccacaaccuuauuaaucuguggugagaguccuugcaacaguuaccaguuucaucaccauguuagaaaagaguuauucaauauuaacuucuuuaaaaccauuuauuuuauguaguaucuaaauuaccauguaugguucuguaaguggaaacuguucuuguuuuuguuucuugacuauuugguacuggcuggccuugagcaugugauucuccugccucauccuucagaaugcuaagauuccaggugugcauuagcacaccuagcucuguucauuuuuaaguaauuuaagguuuucguuuucauucuuguaucuugccucucuuccuuuaguugaauagacauagguuuucuaauucucgugugcuuccucagccucuaagacuguuauguugagaaacccugcaauugucuucuaugaguacaggguaauaauaacaaguguuugggccaaggugagaguucacagugauacauucaauugcuauuacugugcuaguuuagucuuuggauaaaccuguaucuggucuugaggccuguguccugucuuuuuuagcugccugcuuccaacuuuuucccucuuuccuucugcuggcccuaaaaugcauguacauaauagugagaaacaguaugcaaauuaauauuugaaugggucuaggcuauuuuacuaaauuuauauuacuuauaagaugcuuaucaaaauccuacacuuacauguuuguguauguacagguauauauaaaacuuaaaauguacuuuauagguugcacugagccuuuaauaucaugauauguaauaaaauuauguaauaaaaaauuaauaauauuuuaagguacugcaauuauagaguacucuguaaagaugaggccauuauaguuuauguaauggcuaugucacuuagggcaaauugaguuaguuuccucacccuuuaaaugagggcaauaauauuuaugcaacaccuuuuuucuaaggauguacucauuggugccacauaguggagauacaaaagaugagcaauccggugcugguaagaugguucaacaguuuaaaggcaacuguuagcaaguuugauuucuaucuuaggaauccacauaguggaaggagagaacuaacgucuggcauuuguucucugacauucauauaugcaccguggcauacucacccacauuccuauguagaccauacaaaauguaguuuacaaagauaagcaacagaaauggaacuugccgggagauuuauaaaucacacugaaaugcuaguaugaacagugggaggaaugagcaaaauguuacagcaguuuauagggaagguggagggauggacugagacgagggagggaaaucugcaguugaauguaauauaugagagaaaaauacaaugaauaaaaaaaauuuaaaauaaucccauuacuaugaaaaaaaguaaagacuagcuucaugggcagcauagaucugucuaccuuuagaagacaaauuauagucaugugcugucuaacaauauaguuucugcuugugguuuguuuugagaagauaccuuauguagcccagaaacucccuguauaguugucaggaauguauucuguaguggaaggugacauuaagauuucuguaauugaaacauucauugugcaagacuaguuuauuguugcuggugguagagaucaguaaugaauuacagauacagaaauuuauauugccuauugauggugaaagauuguauuaaugacauuuguagacauuuauuuuaggauguuuccacaauaaugaaguuucccuaauagugcauuucuuauauuucuguuaagggauucauucaccagcagcuuuuaaauaguaaaaucuucuuuauauuccaccagaaaaguuggaacagagaacuuauuauacauaucagacucauuuugugggcccagauuuaaggguaauaacuggcuauaguuauuauauagucauguauaguauauaguauagugguggaguuaggcaccaaguuaggcacaaguuaaacagcccaguacugugccacuaugcuguagguuuccuuuaagcaacuugcuuuuauuucuaaauguguuaccaggugucaucuaugaaaguacagaaguuuccucacugggggaaauuugacaaaaaaaaaaaaaaaaaaaacuuaaguaaaaggcaggacuccaaagaaagccccccaccuauaaacacaccuuugaccuacauuccaguaugaguccaauuuguagccuuuuaaaaacauuucuauucuuugagaauuucauacaguguauuuugaacauuuccacugucauccucuuauggguuagccuaauuuggcagguuuuuaaggguguuuuuguuguugguuuguuuuuagaaggaauuuuuguuuugauagucucauuuuagcccaggcugaccuggcacuauguagcugaggcuagccucaaaccugugccaauccugcugccuuaaagucccuaauguuugaauuucaaauaagagccauuauaguuaacucuuuuaaagacuuuuuaaaauuuauuuuauguauaugaguguacugucacuauccucagacacauccgaagagggcaucagaucccauuacagauguugcugggaauugaacucaggaccucuggaagagcagccagugcccuuaaccacugagccaucucuccagaucccacagcuaacucuugucucuguuuucacacauauguguggacacuguaugucaauaagugggaaugaaugucgauccauaaaacuuaaguguuuucugaacugggaauguaguucauuaguggagcacuucuuuugccccaaguccuggauuuggugugagcacugaaaaagaaaauguuuucaaagcccauuuauuucucaacuuuuaaauugugaagugguauauuugcuauuuagaaaaaaaugcauauaucagaugaacuuuguuuuuacaggcuuuuuugaccauuugcuuuucuuuuguucauuugaccauuuggauauuaaucuuuaucagauaaauagcaggcaaagaguuuucuuccauucuuuuaguguuuuauucuaaguucuguuugcuguguagaaacuuaugauuucccauuugucaauucuuauuacauccagaguuuugguugacuaguaauguacuauaaucauacucaguuguugauuccuaccuaguugacccugaaucagaggguaguaucaacugaaaauuuugguuuugcauuuuuguguauguaaguaaaagcaugcauuuuaaauauguggauguuuugucugcaaguguauuugugacuuguuugugccuggugucuguggagaccagaaaagacauuggauaaucugguucugagcucuaauguagaugcugaaaaugcucuaacagucauccugaguucaguucccagcaaccauaugguggcccacaaccaucuguaaugggaucugaugcccucuucugcugugucugaaaagagcuacaguguagucauauacauaaaauaaauaaauaaaucuuaaaaaaaaaaaaaaaccagauaugguacagacccaaucauucagaacuucugagggaagugucagguaaaugguauguggauugaggguaaaauuuuaccuugagagaggugucauagugaggagguaacauuuaagcucaacuuuuagggauauucaggagucaacuuuucaaaagucuugagugcuagggaaugugaaacuuaacaagaccaaagcaugagaagaauacuauauaaugccauuuugccauuaagagagagagaugcaggucuugggugcugcuuuaguacuuauaguuaguuuuaggaauauugcuuugguaauaaugugaugaugggauuagagaucuggcaggauagagccuuaauuuagcauacuuuuaauauauagagaugguacaaugauaaccuauguaccugccacccagcuacuaacaguuaaaacagcaugcggaugugguuuuauuuauuuauacccuacucccucuuucaguuauuuugaaacagguuucuaagucauucauggauuggcacagcucucacggcugaucuguguagccaaaucuguuuauacagcuuaaaaaaauguaugacagucuccaccccagaaccgaguuugguauuuguguaacuagguauuuucaguuucuaaaaagaguuucaggggaacugagugacuugauuucugccagauuaaaauacuuuccugaacucauugauuuaucuguaaugaaauuugcuuguuagguauggacuggauuuuuucccaauuuuuuuauuagguauuuucuucauuuacauuucaaaugcuaucccgaaaguccucuauacccuccccccugcuccccuacccacccacucccacuuguuuuuuuguagacaaguuucugaaauuuuauaaagaauaguaguuuaaaggacaauuucuuaauuuucuuuuggaaguggacaauggugaagaaagcacuuauaaucuuagaaacuggaugugaugaaucaucuuuuugccaggcauugguggcgcacgccuuuaaucccaacacuugggaggcagaggcaggauuucugaguucgaggccagccuggucuacagagugaguuccaggauagcuagggcuauacagagaaacccugucuggaaaaacaaaacagaaaaaaaagagucuuuuuuuaaagauuuguuuuauuuauaugacuacacuguagguguuuccagacacaccagaagagggcauuagauccuuuacagaugguuguaagccaccaugugguuguugggaauugaaaucaggaccucuggaaagagcagucagugcuccuaaccacugagcuaucucuccaguccgauagguaguuuuguuuguuuguuuguuuguuuguuuuuguagagaaacauacaugcuuuuuuuucccuuuugguuuuuugagacagucuuucucaguuuagcccuggaugucauggaacuugcucuauuggucaaucugaccuccaacccauagagaaccaccuguuccugccuccuaaguggugggauuaaaggcgccuggggggagcauacacauuuuaucuugagauuuuaguauauucagauuuuguaugagacuuccaagcaaugucugcaaaugaguuuccagauuuuggggggggggugaguaaaggcugcuuguuuuguuauuucauuuuacugccaggucauagauuuagcugagcaauccucccaugccauuuuauguagcuaaggauagggauacuggugccuguagugaggggcggugggagugguugguaguuugaauuugcauucuuaucccugccuauagacauuuuuugaccuuaguaaauuggucacagucuucauuucucaagcugucaugaggguuagauauuaaugugugauagguaaagucuuggcuguauauuaauuggaacuuaggucagauagagaaaggcuuaaaaauuaugcuuaguccuccuucaggcaaucagugaugucuauaacucuguaaucaauagugaauaggcugggguuuuguuguguuuuuguuuguuuaguuuggucaggaauucuaaaagugauuuuucuuuuaaauuuuuugagacuaugucuacaaaauuucuuccuuccccuuuguaccuccaaaccuuucagauaccuucccucuucuuuaaauucauacucuuuuccuuuuauuaaaaauucuuuuacuuauuuuauguaugaguacuuuugucuucagacacaccagaagagagggcaucugauccuguuacaaaugguugugagccaccaugugguugcuaggaauugaacucaggaccucugaaagaacaguuggugcucuuaaccacugagccgucucuccagccccauacagucucuuuucauuaauuuuuuuuuguuuguuuguuuuuguuuugguuugguuuuugguuuuucaagacaggguuucucuguagcucuggcuguccuggaacucacuguguagaccaggcuggccuugaacucagaaauccgccuuccucugccucccaagugcugggaucaaaggcgugcgccaccacugcccagccauucauuguauuuuuuuuuuuuauuucaaggugcaucuuauugcuuucugacauggucagugcuguuccuaccuaaauuuucugguuagagaagggcaagaggcaaaaaguauuaaguauauucuuuuaugggaauuugaguuuaguguucuaguuuuguuuguuuaaauguuaccacaguuucaguugaaauuaauuaauuuuguguacuacuuugccugucugucugugucuguuuauggaaccuuucacauaccaauagaaaauucaguacuauaugucaagguuuggacacacaaaacaacuaaucuaaggcauuuguaauacugcuuuaaauuuggcccauguuauuuggcucaggaaccacuaaucuucuguaaugaaaauaauuacaagcgaugaagguuuguuauaagugaauguaugacuuacagaaaaauggaaggauuugaaaaacauaaagcauaaauaaaaguauguauuuuuucuaccaucuagaggcaaguuuuaauuuuucgagacaagguuaauuuaaacagccuuggcuguucuggaacuuucuguugcagauuggccucaaacucacagaacugccugcuucugcccccugaauacugggcuuaaaggcauacauguacgucaccaccaccuaguuagaggcaaauucuaauauuguaaaaauuuuuuuauuccuugauaguuuuauacaaugccauuuuaucauauucuuguacuccuuccugauccacccucaccuuccuccccacucaacuugaaauguuucuuuuaacacucauugagucuaauuuguguuacccagcuacuuuugggaguggggccuauccuggaguguugucaaccucuacccacccaccauaaaagaaaccugacucuccuagcagcuaucaaaugccaauagcaucucaguuaguugguagaguuucaugucuaccuccuacuauucauuuugguauuuugucugauaggagcuugcgcaugucuugugcguacuaucuuaauaacugaaucccugugugcaacuguucuguucgguggguuuuuugauauuguuuuguuuguuuuucaauguacucacccugugguagauauuuucucauuaauugucaagggaaguggaaauuuccuaguaaagauuuaagaguuuagguagaauaugauccuaguauuugugcuauucaaaacucauggaaguacucauuauuaugugaauauaaugagaagcuuaauuguuuuguacccacaacugucacagguacuauggggacucuuucaguuauguuagcuuuuucagugaguuuugcuaugucaugcagacuggccuccaagucaagccaagauccuucugucuuggugcugcauuuucuuucuuuaauucuuuucuuuucuuuuuuuuuuuuuuuuuaaagaucagguuucuuuuuauggccuugaacucacagagauaugccugcaucugcuugcuaagauuaaggucuaugccacuaugccagucuuguccuugugcuucuuaaaauuuaauauagaaaccaucuaaggaucuuaacuaaaauacagauucugguuuuucacuuacaaguggguccagaaauucaucagugcugcuuauccuuggaccaugcugaguagaaaugcuaucuacccaugcacgcaaguucuauugaguccuauuugagaacuacagguguccucggugucauauucucucucugugugugugugugugugugugagagagagagagagaacgagaacguguguacguguguguguacguguguguguguguguguguguguguacguguguguguguguguguuuguguguaugucagaggacaacuuccaggaaucuguuaucuuccacuuaaguaguaggcaauucuuauucugucucucacugaacagaacugcuaggauuauaaaaacaauacugcaccuagcuuuuuguggguucagggauaugaacucaggcuaucagacuucuguaacaagcacuuuuauucacugagccaucucuccagcuccuuacuccauguacuuuagcuguauacacuuguucuggauguaaacgaaauuuaaacuucaaagguaaauuaagguugggagaaugaugaaguggaaaaaauagaugauuaaauaaaaguauuuaaguaguagcauugguggugguuaauaauaauucuucuauuuucuuuuuuuuugguuuugggguuuuuuuguuuguuuguuuguuuguuuguuuuguucuuugguuuuucgagacaggguuucucuguguaccccuggcuguccuggaacuuacuuuguagaccaggcuggcuucgaacucagaaauccgccugccucugccucccaagugcuggauuuaaaggcgugcgccaccacaccccaauucuuccauuuucuuaauaguucuaucuucucaagcaaaauuuaagaagaaccacuugaacaaguuugauacuuauaagcaaaacauuuccagaauuuuguuuuuaaaaacuaucuucuuuuuguugggaauuucuauguaauggaguuuuuauuuguuuggccucuaagauagaauccauuccccaaucacuauucucuuuauuugugacacuguauacuaguuaaaauuuagucucucaagauucgcuaaccaaacaaggugcugauuuuccugugggccuuuuuuuccuggaaauagggacaaauugggcugaaagaauauuuguguaugaaguaauaauacaucaagucucuaacugacauguuucaaaguauauucuuuagaaugcuugaauuguuagauaccaaauaagcacuacuugaaaacacuguugugugccuuccuuaaauaaaguuguuuuuagaaucauuaaguaugucugucagccuggcaggguacuuaaaugcucauaacauuuauuuuaaauacaggauauuguuuggcuuaugaugaacacuaaguaaauauucuccuuccuguuauaauaguagguuugaacugagaacagaacuucagaauuuuaauugauaucucaaggacauacuaucuuucauuucuuuuuuuaacuguuaguauuucuugcacuugagugauagaaaacagacuagcuguucacugguuauagggagcauuuauuuguuuuggcuccucauguguguuggugagcagcauauaucagaugcucauacuuggaauuugggaccugagaugauuuacaggucuuucugcuucgaccagcaucuaaagucugguauuggcagcagaagcaccccaacuaaacugcuuuugugucccucccuuggauaugguuaccuggcuucccuuaaauucuaccauuuuccgaauguagauguaggcuccuuccaguucucugagcuacuagauacucuuucaauaaauugcuuucccgcauuaccuggcuuuuauguuguccuugacacuugaauaauauaguaucuauagucaaaacaguuuuaauuagagccagaugcuuauuucugggaauauuuuaccagugaucucaucuacaguuuuugguaaauaacagcaaaguggucauauauuuauuuuauuuaguggguaagguacuugguacuuuguucuuuggaagauuuuuuuaagugguuaauucacauagaaauugaacaguauuggcauguaucuuuaguuucagcacuugggugguauguggaucugaguuccaggauaguuagggccauguagaaaaacauuugucucaaagaauuuguauguccccacuguaaaugauuccacauuaucagcauuccuuuacuagaauggcauauuuguuacaguuaaugaaucauccaaagauuaucuauaguuuacauuugaauuuacccuuggcauuaggaauuuggggggucuugacuauauuuaaaauagcauguauuuaaccuaucguauggaaugacuucacuguauuaaaaaaucuuauguacucuauuaacuaacuccuggcaaucaguagucucaauauuuucccagaauaccauauaauuagaguagucuguuuuguuugguuuguuuuaaaaucagguugacauuucgauuguucauuuucucuggagauccaucugcuucuguacugagauuaaaggcucuauaucuggccuuucagauugacuucuuuuguucaguaaccagagauuuuuccacaucuauuucuugauagcucauuuaguacuaaauauuccuuugucugauauacaccaaaguuugacaguuacaaugcaaauaauaucuuauauuuuaugaauaugcuuaguucucuaaagccauuuuagccaucuuccaggcaaucuaagggacuucuuauucuacauccuugcuaacauucugaugucaguguucuggguuugguuauuguaauaggcauagugaaaucucagugcugauuaucacagucucuuguuguguagcaucuuuucauuaguuaauuuucuaucuguauauccucucugguaagguauccauuaaaauuuuuauugguuuauuuuuguugacuuucucuauucuuuguguuuuuugguuuuuuuggagacaggguuucucuuguguagcccuggcuguccuggaacucacucuguagaccaggcuggccucgaacucagaaaucugccugucucuaccucccaagugcugggauuaaaggugugcgccaccaacgccuggcuuucuuuguguauuuuuauauuuuuaauaauuguuuucuaugucuuuacucugucuuuugcuacuuuggauuaaaccaagcacuucaucgugagccauguccuaguuaccuugaugccuuuuuuagcaaauauuuucuccaugcuagcuagcuuuuuuuuuauucauuuaaaagagaaugcauuaauauuuuuuucuuggauggauacccuuguuuauaauuugaaacaucgucaccaaaaccuguaucaucuaacucuuuuuggagauguauuauuuuacauuuuguagauaggucuaugauccauuuugaauugccuuuucugaaaaauguggaauuuuauuguuuugucguuuuuaugaugcaugugggugcacagcuauuccaguaccuuuuaaaaaaaaucucucaugcauauauugacuuugauucuuugucagaguugaccaauuuauauggggcuauuuuagggcuucauuuucuguuccauugauuuguucuuccccccacccccauuggcuaguaccgcauuaaugaucuguaguuuuccuccuagaucugaacauauuuaaguauucuuaagcugcuuauauaaaugguauucauuucaaauccaguuguucaugguagcauauguaagaguaauugauacauuaaccuuguauucuggagguuucaggagggaguuuuucuuuguggcuauuggguguauuuuuuggauuuucuacauagaugaaaugauaagacacauuccaaucuaugugucuuuuacuuaccuuuauuuuggaccucccauaaacaaguauuuuaaaaauacuuaaaaauaaauuaauagaaaaaagugagagaucucaaucuuuugaagcacaucaagguuucaaaaaucugccaauccaaaaaccaauaaauggcaaggaauaaagauuagggaagagauuaauggaauaagcugaaagaacaauacacaaaaauccuauccuucaccuugcacauuaaucagcuagaaauugaucaaagacuuuaauccuccaaacucagucagaaacauagggaauacccuucuaggcacuggggguaaauagcaaguuuggaacagaauuuuaagagcagaguaacugaaccaaguaucagcaaacuaaauauguaauuacagaguugcuacacagcaaauaaaauuauaaagaaagcacauugacagcccacagagugggaaaaagucuuuacaagguauacuucagauaaaagguuuauauucagauuuacugagaauuacguaaacacuaagcaaauacaacuugcagucaacaucugaaugaugagauugaguacgcaguuuucagaagaaacacaauuuuguaaguagauuuuuaagcgaugucuuuaccuuauucuauguguacgacuguuugcuuguauguguguaugugcaccaugcacacccagugcccuugaaggccagaagugagccaagucccccggaguuacaacugugagcugccaugugggugcugggaacugaauccagguccucugcaagagcagccaguguucuuaaccucugagccguuucuccaguguugaaacacaauuuuaaaguauucacaucccagccaucaaggaaauacaaauaaaacuacuuugacauaccauuucacucaaugaggauagcuaccuauccagauguuugagggaaaggaaauagggaaagaagaaugaaauaggguacuucauucccaaguaccagaagauagaguaaaaauacacaaaacaauuauccaauuauucauugcugguuagcgugcaaauuaauacaacuaauaugggaaccagugugggagugcuucaaaaaauuaaaaaaacacuaccggaugacccaucguuccacucuugaacauauacucauaacuccauauccuaccguagagauauuuccacucccauguuuauugcugcucuauuuauuauuccaaggaaauggaaucaacuuauauguccaucaugauggauugauggauaaauggauaaugaaaaucugguacauauguaaaauggacuauuuaguacaaaaccauaagauuugcuggaaaugguuggacauugaauguucugucugacugagcuugggggauuaaauuaaggucuuugaucaauuucugacugauuaauguauaaagagaaagauaggaaucuaauuuuauuugauuguuuuuuuuuuuuuuaaauaaaucuuuguuuuuuuuuuuuuaagauuuauuuuauugauuauauguaaguacacuguagcugucuucagacacuucagaagagggagucagaucucauuacggaugguugugagccaccaugugguugcugggauuugaacuccggaccuucggaagagcagucgggugcucuuacccauugagccaucucaccagcccugauuguuuuuuuuaauguauuguucuuucaguuuauuuuauuaaucucuuccccagucuucauuauuccuugccauuuacuggcuuuugaauugcaguuuuuuagaaagccuuaaugugcuuuguuagauuauuuauuugagauuucucacuuuuuauuuuccauucauuuauuaauucauucaccuuacauccugaucauaguccccuguccccauuuccccucucauaguccugccucacacauaccucauuccccuucaccucugagaagggggaggucccccucuggguacuaacccacccuggcaccucaagucacugcaggacuaggugcauccucuucgacugaggccagauaagacaggggaauaggauccccaagcaggcagcaggcaggguuacccacaucaaguguugggggacccuaugaagacuaagcuauacaucugcuaaauaugggggggggacuuagguccagccuuuguaugcuuuuuguuuggugguucagucucugggagcccccaagggcccaaguuaguugacucuguuggucuuccuauggaauuucuaucccuucuggguccuuuagcccuucccacaacucuucuacaagacuccccuaguuucauccaguguuuggcucugggucugcaucuuuuucuguuagcuagguggagccucucagaagacaguuaugauaggcuccugucugcaagcauaacagaguauuaauagugacagggauuguugcuugcccguggcaugagucucaaguugacccagucauuggcuggccauucccugcauuacuuguaggcaggauaaauuuuggguugaaaguuuugugggugguuuagugacucuauugcuccacugagagucuugccuggcuacaggagguggccacuucaggcuccauauuccccacugcucuccuucacuggaucucccuccacccccacaucucucacuuucuaauaugaguacuauaaauuuuccucuuaggacugccuagguugugucucagaagggagguucuaguagguuguucucauuuuguuggugucuaggaauuuuaaauuucccuuugaauuuccuggauagcacacuguuacuucaaaauguaucacuuaguccccaaauauuuuuguaguuucucuuguagaauucuuucugcuuuuauucuuuuaugcucugauaggacacaaggaauuagugugguuucuuuuuauuuuguauuuguugggacuuuuuguucuaugauaccaauuuuggagguuccauguacugcugagaaaaaugcauauucucuguuagguagaauauuuuuaauguaucuguuaaguugauuccaucugaaguuccuuugcccauuuucauuucagaacaccuauagaaaugagugguauauugaaguuucucacuauuauuguacuuggaccuauguguuuuuuaugccuuuugcuguuucuuuuaugaaauucgaggcuccaauuauaaaugguugauucuuuucccagccuacuuaauucacccauuuuuucauagauugugcacuuucguguacaaucuuauaaaggagucuaucguccaccuuauauaauauuucuuuuuuuuuuaauuagguauuuuccucguuuacauuuucaaugcuaucccaaaggucccccauacccacccccccaauccccuacccacccacucccccuuuuuggcccugguguuccccuguacuggggcauauaaaguuugcaaguccaaugggccucucuuugcagugauggccgacuaggccaucuuuugauacauaugcagcuaaagacaagagcucccggguacugguuaguucauauuguuguuccaccuauaggguauaauauuucauuaggaauuuuucaaagugcuagcuugguuguuauugauugccauaauuuguguuugucuugaacuauccuuauuucuucaucauuuugaaagauaaacuuugcuagcuaacauucuuggcucccaguuacuucagaguuugauaagacauuacuuccuuuguguugguuucuguuugaugaugaaaagucugggcuaugucugauauuucuuuggccuuuguacguaaguugauauuuuccucauguuacuucuaguauauuuauuuacuuuguauuuuugacauccugacuaauguaucauggaguuucuucucuggucaugucuauguggaguucuuucuauaugucuuuauguguguaguuuuaucuacuuguacuauaaugccaauaaauagccuguguuucuacugauuuuaucuguuccuucuuucuacaccaugaauucuuacauuucaccucuugauuguaucccagaauuuuuagaaauaccauucauacucauucucgugugugugugugugugugugugugugugugugugugugucagagacagauagacaggcagacagacacacacacaccaaccgacugaccacuggaaccucagucaaaaccuggaucauugcccuuuaagaccacuggagucaaagcuuuagucucucagggauccuugggugccacuggggcuggagaccuaucuaaucauagucuucuuagucccuuuggagucagaggccugaacuugugguuauuccuaagcauggcuccuguugugccccuggggauucccaguuaauagaccccuggggcacccagccucugggcuagcccaggauaccagauaagcacuccacuaacaggaagccaaggggagguaggucacuugguggaguuuccaaagcagucugcuacaagaaaauggaguagaguccugggccagaggcuaacaggauaccaaguugaaguacagccucaaggugacuggagaggcaagcaggcuugagaguucuuuauauauucuaaguacuauacaugauuuguaauuauuuucucccaauaggauuuuauauaccuuuuguuuaauucugggacauuuugaguuaauuuuuaaaaauuaauuaucugaauauauacauguguguuacuguguaugugagugcagguucuuguggaguccaaaagagaacuuggaucccuuuuggcuggaguuauaugugguuaugagcuauaugaagugggugcuuggaaucgaacuugggucuucugcaagagcagcacaauuugcugaucuaucucucuaguucuuugaauuaauuuauaugagcugugacacuugggccauagauuaucacuuuguauauggauuuauucuuguucugacaacuuuuauugacaaugcuuccuugaugucacuuggguguauuuguauauugggguuuuuaaucuaucuuaaugauauacaugucucucagucaguacuacucuguguguguguguguguguguguguguguguguauacauguauagugucuuaauguauaaaaugguauagagugguaguaauaguauuugcuagggguuuggaaaauacuguccaaagaauacaagauuucaguuuaggaggaaugaauucuaggaacauuauacaccaugaugacaauaguuaauggacauaugaaaauuguugagagucgacuuuuagguguuuuucuccauacccccaaaauuuauaugaggcaguaccucauuaacuauuuuagcaauucuacaauuugugcauaguucaaaauauguuggagaccauaaaugaaugguuuguaucucuuagcuuaaaguuuaauauaaaaaauagugacuggccagaaguagugcuugggaggagaaauaggucgaucucugaauucgaggacagucuggucuaccuagaagaauucuaggacacccagggauaaacagaaaccguguuugaaaaagccagaaaaguuaguagcugauauuuaauggugguacaugccuuuaagcuuaucauucaagaaacaggcaagugggucuucagaguucaaggccagcuugguauacauagugaguuucaggacagccagagcaggucuuuauucucguuuaaaacaacaaaaauuaaaaucccucaaacccaaacaaaaaacugagaaccagccucacaaccugaaucuaaccccucaacccuacauggugaaaggaaagaaacuagcgcuugccaaguuguuuucugaccuccacaugcauauaugcauaacacaggugcaugugaacacacaagcaauuuaaaauuucugagguauggcugagauaaaaagcuguuugacccuaccccucaagaggguuagguugagccuugcaugcuuguuauccuaucacuacagggggacuaacugacccuacauagcaauacucugucuccaaaaauaguguuuaacccaugagacaagacaaacaccuccccacccccaccuacuccugucuguugggaagauaaggauuguuggggguggcaugucauuuuaugcaauagucuaacaauuguugaauuguucuugcuucagcaaauaaccuccuaucaaugcuuuuuaauuucaacucaguggggcacacacaaagagaaauagugaaaguaggaguggucuugcugggaagaagggguuccagcaggaaugggaaagagcagauugacauggaguggggcuuacaaacuaaauuuuuuauguaaacaugugaauugucaaaaauagugauuugacauuuuuauuuuuccaaguuguuucugcuauuguuauuccuuugcuuucccauacacauuuuggaauaguuuagguuuacucaagagucuuacugggauuggaguaggaauaguguuguguauugucuaucaauuuuaggagauuugacaucuaccauguugaaucuucaggauguuaugagugcucguguauaguauuugucagugcauauguauguagaagcagaguucaacuuugagugugucacucuauuguucucuaucauauuuuuuaauacugagucucugaaccugagguuuucuacuucugguagacugacugaccagugaguccccaggaucuguuuucuucucaccugccccaaacacuguaguuacagacuuuuaccuggguucuggugaacuguauucauguucuugugcuuauacugcaaguacuuuuaucacuacuaaaucugcuuggccauucugcgagguguuuuauaaauaugggauuuuuuaaaaaaaauguagauaaaacuugucuagaaauagggaaaguuguguucuuuucuggucugugugcucguuacugucuaguguuguacuauuaagggcaagaacuuccaacauugucuuugaauaaagugaugaguacacucugaguucaguuccucauucauucuaaagggaaaacaugcaccauuauauacuugaguuguacaauguuggggcagauugcuacuucucauaucagaagcaauuuaauugcuucucuacauauaccuguaucuccaauaaugggaucuaguguuagcuguaaaaucuuuuguaagaacaacaacaaaaaagccugguaguuaaguguacaaauuguucaguauaugguuucuacuccaugguuaagauuguugucaggaucuaguuggccucauuuuagguauuuugaaguuguugauaggaguuaaucuuguccuuuguguuagaugaugagguaauuuuacaagggaauuuguaguuacauauuccuaaauauuaauuauaggagaacguuguuuaauguucaaauacuguauaaaccaaauguuuugggugauaaauauuugaaaauauauuaacuuugauuuauauguaugucaaaaaugacauggccucaaauguuaauauuuaaacauaauauuuaaugugccuaucauuaaaauaaaauacuguggaacauucuuaaucuuuuaaccaucucuuccuuaauacucauugauugaguagauguaagcaaaacagauaauuaggacagaagcuaccugggauguguauguauucaugacugguuaccuuaaauagcaccagaucuuucugaagagccugaaaucuaccucuaccacugugcauguguccuuuuugauaguaggagaaauguugauuucuuacuacaauuuggucaguguaucuucaaggacuuaucuguuauuaaauguuacaggcauuacaugggucugauuaggcuguuaccuauuuuggggccuucuaaauuacuuggucuuaccaaagugauuguguuaaacugucagaacaguuuuaguagugucuuacacauuguuucuuaguauuuuuaaaaaagaauucucugauuuuuuuuuucaauuuuuauuuguuuguuuguuuguuuguuuguuuguuuuuucgagacaggguuucucuguguagcccuggcuguccuggaacuuacuuuguagaccaggcuggccccaaacucagaaauccgccugccucugccucccaagugcuggauuuaaaggcgugugccaccaccacccagcuaagaauugucuuuguuaagacuucucuuucccgaagguccugaguucaaaccccaccaaccacacguaaagagaucugauacccucuucuggugugucugaagucagcuacaguguacuacauauaaugauaaaaaucuuugggcuggagcaaguggaguugaccagagugagcagggcugaccagagcaaggagagguccuaaaauucaauucccaagaaccacaugaaggcucacaaccaucucuacagcuacaguauacucacucacauacauacauacauacauacauacauacauacauacauacauacaaaaagacauaauuuaucuuccuguuaaaaggcacauugccaaaaccaucacauggcuuagccuuaauccuuguguuuagcugugaguuaacauuacaguggggcgggggcguuauuuggcuuaugcguccacauuauacagucuauuguuaaaaggagucagggaagaaacccaaacaggaaucuaaagucgugaacugaaccagacauaggccauggagagggagagaauuuacuggcuuguucuuucugcccugcucagccuucuuguauacuccaggaccaccagggaugucacuauucacaucccuguaguaggcuggaccuuccuacaccaaucauuaauuaagaaaauguccuauagacuuuaggcagucugauagagacauuauuaagugauauuuucauuuccuuucucgaguauuuucuuuagaccuaaauuaauauuuaguugcuuuuuuauuaucuguugcccagccuagccaugaauucccauugauccuucuucugcuccagucuggaguuacaggugugaaucaugaugucugauucaguagaucuauauuucauguuauaacuuuuacuuaaucacaaacuucuguuauguaauugucugcaguauuuucuagcaguuauauagucaauucaaaaaccaauucuagagcugaagagaaaacaguuaagaucacuuuuuccugguaccuguaugguagcucacaaccauccuuauacuuucaauauaucuaauggcuucugggccccacgccucuaugauguacauacauacaugugaacgaaacacacacauaaaguaauuugauuuaaauaacaacuuuaaacaucuuaauuggggcuuuugguacuuucugauuuuucacuuuuguaccuacucaugcaauauagauuaauaauguuaaauguuuguguacaucuuuaaaauuuugccuaaauucccagaccccccccccccauaacuagaggcuuauagugaguuuuccaccccaaguuaucgaaaaaccuugcauacuuaacugugucaauaaagaguuugaaaucuuuauaauaggagaagaaaaaaagcuuuuuuguuuuggcuuaguuugguuugggguuuauuguaacggggaauguugguuaguuuuaucuaaagauacucugccauuuucugucuaauaaccauaucaucgaauuaacauaacuccaguguuacacuagguaucuugcauacucuucaucuaauauuuguauuucuaagacuguagagcuguagaauaucuguaacuuuauuuucucauuacuuugggguuuuuguuuuuugguuuuuuuuuuuugcagaucuuaaaucagaaaacugaaaacaugaaaguagacaggacuaaacugaaaaagacaccuacugaagcugugaguauccaaauuugcuuugugcauuuucuuuauuucaggaaaaaaaucauugugaccaguucagcaguucugaucuuccaaauaaguauguccaguuaauacaaaguguuaacuauaguaacuugugaaacuaggaggaauaucucuguuugucuagcaugcaugaggccuuggguugcauccugaacacuaccagaaaaaauaauacuaccuugccauuuuaacuuacuuugauuaaaaauuaguagccaagugaccaguggaaaaaggaauagugaauaauacuuuagguauuuguucccugaaagggacucucaggcuacaauauaagcauugaaagacaguaugacaauggaaaagagauguagaauuaaaauugacuauagcuaauagaacuuaagaguuuuuuguuuuguuuugaagacaaaaaugguaaguucauugacuuuuuuauuagccuuuuauuuuguauuuugacauuggaauaucaguguuuuuacuaaaugccauauauugagcauauuaauauuguuucuguaaguuuucauuugauucuguuuuugauguguuuugguauuuauaaguuuugaugacuauuauauuuaaaagugaagaauaaaaaagucuuaaggaauuaagauuuuuaaaaacaagacagugccaucagcguaauaauauauuuauacgagaguugaaaaucaggacaacuuagcauacauaagaacuuaauagagggauuauauauugugggaaagaacaguauuagucaauaaaaugugccaagacaauuacauuugauuugggugggauggugcgggggacuguuuuacugaaguaaauuguagauaagucaucaaaagucagauauuuuuaaaagaaauuauaggagaaguagaacauacaggugaauguuuaccuugucuuagguggggauugcccuuccaagcauuaaggcaaaggacaaaauaccaaaauggaaauguaaaauaccauauccaaaauaaaaggacacaugacaauagccauucuaacagguaugagguaauaucucauuaugauuuugauuugcauuucccugauuauuagugauguugaguaccuuuguaugugccauuuggccauugucuuuggagaaaagucuuuucaaauuccuuugcccacuuuaaaauuggguuauuuggggguuuuucauuaugaaguugaagaauuucuuauauuuuuaaaauuaacuccccccagaagaaugaaaagugaaauaaguuaauuacagaggaacaaauacugcaugauuccucuacuauggggcaucuaaaauagucaaaagguauguaaguaggcaacagaaugaaugauguuuaucaggggagggaauggggaauuguucuauggcuauguauaauuuaguaaaacaagugaguacaaagugaauaaaaaguuggguaugguggcuccugucuaaggagacugaggcaaaagagccacaaguucagggcuacauaguguuacccuauuugaaaagaaaaaggauaaguuucagaacuuacaguuacugguaaauugcuguguacuuuaagaauuucguugaggauaaacuucauguuaaguguuuuuaauacacacaaauacacaaagggccacaaggaaacuuagaggugauauauuuuucaccugaaauguggugaugguaaaaugaguguauggauccauauaaacucaccaaauuauguuaauuaugugcuguuuuuguauguucacaauuaagcucaguugugugggggagucaugggacaugacaagcuggagaaaauauuuguaacccaaaauaguuaauaucuuuuguaccaugucaguagaagaaaugaauaucccaaugacaaaaugggcauaaaaccuuucagagaaggaccaaagccaguaaacuagaaagagucucucuuacaggugaucagagaaaugcaaauuuuauuuuuuaugcuaagugaauuauaaggcucuuacagucacacuuauguaaauuuccuagcuucuaucagauuauuuaagaauauaaaaucacugacuagguguguuuuaaggcuuggguugccuuauuuacucaagcaacauagaagauugcccaguuucucauacugguguuaguacucgguuuuauuaagaaauguuuuguuuuucauugauuuuacuggugucaguacuagguucaguuuuuaagauuuuuuuuucauugaucauacugguaucaguacuagguuuuauuuuuaagaaacauuuuuggucuuucauugaucacuuagaauauuggcaguauuucaaaggauuucccccauagguuugauaauggaaacaaauucagguaaauccugguagcagcuuugaacugacagauggcuugccuuuuccugugagucgggacagucccacuugguuugcauuuauguacagagaaauaggaaaaauacuguaaagagaaguaaaccuuauaauuagaaaacacgagcaccuuagauuuaaauguguguaauagaugaacccugugaaaaguuggguuggaggugggccuauaccaaaucccaugagaugguucaccagguaaaagucuucuuacaauuuaaucucaaugagcucagccccuagaacauaaggugaagaaaaccaacucugcaugauugucccugucuuaugacaucugcacauauuuacucucucucccuucuuuccuccuucccuauuuccuccucccuguccccuaauccuucccucuuuccccucucagcaauaacaagucucucacucacaaguuuaaaggauuucuuugaaaauaagagagacaagaaagguuggguaugauggugcaaacuuuuuaaauccuagcaccggggaugcagaggcagguagauaucugaguuccaagaccaacgagggauacauagggagacccugucucaaaacaagaaagaauuuaagcaagaaagagaaggagacaauuguuuauaauuuuuucauauaccacaaagauagagaaauuuaauacuugaguuugggaaguagcauuuaaguauccuauuuuggucuaguccuugguaaccucuaaagcauucaguggccauuagugagguugaguucuaggaaagaugguaaaagguccaggcaagcugccuuugugccuuguauggcuuguccaguuagacucagauaucucauaacuguucaugaugccaagcagagucuuuggcaaggccauaguauccuuugcuaacaauauugcauucaagcaagaucuggcuuggguaccagguuugugagauauuaaaugccacguaaugguagacauaccaaguuuuuacaggacucagauguuaacaacaaaauggguauuaccuaacccacagaaucauaacaaugaauuagccuaucuuugucauuagaaauuuaaauacaugcauuugauacuaaauccaaguaaaugaaaaagggacagaugaacuguguuaacaggugucucaaauucuccauguuuucuguuauuuauucuucuuuacuguuuuuccuacaaucuauacauaaaagggugugaggcugaggucaagccugguuuauagaagaauuugguguuagguguuuuucauacauaucaucaccaaaauuugagguagauccuagcaaaguugagaauuuggcuuaaagaaaaucauaguuuuaaauaucuuauaggagaugggaaucuuuaggguuuccucuaguuuuagauuucacaacagcauuguuggauauauaggugguaucuaacuauucaucucuuucuugaugaggauacugagauucaaaguaagaaugacuuuaaaucuaaaucucauguucuuuguuucguuuuuaaaauuuuucucuuguguguacuuacuaaguggcagguacuugaauauacucuucaagcuagcuuguuagauuguguuuuccugguaaguaauggauaguaaguaggauucaucauaguagucauaaaaccaaaaucagaacauagauuuguuuguuuccaaagcuaguuuauucccaugacaccauuuauagaauuaaguaaaaaaaaucacuuucccaccuguuguccauuaauagaauguuucccagucucagucccuaucccauuuuccuuaccacuuucagaaccuuuauuauaaauucucaauccacuccuugauaccugauaaugguccuguucaucaauacaagauaucaggaauguauggaaaugggaauaccaaguaagaauagagucuuaguuuuacaaaguucagaagcucuaugaucuuuucuaauucaagguuuaauauuauagaaaaauaaaucauugcuagccuuuuccuuucaggcugguuggcguucucuucucucuucucucuucucucuucucucuucucucuuccauccccucauuuucccuccuucuaacauucugguuaccuuuuaagcuauguugcaaauuauuuauuuuugcuuuuagugcugcuuaguuuauuuccuuuguuucuauuguccguauacuucaaguaguuugcauauacagguuuauucagauuuaaacaaaugcauaguggauuguugggauuaaaguguuuccucacaggcuucuauuguaaucuaaacuauuuaguuuuauauaagcaaaaguugaauuucuuuguggguuuaagggucccuuuucccauucucuuuguuucuuccucauuccuaaacaccuuuuaugaauacuuguuuguuuuucuuagccugcagacugcagagccuuaauagacaaacucaaaguuuguaaugaugagcaacuccucuuggaacugcagcaaaucaaaacauggaacauuggcaagguauguaaaauccaugauaacagaggauagggaacaugcuauuaguacaucauuuugugugcuuugaugaugaacaagagaacuguaauggaauagccuuauucuauaguuacuuaaguaucuaguauaugugucacagcucuuggcuacugguauuuagccugaauuguugccaagaauuauuuuuuaaagauaaaccaaugugcugagccagagagagagaguucagaaaguaaaagcauuuauuuccaagucuggugacuugagagaucaagucuaauccccgcauccuucauaauggauggaaggaaucaauucuucuccuccccccaccaaauuuuuuucugacuucuacauguauucucuggugugcacauacccacauaaauacauugauguuugaagaagugaaaacaaagcuaaguguuaauaaaacucuacuucaaagaaccauuuaguguuaaaagaaccauuauuauuuugaugaugggccucacuguguggccuaggcuccuuggacuauauauccuucuaccuuagccuccucaauacugagauuacuagagcauaccacuaagccacuuuuaucauaauuuuauauccucuuuauccuucuuucuagugugaguuauaucacuggguggaucuguuggaccgcuuugauggaauucuggcagaugcuggacaaacaguggagaauaugucauggaugcuuguaugugauaggccagaaaaagaacagcugaaaaugcuucuauuggcuguauugaacuucacagccuugcucauugaguacagcuuuucucggcaucuguacaguuccauagagguaagagaauauaaggcuauguggucuguuuuuaacuuaaucguguguaugcacaaacaagggaauuucuguuucugaugguuguuugcuuuccuuuucauuauggauuucuuaagauaguaaguaguaguaagugguggggauuuagcucaguuguaguauacuugccuaauggguauaggccccuggguuuaauccucagaaccacaaggggaaagagauaauaguauggcauuucuuaggcauaaguauuaccugucuuaggauugaugugaaaguuucucuguuucauacuucaaggcauaaagaauauaguaccuguauugaagcauuuuauggacuauuuaguaaucuuugucaaagauuauuuagagguauuccaaguuauucuuaaacuauuaaaaauaguuugauuuucuuauuaaugugcuuauaauuuucgaugucuuuugccaaaacacauacacuccucccaucauaccuguggggggggggugaguuuaagcacccguuccuuauucagaaugguauauuugcauguaaccuacauauaucuuuguaaauacuuaaacucaccucaagauuauuuguaauacccaucacaauuauaucacuuuuguuccuaugaccaaauugcugacaagaacaagggaggaauguuuuugaggaaacagauuucauucuucaaggauggugguagucagcuucaucucauggcaguuacauacuacuuuuuuugaaccaaaaaaagcuauaaugcccaaggcuuaaacccuagugcccuaauucuaaaaguucuacaaccuuguaaaacugacuaguggcuaacuaaggguucagaaacaagcuuauagaggggcauuuuacacucaaauuguagcaguguaugugcaguguuuauaguuaacuuugucuuaggaauacugaccaaacucuguaugggaauguaccucaaaaauauaugucuauccaugguaaguugaauggaugaaugauaugggugggacuuauaagagccuauuguauucuuuguacccauaaagacugagguaaucaauccauggucaaaagggcacugaaaaggguuuaacaguugauuacuucuagcguagaacucagguuugaauuccuaccauguaagcauggaaggcuuacaacuauauguaacuccacuuccaguggaucuuauucccucuacuugauguuugcggcuacaugguucacagacauacauucagacaaaacacauuaaagaaaucuuaaauuuaguggucauaaauagaaguuauuuuccuuuagccaaacuugaugaccuugauaccacccuguuguuuuuguuuuauuuucugaaugauuuuggacaaguaguagaaugguugaacaucaagugggaauggauaaacagucagucuugauaaagaaauagaugugcugcccaaggaaguccauauaaaguaaacaaauaaaauacuuuuguuaauuucuaacucaauuacauagugauuuuaguuuuauccaguuaugugcugcaacauauuggugaauguucucuguuuggaaaaaaaagagguuacucccaagcuugucguacuuuaauaguuuugaguaauugcacacagcuguuguugauaguuuuaguuucuauguguccuuuauauauuuguuauaaaggaaauaauagcauacacuuagauucauuucacaaugcuuagaaauauaaauuuuuaguccuacauauguauuauagcauguuucuaucuugaaauucuuccuuaugagauacagauauaauaucgagcugcaauuuucaguguuuacaguuauugaacuuucuagucagcuguuccuuggaugcaggauuauauauuguaagagauugacuuauuuuuguguauuguggcucaauaacuugauagcuuuuaauguugacacacauuauuacauuaaaagaauuucuuuugaaguuuuuagugccaaguacuugauccacuaaacuuugucccuuuuuuguuucuauagcauuugacaacuuuauuggcuuccucugauaugcaaguggugcuggcaguccuuaaccuucuauauguauuuagcaaaagaucaaacuauaucacacgucuuggaucugacaagaggacuccgcuacugacacggcugcagcauuuggcagaggugagucuuuggggaagauaucagcauaugguuaaacaggcauuucuuguuuugccaaaguggauuagaauccuuuuguuaacuuucugagguuuacaaguauuugugacaguguaacaaaguuucaaaaagcacgaguauucucaacuauuaauuaaauuugaaauauuucaucaacucugcucaagaaacaaaauucuuguuucaaaacugauagugcugcuuuggagaaauucagaauaaggauucuaugugaaaaagaagcauaccgagagaaaaagguuagauucgaaucuuuaauucugauaaccaguuuucucauuucggaauuuaaauaagaauuguuuagaauaaucggagaacauuuagugcuauuuuuuccaaauuggauauuuucuuuauuuacauuuaugauguuguucucccuuccuccccccaaaaaaaacccgauguuguccccuuucccgguuuuucucuccagaaacccccuguccccuuccccccucgaccugcuucuaugaggguguuccccccacucaccuacccacucccaucucccugcccuggcauucuucuacacucggacauugaaccuuuacagggccaagagccucuccucccuuugaugccugacaaggccauccucuguugcauaugcaucuggagucauggcuugcuccauguguacgcuuugguuggugcuuuagucccugugaguucugggggggucugcuugguugauauuguuguucuuccuaugggguugcaaaccccuucagcuccuucaguccuuucaguuagugcuauuuucuaauggugguauuguauuggagucaagauuuccuacaggaaaauuuaacucuauccaaagauugugguauuccuagagguuaacugauugauaacacacaguuugcuaugaaguugucuuagaauuuuuuuucagggucuuuaucuuaguuacuauuguccuauuguugugaggacacaugaugaccaagguaacuuuagaagaaaacauuugagaguuuuuuacaguucauaaccaucauggcagaggaauacggucauagguagucauccauuuggcauuggaacaguggcugagagcuuaacauccugauuugcaagcaagaggcagaguagagacuggcccugucaugagcuuucuaaaacaucaguagcacaccccugacauggccacaacuauucacaaggccacaccuccuaauucuuccaaaauagucuacuaacuggggacuaagccuucaaacauguaauuauauggggcccauucucaaucaaccacacuugcgauagucugaagucuacccucaugaucccaucuagugcuaauauuacaggcauguauuaccacaccugauuggaggcuuguuuguuuuaauagucaauuuaaugguuaccuugggguugacucacuuuucaggcuauuuuaguuucuuuauucacaaguuuaauaaauuuuaugacuuaucagugcuagggauaaaacauggcuuugcucaugcuagacaauacuaccacuaaacuguaccucuugccaucaaaccugcuuucuaaauauauuuugaguguuuccucauuguaagaaauguaagacaguucaauaugggaucuagaguucaaaagaaaaaguuuaaucuuugauaauuaacauaauguuugcaaacaacuucaguuaaauuaagugguccauacacaaaggcaugaaaguaggaggucuuguugggaagaagaguugguuggggggaggaacggaaggauaauuauggauaauaggagcuggggggagccuugaaucucaauauucaugaggggaggcaaagacaaguagagagcucugugaguuuccggcuagccugauauacauaguuccaggacagccagauacauaauaaauuucuauucaucacguuaaucaaacauuaggguucagcaggugcuuaccaccaagcuuaacaguaaugaccagaguuugauccagacacuauauaauaagagaaugacuucuaaaaguuuccuucugaccucuacaugcauacuauagaaugcaggugugcaugccacaugcuuauuaaauaagucaguaaaaauguaguaagaacuuaaaaaaauagacauuaaguacauaaacucaggaagcucagaaguuuuaaauuuguaaauaauuaaccugugguccuaauggaugaagaaaauuuaaaaaugagcaaaaugccaaguaauucuuugucuuuuaauuuguaguagagcaaucuguagagaggauuucagcaguuuggagcguacucuuguggagggcuggagcucaauucccaauguacacacagcgccucaugguugaucaggagcauuugacaagucugaucucuuugggcaccagaacucauggacaaauuauucaacacacacaauuaaggacuuaacuguguaaugaaagaaaugauuugcaauaauuauuuuaaaaguguuuguugcagacagugggguuuucuuuugguuuccuagggagaugauacaaaauuguuagaacuggccaguauguggaaacauacaucuucaaaauccagcacuuagaaggaauaacuauuauccagugggcuacuugaguucaaggacagccuggucuauauagagaauuccaagccauccaggccuacauagaaagauccugucucaaaaaauuguuaaaauucagugugauagcuaagcaauaaaucaucacaugggaguagcacuuaauauauauaugacaccgaucugaggguaaaguuagaaaauaaucuuaacauuaauuaaaguuucauccuuaaaaaccucaagucuuuuuuuuuuucucacgucugaauacuuuaggaucucaucuuguaagguggugcuuuaagcaugcucuaagcaugacugauauauacuaguuauuuuuuagauauauaccaacuuaauuaccagggucauaugauaauccccacuggguaggugaguacauacagcaaggcuaauaaauuaaugaguauuauuuuggggggaaauguauaugggcuuaguuccuagaaaaguuaugagaugcaaaauguaauguucuuagguguuuggaauugcuggagaauuguuauuucauaccuggggucucuuuaaagccuguaaacuaguuccugagucauuuccacuugguaccauuaaagaacuuuauacccaacccuuccuggaugaaacacugucuuugacaaauucauuuauaacugagaaaacaguacaaaaacauaagauuaaaaaaaagauaauggacuagugcuguuuuaauaguccuguuuagugucuccuaaaaauuauaaacauuuguuuuggugacaaagcagauuuugcuuccuaguauuaaaauacaaauacaaaauaaggaaauugguuguggucaguuugauaaauuuucucaauauguauauuagcacuuauggcauauauaauuuuuuuuguuguuuuugguuuuuuugagacaggguuuuucuguauagcccuggcuguccuggaacucacuuuguagaccaggcuggccuggaacucagaaauccaccugccucugccucuggagugcugggauuaaaggcaugcgccaccacaccuggcaagaaacuauuucuugcucguuguucaggaucuauuucacaaagaauuauucuaagacuaggucaagguucauuuacuauuaucuuucaaaacucugaggaguucugacucaaccaggauuacuaauccgagugcugggauuaaaggcgugcaccaccaugcccggcggcauauauacuuuuauaucaugcuuuauuaguguacuagcuaaguguuuuucaguguuaucuauuacuuggggaaacagaaggaaaaaaaugauugugucaagcuucugccuuguaucuuuauauuugugguuuuuuucuuaccuguuucuuuuguguagccuguagacuuuguauauuccuauccauaugguuuucaacaaauuucuuccguggaauuccugaaaauagccaaaagaauacuagaaacauagugaggaaguacuuaaacuguuuuauaaagguauaguaauuagaauaauguacucaacugaugguucaguagguuccaaaaucauauacagcaaacauguaagaaauuaaguuauagcaaugguagugcaugccuuuaaucuugggguuggugugguuugugcuggagugggcagaucauuucuugaguaccaggacuauacagagaaacccuguugagagagaguggggagaacacauaauuuaugcuaaagaugacuguaaccgaagaugaauggauuguuaugauucaguguuacuauucaggaaacaauuugguaaaaagcaaaguuaagauaaagaacugaaugcuuaaaaauacaaauuuuuggcuaaagauguaguuucacugcuugucuaacaugcauaaacugagugugguaguguaaauguguauuccuagcacucaggaagauaagaaauugaagguaaguccuugccuauguagcaauuucaagaccaaucuaggauacaugaggcucugccuuaaacaaaaacaugacucuauaaaauaauugaaggguaauagccaggcauggcauaccacuuaaguccagcauuugggcaacagaagcaggaggauguuuaguuguugguaagccugagcuguacagcaaaacugcauuucacagagagguuggaaagaaaagagaaaacaacacagcgguaaaaagucuuuuuccgugaaggaagaaaucaguucuuucuccaauugagaaagcguaaccuuuuaugugaaaaauuugaauacagucaaauuauggcaucuaucguugucucaguuuccuuucuauuuggguaauuugcauuuuuccuauugucauaguaaauucuuuuuguucauuaauauuuuccucuuuauuucuguuucuuuccuuucuguuuuuauugcuguucccuuuacaaacuacauuuuuauacauaguauguucaucaucauaaacauaauuuuuggcuucugucaaagaacuuagauaguucugcccuaauaccuuugcugacugcaauauaauucuuaauuuugguuugguucuacuuccuguaugucacaaaccuggcuucaggggcucuuauuuagccaauuagaaugauuauacaacacuguuucuccuguauccuucauaauuuuaaagucagaaccacauaguugauaccgucaacuuuagcugccuucuuggaauggagccugcuccucccuuuaaauuauauuugcauaagaguugaucugauacuccuuuuuaggaacagaaaaucccuuaagcauuuccuuucauaaauuguaggacuaacugggugugggggucuuagcccaaggguauuauuacucuauuccauuuugugucuggccuuaucucuuuaucucuuucagcacaagccauggcaccaacauuuaauuuucugcuguuccuuuucucuuuaaauuguauauuucauauuucuuuuuugucuugcuuggccuuuuccuuuguaggccugaauaaaggugauuauuacuaaucucaaaaaagaaucaauaauaggaugucuuggauucucuauguuucaaaauaguccaaaaauuuucaguuuagcuccagggagauuuuucggaccaggacaaagacagccacauuguuuaccaaaauaucaggaguuaggaucuuuauuugcuaaugcuguuuucugaaaccucuugagcuaugccuccauaguucacuuuguucucagcacugcugucuucaaaacuccugguaggauggccuaauaagccuagcuuacaguuuucaaccacuuugcuacuucuaaagucuucuacauucuuuucaaauaauaguauggucaguccugucacagcaguagccuacuuucugguaccaccuuuugucaguaacuuuuaaauuguugugauaagagacaguauggugaaaguaguuuuuagacacacacacacacaaacauuuaauuuggugcuaagagauaagaguucauggccaucauggugaggagcauagcagcaagugggcauaguguuggagagcaguaggugagaacuuagaccuugacccacaggaaugaggcggagagaaaacuaaacuggguuuugaaauuguuagcaucauuugaccccucuuuucuguauccugugcuuuuggguuaauaaagacuuacaaaaagcuuacuuuucugggauuaggcaaauuuuguuuugucuacuaguaggguuuuguaauagagaucuuugaaugacagcuucagugauacacauuguguuauagauuuaucaaaaacaugcugacgugauuauauuucuaaagaaggaaaugauaaccuuuccuaguagaaaaacagccaaauagugguugggacacauacuggauuagugagaauuguaugaaggcguuuguguuugagcugggccaggcaugacuuaccuuaaggcaagaguaaaaguagcuuauuaaaguucguaguuguagcugagaugacuagcaauuacuuaaacaaaaacaaugcuauucuugccagaugugguggcauggaucuuuuaauaccaacaacaccaggaggcagaggcaaguggaucuuuagaaguucaaggcuagccuggucuauauuuucuaguccauccagggauauacaauuagaccuugucucaaaaaguauauauauauugcuaauaaaauuuuggcuauuucaaaggucaaagaugcagacuaguccauaagcaaaaauaauaugguuugaauuugggauauggaaguuaccaggaacugugcuacucauuaccacaggcacuuguuugaaagcuuuuauacuuagguuagcaaaacaucuuagucauguucuuuugcugugaugagauaccauaaccacagcaacucuuauuaaggaaaguacuuaguuggggcuugcuauauagguucaggggcuucguacaggaucagcaugcuaggaagcaugguggcaugcaaguagacauggugcugagagggaucuugcgagcucuacaucuggaccagaaggcagaggaaacacuggggccugacuagggcauuugaaaccuuaaagccuaucccugguuacacacuuccuccaaaaaggccacacuucuaaugcaacucccuaagcauuugaaaauaugagucuauaaaggccauucuuauucaaaccaacaugcaaauaauauagaaucuuagagagcucuugguuuaugucaagaaaacaugguuccaccauggugaaggaaaggguuaaaaaaccuagaauggugagaaaggccagcuauaacuaaauuccagcaaguaugaauuuauacauauggaauguaguagcuggcuagcauugcugcuuuguacucuuaucuugagcagcuccauagaaccauaaaauagauugcauuguuuguuuuuucauuaaacacuuuauaaacuuaugaccauaagcgugguguuaacucuuuuuuuuuuuuuuucuuuaccaagagcugggguggaaaggagaauggcuuuggacuugcagaauguugcagagacuugcaaauguuggugaguuaacuauuugggauaugauaaagucuuguucuaagccucacuuaacaaugaauguaugauauauaaauugacacuugacauuaggacuuuuguagaacuugaaaaauuagugcauaauaucuuuaggaaauuugagcuauuauuguuccuguuauagauaaaaaagucucaguaguguguguucauauaaccaguucugaaauaaguugaauuuauuuaaucaaaucccagaaagcugggaagaguaguacuuccacaucuguauuugggauauggcacgaggaagagcacgacuucaagaccagcuuugacuacauuuacuuauguacucacacaaguaucagaacucugagcaguguucaggaaugacugauaggaaauuuuuuuuuuaagaauuauuuauuacagggaucuguagacaaaucaagaguaguugaccuacauuuuauuuccagcacccuguggcaacuaaaaacauuuguaacuccagugccaagcccuaugauuagccucuucuagccucuauaggcaccaggcacuuacuuggcacagcagauaugcaugcagguaaaacacugauacaaauaacauucuaaaaauaguuuuuuaaaaacuuagguauacucuuaccuugucaccaauucucuuaaggauuuaggcuauccucccuucugcuuucugugcuucaaguagagccuagauugucauauucaucauuaaguagauaugaucaaaucuaacuaauuuaucuucuggaaauguuuaucccuuaguaggaugguucuuauuuuuaguugcagaaaucuacauauuaaagcagguuacuuucuuaccuuagcugauagaugaucuucaguaaguagcugugaauggauguugguaauaagggaaauaugucuuaaaucuuacucaguuuggaguuucaauuuugagaacauauuuuaaugaagaauucugaagcucauucugcauguuaagacuuucuggguuugugccaugacuguuuuccuguuuuaguccuuggcuuuaucaagguugagauuuggcauguuaacaguuugaaauucuuauacuuuaaaaugguacauguacacguugaacuaaauuuuaaaaugauaguacccuguccauuacaacauucccuagaaagaaaacaugaggcuaucauuguuuaccuuguauuacuuuuguagaguuauauaaaaagaugugcuuugaggguguagauuuuuuuuuugguuugguguguaucaaugcagaaagccaugaaaaauguucuagaaagguauagaaaggaguguuugaaguaauagaaaaaguguccauaaggaggcuguuaagauauuuuuacaagaaugcccuuuuucauucuuuaacugaugccaagauuuugacccuguucacuauuauuuauuaaaguuguaugcauuguuacuuggcagacuugaccccaccacaagaauaacuauagucaaaauuuauguauuaaaagaaagaguaacaguuaaucuagauguugaaaacagauuuguaucucuaaacuugagccuucugauucugcuucuaccaaauaucugauuaaagacacuauugauauauaaucuacuacugucacaauguguuugaggaaaguguuggagaugucuaaaaucaguuuaagcucgauauguuacucuguuuuauacacagaaauauccacccagugcaaccacacuacacuuugaauuuuaugcagauccuggagcugaggucaaaauugagaagagggugagucagguuauuuuguuguuauuuauagacucucuuaguuuaaaugaggggauguuuuguucucuaucacugcccuuugaagcuagauauaccuagaagcucuuuaggaaaaauuaaucauaugccuacuucucacaucauuaauuuuuuaaaauuauuuaucuacauuccauuccaccuuaccuuuccaguucccucucccagaguuccucaucccauuccuccucccccuugccucuaagagggugcucuccucucccaccccacccccaucauuagguuuuaugcugggaccugccaaaaguuacaacuccuuuuauugggcauuaccauauuuguguguuugcucagagucucuggaauguauccuaauagucuuaguuggauuucaguuucuguauuuaucucagucuauuaaaaagagcucugguuugcauguaaaauguuacuuaaaugauguucuaaauuccuggaugaucugcuaugacuugguuuggcauggaaacuccccaaugauuuuucuuccacuuucauuguuaaauuuuuuuuuccagaauaaaauugucuucaaaacaugagaaaguauucucauguauucugucuuugguaugaauacuaaaauuguggagauaguuagacaaggguuaaaaaggaacacaaaauaugaaacaugccuggcuaacagaauuauaguuaaauacuaccaguuugaaagaagcaucuugugacuguuauaugugggaaauggaugcuuuuaaugacuaugaaauuaccuugauucucaguguuucuuacaggguauuuagugaaucccuaacagguauuucaacuuuuuaauuucagacaacuaguaauacacuacauuauauucacauagaacaacuugacaagguaagagaauucuuugacaacugguuaguucauuuuuguuuguagccuuguucuuaacuaauuuuuuucuaauacagauuucagaaaguccuucugaaauaauggaaucucuuaccaaaauguacagcauuccuaaggauaagcagguaaaauacaucugaaaaauaucuugcauauuguggauuuccaaauauacuaauaaguugggcaaacagaagccauagcaaaauugauauacauuuggagucugaccauagcagauucgcuaccuagauuuguuuccucuucuugaggacaauaacuucuagcaccuuaugauagauuggaaacauaaacuuguaagcugauucaaaaugauuaucuaguaguggugauaacuuucucaacauuuuggauacauuuaggagaauucuauuguguuagcuuguucuguucuuuuuggcaguggucggauauuuauugaaaauuugaauuauuaucuauuaauguguauugacaauuuuugaaauaguaguauauugagagaucccuguuuugccacucuaguucugucaucuaaucucagaguaaauaauacuaguucaguuugauacucuagcaacaaaacuauuuuaccaagcagcauaaaaguacacaacagcucaagaaccuauccuuuguagugauuuacuaauauaagucuuacaucucuacagaugcuguuauuuacacauauacgacuggcccauggcuuuucuaaucacaggaagcgguuacaagcuguucaggccagacugcaugcaauaucuauauuagguaagaaaacacuaauuaacugguccuaaguaggcacuuugaauuugauuucugaugagugccaucuaucuuuaaugcuacgaggcuuuauuauggcaaccuaaauuauaaauguauuugcucaucccaguuacuacuguagucauucaucaucuugagcuccuuuauguacuagauaaaaggaaacuuuuauugcccaguuacaugggcuugguugucaucaucuugucccuguuauucuugauaaucccuuguccaguucucccaucuuuucagagguauaauuuugaagucugaaaauaauuaaaugguuaauacucuauacuuuuacuuugcuauaggagaauauauaggagguuuuguuuuuaauuaugcagaauucuaacaggccauuuucauguaagcauauaaugcacuuugaguguguaauaccuacuauagcucauuucucuccuuuuuggccaauuuuaccucauauuuguuccccagauaauuuuauuucuauuauuaugucaucagcacauaacugauuauguguguaaagagugugacauacaaaugagagauauguuacuuguccauuuugcaugaaguugcaucuguuuuucuacaaaugacauaacuucaucuuuauguggaagucacauguuuuugaggcucccaccaugguucugagaauuguauaccuacacacuguauucccucaggcaacuucaaguacguuauauuuggacaguauuuauaagcuauuuuaagaaaugaaagaaaauccuggaaauuguccugucacaugcuaggcacauuacaaggcaaaaaaggacaaguaucacuauuacuaccuacuuucauuuaguuucugccuacauacucuuagaacugacuacauugcuauguuuguguucauaccuaguacaauuucuggcauuauaaugauuauccaaaaaguuaaugaauguacucacgucucggccauauuuuacuucagaguguaugccacuauuaccucagugugugauucagcaaaaaaaaaaaaauaugcauuuucuugagccagggucucacuauauauagcucugucuaucuuagaacucaugguauaagccaggcuauccuugaacucacagagaucuaccugccucugucucccaaauccugggauuuaagauauagguaggcuacuaugccuucucgauauuacaaagucuuuuuuggggguggggggugggguuguuuuuguuccuuuuuggguuuuuuguuuguucguuuguuuuuuggguuugguuuuguuuuuugguuugguuugguuugguuugguuugguuugguuuuugguuuuccgagacaagguuucucuguauagcccuggcuguccuggaacucacucuguagaccaggcuggccucaaacucagaaauccccuugccucugccuccagagugcugggaucaaaggagugcgcuaccaugcccagcgauuaugcacauucuuaacuuuuaguagugccacaugaauuugacaguguacaauagucuauaaauuuucuuuguuuuaauaaggauuuguguuauaagcaaagaaagaagccaagucuauaccuuuauccaaagcauaguuacaguucaaucaaguagugaaguuaagaaaaugaacucuuugcucccuuuuccuacaaaacuucccccaaauuccuucugauaauuuuaguagaaaaauaugugguuauucagauuuuaccacaaucauauaauguagugauuuuacccuuuugugcugauuggaauguguguuauacagugguggcuuaauaacugcauuucuaccaaagucuuugcuuuucuuuugcagucuauucuaaugccuugcaagagucagcaaacaguaucuuguauaauggguugauagaggaguugguagauguccuucaaauaacagauaagcagcucaugguaaguaucuauuaauauguaccuaucaaguuuuauauugcauaugccuucuguuuuucuuaagaaguccaaaaguauccuagaaguggagccugaaccuuuuacuuuuuucuuuuuggauauuaaacugugaaauuacugaauaccaaauacacauuguuauucucuacugaccccauuuuccucaaacaguuuuaauaaaauuacugaaaauuugauuuugagauauuagcaccuucguucaguuguccauuuguuuuugacacuguuuacuuuguccucauaggaaauuaaagcugcuucuuuacgaacguuaacaucaauuguucauuuggagagaacucccaagcucagcaguauuauugacuguacuggaacugccuccuaccauggauuuuugccuguacuugugcggaacugcauucaggccaugauugguagguuugcaugguaauuauuuaccuaggaacauuucaucguuuaacauugugcuagguaaguaacugaggaaaucccaacuuucuuuguagauccuuccauggacccauacccccaucaguuugccacagcucuuuucuccuuuuuguaccaucuggcuagcuacgaugcugguggugaagccuuggucuccuguggaaugauggaagccuuacuaaagguacucugcuuuugcuuucuaauauaauugugugaaaaucaaauaagagagggcagauuuuuaauguuuuacagugaguaaauagcacagaaaguuuauccuaaaagaguuauaguuuauguucuaguugccacauguaucuauugucaauauugggacuuuuuguaauccagcguaauuugguagacuggaggcccugggucuagacaguacuacaugcauaguagugugacauuaugcauggcccuaagaaaaauguauguaagaguccuuguaaaguuuuaguuuaauuauaacaggauuuagauuaguugguugauuggcaguagguauuuugaggcaaugggucuuggccucucuggcuugcaauaaaauaagcuguauauauuuaaucaucuuuaugaauuguuaugcauguggccucaggagguugaauauaguccuugaauucauaacuuuauuauuugacaaaacauucagcauaugucuuuaucuucucuccaguuucauacuaugcugacucaaggggacaccaauacuauauuuucgaaaagcaauauuaauuuuuauagcucuguuuuuaaauuauuauguuuaccccucccuuccuugcaggucauaaaguuucuuggugaugaacaagaccagauaacauuuguaaccagagcugucagagugguugaccuuaucaccaaccuggacauggcagcuuuucagucucauaguggucuuucuaucuucaucuauagacuugagguauuauuuucuuaagacaauuugcauagacuuuauuggaucccagugagugcugagucuaggaaaauuuccaccuaucauaagcaaccaucuuaccucucuuaaauuucuagaaacugaguuuauaauuugcuuguuauucuucauuauaauuuuuuaaucccaaaaauguauaggaguuucuuaauauuuuucccuugauuguagcacgaaguagauuugugucguaaagaaugcccuuucgugaucaagccaaagauccagagacccaguaccacucaagaaggagaagaaauggaaacugauauggaugguaauuaacaaguuauuaagccaaugauauuuccauguaugugauuuuucuauuauccuauccaaauucuaauucuuacucauaaauuaaaaggcacacagguuuccagguauaucuuucaacacuuuuuauauaaaugauauauaaauuguuagggauagaccugggagguaaagcuacaguagaccacuaaagucacucuacacauuuuuuuaguuuauuaucuuauuuacacuacuaaaaccuaauaagcaccguguagucaaaauacugucuuuuuuuuuuuuuuuuuaccugauaaauuaccuggagacuauaaacucauaaaugagaccuuggaaaacuaucuuaagaucagagauuuuaauugguuauuguuuagggaucuuuuaagugacaaaauuacaauugcaaaaccagaucauuuuaguuuucauguguguuauauggguuuuuuuuaacacuuucaucucuuuccuaauagaauaaaaauucauaauagaauaaaaaauacugccccaagcagauuucuuauaauuugcaauagucuuaaugacagagauuauuauuguguaucuuacuauguuuaugauaaaaguacuacaaauguaacgcgccguuuuguuaauaguaaauaguauguuguuccuuuuucugacuuuguuuuugggcaccauuaucugugcauguugcaguccacagaaauccuuuugcucaguuucuguuucuguuuuauugggaacaagcugacauuuaaguucacaggugagauuccaaguguugaauaaaauguguuuauuaacugcugauaaauaauuguugacuauccauuguaaaucagcaauugucagaauuuaauaagcagaacaauaagugcuugguagauucuggcgccaucugaaaugcuugauucaguaaauuugcaacugaagaccaggaaacaaguauuuaaaacuaauccaaacgauugcauugaauucucaaagaaauuacauacucaauacaaagaaaguuacacagcuguucguccuuacuacuuguguaaguaggugcaugcauuaaaauaacuuuaaaauguuacauuuauaaaauuaauaagauccccuuuaaaguuuacauaacugaaacauuguagauaguaaauauuugcuuuucaaaucuaaaaguaaauguuaaugcucagucuuaacccucugccauuagcuguuaauuugaugugacucaauacaacuuuauuuccuuuucauuuucacaucuacaaguauauaguuuuuagaacagagagagaggagagcacaaacacauucugcuuuuauuguucauucuauguaucauagccauccuucccuaugaacaucagugcuuuuuauauuuguuaauuaaccucuguuaguagucuugacuuacuaccucccucuuagcaguaacauacaaaguugcauguuuuacaucucacucaguggacgaaguuuucucagaaaucuuucuuuucuuaguaccuuuuauucuaauuaguuucuuuaucauaacuuguacuuuaguugcagauguaacuauggaaagcaguccaggcucguccauaucuauggagcaccggcuggauguugaauuaagggcaucaaguuccaacagcagcacuagcaucucuggcccuggcccggguccuggcccugguccggguccuggcccugguccuggcccugguccugguccuggcccuggcccuggcccuggccccggcccuggcccugguccuggcccuggaccccguccuggugcguagacacauagauacacagucuuuuacagugacugacuuauuaaacuagugaagaagagaacauuacacggcacuuauugguacauuugaggauaaucuuauaagaacaugucuugcaacauuuuauggucuucuguuaguucacacaguaucaaaacagacauuucggagggcagauaauauccaaaagugaaguuugaaguugaaucuuuuuacucuacaguauuucuguuuuuaucuuuuucuuuuuguuccucugucugucugauuuuaauaccggucauaugcuaucuuuggugauuuaauuucagcuuucagaauacucucucucauguccagagaucucacuuuaaaugucugcuaguuuugcuuuaguggauauagacgggucucuuaguacauguuuugugugccucuucacugugauuuaauaaugagcacaauaugauacuuuuuucuuucucccauguuaggaguucaguguauuccacaacgagcagcacuucucaaguccauguugaauuuccucaagaaggccauucaagacccugcuuucucagauggcauacgacaugguauuuugauucuguauacuguuuucuaagaccacuugguuauccagauuguucuuuuucauguuuucuugauguuuuucuaaagcauacuuaguaaacugauagcuuuuuguuacuuaauauguuucuuagacaugaggguuacuuacacaacuccacuucccagcuuuggauucugaucucuucuauccuacugccaccucucauagucuccaugucuguucuuauuuugacccucuauucaagcuaacugcaugaauaaacuaaggcguuauaugaaacagaggccauagacuugaucauuuauuuacuacaguauaacauauugcuacccaucacccuugaucuucgugccucacccagacuuaucauauguggucuuuguucauauuucuuuuagugauggaugguucuuuaccuaccucucugaaacacaucaucagcaaugcagaauacuaugguccaucacucuuccuccuaggugaguagaauugaaguucgggcuagguugaauguucuggcauacauuuauaaaguaccuggaggcaaaaggcagucaguucucuugaguucaaugccagcuugcugcaugugugugcacgcaagcuuuuagaacuuuuuuuuaauuucuuuuuuuaugagauauuuuuucauuuacaacucaaaugcuaucccaaaaguccuuuauaccacucccuacccuggacccugcuuuccaacccaccuacucccacuuccugguaaaugcuacaaagcccauuguuuuaucccacuacgcacuuuggcaucacaaaugcaaguuggaacuccauuuaaaauucuauaaagcaauuuagggggagauguagaaauugcaauuucuuugaacauaguggaguguacauuguacaaauacauuaugggcagucuagagauuuguauuuauuaugacuuuaccuuuuugcuaaugaaacaguuuaugaaucuguauuucuaucuugugaucuugcagaauuuacuaguuugguuuucccuguuaaugaaccaaaauguuuccauuuacuccaaggauggcaauaugacccaguauuuccuuuuuuuagugaaacuucaugaagcagguauacuuuguaguuggaucuaugauauuccaguuacuaaauaugaguacaggucagguccuguaaaggaguuggaguugugacaaaggaaaaucagccuaagguagauugaaagaguuccuacugggaaaauuuguaucauagcagacagacaguuaaaaauagccuuaacaaaggauguugcacaugcuuuuaguuaaguaucugggaauaauacucauaaauggaaaguuaacgaggaaguauguggcaagguuacagugaucuguaguaacuacacacugaaacucaacaaauaaggaauuugacauuucuuuuuuuuuuuaaagauuuauuuauuuauuauauguaaguacacuguaguugucuucagacacaccagaagguuaguaugguagaaauauaguuuuuuuuaaaaaggcuuguuaguguugguugauaucccugggaggccugcucuuuucugaaaggaaauggaggacgaguggaucugggguaaaagggugguggagaugggguugggaggagugaagagagggaaucuguuuacugauaugugauguaugagagaaaaauacauaaaaaggaaugauaacacauaaaacucuuaauguuuauuggacuacucuugguauucugcuggaaaauuguuuucauaauaagcacacaaguuuaaauuauuaaauauuuaguguauguguuuuaagauuuugugacgggcaguguuguugcaugccuuuaaucccagcacuugggaggcagaggaaaguggauuucugaguucaaguccugccuggucuacagaguguguuccacgacagccagggcuacacaaagaaacucugucuugaaaaaaaaaacagauuuuauuuacuuuuaauaccuauggagagucucaguuucccauaauuuuucuuauuucuucuuagcuacugaaguggugacuguguuuguauuucaagagccaucacugcuguccucacuccaggacaauggacugacagaugucaugcugcaugcacugcucaucaaagaugugaguucauucuaccacuuuauaaaaaagacuacuccguuuauuuccuguuuucucagauacaucuuccacaugcuuuagaagcaaguuugaaauguuauugugugaaaaaauuuauguauguauuguugaauuuauuuuauaccuguuuaacaaauuccucagugugguaacccuaacuauauuuucuuugcauuuguauaugacauuuuuugaguugcauucaaauccuuuucgucuugacuagguuccugcuacaagggaaguccucgguucccucccaaauguauucagugcacuuugcuugaaugcccgaggucuucagucuuuuguacaaugucagccauuugaacgucucuucaaaguucuucugucuccugauuaccucccagccaugcggaggaggaggaguucugauccccuuggugaguugugcuacuauuuauuuuaaaauagaaaguugguuuuggcaaggaaaguuuuccuugacuacacaucguuucucugguuagguaugcucagcuuaacgggaauuaucaccauguauucuaauauuacagguaggaaggaauacgucauccuuagccucucucuucauaguauuuccaugcuucugaauaguucacuuuacugauguugguaacaaacagguauagggaauggugauuucuuuucuccucuccucuccucuccucuccucuccucuccucuccucuccucuccucuccucuccucuccucuccucuccucuccucuucucuuuuuuccccagugguuuauuuucaagucuaccaucuaauauacaaauuuuucuguugugaacagauuucucauuuuuuucuaaaacaguuauaaauaauuauauuuucuucucaguguauuuugaguguauauugcuaaggcaaaagagagaaaaauacuguaguuuguaaaaguguaccuguauauuaccuaggcugagucugggcauuugaauucagccugggcaauauagugaggggacaacacaacagcauucacccccuaccccucacccccuuuucaugaauaaauguauucuguacuuccauucaccacuguaucauucuagcagucuucauggagacaucccaagggucaggguauaggggacuuuggggauagcauuugaaauguaaauggaggaacuaucuaauuuuuuaaaaaugccauaagaaaguauuucuucuuuucuacuccuuugucuauaauagaguagcucagaccuugacaguggcguuugcuaaacugaucucuuuccuccucuuccuccucaaccaccaccaccaccaccaucaccaugauuugguggauugaagcuuaugugaauucauucaagcuuauguguugguagauagucacaagaagcaguucaguuuuuuucuuucugucuuaaauuggcacaaaaauuuuuggaaucaguaaaaaaaauuuuuuuuuuugccuuaaggggauacugcauccaaccuggggagugcuguugaugagcucaugagacaccagccuacccucaaaacagaugcaacaacugccaucaucaagguagggauugauaaugguuaggaauuugaucuuuuacaaaguguccuagcuuaacugggaaggguauuuuaucugccuaauuucuaagccuugcuuuuuuggacuguucuuugcaaaaccaaaaguuauaaccaguagucuuuacaagaguggacuuuauguugauuccauccuuuuuauuuauacugaaucauuuucugaauuaacacaguuccuuuguuuaguguaaaucuguuuguauugcuuucuuaugagauuaacaaauaugcaggggcuucaguuuguaugagcauccuugcuagcuucuuuucuugaauuuuucccuuccucauuucuccuuccuccaucaggaguggauuauuugauucugcauauaagauaaugaugauuuuuaaauuaggacuggcaugugaccuugugugauuuuuuuuuuuuuuuuuuuuuuuuuuuuuacuuuuuacacuuaaauuuuuucuuuuuaaaaaauggauguaaugguuaugcuucaggaguguuguguauauuacacauagaaaacucucacaaaaugucauuccuucauuauaaauaaguaauguuuuccucuuugacuuuuaguuacuugaagaaaucuguaaucuuggaagagauccuaaauacauuugucagaagccaucuauucagaaagcggaugguacugcuacugcuccuccuccaaggucuaaucaugcugcagaagaggcuuccagugaagaugaggaggaagaggaaguacaggccaugcagagcuuuaauucugcccagcagaaugaaacugagccuaaucagcaguaaguguuaauaggucagauucucuuuccuuaugauacuacuuaguaucauaauaguuuauggugaugguugugguggcacuucuaauucuacuauggcccaucucugaguuuggaggccagccagggcuauagagagagacacuggcuggagagauugggguugugggcucaauuuuuuuuuuuuaugaucagcaggauggaacucaagcaaagcaacuccauacccuuuaugucacuucagucuauaaaaaaguaaaaaauacaucagaucauuuuaaaguucuuucuggccuuuuagguguuuuguuccuuccucuguagugucagaguucuguguuguaguagcauugguugccuuugaaaauugcuauucuuaaaauuuuaguucaugauguuaaaucagaauucaguauuccaaguaauauaugaaacuuuuauuucaaauguggaagcaaugucucuagacaggggucaauauuucagcugugaguaagaauaguuuugaucugguacuaaacuggcauauuggagguaggaaaauagucuaguagaguaugaauaaagcccaggaauagcagaaguaaaaagaguuacuggaacucagcagugcacuugguggugucaguaauuuuggaggggagucauuacuuaaucuccauuugccugagacagcaggcauaaaucucuaguguuguccucaaucuaccauuaagaucauguuucuaaaagagggagacauucugacauucugaaauuauggcauuucucaauacaguauaaagaaguuacaguauuuauucccaaucuccaauugccaguaacccugcagagcugauuugcuuuuccuguucacaaaugaaaaaaagauuuguugaauguagaauguuguugguggugauuacaaaucaaguuguguguaucugcauauauuagaucuuagaucuaauauauuccaaauucaagcugcuguuaaaguaaauuaacaucuucugaauauuacucauuuuucauacuauuuuccuuacuugagauauuguauaucauuauccacauuuguuccucauuccagaacaucuuccaauugggaaaccaagcuuauauuuucccauaugcugauucuuuucuguauuaaucuguuucagugacuccuaucucuauuuaauagaauuaucaaagaacuuuagaucaagugccugucaacuuucucuuaucugcccucuuuccaguucacauuacccccccccccccggcccuggcccugcucgcuccaggccauagguuuuuuuuuuuuuaauuuguuucucauuaugagaugacugugagccaccaugugguugcugggaauugaacucaugacuucuggaagagagucagugcucuuaaagcugagccaucucaccagccccccaguuuacauucucaauuggaccuacaaauuccuguuucuuugccucuauccuucuucaaaugccauagguauauauccaaauguaauuuuuauauguauguucaaauauuucuccauccaaaaauggagcuacugaucuuacuucuauuauacaugaaauaauuuuguauauucaaaaauacccuauaaauacaaugauaauacaaaugugcaucuaaugcauaguuucuuuaauuugguuuuacuuacuguguuuugggaauuuauccauauuaguaacaugucucuguagucuugagugcguuguauaacuaugguuacauuuauuuaguuuuccucuuaaugaacuugguuuuuauuuuccugaggcuaauuccuuuuuauucuuacuuuuuaaagucaugauggcuuaugaaugauagugaaauaauaguuuuuguuggauguguagaauaagaacgcuuagguaguuuaggucuaaauucuuagguuucuaaugugcuauucacaaacuaaggucuugcuuugcagguaagaguagcugggaauucauuguacaguguccucaaacucagucuucccucuucagccuucuuuuuuuuuuaaacguauuuuccucaaugacauuuccaaugcuaucccaaaauuccccuccaccccccacccccacuucccuacccacccauucccauuuuuuggcccuggcguucuccuguacaggggcauauaaaguuugccuguccaaugggccucucuuuccagugauggccgacuaggccaucuuuugauacauacgcagcuagagucaagagcuccgggguacugguuaguucauauuguuguuccaccuauaggguugcaguucccuucagcuccuuggauacuuucucuagcuccuccauugggcacccugugauccauccaauaagugcugaggauuaugacucuguuucuggccacucuauggucucugaaacaagccuuucaaguccuacaaagaggcuuuuugauucuugcugcuuuucagggcauaguguggcauucuccuacaugacuuagguugauaauaaacaccauaguuuaaguuuuuccugguccuaaacugugaggagaagaggggcuggaccugguuauccaaccaaggccuguguucccuaacagucccugcaagugccugucagucaguucuucauucuaaaugaugggcugggauauggggaauguagccugauaccuccaggcuguugcaaauuuucaagcagcacucaaaauuuuaaaguacaggcucaugauccuugauauuaaggaacuuuuaaauaauaugcauaagucuguggucugugcagcucuguagcauuuguuugagagaauagagauugggcagaggagaauuggacaauuauaacucauuuacaaaaacagacuuuuguugcucagggaugugacugcuucaaauuagguuaaaccuaggcuuguagguagaguuccuuaggagauaacugaucauuuuuauuuuuaaaugauguaguaggaaagaacaauagauacauauaugaaugagucuguuccuggaguuauauuaagaacaauacuguugguuugucuuuuuuuuuuucuacagcuuccuuuuuagcaaugaaaggcacaccugggauucauuucguugcauuaaccugugcucuuuacuagaucauauuugacauauacaaagaggcaagaauuccauuggagugguaucuguacuuguaguuuuagagguggaucuuuagguucuuucuagggaggugaggcuuaguugaaaaggauaauuaauugauuaauaaaaugcugcaguugugcauuaucuaggaaauguucuuuucaauccuggcuuaaagauuuccuuucuuugaagggucuuaguccuuugaaggacuuaacuuucucagagugguaugaauacuuaagcugauacugaaaaucacacagcacagugccugauaaauuguggggaaaggacuauacuaguuuacuauuauuucuugugccuuuuguugucaacaaaggguaguucagagacccagaaagaccuaagauaaacuuugcaauguaaggauuaaaacagccucucagauuucaccaucaucucauuaucuaauuugguaauguggccauuugaaguuccucacaaggccagcacugccacccugcuuuguacucuguccagaaggcucuaaugaaguccucuuccugauuugaacagcacuuucuguagguacaaagggccauuuccuuuagugucucuacugcgauuuuuaauaauauacaaagcagggaaaaugaaguggaauccaauaaaauccuuuuauuaauaaagaucaaacaaaacaaacaaaaagauuuccacuuuuuguacaaaggucuuugcccaugggacuagaaaaaaaagcuggauuugccgcucuuaaugaagacaggacacaguauucauugaguuaggcggcuuacaaccacuuguaucuccaguuagccugcacucacguguauacucacauguaacauaaaguaaauuuuaacaagauucuuuugcaaguccccucccccaauuuucuucauuuaguguauauguguauaaucucauacacacaugugaaaggucagaggacaacauucaugaguugauucucugcuucccuggaugcugaggacugaacucaaauuguaaggcuuguauggugaguacuuaccugcugugcuaucucuucagcccuuuuaaaaguugaggaucuuuauaaaauccuuaacccugggcuggugagauggcucaagcggguaagagcucugacugcucuuccaaacucuucaugaguucaaaucccagcaaccacaugguagcucagaaucacccauaaugagaucugacucccucuucugguguguuugaagacagcuacaguguacuuauuauacauaauaauaaauaaaccuuuuuuaaaagccuuggauguuucauuacugaagcuauucuuaaagcuucuuuguucuuuuucacuuuucugcuaaauguuuucaugguugucaauuuuuauaauuugucagauaugagaacuauuagcauuuuaucuugcuugucucuuuuacuaucuuuucucucaacaccacuaucucuguuccuccauugccaccucuuacucagaucccaaggauacauauagcaucaucauauguuguuuccuacuuaaguuuucuucuuuucugucuuuaugaguuacauuuucuuuucaucucaguacaguauauaugguuguuucccccucucauuuucuugcaaaagacaauuuaaucuaaagauaccuuuugccgggcggugguggugcacuccuuuaaucuuagcacuugggaggcagaggcagguggauuucugaguucaaggccagccuggucuacagagugaguuccaggacagccagggauauacagagaaacccugucccaaaaaaacaaaaaagaaaaaaauauuaagauaccuuuauaaaucuauaaccuaauuagcauccaguauugaagaauuugaaaaagcuaaaaaacaugauaaauuguuucauaauucaggaacugucauccugcaauuacaaauuagcaguaaaaggaggccuucgaaaaugacuuuagcuuugacuguucauaaguauuugucagucuuaagcauuuuugauuuuuugagauaagguuucuuuguguaacagccccugauuuuucuggaaccgacuuuguacacuagccuggcccugaaagcuccuccugcccaugccucugccucuuuaaguacgaggauuaaaagcauaugccacuacuccuggcucauaguaaagauauuugaacaaaaccaaaaauccacuucuuucucagcucuuaaucuaacauaagauuaugacuguuuuauguuugcuucauugccugguccuucccuguaagcacauguuuggucuuuuaauucaguuuauuuucaguauuuuuauaauguugaauuuuuuucuaacaguaauuucucuuagaaaggaugugucauuugugguaaguauaaaauugcuauauuuuuauggccuguuuauuuuauacucugaacucuaccuucauuauugauuucagcucuuuuucuucaugucuuaguuuuaagguucauauacuaaaagaguauauacucuaggagcaugacuuauuaaaagggcuucacuuuuuuucccuuacgcuggugcuaugaauuucuguguaacugauucuuuucucuuuaacagggucguugguaccgaggaacguauaccuauaccccucauggauuacauccuuaaugugguaagauucauuguagagcuaaagaugugugcuuuucaggaaaauacaucagguugucaucagagcaaguuacuuuuucuccccuaaugccuuuaguuaguaauuaucauuuuauuuucucaacuugaaaguaccuuaugugauaacauuguauagcauuuaauguuuauuuucucuagagcuauuaaaguacagaggaaaaggugugcaaaauuggaaauauuuguucuugccccauuuucaguaaaugaaccaguauucucagccuuuuuauauuuucaacugucuguucacuguuauuauuguacauuugaauuuuaacgagauuuaguguguuaaaccaauauucugucagaauuuacccaacauguuuuucccccauuuuaccccuuccccugccccucucugaaguguauggacguucccuguaucauuaagaaaaugugaagagcacuaaaauuuucccagaauuuaauauccacuuagcauuuauucuagacuauuaagcagauaauuuuucuugugcuuuuguguacauuaauacauuuuuucuaucccucaaagaucccuauuguuuugauucaaauccugauuccuggaguucauuuuauuuauauuauaaggaugcgugggaacuguccuaacaaauggaguguauauacaguuaagacauagaccuguuucugccacuaauucagaauguugcucugaacaaggcauuuagcuucucuuugcuuucaaauugacuucuggagugguuaaaaagguagaaugggaaggguuccuuauuuucuggaugaguaugugcuaauuauuugucccuguuaauugaagugguauuacagaaaauaacugaugucuugcaaauacguugucccuauccugauccugaugaaguaaaacugaccuuuuacuuccaaguguuagccucuaacuuguuuuuaaaaaacuuucaucaccuagaugaaauuuguggaaucuauuuugagcaacaauacaacagaugaccacugucaagaauuuguaaaccagaaaggacucuuaccuuugguuaccauuuugggucuucccaaucugcccauugacuuucccacaucugcugccugucaggcuguugcaggugucugcaaauccauauugguaagaaacaucuagcgaaauauuuuacaucucuguauguauuuucauuguguucucgcuuaaggaccucuaguuaaaaauugauaaauuuguguguuuuauauuuuauacuauuucccauaguaaaauuauuuauuuucuuuguuuuugcauuugcguguaguuuugccauuugaauucauaugcgucuaaauuauuuccaggaaagcuuucuagcuuucuucauguuguuaugguacuguuuuuuuguuuuaauaugcgcauucacuuugcaguguucguuccuuuuccccaagcuuuauuagucauaaauugauauguaauuuauugcuuaaaauuugccaaaaacaguuucuuuauuucuacaacaccuuugauuuuugcaaguuacuuguucaccccuaaugccuucaguuaguaauuaucauucuauuuacucaacuugaaaguaccuuauguaauagcauuguauagcauuuaagaguguuacagugacacuaaauauuuauuaauuuugucaguuuccuuuuuaaagcuaaaugauaaaaaaaaacacaagaaaagcuaaaugauauuuuaugaaauacacucuagaucauuuuguccguuccucuguuacuggacacugagguugcuuuuauuuuagccccugaugaauacuguuauaaacuugaguguauaaauagcacuucaagauuugccuuuugaaucuuuuggauauauacuuugaagugacauaacuuaaucaaaugauaauucuauuugugugugugugugcuugcaugaaaccuucaaaguacuuuuccaagauuauuuuccauuccuaguuagcgccacauaaggauuguaauuucaccauuuccaugccagaucggucggucggucggucggucugucuuucuuucuuucuuucuuucuuucuuucuuucuuucuuucuuucuuucuuucuuuccuucuuuccuuccuuccuuccuuccuuccuuccuuccuuccuuccuucuuucuuucuuucuuucuuucuuucuuucuuucuuucuuucuuucuuucuguuuucuuaaauaauagccauccuugaagauaaaguagugcuucguuuucauuuugacuugcauuuccuaaauaauuggugguauugaucauaacguuugauuuguguacuugaguuauugucuaugugugcauccuuugcuaaacgaauacuuguguucuuuauuuuauauuuaaucaaauuaagauguuuuucuguucauuaucgaauaucucuguauauauugaacaccagccucuuuuuuucagauacaucacuugcaaauauccucauuuugucaguugccuguuuguuaccauugacauacuaaagguuuugaugcugaccaggcccauuuugucuuuuguuaucguugucauuuuuguuuuuugugcuuuuggugcugauccaagaaauuucagacaguuuaauuccuauacuuuaaucuagauauuaugaguuuuuaauucuuaggucuugauacauuuggaguagagaccgaaaagguuccacuuuauuuauuucauuuguuuauuuuauauuucccccaauaucauucauugaaaagacuguacuuuuauuaaaccaucuccuaucaacacaucucuucaaacacaauuuaacuaaaaaauuuggaguuuucuuucucagcccaauucuuuuccauugauuguccaguagcacaauuuugauuaaucaauuauaacuaaucaaaaucaaauuggaaaucaggaagugugagaccuccaaauugaguuguguucucauaccccagaaauauuuuguuuuuuuuuuuggggggggggguucuuugaaaaguuguaaaugaauuaugagggaaauuuuauaucugccuccaacccagaaaaaaaaagauugggggaauuuugauaguaauuacaauaaagcuccuuuguuggcuguuuugugcagugauaaauaauuuugagaaacugcaauuuaauguuuuauuuuguuucacucuuugcagguguaaagugcuuucauaagagaacauggggaaaggacugaucuaacuaccccaccucuaagaugcucugugaggagggauagauuuauuucaagccauaggaaggcaaauaauuucuagcuuugcauaacaagugguaaucuuuaauugccagauuuuucuuccuuaacuugaaaagaaauguaauauuuggguuugucuauuaaaauaauuugccuuccugaugccaaucucagagucaccacucuuauuuuggaaagaagacaacuuuauagcucugaaaguacuucuugauaguuugacuagccucaguagcuuuuauaauaguugcuuucucccuuauuuccuucugcaccauuuguacugcuagauauagauacagcugcuuaauuuauguaacauuguaugagguugaguuucacaugcccucucagccuccucccucaacaauauuuaauacaauacuuacuuuauucaauuauugauuuacucauuagaaauaaauagaaaacaccauuguaauguagcucauuuuuaagauuuggaacuuugccuaacauugcuccuuucuaagcaaaauuugaaacuaaccucuuacacagcaguacaacaaacagucuuguuugacauuuucauguuaugauuggcucaucaagcuuaaaaauaauaugcuauuacacaaaguagugaaauauaucauuccuggcuucauauuuugguacugccauuuauaaauugagaaauguaacugacugaaauuucggagaguuaaguaauagucacuauuacuguaaauguuaagaacauaauguauguauuucauuacguggagacacauucauaauucuuguuucagacccugucacaugaacccaaaguucuucaagaaggucuccuucaauuagacuugauccuuuccuccuuggagccuuuacaucggccgauugaauccccugggggcucaguguuacugagagaauuggcaugugcaggcaauguugcugaugcuacccucucagcucaggccacgccucuguugcaugcacucacugcagcccaugcuuacaucaugauguuuguucacacuugcagaguuggacagguaagaauaaucauggggcuaugguuucagcuuaaagccaauaaaauggcaaggaccuauauccaucugcuagauuacuggcuugggaacaaauauaccuggagucauagcugaaagaaaugcauuauuuuuauuuaguacuguuuuuuuuuucugaacaauauaucugguggugguuguggguuuauauuuuaaauugccauggagcuucauucucuuauuuuuuauuagcuguuguguaggcauauacauuuaucauaugaauagaacuuuaagaaaaaccauaauuauuauuuuuuauuacuaucuauaacaaaugacuguuuuugcaggcaaaaauuauuugaguggccauugcaucuuaccgcuaucuuuuuaaaauagcaaauaugaaacucauuucauugcauuuauuuaacuuuuguuuacuuuugugugggccugauaacuugauggguuuugagcauaccauaugggauuuggggaggccagaggacaacuuuuugaaguccauucuuuuaugcuuuuauguagauucuaaguaucaagcucagguuauugggcuucccugguaccuauauuuaucccuaauccuucucaaaaaaauuauuauuuccuaaucucuauauaaguacauauagauccaacaguggaauggcaaaaaaaauuuuuuuuaccacaaagcguuuaguuagcagacagcaacaagaagaaaaugugucaaaugcuaugucugcauucuguggucuuguucauaaagaaaacugcuguggagacagggaagcuuccucaguuucaaaauaacugcuguguaaaucugaagacuugaguuuucuucuuuuuuuuauguuuuuuuuuuuaauuuuuuuucagacagguuuuaucuguguagucccaacuguccuuaaauucaaucuguagaacaggcuggccucaaacucagagaucugccugccucugccucccgagugguagcuaggauuaaaagguuguacccccauguccagcaaagaccuggguuucaauccucagaaauucuguauaaaugccugacaacuuugcacaugcuuauaaucccaacacuguaaaaaauaggugcauuucuggggcuuuugggcuagccaaaaauugucucaaaaacuuaagguggucagcaccugaggaacagguuguuuucuagccuccauacgccuagauacucguacaugugguaacagaaguacaucuccuggcucuguguuuguguauucacuauuuuuaccauguuuaugucucaguaauuuauuacaaaaaguuguucaacaguuccaaaacuggguaagaguacguuuucuaccagcuacacuauaauguagcccagacauugcucgcacucaguauuucuugccuccaaaaaugcugggauuauaggcagaugauaucgaaccaaacaguaaagguugauauuuuaaaaauauaguauuuuuaaaguauaauuguuuguagacagucucaaauacuuauccuuugguugcagagugaaauucguucuaucucaguaaaccagugggguucacaauuggguuugaguguucugagcaagcuaagccaguuauacuguucucuggugugggaaagcacuguccuccucucucuauguacccccaacagguaagagaaugcucauuucucuuaacaucucucuuuguuuuucuaauagacaaaguuugaacaggguggaugaguuugauuaaaaagguccaguuuuuuauccuuccuaccuucuagccuauggauuuaacugacaaauuauaacauccucugaauguuuaauaugauuuccuggagauaguuguguuagcacaaugcaaacaaaucuuguuuguugcuucuucaagaaucaaaauuuuuuuuuauugcacuuaggauagcuuaggugcucuuagagguacugcccaagcaguauauaaguauauaugcagaauauaaauuguaauagcacuuaauucuguuuguuuugguuuuuuguuuguuugauuauuucccuuguuguagccuaccaucuggaugugaauuuggucaagcggacaugcagaaacuaguuccaaaggaugagaaggcagguacgacccagggcggaaaaagaucagguaacuguaagaaaaauaaaauguaaugacuguuacuucuaaguuaugucccugugacuuccacaggucaugugcuuacugugagacuuagcucuccaucauccuuagucuucaaguugauuuuuuuuauuaaauuuaguuuuuguuguuucuucuguaaaaacauacacauauuauaaaaaaauacugggguaacaacauauuuugccaccaaacauuugagaguuaucugccugauacuuuuccuuaguauauuuaagagucucuuagauauauauaucuuuguuuuguaaaugccaagaguugacuauucccagcuuaugugcuacuuaggaaaguaaaagucuuucauguaguuuuuuauaaauacaagauaguguccugacaauuaugauaccuaaagguaugguaauauuuuaauuucauuuaugacuucucaacuuuuaguauaaauucucuguaaccuguugggaaaauaauuuuucucauuuuucugaauaauaauauugaucauacuggauuaaaugauuuguuaauggaaaacuuccaccuauuuuuacuuuuuaaaauggauacucaaaguuguauguauggcuuacauucuguuucuuuuagacaguagugcuuuggaauuaucuuuuuuuuuaauugcauugcaaguuccauaauaguauaaucagaaaucacauaaaauucucugaucuugauguagcaaaugugaaggugauaaaaaaaauuuccagagauuuuaaagacccaaguaccuaaaacugaaaaauaacgaugacgauucuauguauaaagcugucagauauucuuuaaaaugaauugaaauuacugagaaggaaaccuaagcaaccaaaaucaaaauggauauaucuuaaaaauaagagcuuacagcagcuguuuguuaggagucagaauaaguauacacagacuucugagguuaauuuugaagaaaauguauauuucaaauuuuaguccauuucaaauacaacucaauaaaauuuauuaagaacuaggaaugaaauuaaaauccugaaagaauuguuucucccaauaguuuacacucuuguuugggggcguggguagccuuggucagucuucacauuuuuaccaccucguuucuagcaauuugguuaacacucaagucacaauuccuuaaaacuauuaaagaggaauucugagguuuagaaauacauagucaaaguccgguaauccuuaccauuguggcuuaaaggcaaggaggauuagcaccucugacuucauacugaguguggaaccaguuugagaacuugccucuaaaggggguggggcuuugguuggagagaugucucuuuaagaacacuuugcuacacugucaugagaauccaaguuugucuuucaguacacauacauaauuacaauaauuaaaugcugggaaauacugucagaauacuguccagaauacuguccagcaguauucuauaauguucaauuuuaauuugaaaaaacuauaagauucuaccaggacuucuucagugauagcuucaaauaugauaccgguguuaagaugcuucauauccuuucauuuggagaugccagcaaguauuuacuuauuagagcuccagacauaaaagcauauuggugucauucuuauuguuguugugcuuuggauguggaagauugguuugguuugagcuucuuaagaacuaauugaaauuuaaauagggauaagcaccauagauaacuauuuuuugagacccuucaaaaauggauccugguaaguacuagcucugcauuaucuuauuacccccuuuuacuucuaaagauggagaacaggauggaacugcuggaagcauggaugcaucugcccaggguuuauuagaaggaauugaacuagauggugacacacuggcacccauggagacagaugaaccuucuucuucagauucuaagggcaaaucuaaaaucacaccugccauggcugcaagaauuaaacaaaucaagccguugcugucaggucagugacucuccauuuuuagaacucccucuuugggcuucagagcucuaguauuccucaaacaaguuaaauuggaaaaaccauauuuuaaauaagucaauguuguagaaauguugugacucucacauguacuuuguugaaucccuauugugucucaugcucuaaauugguugcuaaagauauaaaaggagauaacuucuuccugaucuuuaucuacucuuccuuuuaaauuuuacuuguuuguucuucaguuauugcaaauggcaucuccuauuauucugcuggaaugucucccaggguaccuuacugcugagucuaccagauacuuuuuuuuaaaaauaacucuuagcuuuuuauaugaccaagcaaucacaauuuucaccagucucauuuugcuuugauuauccagaaacauaguuucuuguguuuuauuaaaguuacuuuggcagcuuucaaggagccugcauuaaagauguaaaaugauuguguuugccaccuuuugccccuuuauaugauaccaucauucagaggaccuauuuuguauauuuauuaauaguuaccauuuaggauauaagaagaaagccgggcagugguugugcacaccuuuaaucccagcacuugggaagcagaggcaggcagauuucugaguuccaggacagccagggcugcacagagaaacccugucuugggggaggaaaaaaauauauauauacacauacauacauacauccauauacauacauacacacacauaugaaagugaaaaucuaacucccaaaagcagagaaugaccuucaaauccuaaagauuuuaucguugugcuuguuuugauaugaauuuuacuaauuaucccugaauugaaguaaaguuagaugauguuuguugguauugucuuagaacauucuaagguuugugguagaucagaaccauguuuugucuguuuccuugcugaucaggcauuuuguuuucuuaccuuugauagauuuuugagcuguuuugcuaucuguucauaugugaguaauacugagaaacagggcuugguugcauuuuccuuuugacuuaaauucauuuaaguuuuuagauucugaguaugccaaaacuuccaccuaggcaguagccuguuccauaauuaauauuauacaauauaaaauuauguagaauagaagaugaauaacuuuucuguauagaugcauaaucuuacuguuuuaagcgugaucuuuaagaauaaaaagguucuauuauuuaguaauuuacauaauuuguauuuuuuauuuauaacaguguucuguguguguguguguuuguaaauuuaaauauagaaaaggucuagugaaaugacuaaagugacuacaguguaaaugagaguuuaggucuuuaacacccagauggaaagucaggugugacaacauauuuccuguaaucccagagcucauguaaagguacaaggagagaacagacuucuuaaugguguccucugaccuacagacuuacuauaaaaaugauaauuauuuuuaaaguaugaggagcauaggugugauacuguaaauugugugaauacuuuauagaauuauacuaccuucuggguuucagcuucuuccagauuaggccgagcacuugcugagcucuuuggacuccuuguuaagcuuuguguggguucuccuguccgccaaaggaggagccaucaugcugccaguaccaccacugcaccaacaccugcugcuagaucaacagcuucagcccucacuaagcuacucacaaaaggcuuaucauggcagcccccaccauauacacccacuccccgcuucaggugaguuccuguuuuagguacaggaaguagaaaguggcaauaaaaaugauguauguuucuuccuauucuacugaggaaaaguuuagaagucucuugcuuucucuuuauauauauuccauaugaaguauuuuuauuguacuuaguauagagcauggaaauuucuaaaggguuuauuguuaaacaguauuuaaguaaccuucuaauucuuaauuggguggcagauaucacaggagugccaaacuaaucuuucaccuaaauacuuugcuagccuuuccuuuagauuuuuuuuuucacuuaauuuccuguugcuuuuuuguguguaucuuaaagauguuugucuuuucuuuguuuuauuuuuuaggcugacguucuucaucuguucaguuggauucaccucuccaaugcucuuugaugagagaaaguauccuuaccaccuuaugcugcagaaauuucucugcucugguggucacaaugcucuuuuugaguaaggaucauuugcuucacaaagaauaguuucuugaacuuugaucuuuccuauguggcuuaccugcucacagcuuucuaagucauuuauccugugaugcuaggauauauaaagagagcuauuaguuguaucauuuuguguuuuaugagcaagccauguauuuccucugaagaaagucugcauuucagcuagagaggugguugagcagagaagaggacgcugcagcuuuuuccugggacccauguucuaucuccaauaccuauuuggcaucuuacuacugccuguaacucauucuaggguauaugauuaccucuuccuuggcaauaaacacacacaugucaacaaacacucauaaaaguuuuuuaaaaaaaguacgugcaugaguguauauaggaucucuuguuuuuauauuuggcuuucuauuccuacuacuacacauuuuuuucuuugaguacaguaaauuugguuuuugucuguuuuacuuuacuuggccaaaacauuuuaagaugaacuuaagcaguuugaguggauuuuuuaaagucuuuaaagcauauguaaauggcauguuaaaaguaauaagaacuucacaugagccuaacuuaauacauaaaguauugaccuuugucaagaaagguuucuucugcaguaagaaagacaauuucagaaaaccacauccacucaaaaugcugaguuauggagccuaguucuauuggauacauauacaaaauaacucuguaccuaaagcucagggaagauuguagaacaagggguaggaaaauuguaagagccggguaucggggacugugaccauaaaguuuccccaguguuucagccuauacaugaauugaacagagaaaacaacaguagauguuccaaaguguggggagaaggccacaaggacucaaaccuauacaaaggucuauacaggcuauuaaggaaugcucagagugugaguuuucccuagggaagagcguaaauggucagcccugaaaaauuugcauacaauuaacauuauacagauugaacauguuauauuuaucaauauaugaguauacauguauaugcauuuauagcaacaaagaaagaggccaugaauuugaaagagugaguaguaguauauggguguaguauuggagugagggggagggaaggagaaagugauacaauuauaaccuaaaaaacaaaauguguacgaagaggauaaaagauaagguacaaguguauuagugaucuuucaauguaaaauacuaguuaauacucuauuuacauguuuugucuuauuugaauuuagaacuuucaacugggcucuauccaugggaggaaaaguuccuguuucugagggauuggaacauucagaucuaccugaugguacaggagaauuccuagaugccuggcuuaugcuuguagaaaagaugguaaaucccaccacggugcuugaaucuccacauucguugccugcuaaauugccuggaggaguccagagcuuuccacaauuuagugcccuucgcuuccuuguaguaacucaaaaagugaguauucuacauuuuaaaaccaaagggggaaaaaaacucuucaugcuagguaguuaucacuacacucuguccauauuaaaaugugaauuuugaaaaacaaauggacuugguuuucagauuagcuuuuuuuuuuaacaaaaaacuugaaguacaugcuucugauugguucuucuuguugacuuaaauguucccacccuaucauacccaccaucuacaugccagucuaacucuuuguuguuguuguaacugacucauuguggaaggggcaugucugugagucuuauuuuccuucugaggauuugaauugauggggaaagucaucauacacuuuucaaauggcuuacaggcagccuuuacuuguaucaagaaccuguggaaccggaaaccccuuaaaguauaugggggaagaauggcugagucuaugcuggccauuuugugccacauucuccgaggggaaccugugauucgagaaagacugagcaaagagaaggaaggaucucgaggagaagaagaagcaggccaggaagaagguggcucacgcagagaaccucaagucaaccagcaacagcuacaacagguagagugcucagauucuacacuuucaccuuauauauagacucuaaugcucaaaaauuuuugauuuuuaaccucgucucacuguaggcaagacugacuucaaauucugagaguuauuugccacucaacuugcuuguaaauuuucuaagcuuucauaccacugcuuuccuugguucuuaguuucucaaagcauuuuuuuccuagugaggaaagguaaaagguauggucccaguacuuugugcagaaaacauaucuauauuuucauaaacauauuaauuacauuguuuucaggaaccugcaaaaauuuuuuugguaguacugucaacuacuuucugguuaaacgauaaggcaaacuauuauagcuaaauauauucuccaguaaaagacuuuugaaaaacuauucacuaaaccuguaugacguuaaaauaauaacauuuugaaaaauaaagaccaaaaaggggaaguuucaaagagcauuuuaacauuauuuuucuuacuuuucuuacucuuugagaauuuuacacauguauuuuaaucauauagccaccccuccaaccuccuucccuaguuuccccaacccauuucccuccuaccuucguguucuauuuuucuuuuuuuuuaaauaacccacugagucccguuaaugcugaccgcauguauguagguauauggccagccacuggaacauagaaagcuuaacaguugccagacccugaauuacucucucuuccccagcagccacaaacuaucaauagcuccucagcuagagguggggcuuugugaaccccucaccauccuuaguugaauguucauuggcuucaucauguuucagguaacuacaacucuugugaguucaugagugcaagggccaugcauguccagaaagcagcauuugagaagcauuccauuucauuucccaucuuaagaucuuucugacccccuucccaccauacuccccaagcaagccuuuggaggguggguuuaauauggacugagcacuugaaguugcuuauucucaauacuuggaguaaaagucucugcauuaacuauugccuacaacaaaaagaaacuucuuuuaaaggcugaaugcaacacuaaucuauagguauaaauauugaaaaguuagcuuaaguacaugacuuucucagccaugggcuuuugaccagguauauauauuggucccuccuguggaccaauccucaaauccaaugaggaagcaguuaguuaccuccauaauaaucaugccaccauugcauggggucuguauuguagcaugccuggauucacagccggguaagucuguuaauuacuuuucuccccaagugaccuacauagcaguuucuggcacugugaaagcuagccagcaucgaaacauaaucuagcuccauuauaauuugauuucucuguguccuguaaccaaaguguguugcaucuucagugauggggucugaacaaccuagcuaaucauuggcaaccaaaaacaaagguaauauccugugcuguuuaaagggacacugaggcuucuugaauuauaauacuuaguaacauauuccaugccuggcacuaagauuuuuauuuaauaugauccaugucuucugggagcaauguuuucuacucgugcuagguacuuccucaaauuuuuaaguaugaaguuucuuuuauucaaaucugucuuauauauauauauaugccuugcuaugucuuauuauaaaaauaaguucuuguuuaggaauuuugagacuuuauacuaauauauaauaguauauauaauuguauucuuauucaggaaauuagucuauuuuaguuggaugcuaugguauaguuuuuuuuuuaauauacaaacucuuauagguauaucuuauuucacaaucacuuugugaucauugaaauccuugaucaguuuuguagauagauuuucuguuguuacaaguuucuaauucagaauacaggugccaauuuauacuucaguguaucucaaguuauaguaaccaucuacccuggccuccauuuugagaugaugaaauugagacauauugguucuuuucaucaauaagcaacuuuaauguuuggauauuauauaacuaccaaaaugaaaagaacauugaugauaaauuacuguucugacuuauaaguacuguuaguucacauaaacaaguuguuacuuauuuuuuuuucuguuuuuguuuguuuguucguuuguuuguuuuauuucucuguuaauguggcucugggcucuugguuuuuuuguuuuguuuguuuuguuuuuaauauagcucauggacauggguuucacaagagaacaugccauggaggcacuguugaauaccaguacgauggaacaagcaacagaguaccuuuuaacccacccuccuccaaucauaggaggaguuguucgggugaguugacacagaaacaucuuaacauuuuacuguauuacuuuagcugcugagccuuuuuuacccacguccuuugccuaugcuuuauguacuaauucugaaagcuucagaagcugcuaggaucuucuauucccuggccaugcugcauuuuuuuuuuuuuuuagugcuuuguuugcagaauucuuucuuacuuaauuuucauuguaaauuuccccauugucccuguagugguuggaacccacauaagccuuauuuugguuuaauuagagagaguaauauuccagucucauucccuuuccuuaugagaguuuguuuuaauuuagguuuuauuauuaggggauuuguauauuuauuggauucucuguuguuacuuuguaggaucuuagcaugucagaagaggaccagaugaugagagcaauugcuaugucucugggacaggauauuccaauggaucaaagggcagagucaccugagguaacuaaagucuaacauucaaaaguauguuuucccauuaaucuguguauuucugugaauacuauuuuuuguauucuguaaucacuauacaaugguaggaaaaguugggggagugaauacuuauucaucucaacguuuugauauacucagcuaacuuuuaucaaccaaaaugaagcugucgaugauucaaaugaaguauuagucuuuguugucaauaaaacccaaaauggaacuaguaguaaccagucguccaaacuuagcuauaugauguuacuuaaauuuaccacacuggaaggaaacauuggauaggaucuaaaaaugaguuuucuugagaauaguacauacgauguuauaaauuucaacugacaaaguuuuugggugcucuuagucuguuuuuccuauauugcauuaaccucuuuagcuauuauguuacauucguugccauguccuuuugaaauauucaacuuuuuaacaauguagaugauauucaaagacugaaucagguacuuaauuuuuuauucuuuaccucuggcauauauuaucccacuuccuuuucuaccuccaggaaguugcuugccggaaggaggaagaagagcguaaagcucgagaaaaacaagaagaggaagaagcuaaaugucuagagaaguuucaagaugcugaccccuuggaacaagaugagcuccacacuuucacagauacaauguuaccaggcugcuuccaucuucuugaugaguugccugauacaguguaccguguuugugaucugaucaugacagcuaucaaacguaauggagcugacuaucgugauaugauucuaaagcaaguugucaaccagguaaguucucaaaauaccggauuugguaguaaaguuguuuuacuguuaucugucaacuucauuucugaaaaagucuugcauucuacaccauauguuuauauucuggauuugaauucuuuuguuugcaaucuaacucuacuugguugucuuccucaauuuauuuauuucacacgaaaaauagucuucagaagguaaaagcagaguuacguagaauaaaagucuuauguuugagguaaauuacauuucauauuaagaaaauacucauuuuuuuuucccguuguaugacuuucugauggauauucaacccaguuuuguuacuauuuuuaguguuuguuuccucucuguucuaauuauuggguugggauaagaaacaaaguauccccaaucuacacuucgagaaauaucccuguagcauuuauuuguauaucuuuauaaauuuguaucacuauauguauuuaagucuuuaagauuuuguuuuauaaaaucuuuucuuggguaucauuuaaaagaagaaaucuguggagacaaugaaaacauaaggauuguuuguuagcuuuaaaaaaaaaacaaauggaaccaaugugguagguguaucacaggaauaugugugagggguuacuuacaggagcagaaagagcugaaugacaguuauaucacuaaagcuuaccauggaugauaccucacaaaaauugggaaccuggaacacaguguacuacacuaggcucaaaauuaucuuuucuaagucaagcaucuguuuuuuucuagacagcuggccaaagcauaaauuuuuaauaaauagaaagauaaucauaaggaaaacuagauacacaaucuuuuagugaaaugugugguuacacaaauuaaauuaguuugagggagguuaaauuuuaauaaagaucagugauaucccuauacuaauuuuaaggaauugaaaauuuaauaauuaaaacuaugcuucuauucuaacauuuuaguaguuauuugaaguaaagauuggcagaaucuuuuggaaguuuacuauguauaccagaaaaguuuuuuuuacauucaugcugguuuagaauucaggcuuucuguaauaaaauuuaagaauagcugguuuagcaaaguguaaaaguaauuaccugccaagaacccacaugguacacacaaaaaggaaauuaaaaaaagguguuuagaaugauuguuaaugauuaugucuucuuuugaaacauucacuaucauaaauagguuguuauuucuacuuuucugcaaauauauugagguuggagggaauauguuuaauauuuucacagacuggguuacucuauauguacaugacuuggcugcuuauuuuguguuuguguguguguguguguugccuuuuuuaggugugggaagcugcugauguauugaucaaagcugcucuuccucuaacaacaagugacacaaaaacaguuucagaguggaucagucagauggcuacccugccacaggccuccaauuuggcuacuagaaucuugcuuuuaacacuacuuuuugagguaacagaucuuuugcccuguguaauccacuuauuaaagaauuacccagcacuuagcaauacauugaauuggagagaaguacaaaauaugguccuuguauuucauguguaccaauagacuaaaaauguacaucaugagguuagggguagaagguucuguguugggaaaguuuauauauaucacuuaugaauauaaugcgagaagaacuuuuuagaacaaguguuaagucaaaagaugauggucaguuucugucauuguaguugaguauguacauguguaaaagccauauacacaccagucagauaccauuauagaaggggauuucuucguauagcauugccugucuaggaauuagcccuguagaccaggcuggccuugaacucaaagaaauccaccugccucugccuuccaagcacugggcuuaaagauaugugucaccacugcccgaaaguaaagaacugcauguuuaugauccucuguagcauuguaauauuuuaaaaaaaaggugauucauaggaucucguuuaaaaaaauuacuaauuuuuccuuucuagucuuuuucauuuaaauaaucaugauuguuucccuauaucauauauauacauguuauuuuuucuaaauaaccaucuauuguuacuuauaauaguuuucuguuaaaaagcaaaacacuuuaauaguacugcuaagaaucauuauuuauuaucuuaguuuucuuggaauauuuuaaugcuuccuuaaaaaucaaaaacaauuuaaauguuaaggcugcauagucacuacugagugguaguggugaugggaggcagaggcaggcagaucucuugaguuugaggacagcccaguuagucuacagggcuauauagagaaacccuggcuuacuaaaaaauaaaaaaaacaaaccaaaagaguguguagccuaggugacuauuaugccugaugcuauguuuaaucauuacaaugacugaggaaguagauauaacuucucuuaacucaugaggaaaccaaaauguagaacacucugaaguuacuaaucugaguccacauagcucagcucauagguaauaaggaauagaauuugcauuuaauuaguuguauaaauguuaaccuuuguuugauugucuuuuuuaaucaggaguugaaguuaccuugugccugggugguugaaucaaguggcauucuuaauguccuaaucaaacucuuagaagugguucaacccugccuacaggcugccaaagagcaaaaggaaguccagaccccaaagugaguggcucuuuaucuauccugguuuaacuucuguuucucugagacuuggcccuugaguuuagggucugaaucacuuuucugaagcauaugugaaauccugagaucuuuauuuagacaacuauaaaauaccugacauuuuccgaauuuguguaguuuucugccuuacacuaaauaaauaauuucuucuuagguggaucaccccaguguugcuccuuauugauuuuuaugaaaagacagccaucucaucaaagagaagagcccaaaugacuaagguaugugaagcacuaugucuuuguuuuacauggccauuucauuucuuguggcaguaguagacaggaaaaaguaaagaucagaagugaaaacuguaaaaucaucccacaaaaauacaacucuugagggauuucauuaguuaaguuucucuuuuaaaugaacaguucaaguuguuguuguuguuguuguuguuguuguuguuguuagcaguagcagcagcaccauugucaguauuuuuggaaccauuugguaaaggccucaagaucuuacuaugggaauuaguaugcucuuuggcuacuugaaaaaaacugcagucucucuagaaauauuuuccugaaacaaagauuguaguauuccauaauaucucaguaaguucuuagcagcauuuguuccuuauaucucucaugaucauaauucuuuuaucaaagauaauuuaaaacaaaaggaagaauagguugucaagauaggaaauugucauggguuuuuggcuuggaaaaagaccaagaaaugaagaaaggccucuugaaaguauauuaaaugcccaguacauuuuuuuccugcauuaguuuuaagcagcugucuacugauagcugcugauuauuuugacaauaaaaguugcaggaaauaugaagauacuuuaugcauuugcauuuuauuuaguaccuacaguccaacagcaacaacuggcgcugguuugaugaccgcucugggcguugguguaguuacagugcuagcaacaacagcaccauugauucugccuggaaaucuggagaaacaaguguaagauucacugcuggccgacgaagauacacuguccaguucacuacaauggugcagguacaugcucaacuuauaauguaaacuuuauugaaaaggggauaguccucucaggcuaaggaguaggacuuuguuuuuuaaggacagcuuuguuuugucugaauucuuagguuaaugaagaaacaggaaaccgacgcccugugaugcugacucuccucagggugccacgacugaguaagaacucaaaaagcagcaauggacaggaacuagagaagacacuggaagaaagcaaggagaccgauaucaaacauaaagaaaauaaaggcaaugguaugugccuuacauuuugcauuuguuuuuccuuccaaguaagugguugcucuugcuggauauauagcucaagcuagucucauucaaaauccuucuaccucaaccacccaaguaguuggaauuagaggugugcacuuuuuguaccaugcauuuauuuuuaauccuuuuuuuuguuuuaacucugaaagaauggauuuguuuaauuguauuuaguaccuuuggaggccagaagauuauaucaaguccccuuuaagccggacuuagagauagucaugagcugccccacaguagagcugggaacugaacucagucuucuguacaugaucuuauucacagagccauaucuccagcccccucauuaugaguuauauuaacaugauuuaagguaguauggcuuauuaucugaaacucaaagagacagagagauggucuuuuccuaagaccuuuacaucuggucuuagaauuagguguguuuuucagcucaagugauggcugauuauuuuggaaggagagagaucgagugaaaugucaaauugaaaacacuuuuuuuuuccaauuuguagauauccccuuagcucuagagagcacaaacacugaaaaagaggcaagccuggaugaaacaaaaauuggggagauccuaauccagggccugacagaagauauggugacuguucuaauccgugccugugugagcaugcugggagucccuguggacccagacacuuugcaugccacccuucgucucuguuuaaggcucacccgagaccacaaauaugccaugauguuugcagaacugaagaguacacgaaugaucuugaauuugacccagagcucagguuucaauggguuuacccccuuagucacccuucucuuaaggcacaucauugaggauccuuguacucuucgucauacuauggaaaaggucaguauuuuugaagucuugugccugucuguauauuuguuuuuuuuuuuuuucuuuaauguuccugguauguugugcacugaugggccuuuaaccauuguaaaaauuagaaaauagguucuuauauuuuagaacuaaaugaauauaucaguggaagaaaugaaaaaaauuauaaaaauauuuacauuaaguauaauuaagagauaaauaucuuaaucagcaaaucuuuguaccuccuaaagacuuuugcugaauucuuauucuucuuacuaaaucauuuucaguaaucauauaaauauuaguagguuucacccucuuucuuggaacauuagaauuuuuuauucuuccuucaagaugguuuugcaucacguguccaaaaucacgagacuuagagcuguuuaaggcagcauauuugaggucagugggggaagaaauaguuacauauagacagaauuugggcuuuaaaaaacccaaauguuuaaaaugcuaaggugauguauauacagaacaugauugaaugaagagaaucuuugaaagacuuaaguauuaaauugaagcagacuacaacaggaacaaaagaagauaaguagcaaaaggcauuauugguaaggcuacaucauuguaggacaguuucauggugcagaguaagagaaccuucuagaaauuuuuuuuuaaacuuacuuucuugguggcacaugccuuuaaucccagcacucaggaggcagaggcaggcagauuucugaguucaaggccagccuggucuacaaagugauuuccaggacagccagagcuauacagagaaacccugucucaaaaaaucaaaaacaaacaaaaaaaaccugugucuccacaugauauagucuagguuuaagaccaguuuagcuguuuaagcuguugcaguaguuuggcuaaauuacacugcaaggaagcaacugcaccaaaucugaaaauuuguugguauguauguacaaaaaaguacagugcccucaaaguccaguagaucuccuggagcuggaguuauagccuguuauaaccuguucaucuuggguucuggcaacugaauuuagugucucugcaacuguacacacucuuuccauuacacaucuacauaaucuauagcuaaagauuugccucaugauaaauauugguuauacaaaaauacauagaauauaauaucaagaaaauacaagucuaauaucaaggaguagacaacuguauaaaguauaaaucauggcuuuacauauaaagcaaaacuucuguauuuuaaauuaagaaauauaacuggcuagauaagccagaucuucuaacaauuacaauaugcuauacuagauaacaugaguaguuuguuaaaauacaauauccccaaaagauuauauauuucuaaaaguuuuuaaucgcaggauacuauacauaaauuugauagcucuuuuagcugucaucucaaagugaugauugacuaaauaaagcaugaagaaauuguucuauuauguuaaauauaauugaacuauuauagcuuaaaaucacagcauuugcggagucuuagagccuacacuuaaauguggaagcuauauagcauguguaaucagaugcaccucaauaacauucauguaagaauuuaguuuugaaaaccuuuaugacuuguauaugagacuuauuuuaauuguaaagagucuugaagaacaagcguaucuuucauuacuuaaauugacaaugcuuuuuacuagguuguucgcucggcagccacaaguggagcugguaguacuacaucugguguuguaucuggcagccucgguucucgggagaucaacuauauccuuagaguccuaggaccagcugccugccgcaauccagacauauucacagaaguagccaauugcuguauccgcauugcccuuccagccccucgaggcucaggaacuggucaguuucauuugcuacuauucuuucagaaaauucucuuuaggcagauauugagacauugguugagcauuugacuuaguaaauucuguauguaauucucaguaauuucucuuggccucuuaauacaacucccaaggauucacucuagucuuuaccuacaaaguguucauuuugaugugacaauagaaguuaaauuaacugcaguugguuucuguauagugcgaucauugaaaaacaauuguuuguuugggugacagaauccaaugaaaaguuuacagugcuaccuguauucuuaccaaaaaguuaaugccuguauuucauugaggaaguaauuacauuuauaucaaauuauggaaauauuuuacugaacagcuagccuaaacccaugguaaacacgaauugaaaggaaaaauugaaguaucucagcagaugagaacggucacuucuacuuggauuggauucuggauccauuucuaggagacuuguaggauauaugaaguuucucagaaguucauacagacauuuaaaaaauugugagauuguuuauugaaauauaaaaacauuucaccgggcagugguggcgcaugccuuuaaucccagcacuuggggaggcagagucaggugaauuucugaguucaaggccagccuggccuacagaguuaguuucaggacagccagagcuacacagagaaacccugucuugaaaaacuuaaaaaaacaaaacaaaauuuguuuauaguuuauaaaagguagauuucuuuacuauaagacuugaacuuaauuuuuaaagaauuauuucuccugcuuuuuauguacuacacaauccuuguucuggguacuuucuuguugauagugaauaccaguguucuauugucugacuuuacuguuuaauuuuggccuagcuucagaugaugaauuugagaaucuuagaauuaaagguccuaaugcuguacagcugguaaagacaacaccuuugaagcccucaucucugccugucauuccugauacuauuaaggaaguuaucuaugauaugcugaaugcuuuggcugcauaccaugcuccagaggaagguauguaucugcaauugguguucugaaggcuauauuaucucgcaugaaucauuucagcuagcacauggcuuaguaagcauuauacccacaguccuggaaucaaaaggugaauaugauagggaugacauaaauggcccagaagguaagaacaccugccacucuuguagaaaaccaggauucaauuucccagcauucacaucagccaaccucaaccacuugugacucuagauucagaggauccaauacccugggcacugcagucaccugcacacagaugugcaugcacaaacacacauacauaaaauuaaaucauuaaaaaacaauuaugacaaauaauacacaccugaagagacuuacuuacuauaaaauacaagaggugugagaauaauggugaguccuuaagauaauguguguaaaucuguucugauaaugguucuugaaugauauugaugaagaguuuacagagugucuguuguuugagaaaauaauauaccauaaacagaaagcugugaacaaaaaguucuugguauuuguucacacagcauugugugaucaaauaccaaaaauuuuuuuaaagauauauuuuuauuauauauguaaguacacuguggcugucuucaaacacuccagaagagggugucagaucucauuauggaugggugugagccaccaugugguugcugggaauugaacucaggaccucuggaagagcagucagugcucuuaaccacugaaccaucucuccggcuucccaaauuuuuuuuuauucuuuuauacccaaaagcaaaaaguauauuauuagugugacauggcuuccuuuucagaccuccauccuaauccuccuuuacaugugaaugauuggaaaauuauguuugauuugcuucaaacccaagguucuaauccagccaugcuuuuaaguuuuauucaggcuauaaauagugaaaugagcagugaucauaauaacuguagaacaaugugagacuuucauuugguuuuauucaucuuuacaauauucugauccuuuccuccuauccccauaucauuacuccaucuacaaugauuuagcucuaauugauguaccuauugacuggccucauauuauacaagccuuuugcacuaaauauguucguugggggcuugauagugacaguuuaaaaauguaagacuaaugaacugcuuuggucauaagacuaauuaauguuggaauaacaaccaugcucugucaguaaugauaggcauacauuuugagaaaugcauuaacugauguguaaacauaaaggucauuugcucaaaacuaacuuggugguauaccgugcuauaaacauagguuauauuguauauaccaauaguuuuguugguucuacaacauaauuauugcacuaguacucuuaaaugcagcccuaugaacauugugcuaauauugcacaauuaaaggaccauauuuuaauuuagauguuuguuuauauuuuucuagcagacaaaucugauccuaaaccugggggaacgacccaagagguuggccagcuccugcaagacaugggugacgauguauaccagcaguaccggucacuuacucgucagagcagugacuuugauacacagucagguuuuuccuuaaauguaagucaauuucagcuguccuauauuuuccuucucuuuccacugcuccuacuuucucaguaucuuggguuauccaaaggaagcuuuaaaaguauaaguuuugucaguaugaugguucgcaccuuuaauugaucccagcauucaggagacagacguaagcagguuuuuaugaauucaaaaccaccuuggauuacauacugagacccuguuuuuagaaaaaguauuaauuuuaauauauguguaaauuauuuauugcagaaaaguaagguauauuaggcauuuuuacuuuugauuuuguuuuuuguuuuuguuuuuucuuuugaacuugacuagucugaaaacugugauagcuuccuauagauuauagggagaaugugguugaaagaucaacuaagaagaaucuguagcauucucagacauuacuuguaaaaggagucauaacacuuguauucaucacagcucacauguauucuuucagagucagguuuuugcugcagauggugccccugcugaaacuuccacaacuggaaccucccaaggagaggguaauaauuugccuuucuuuauuauuugcugcaaagaacacuuaaagaaacugguugucucugcacuagaguagaauaauaggugucagugucauauuuacauuuguuuacucaucuaagugauuucuaagggcugugucugaucuucugcagguauaggcugcugaaguuaauagaacuguaauuugcauuaacuugcuaauguugcuauaaugauguccuuugguuguauuauuuguacuaguccauauguccuuuuguucgauucccaugagcuggcuugcauaguguuugugccauugacaugauuauagcaauacacuuuuuguaguugauuccuuuaauagagcuuuaaaaauaaaauuuaggagacacuucgguuaauauacuaguuccaagagauuaaaaggugagaaaguaagcuaucuuaccuuccacaggaccugaguucaguucuuaaaagccacaugucacuuacaaucaaccagucauugaaauaauggcuuccucagaagcuuggauuguaaugauuaagagcucuaacccauauuuguucuugcagaguacccgaauucuuuucccaacacuauuucugguggcucauagcuuuuuggggcaucuuugcucauacacauauccacauacaauuaaaaauaacaucaauaggauaauugcuaaguuauuuuacuggccuuacuaacagcauauuagucaaagaaaacugucuuugcccuuaguauguggcaugcuauauuggaugccuaccuacagcuuaagaauuuugucaaaugagggagacggcaacaauuguaacuaauggaaugaacacauacuuccaugagauauagagagaccaauauuuccauauguaucuagauggcacuugaguugaauugcauaguguguaguaggcaaaagaaaggagauggauauuuaaagaauuacuacuaauucauuauuucuaggacaugaaauugcauaaacaucaggaaauagugggugccuggauguuugguccaagccuuccuacuaugucuuaugcauauucaucaucuuugucauuuaacuacagugguaauuagugauuuguacaaguggccuaaaaugaagaaauacugucuucauucuaccuguggcuugguuuuuaauguuauuccaguguaaaauugaguguuuaccuguuuucucaggagcuucaacuccagaggagacucgagaagggaagaaagauaaagaaggggaccguacaucugaggaaggcaagcagaaaagcaagggcagcaaaccuuuaaugccuaccucuacuauccuucgucuucuggcagaguuggugagguccuauguugguauugcuacccugauugcaaacuacagcuauaccgugggccagucugagcugaucaaagagguaauauuuacaguuuuuucuuucuuugauauuuugguuauauccuagacuguguuggaaacuauaauacucauugaaaggaaagcuagucuuuucaccaugaugugaagcaaucagaguaacugcaaggaaacaguugaugaaaucuuuuguaucuuguuuggcuugacaaauuuuuagauucuucuuuauuugagucauuuuucuguuugucacuaacacuguaguauugcuauguaaauuauacagaugcauaucucuuuggugauguaggcuuaagaauauuauugcugagcucuagaacaugaauuuauauagcuuuaacagaugcuaccugaaguuuaccaggguguauauucuaguaguuuaugagaguucugauugucucaccuuaugccaucacauauuucauuuuauuuguuccaguugguuuguuaguaguuuugugguuaggauuugcauuuucuuauuggccauauuuuaauguuuuuugguuauugaaaaaggguugguugguuaguggugagacucuuuuguuggccuuaaauuccugggcccaaucuuaccauccugagccacucucaagaauagcuggaacuaugcuugaaugccaguuaacacuuggcuucaaguguuucauuagauuccuuauacauuguauaugugagcccuuuuugucauacauacauucaacguguauauacuugguuucauaucaaaguuuauauucauauguuuuauuccuaauuuauggaacaaaacauuuaacuauaaauguauucgguauccugcuuauaacuuacccaaacauauuauagguguggcaaggugguuuauaaauaacauugauaugacaacuccacuuuagaguuauuaguagaaguaucuccuuagaguuaagagauaagauucagagauacaagugagggcacacuguauagggccagaaugaaaauugaaacccuugucuuugauucuaagcuaagugcuuguugugugguuacauugaaauucuuuucauauuguacuauaugacauuacuaagauucaagaaguuuuagcuuuguauuucauugagguugaguuuguccaguucuccaaucucuagaguccugaaguauacccuacuuauugauauaaauuugacauaaaaucauuauuaaaaagugugaguugagugacauuuaaaguguuacacagcuauuacuucuuacucccaaaaucuaccugaaaaauagaaccuaauucuuuuccuaaaaaucagagcagaaauuauagaguaaaagaaggguccgucuuccuuguuagacccuuuugcaauuuuuaggugauucuauauuucauuccgcucccaguuuucaguacagggucucaggcacauugcaaguguuaaaaggaauuauagaauacaaaaauggauguuugaauccucuacccuugacuaaauucuuagugcaagcuacuuuucuuuaggucucagauuauucuccucucaaauggagaaaaugcuugauuuacuucagucuauuuuauuggcuuguuauaaucaacuccauuaaagucacucaaauacaugggcuggaaagauagcucagugguuaagagcacuagcugcucuuuuagagguucugagaggucaauucucagcaaccacaugguggcucacaaccaucuguauugagaucccaaugccuccucuggugugucugaagacagcaacagugcgcucacauaaauaaaauaaauauuuuuuuguuguuguuacgaauacaaugguguuagcugucucccggaaucccaguacucuagaaagucuaccaagcuagccuaggcuaggcuauaugauucccagccucagauuuuuuauuauuaagauauaucaaguauuguuaccugugguggugugguggcacaucuuuaauccuagcacuagggagacuuaguggccacagucgucuauauaacaaguuccaagacgagcuaaacugugugagaggccacaucucaaagauaaaaaguagaaagcaacaugauaauuccaugacugucugugccaugugguaagaaauagauggaaucuggaagcuuuauacagccucuuaaagauuucuaauugguucacuacuuaccuagcuuguaccuuggaugacuugaaagaaaaaguuucuacuuugcuauuauagguaugguguggauuaauugcacuuuugaguaaaugucauaauuaaugacuuuucaggacugcagugugcuagcuuuuguccuggaccaccuccucccacacacccagaaugcagaagacaaggauacaccugcccuggcacgucuauuccuugcaagucuggcugcugcggggaguggcacagaugcucaaguggcccuagugaaugaagugaaagcagcccugggacgggcgcuugcuauggcugagaguacagagaagcacgccagguaaaagcccaugucuggccuaguacugauaaacaagaacaucuuuuacuccauggucuaaggaguuccuugaacuugaacaagaguuguguucacaccaacaauguacauagaaugucugguacccauggucaauugaaguagauauugcaacuuagaaaaaucgaagggauauuuuucgcuauauucagacacaaaauugagauuuuaaauuuucuguaguaaacaaagucuacuaacuagaaagguaauucucuuuguagauauuauuuccagaagaaaaugcaaaaggcauaagagaauuaucuaaggcauuauauauaguaaagacaucuuuuacaaaugggcuguauucacuugacagagguaucaaacuucucucccagacuucaggcagugauguguaucaucaguacuaucauggaauccugccccuccaccuccagcuucuacaguagugcuacagccaagacucagcauaauggcaugaacaacaucauucgacuguuccuaaagaagggacuagucaaugaccuggccagaguuccucacagccuagaccuguccagguaaaguaauauccugugguugguaaggaaucagcugcucucguaagaaagcaucagauguaggugaaaauuaugaugucuguacuaaaaguggauagauuuuaguugguuuuaauguuauucuugauacuuucugaaaugaugacugcuuuucuacaaaagucuugccuucuagauuugguggaguugcugccuugcaguguaauuuagccaaacuacugcaacaacuuauaccugucuuaaacccagacuauaucauguggaaacacaggguugguuuuuuguuuuuuggagacaggguuucucuguauagcccaggcuggccucaaacucagaaaucugccugccucugccuccugagugcuuggauuaaaggcaugugccaccacacccggccacggggcuuguuuguuuuuuuuuuuuuuuccaccuaccauuaguaauccuuguuaagacugacuacuaagcuggaaccuacaaucucagcaguuguuuugucucagccuucccaccaaguacuaaaauuucauguauacacauaucaugcacagcuaacauuaaauuuuuuuaauugucuaaauucuucaaacucagguuaagcucaauaauaacacuuauuaacagcacucccuaacacuaccauuuuuuuaagcuuccaaacucaagucauuuaaugguauaagucuauaguuacaucuugguaacacuuuuguuccauauguguuuugauuuucuggagcucaguucuuagaaauuaauuuuuuaaaacauacuauuuaacuccaaauacuaagcaauuauuccuaaagaugaaacauuuauauccuaaaagcuugcuauaugaugcuuaauaaucauauucucucugaucuauauucauauguucccaguuauuuuaauugucccuucaacagccuugggaguguguuuugauccaggauccaaaugaagaucauguaugacauuuuguugucaaaaagccuaggcagcacuauaucuucauuuguagauuugauccccaauguugcauaaaucaagguugguggcaaauagcuauaacucuagcacacagaaggcagaagaaaagggaccaagaauucaaggcccaccuggagcugcauaaaacagucucaaacaaaaaaaacuauugcuuuucuuugcacuuuugacaaugcugaagaauucaggguaaauguguuacagaugauugccugagucuauaugugauuuccccauuauguaaauaauacaaguuaaacauuuuaagaaaaaaaaaacaauaauaauaugauaugugggucaacuagccuucaaugauuaaacaauccuuuuauauccuuaucaccauaaguucauucaucacucucucaucaguauucuuguuacuuaaacaguucauauuccuuuuauuuuuuugaaaacuuucugauauaaugauaucccaaccucauuugugauguccaugagcuuugguucacuuuaguguuaguugguaucagagauuguggccagaucuacaggauccacaugaccucucuaguuucaguggugcccaacuuagccucauguuacaucucuaccugcaaauacuaugauauuuucacugaacucuauaaauccuacauuuuguagacuuaaaaguggucauuguguuuuuaaagacuaaaauaggugugugguagcauauaucuauaaucccaguacuuggaauuuguaaggagaaucagaaguucacugucuucauagagacuuugacuagccugagcuguaacuacaugaggcugucccaaaaaaaacgauuaaagacaaaauaaaggaguuuggagauguuuuuguuugguuaauuaguuggaaugggucuggguuuuuuuuuccuugauaaucuaagaaguauugauauuuguagucauccagaauuuauucuggcuucuacucaaggauuucucaugugcuugucauagcuucaugaaauaugacaucgacuuaacuuuugcuuuacuggguuuuauucuuaaacuuaauggaaaguugaaaauucuagacuuugcgcccuuuucucucuuagcuuccauuauaagaaccuguaugcuuaugagauuggcaccuauuauuucuauccuuaguucuuguaucuuucuuuaucucagucccaauauggccaacacagucaaugcugcucuaaaacccuuggaaacacuuucccggauuguaaaucaacccaguagccuuuuuggcagcaagagugcuucuagcaagaacaagucugagcaggaugcucaaggagcuucucaggacuccagcagccaucagcaagauccagguagggaaucagaaugaauggacugcaaaaacuggaugggugggaguuguugcuuguggaauuaaacuguucuagcuuauuguuguuuacccgggaacuugcuggucuugcagauaucugucauaaugguguggaaaucugucccacaaggaauuucuucacauuacagcuuuguuuggcuauccucacaugaagccaagucuuuuucuucaucacacauucauuuauauuuauacucugagaauuuguaaauuugccuaaagacaaaucacuguguucaugcuugccucaugaugcccagcauauaaacaccuuuugauuauuuauugugcugguugguugauuguuucaggcgagccuggggaggcagaagugcaggaggaggaucaugaugucacucagacagagguggcagauggggauaucauggauggggaggcugaaaccgacucaguggugauugccgggcagccugaggugcucaguucacaagagaugcagguagggaggcagaucauuccaacauucuucuguugcggugcugaaccaaacucccaaguguugugggugggugaguacuuuagaucuugccucaauguggucuucagaggagcacagaaugcuuaacauguguuuaaauuguuuuaguuaaaauggggcuggggacagagcccuuuggguaugguuucuuugauuuacuuggcucugaucauuauugaaaguuacuuagcgcuaucuuaugccaugccaccagaucucacuggaguauuuaaauaccagucuucuaaggauuuuaaagaaagcaugguaauuugguagcaguggguaagaaauuguuccuguauauagcagaggauggccaaguaggccauuuaugggaggagaggcccuuggucucgcaaagauuauaugccccaauacaggggaaugccagggccaggaagugggaguagguggguuggggagcagggcggggggaggguggguauaggggacuuucagagaggaaacuaggaaaggggauagcauuugaaauguaaauggaaaaaaaucuaauaaauugugccugugaaccuuagcugcuggcucuaaugugaucugcauguauuccuagacaguguuaaaacacuaaccugguauuuguugaccaggauacagacagugugaguguggauuuauuggaagcaugugguaggcucuguguuaauagcaccaauuaugugguuucuguguaacauccuaucacauauuauagaaacauaugcucccuugcuggcuuuauaaaaggguuuccgugcuagcacaaugauagacuuguugugugcauccauauguauguucucuuucucuccagguugaaaaugaacuggaggaccugauagaugaguugcuugagagggauggcggaucugggaacaguacaauuauaggugagagccccagaacugaguaaagccucuuccuuugucucagucucucuugggaggaccauuuuucucaucaucugcuugcucagcucugccuaagggcucauagccagccuagauugcugcuugucuugauguugaugaucuuaacagaaaagaaauuaacaaguuguuuauaggccuguaacaggucugaaguguuguguaugucggguggcggugaggguaacaaucaguauagaugauaacaucaggcacaccaaaaguguuuauucauggaggccuagaagaggcuguaggaugagaaaaugcuuuucuuucaguucuucaaugaaauccaggggcuuuuugccuuugugucuuaaaauguaaaaaagaguggucauuccuuaaggauggccccuuuuaagucucaaauggaaaaugacaaagguaaacaaaccagcugccaccucacugugaagguguuuauauuuuuauuuuacuggucaagaaaaccaaaggauuaauggaacuaggcauguauucuuaaaagauacaaagcuuuuucacauccaucguacucugugauugcacaauuagugggauuggcaagacagaugugaucguuccauuuuacagaugaggaaacugagacucagacagguaaagugacuggccaagcucaucuagauaguugacagcagagaaucgagguauucucccucaucggaaaaagaaaaaggagaaaaaucaaacguggauaucuauuagguguacauagcuacuuagacgcacccagucuggaaagggaaguccucuguuguucagugaaggcucugcucuguaaccuucagugagcagaaguggagaggaugaaucacaagaggacgugcugauggaugaagcuccuuccaaccucagccaagcuuccaccuugcaggccaaccgagaaggugagagugccgaggccaaaaaggccucccuucuugcccugcacgucugacagacacuacacuaggguuuuccuggaggcagcugcccacaugugcagaauaaggaagcaucugucugcaugcgcugacauacaccauccacuuuauccucagccaguuuuucaaauaacguuuuacuacugcuugcccaaaguuugucacuucuuacuugguucgcuuucuucucacccaccugcugucaucgcuccagauucccucuuaucaacaggaugcagucacuagcaaaauaggacuggaaaggcaaggggacaccaacagacuuggucaagcccuacaucguggcuccucaagcaccucccuggagccagcuuccacauuucagcaacccugcucagcgugucgaugcauuaauuggcacucucaggaaauuugggcuggcucacuaagucuguacaccacccuagaucugauucuuccucucuuagagucagauaccccaucgccuucccacucagucugccggccugcacaguggccuguuuucuagcuacucaguauaguccuccaaugugcucccuuuguuuuagauuccaugaauauccuggacccugaggaugaggaggaacauacucaggaagaggacagcaguggcaguaacgaggaugaggaugauagucaggaugaagaggaggaggaggaggaagaugaggaagaugaucaggugaggggggacuguguuuggguugguucagaugaccucuuccaugggagcacagaacuacagaaaaacggacaaucuggguuacuagcuagccucgucgccucccucccucaugugcucauguggccaugacaccaagcuucagaaaacacuuaccuccagcaauucuccaucucguauuuucccuuaaggaggaugaugaaggugaagaaggagaugaagaugaugacgacgaugguucugagauggaauuggaugaggauuacccugauaugaacgcuucucccuugguccgauuugagcgcuuugaccgggaggaugaucucaucauugaguuugacaacauguucuccagugcuaguaagauacaggggcucagcuggguuuuuaccuauugauucuuauacccuucucuaggguaaaccaagcagaacuaaagcagccaucaaucugauagaggacaccacuucuuuuacugucuugacaucccaggucaagggaugucugaauccaucucucuggauagcauacauauccuugcaagaaggaaucggaggaggcugcucuuacuaucuccaccucaguaaacagggagcucuuagagccuggacaacuugauguuuugcuugauugagaaaaugagaccaagucugacuacaugaggcaccugaaucacacugcagugacagggcaaucaauaaucuuuuauuuguaacgcuggaucucaaagguuuggauggacaucgcugagccuggcauuagggaguggauuuuauauauucacuguucaucauggauggaacugauccggagagaaaaugaaucucuccacuccuuuucuaucaacaucaacguuccuuuguagcgacgaguucuuagccucaagcugucuucaugggacaggucuuaccucaaaucacaagcauaauauagcugaaaacacuuuuaacaguuuuggucuguugucuuggccauaaucuuuuaccucugagccucaguuugucaccuguaaaugaaaagcaugaagagaaaaacaaaaugagcaguagauaauuuucaagauaucuucuaugauacucuuagaauuuuugcgguuuucgucaaccuuccuuuuauuugagccuuuguccauucaacaaaaugaaugaauaucugagaugugccuaccaguccuugguacuggggauaaggugguaaagaaaaacaggaguuuuuacccucuauaggaacuuauggucuguaaggaauuauaaguaagaagacaccacauuuaguaugcuaaugcacagaguaaagguauaucuaaccugaccuguuagacuuuagaaguaacaucuuggacugagaacaaaagaacaggugaggaagggaagcagagucuucuaggccaaggggccagcaucugaagugccuagagacaucacuguugucuugaaagugggcugggaaaagguaggauuacauugaggugguggcauaaccuaugguuguaucagauccugaauuaggugugagaaugagggagaaaggaaaaagaucacauuuccaugugagcaaagcccaggagacaugguucuacacaugaacagccauggaagaaauuuauuuuuggcacugaccccuuuugcauauuuuccuugcagcagacauucccccauccccaggaaauaucccuaccacccacccauugaugguacgucaugcagaucacaguucccugacacugggcagugguucuuccacaacucgucuuacccagggcaucggucgcagucaaaggacccucagacagcucacugccaauacaggccauaccauucauguucacuacccugggaaucgccagccuaacccuccucuuauacuccagaggugaguuuguguugaagcagaaucaaugagaaguuggauucaaugaagcucuuaagaauuauaacugaacuucaacauugucuugaccauaaggauaaacagucccucauaaauaagguugugugacccauaguaagugaaacaauuuuaaaaugaaagagugaauauaagugccuuauaaagguguacaacaaaggcauuaauaccuaacaugguaccuagcauaucaaagcuuccuaguguucaaggaacuaacuaaagaauaauaugcaguucaaucucgaaguuaucaaacugacaugcuaauaagaaugguaguaaagguuuagguucaguaugauuaaaaucuacccauaauccuauaaguuuacuagauguacaugcucgaucucaugguuaacagacuucuguggacuugaaagugaaagugguaccuuaccauuacccuacagguugcuuggucccucugcagcugcugacauucuucagcugagcagcagccuuccauuacaaagccgaggccgggcccgccuccuagugggcaaugaugacguccauaucaucgccaggucugaugacgagcugcuggaugacuuuuuucaugaccagaguacagccacuagccaagcaggcaaguuuauucaguaagagggaggauagaguucuuugauucuucuucaguccuaagaagaagaguagucucuuucuuggagaaacuacauuuuauaggagccaaaaccacuuggugacuuagccaaggacaacaacucuguugccucuggguaccuguuauguagcaaaacuuguggcagaccauggguucuuuuaggaaaauaaugcaguuuuuaggucaaucaacacuucauaaagccaagaauuucacuuuauuuuguucucuuauaggaacccuguccagcaucccaacagcucuaacccgauggacagaggaaugcaaaguucuugaugcugagaguaugcaugacuguguuucaggucugugacaacuugaauaucaggguaguaaugagccuuccggcuagaaugaguaugcagagaguuguuuuugauucucuggcuauuaacucugccucucuacuucucaaccuuuccaaaguagccucugauuuuuaccuuuuucuuguagugguuaaagugcccauugucaaucaccuggaauucuugagagaugaggagcuagaagagagaagggagaaacgcaggaaacaauuggcugaggaagaaacaaaaauaauagacaaaggcaaagaagacaaggagaacagagaucagagugcacaggugaggugacuccaaaagacuuaagagaugcagcauuuuguauuuauuaugauuuugcccugcucauaguacuaaacuacuagaaaauucuagaacauuacguugaacaugaaagauuguucauuuccagauugacuauuuacucaucugguuuuuaggcaaaaagaaaaaaaagucaaacccagagguaaauuauuucuccacuaccuuacuggggaaaugugaaccuuauacaauaguccuacuuuguaaacucuuucugaggccuaaagguagacucucacucagcucacauucuugguucucacuuccauuucacaguggacuuccagaaaauuuucccaccugaacucuauuaccaaacaacuaauguauauacauaaaagcuaauagaaacacaaaaaagaaugaaggcuguaguaugucccacucauucaucuauuaggauauuggguaauuuuuuucuuuauuugcauaccaaucaaagcuuccccucccuccucuccucgcagucccucccucuucucuuaucccuuucuccucagaaaacaggaggcugccaauggauaucaacccaccuugcuauaucaaauugcuguaggacuagaugcaucuucuguugaggcuagauaaggcagccaaaggcagacaacagaguaaggaacagccccugcuucucccacaagaccaagcuguauaucuguuagauauguggagggaccuaguuucagccccucugggcccagguuauuugauucuguagguuuucuugugguaucuuugaccuaucuggcuccuuauuggguaaauuaaaaauaaagacaugaggggcuagagauaaccacaguuucauucccaccaauguaacagcuuaaaacuaacuucaauccaggugugguggugcaugccuuuaaucccagcacuugggaggcagaggcaggccuggucuccagagugaguuacaggacaaccagggcuauacagagaaacccugucucguuaaaaaaaccuaacuccaguucccuggaguuucuuuguuuucagccuaaacaaaacaaaacaaaacaaaaaaucgccacaaauaccagguucaguucagagagcucuuaccccaaaauaauaaggcaaaaaaaaaaaaaaaaaaacuaaaauguacugggauugaaucagugguaaugugcuugcucuauauaagccaaacccacuuacuuauauguaggcacauacugcuacacaugcaaagaaaugggggggugcauuaauauugaggguauagcuuagugauagggcacucuuccagucuguacaagguccagguuugauuccuaacaugcuaaaauuagugcagacacauugagguauuuguuuauaauaacaggcuugcucuaacaaauacuuuuauuuauauaaaacuuugccuuaaaaccagcaacauuguauaugacuaaaaacuaaaauggacauuggauuauagcucaguggcaugugcaugguuugauccaaagcaauaccccaaaacaaagcuagaguggaaaaaauaauaaacccaaagaagggaaauagguggagcuaagaguuuccugucucacaauugugcuuauuucuaauguguucuuuuuuuauucuuucauuguucauuuccugcucacucccauacuuuugucuuuauguaaccuagugcauucuuucuaguguguugcuagagauaaaaaacuaggaccucacacaugguaaacuuuugaacucuccagcuggccuguauuccccaaguccucuccaaagcuguugaacauuaguauaguguauguaaaggaauuggauaauauuuuguauucugaaaugcccacauggccaggccacugaauuccuugauagucuagguaagaaauaaugacucucauauuugaccuuucuugugugcuugucucccauuacucucucuucucuuugcaguguacuguaacuaagacaaaugacuccacugaacagaaugucucagguaacccucccucccuuccacucuugcuaauuaaucaguggauucuuucuaaauagcuggccacaugggcugaagacagacacuggugcucugugggaugagguaguagauuguauaguuuuagggucauaccccaucuuggagauaacuauacagucuacugucuuucccacggugguacacuucccauccaacuagcccuguucaaguuccuguuacgguuaugcuguguuucggucugauauguacacaagcuauuuaucuuguucuuuucccccacacacucgguauauacaucuuugagguacauacuuuuguauggcacuucauuagaacaccugguggcagugguucucaguugccaguccucaaugaaaauuaacacagggaagucuaauauguguuuuagagcuagauuuguuccauucaaaagucuuuuauauuuagaaguuauauucuccuagaucuuggauaacaaacuauuguuacuaaauuauuggggguuuuuucuuacaaaaccaaaaguaaugccuaguuuaguccuuuucauucuuaaucuaaaaucuuaguggucuauggaauuuaaaaguuuuaagaacauugucuuuuaaaagugggguuuuggggaucauagcuuugugggauauauauauacacacacauacauacauacauacauuacauacauauacuucucauuccuucuaaucaucuuaacaauggucaguaaccauuuuugucauuggucaauguggucucaugcuugccucauaucuauucagaacuuucuucugcccuugaauugggagacuuguuuuaccaaagccuacauaauauuuuaaaagcacugaagagaauagcugucccagcgcucuuaauaucuagcaaaaguauaugaaagaaagaaucuaugcuacaagguaaaguggccuuuugccuacugcccuuacuagacacaucugcacaugcuggggugagguaguaaguuguauuguugugggguagggauuuuaggccccaguaagaagauaacuauacaacuuacuacuuuccuugguguguggcauauucacauuaagucuuggcaguauugacuccauuagagaaaaguuguaaauguuuauucaguaaacaggaauauaauaaaggaagguggaagggaacagaugauagagugaggcaaauaauguuaaaugacuugcccauauauuagaacauuauuauguuuauuuuaccauugaguauaaacuggacauucuucuacucuuugauucuaugauaacuucauuuagaauaugaauaugaagaauaugaauggaaacuguaggaauuuuuuuaauaagaagcaaggcauguugguucauacuuuugcaguucuaaaacuuuauaggcagaggcaagaaaagcaaacauucgaggacagccuuggcuuuagcgugagcucaguguuagccuaggcugcaugagacccugucuguaaacaacagcaggaauguagaauuaugaauaaauucugaccauuucuuguuccaaguagaucaggaaauguaaggaucuauaagcuuuuaggagguuuuuuuuuuuuucugaguagccuugaccuaucuaugguaugcaacuguucccuucuaccuggaacauagaaaggauuguacucucuagaucauuagagucauaucucugguguugagauacagauaguauuguuauuuagcccucauuauuaugauaugccauccaagaacuguuucugggaacagauugauuugagaaagauuuucaugacuuuuauuugaauggguccuuaccaggcugcaugugcugauuggauucuucccauggucauucgcuaaguuccccuuaaccucgaauaucauucuuuccaauaaagaugggacuccuaugccugacagcuauccaacaacccccucuucaacggaugcaccuacaucugaguccaaggaaacacuugguacccuacaacccucccagcaacagccagcacuuccacccccaccauccuuaggagagauuccucaggaacuacaguccccugcugaagaaguggcaaacucuacacagcuauugaugccuauagaguuggaggaauugggucccacaagaccaaguggagaagcagaaacaacucaaauggaauugucuccagcucccaccauaagugaguagaaugucaucuuuaaaagggcauaaaaaagaaaagaauugcaaucuuuguaacuuuucucugcuuucuuacuuuaaagaauuaggagcucagaauccucaguuuacacuccagcuuucuuaguagaagcucagauuucuucuuuguguccucaguuaauuauuguuguauaucuuaaugauaaguacuaagcaugccauaauuuaucuaggcaauacucauuucugaacuaacuaucaugucagguuuguuauuuaacuucuuugaaaauaauguuucagaguugguggugccuucauucauaaacugaaauucuauaucauucaguuuuccuaucauuuacauaccuacugcucacuuauuuaaaauagugcaucaaaauuuucaacaaaauacuuuuuuuuaacaaggcaaacugaaacugacuucacuauaccauaauuucuaugcuguggacuggagagauuuuuuuuaaagaugccaguuuuguuuguuuuugucagggacugucacaauuucuuuuccuguugcugugauaaaauaaucugacauaauuuuaagggaagaaggguuuauuuuacucacacuuugagguuauauucuaucauagcgggaagagucacagcagaaacuucagggagcuggucacauaucauuauucauaaaacaauacaugcaugcuucucagugccccuucuccaguuaaacagcccagggucccugggagugcuaauucccaaaugauguuuuuucaaaggcccauguccuaggcaauauuagauuuggucaaguugaugaucacaacauaaccaucacaagacaguaaccauuacaagagccuuuuuuuuuuuagauaacugagaccacuagcauguuuguguaacugguaccugcaggaaacauuagaguaacaaaaucccuacuucagauaucuagggacauuguagacguguguagaacaaacgugugguacauagaaaagucuuaaggaacuuaagggcaguugagauggaagagugggcaauagauaaucaagugguagaugagucuguauuaacuguugcaaaaggaaacaacccuaccaaagacuuugccugucauaaccuugauucaaaguagccaucuaauuucucacucuuaacuuccuucuagccucucuuuccccagagagagcugaagauucagacgcguuaacagcugucagcagucagcuggaagguucucccauggacaccagcagccuggcuuccuguacguuagaagaggcugugggugacacuccagcagcuggcaguucugagcagcccacagcagguaguuccacuccuggggaugcgccaucaguuguggcagaagugcaaggcagaccugauguaucaagagaauccaaccagccaccugaggacagguaaguacuauauagccaagaggagauuaggaaugcauuagaaguuauuucaagcuaaacacuaucaggcaugcuuguugcacugugauugauguguucuaucugagauggguauuaggaauguuuuuguuguuugguuuguguuugcuuuuuauggggaaacuguauaaagaaggaugauuucuuucccuagcucccccccugcauccucggagaguucuuccacuagagauucugccguggccaucucuggagcagauucucguggaauucuagaagagccacuaccuucaacaagcagugaagaagaagauccccuugcugguaaguuucuguuuccaaaaaaaucauugcuuggacagacauaacccuccaaacacuuuccuccaggucggugugugagucggggguggggguuguugaagauagacuagcaauaagaggaugcagguguugcgcguaauggaaugaguucaggcuuagaagucagguuagccuuagcucacucauucucuacuuuuauaaaauaggaccauuauuuaauaucucuaauccucauugacaaacacuauguuagucaguuuuccauugcugaaucaaaugucugaaauagccaacuuuuaaaagaaacgauaagcuuagcucacaguuacagaguuuucagucuuuggucaguuguuucuuggucucuguaguaagagacuacuauauaaugguggccacacacaaucuacaugaaagucuuuauaaagguugacuugacaguguauaccacuaaugaacuuuuuaaauuuauuugagcuguugaacuauuugaagcuuaggaagauggguuauggcucuucucuauaucuuugcaagcaguggaaacacaaauggcugauuuuccucaacccaugauuuguguuucuuuucucugaguauaccuuugaacauccaugaagauguaaguuccuuuacaucuuacaaucucuuuagguaucagucucccugaagguguggaucccuccuuucuggcugcucucccugaugauauccgucgggaaguccuacagaaccagcugggcauacguccaccaacccgaagugcucccuccucaaauagcucagcuccugcaguaguggggaacccugguguaacugaagugagcccugaguuccuggcugcccuaccuccagcuauucaagaggaaguauguaagcgggaacauggugagaacaguuuuagcuugaaaagagcuauacucuuacugauuucuuuucuucuauaggugcuagcacagcagagagcugaacagcagcgacgggaacuggcucagaaugcgagcucagacacccccauggacccugugacuuucauucagacuuugcccucagaucugcgccguaguguccuagaggauauggaagacaguguguuagcugugaugccaccugacauugcagcugaggcucaagcucuaagacgagaacaagaagcccgacagcggcagcucaugcaugagcgucuuuuuggacacaguaguacuucugcacucucugccauucuccgaagcccggguacacagggaggcaagugggagggcucuggaauaucuugcuuggccuuguuuuuuaauuagccuccuuuacuaccuguuaguuguuugaacccaguuucuccucaguucaccaaauucaguuuccuuuuucuuuucuuguagcuuuuaccagucgccugaguggcaaccgugggguccaguauacucgccuugcuguacagagggguggcaccuuccagaugggggguagcagcagccauaauagguacccuugucuuuuuuuuuuuaaaccucacuauacuaccuucugagucccuuaauuuuguaaguagagaagcuaaaagauuuuguggcggccaggaugaccauucugggcuauuuuccuugaaaugaguagacaagcaaaaucuguuuaaauuccaagugccacagcucaaaaaggcaggcuagcagcagauacuaguuaugguuuuaacaaaauaguggaggccuguuuggccuuaggacugcaacagauaugcuacagaaauaggggaggaguuacuuacgacuaacuaggaugaagcacaguagauuuaacauucuaaaacaauuauagaaaagaucaguccuuauaaaagaauggcagcuccuuaaucuagaaaaggcaaaaagcaagcuguggcucauagaccuuagauuuucaucacuuaguaaaugauaaaaauaugaaucucugcucucuucauagucauguaauaaagagcaaauuaucugauuuguuugagcuuuuuucacucacagucucaauaaugcuguacaacauccuucagggaaagaaguuguaaaguaccugguauaugauagauacacaauagacuuguugcuguggauuguuuugucuucuuuuacagucuuccugggauuaucccacucguucuucucucauguaccucauauacugauccuagugcuuuagcuaguguuacccagaaaccaugcucuguuuccaggccuucuggcaguaauguggacacacuacuccgccuccgaggacgacuccuucuagaccaugaagcccugucuugccucuugguccuacuuuuuguggaugagccaaagcucaauacuagccgucuacaccgaguacugagaaaucucugcuaucaugcccagacccgccacugggucauccgcagccuccuguccauuuugcagcgcagcagugaaagugaguuaugcauugagacaccuaagcucuccacaagugaagaaaggggcaagaaaucaagcaagagcugugcaucaagcagucaugagaaccguccccuggaucugcuccacaagauggaguccaaaaguuccaaucagcucuccuggcucucaguaucaauggaugcugcuuuaggcuguaggacuaacauauuccagauucaacguucuggagggcguaaacauacagagaagcaugcaagcagugguuccacuguccacauccacccccaggcugcuccuguuguuugcagacauguuuuggauacacucauucaguuggccaaggugaggagcuugaaggaauccuugaccccaggguuuuuugggcaucaacaccuugggugagaucuggacaguaaagggcuaacagaucucuuuguugauuuauuuuauauugugccauuugcuguuucugagaaauuguccaauaaauaacuucauggaguuuuaucucuguucuuuacaauuuuuaauguacuaucucagucaucgaaacaacuguuuacacucuauaugauucuuguuuuacagauaaagaagcugagauucagagcacuuuaguggcuuugucguuugacuagaaagugacaagcucaguauuuuuugaauaauaaacagugcuacuauguauugggggcccaccuguacuaggcaccaggcaaaaugcaucaccucauuuaauacuuugugucguucuccuuguuucauuaagugcagagagacaaaagauuuagaaagauuuuuaauuuugucuugcuucaaaguccuuauuuuuuuaggcugcuucaccaucuacuggauagaagucauauaauccaucugucuuguauuagcagagcuggaaaaggaauagucugagaagcaauugucuuuuccugucaggcuuauccuuuacagagacuccuuagaucgaaccuauucuuuucccugcagguguuucccagccacuuuacacagcagcggaccaaagaaacaaacugugagagugaucgggaacggggcaguaagcaggccugcagcccaugcuccucacaguccuccagcaguggcaucuguacagacuucugggacuuauugguaaaacuggacaacaugaauguuagccgaaaaggcaagaacuccgugaagucaguaccagugagcucugguggugaaggggaaacuuccccacacagccuugaagccucuccacuggggcagcucaugaacauguugucacauccagucauccgccggaguucucucuuaacugagaaacuccugagacuccucucucucaucucaauugcucucccagaaaacaaaguaucagaagugcaaacuaacuccagcaacagugguuccuccacugcugccaccucaaacacaucuacuacuaccaccaccaccacuacugccacugcccccacgcccacacccccagcugcaacuaccccugucacuucugcuccagcucugguugcugccacagcuauuuccaccauuacuguagcugcuucuaccacagugacuacccccacaacugcuaccacuacuguuucaaguaaguguuuaaagucagagcuaugggguaugggcucccaucuuacucucacuucccaauccagauaauauucucuaaaucauaauuauugugagaacaggauguguucauucuuagccuguuuucucuucauuccccuccccacaccaccaucuuccauguguaugguguaugcaccuguacauuuguauaaagccaaaccucuggcucuaccaaaagugguggaguuaaauccuaagauuuccagacuauacaauaauagacugaaugaaugcagugugcuuuaagauaacagacaucucaggaagaagagaaaauaagccagguagcagaggauucucggcagguauagguugguuaguuaguuuggggguuuggaguuuuuuguuuguugguuugguuugguuuuuuuguuuuuguuuguuuguuuguuuguuuuauuuuuuugaguaaggguuucucuguguaguccuggcuguccuggaacucacucuguagaccaggcuggccucgaacucagaaauccgccugccucugccucccaagugcugggauuaaagacaugcgccaccacugcccggugccuguauagguuuuaaaggauaaauugugggauaugauagagaaauacuuaggauuuuugguaaccuuacaaggcauaguuaagaauauagcucagugguagaaugcuuccaugguauguauaacauccuaaguucaauucucagcacaccaaaaagauuuggccuugauagguagguugucauuuucucugcuuugccauuuugaagcccuguacagugcagcacuuccagguuuaugacagucacagagcuuuaauguguucuguuuccuugaagcuucuacuacuaaaggcagcaaaucuccagcaaagguuggugaaggaggcagugguauagacuucaaaaugguguccucuggccucacugaaaaccagcuacagcucucuguagaggugagucuaagcucuuuauaccuucugaaauagaaggaaagggguagacauuucaguucucagguuagggcuuuuauuaccucuccuauauuuuaccuagguguugacaucccacucuuguucugaagaaggcuuggaagaugcggccaauguguuacugcagcucucucguggggacucugguacccgggacacuguucuuaagcugcuacuaaauggagcccgccaucuggguuauacccucuguaaacagauagguaauaauauuauucuauucugucuucuuauaagacacacacagagacacacacugaauuagaccaugcuccuaaagcucaguucuuguuuucaucuguggauuguuugagaacaagguugucugacuuucucaucaccagcaacugcuauauagcuggucaucugugcuuagugaaggaguaggggaauauuauucaugagaacaaaaagaccuacuuuuuuuucucccuaauuauuaguaucuacaagagccccaugauaaaguugcaauaacggcuuuuuuucaucuucaaagauauacguaaacuaugauaagguucaggaguuauacucacaauaauggccuccuuuguauaguuuugaugaugcaaaaguucuagcacuugaaaauuguccacgggugauacaugauuaucucauuguucuauagauagcauccuuugagggagaauaagaauaccacaaaaaccugaguagguuuuuuuugguuuuguuuuguuuuuguuguuuuucuguguaaaccggggcuguccugcaacucacuuugaagaccaggcuggccucgaacucggaaaucugcccaccucugccucccaagugcugggauuaaaggcaugcgccaccacgcccggccaccugaguagguuuaagagcuauauagauagaacauagaucaugauaugucuccagaaaaggcccuuuuuauucucuauaccaaacugcuuuuuguguagauucaguaagacaguccaaugaauugguagucccccaagugguugguccauagaaaaaacaauaaaccaaaugguaaaaauuucuguucacuuauauuuccugcaacaauguccugguaaaguucagcuuucugcuuuaaggaaauuucugaccacaugaauccucugccuaccccagguacccuacucgcugaacuacgggaauauaaucuggagcagcagcggcgagcccaaugcgagacccucucuccugauggccuaccugaggagcaaccacagaccaccaaacugaaaggcaaaaugcagagcaggugggugugggcuagaaucugaaacauuugaaaaguggcuuuggcugguuuuucucuucuguguuuuuucuauuuguucuauaacauacuugaccugguguuuuuaaaaacuucuccaauggcuaauacuauuuuuaagguuauuuuuucuaguuaauaccagaaucccuccuugcucugaguauuuauacuuugaugucaauauacauaagccaccucuacacuguacagguuugacauggcugaaaaugugguaauuguggcaucucagaagcgacccuuggguggccgggagcuccagcugccuucuauguccauguugacauccaagacaucuacccagaaguucuucuugaggguacuacaggucaucauccagcugcgggaugacacacgacgagcuaacaagaaagccaagcagacaggcaggcuagguauaaagcuagagugucuaauugaggguggugguggugauggugaugcugcugcuacuggggcuggggguggguccagagucccuggagaagcugggcuaaaauguccuguuuuguuucuauuugaccuuuccaaaaaagcaccaccaccccccuuuuuaucaaguguugauggcuguauuguauaacccauucaaucauucaccugagaaugaauagaucaaguuacaguugagggguaauugaaaucuggcaaagaaauggaaagaccagcauuucucugagaaaaacuuacaaaugugcuuucugccuccuuaaacacuccuaacuaaaauauuagccauguucucauacauuggcuucugucccauagaacacucuacaugucaccauccauuugucuggcaauccccugcucuucucuacccugggacuugauuaugaggauacaaaacugccuaaacuaaaacucaaauucaacaagauucccuauggcauccaugaaagaagaaaagaauuuugggcauucccacuuccuacauuuuauaucaugccuuuccccuuuuccucuuucucccagguuccuccgguuuaggcucagcuagcagcauccaggcagcuguucggcagcuggaggcugaggcugaugccauuauacaaaugguacgugagggucaaagggcgcggagacagcaacaagcagcaacgguuagcaugaugccuguggccccucauucauuucucuacccuccuuccugcaccaugucaucaguggggguucauugcccauaccuuguaugcuuuugcauuacguuugcuaaaugaaugccucuagacaacaagguuacuuucuguugguguuucucuugcuauucauugauuguuuuacugguuuguauugauugauaucugguugaauauaaagcuuggccaucauaccucacucccagcuauccaguuagcaguguuuugcaaauugucuuaugcuccaugccuggguucugaagggauauaggguuaaaaaaauuuaguguugugaaauaauguagagacaacuccaaaguccccugagcuugguauacauuaucuauggccacuguuccacccuauccuuuaaucucagcacuugggacaggggcaagggggaucucugugaguucaaggccaauuuggucuacauagugaguuccaggaccagagaaacccugucucaaaaaauauaguauauuacugaucacacuggacauaguacaggauuuggggaaugacuccagcagcaguaaaaagagaaaauaaagagcugcuauucuuuuuuaucugcccagucucauguccuaccugauaaagacauagcuuaaauaccccacuuauggaagauuauacugaguucaguuugaacaaauagaaauagcaggaagcauacuuucugccuaccuuacaaguauguauacaaacagaaccugguccagaaaaaccuacaauuuuugucuauauucagagcaccaguguagggguagagugggaucugagagggaauuacaugggagcagcuuauagagaaugcagucauccgggagcucuugguucauagugaaaaagaagcaugcuugucauucuuuugaccuagagagcuauauacuuugauaaccagauaggagaaaguaucuucuaagcucaaagugugagacuuucaggggccaaccucuaauuccagagaaaagcagaguugcaccuuuuaugugaccuuuucuccuuuuauccagucggagucuucuaaccagucagagacaucuguccggagagaggaaucgcccauggauguggaccagccaucuccuagugcucaagauacucaguccauuggucaguacuacuucugcuuguuuuaaaaauaaaaaaguuuuaauggaucuauaaauguucacaagauuauaaauguagcaucagccaagacaacauaggaagaaccugucuuuaaaguagcagauuagugccuggcgagaugagucagugaguaaagggcauuuauacuugucaccaagccuugacaaccugaauuugagccccagaacccacauagucaaagcagagugaccacaaauuuuacuccaacauguacccuauguguuucugcuaaauaaauaacauaaagcugaggcaagauugagcugcucauauaccaagccuacaguuacauagugaaacuaucucgaaaagaaaugaaugagcuggcuuagcagguaaggguacuugcuacagagccauuaccaaguuugacccccugguaucuuuuuuuuuuuuuuuuuuuuuuuuuuuuugguuuuuuuuuugauuuuugguuuuuuggagacaggguuucucuguauagcccuggcuguccuggaacucacuuuguaaaccaggcuggccucgaauucagaaauccaccugccucugccucccaagugcugggauuuuauaaaggcgugugccaccaugcccagcuaucccugguacuuauauggcaggaggaaaaagaaauuaacuccuucacauuuguccucugguuuccacacaugugagggcauacacacacccauacguauacacauaacaaguuuuuuuuuaaauaaguggggaaauguuaauguaaaaagaaaaaagggagccauauaugguggcacaugucuuuaauucuaguauucuagaggcaaaaguaugcauaucuaaguucaagacuacuagccugggucuacauaggaaguuucugggcagccagagguacauacugagacccugucucaaaaaaaaagugcaguauauuuuguguguggggugggggcauguucaagucuuggcucccuaguauauuuuguguguggggugggggcauguucaagucuuggcucccccguuuucuagcucugaguuacaaggcauaagcaguacuauuugggaugggaaacagcccaguguccacuguaggcaaagugcuucccaugggggaugauuucaauccuaggucaugaacacccaacaugguaacacacacucuuauaaucccaguacuaaagaaagccaagaugggcauaucucugggcuuagguuugagguugcugaccaacuggccuacccuauucagugagcuccagguuagugaaagacagguagauccuagagcaguacucagucuaugggucaagaccacuuugagggucaaaugaccccuuucauaggguucuccuaagaccauccaaaaacacagauacuuauauuaugauucauaacaguagcaaaauuacaauuguaaaauagcaacaaaauuuaagguuggggacaccgcaacaugaggaacuauauuagagaguugcagcauuaggaagguugaaaaccacugaucuaggggaauaauaucuaagauugaucuuugugcacauauacacaauuuuaaaaauauuuuuaguuaaaauaggaauaugcacaguuguuaaaauuaaauaauuuaauauguguguaauacuuaaccaaguaccuggcacauaguaaauauggcauuuuucaauaaguugcauacagaauauuuuuggugcccuuuaaacauauuacuuuaaaauaguguucucauaggacauccaguuuugaaaugcuuuauuuaauuaucuggacuuuggggggguaaauauuacucccauguucuguauccaucuuuuuuuacccaaggucacacgaucuccacgugcaacagccagaacucaaaccuagggcuaacagagccuugaagaauaguuaggauuugguuagaggacaaaagugaaggucaggaagaagccuaagcaaagcagggaucuuaugggguucugguguugcuucucuauuacuuagaagauucgacuagacuugcuacuuggcuauuaagcaguugugaauaaacuuccagagaggauagaaaaaaauaacaaccauggagaggagggagguguucaucuugcacuaaggcuucuuaagggcuuuaagaggcaugagacuuuuauuuaaaauuauugagucaaaauaucuauuuuggcgcugggcauaguggcacaugccuuuuaauuccaacacuugggaggcagaggcaggcagauuucugaguucgaggccagccugaucuacaaagugaguuccaggacagcuagggcuauucagagaaacccucuguguguguguguguguguguguguguguguguguguguguguguguguuacccuagccuuaucucuagggaaaaaaaagaaauggagaaggcaaccugauugauuacaaaggcagaauuuaucagaauuuaaugaacauaauuucuaaaacauaauuguacuggaagacaauuuuccaaaguuccauuguagcacauugcccuuacuuaacauaagagguuccuucucagcuaagggggcaaugacaagacuauacaauauauggccuuugaaaauuugaaaaagagagaaagaauugcccucucuuaguuaacucugguacuugugauuugucuuuauaauuaauugccuguuuugcuuuucugacauccucuuuuuauuuguauuauuugaggagucaaauuuguuauuuaauuuaccuucuagauguuguucaaugauuaauacucauuggccagugagcccagacugucuaguguccugugcuuuuguucugggaaaaacucucaaguaagagagacacucugcaaguuuuugacuguccuuuguguaucuaguaaucucagauggaacaccacagggagagaaggagaaagaggagaaaccaccugaguuaccccugcucagugagcaacugagccuagaugaacugugggacaugcuaggggaauguuuaaaagaacuggaggaaucucaugaccagcaugcaguauuaggugaguugcucucugagguuacagauucccagccccuuggucugcucuuggacacucucugucugguaauggugcuggcgauuaucuugcuuuuucagucuaaguuuguugaacucccucugugugucuguaacaagaauucaaaagaacugcccucucuuaguuaacucugguacuugugauuugucuuuauaauugauugccuguuuugcuuuucuaacuuccucuuuuuauuuguauuacccugcaaguuuaaauuauucuauguuuuauauuugugauguguuuaugggaagguuaaacuuuauaaaguuuauguuaaacuuuguaaagugucacuuugcugucauugcuauccuccagugcuacagccugcugucgaggccuucuuuuugguccaugccacagagcgggagagcaagccuccuguccgagauacccgugagagccagcuggcacacaucaaggaugaaccuccuccacucucccccgcccccuuaaccccagccacuccauccucccuugacccauucuucuccagggagcccucaucuaugcacauuuccucgagccugcccccugacacacagaaguuccuucgcuuugcagguacauggaacucuuagacccauagauuuuaucccuaucuaauuaagcaaaaugagagaguuggcaaacaugcuugcauacuaacauccaacacacacuuuggaaaaaaaauagaccuaguuaauuacaggagaguucugcuauagaacuucuuagauuccuugcguuccaaaggauuuggguuuuauuguaaagcuagguguuauaaaugcccauucaucccuuaggaguguagcccuugccuuuagcuauuuccugauuuaggccccuaaaacaaauaaaaccaaguugguugcuaguagacuguuuuguaguuucuuaggaccuauaauaugcugauuccugcuguuaucuuuucucucagagacucaccgcacuguguuaaaccagauacuacggcagucuaccacccaucuugcugaugggccuuuugcugucuugguagauuauauccguguccucgacuuugaugucaagcgcaaguauguacccugggauauauuggggugaaggacuauauaaacgauaccugugucaccuuccaggggaaaaaagcuauaguuguuccuaggguuauaaggguuucuuggugguacuacauuucuaaaguccccucucagccuuuagagucauagcagcaguaauauagucaaaaugagguucaagacuccuuccuugucaucucuacuccuucuuauacagauaaaugugcuuucuugauuguugcagaaaucaaauuggcucugugaucucucauucacuagaaauaggaaaauuuugaauucguaauaaaugaucuagcccagcugcuauagacuuuccggguguggggggguuaaaagaucaaagggaacaugucacugugaguuuuccuucugaacagacagauauaaguuugcuuuaaucacccccaauccuacuuccuuuccuuuucuacauccuaagauauuuccgccaagagcuggagcguuuggacgaagggcuccggaaagaagauauggcagugcauguccgccgugaccauguauuugaagacuccuaucgugagcugcaucgcaaaucuccugaagaaaugaagaaucgauuguaagaacucaggagagaaaacagcuaagaugauucagggccuauaugcuauaucguagcagugaccuaauguggccucaaguuuaggggaaguggucacaaaacucccaguagcauucuggcuuagauaauguuaauugagcuuccugcauuuggacuuggacugcugacuuagucaccaaguuuuaggcagacaaggaugucuuuaaugccuuugcagugcaagcuuaauauauuauuaggcuaggaauagaaauuugccugcaaagcagauugguaacccuggguuugggaggcaccaugugcuugagugccaccccccacuccacccccagucaguaauuguucacuggugaagccaccuggaagaaauugauagcuuguagccauaaguaucacaguagcuaaugagacagauuaaaaucauggucucuccugguacucuguuuacuucuucaucuaacaguggacucuccaaagucagauucacagaaucuuucucccuuacaugaugcuacaugaauggucagaucuguccuggcuuucugcacagcucucuuauuucugcucuuaugcagguauauaguguuugaaggagaagaagggcaggaugcuggggggcuccugcgagagugguacaugaucaucucucgagagauguucaacccuauguaugccuuguuccguaccucaccuggugaccgggucaccuacaccaucaauccaucuucccacuguaaccccaaccaccucagcuacuucaaguuuguuggacgaauuguagccaaagcuguauaugacaaccgccuccuggagugcuacuuuacuaggucuuucuacaaacacaucuugggcaaaucugucaggugagauuaugguagccuuuagacugccuuuuuagcccuaugacucucuuaucuuuaucccccuuuuauuucuguuccucaagccaugacccuaucuaauugcauuuuucuagguauacagauauggagagugaagauuaccacuucuaccagggccuaguuuaucugcuugaaaaugaugucucuacauuaggcuaugaccucaccuucagcacugagguaaguugggggauuacuuuggaacugacucucuguaucaacaguucugagaaagcacuuugacuucaucaaacaggaaauagaauugguaaaauaguccaagcugucuccuaguuucuccucaguggguaagagcacauguuuugcaagccuuauggccugaguucagaucugacacccagguauggucaugauugagugcuuggaacuuuugaauacacagugcuuggggagugcaacacaaaagagaggaucacuggagauaggcuggcugccaguuuaauucuagggagagaccuugucuagggaauaauagugcagaacacacagacaacauccucuggcuuuuuuacaugugcauauuaucgcauaaacuuacauucauacacacaugaaauaguuuuauuuauguauaugcccauguguucagguauauacaaaccagaagugagcauugggucccauggaguuacagggcucugaaccaccaaaugugagugcugagaaccaaacuugagccaucuggaaaagagagcagcuugcacuuuuaauacugaacuauaucuuucuagcuuuaauuuuuuauuuucaauaaaaguuucagagccaguaagauaguucagcagguaagccugauacuuugaguucagucccagggcucagugugguggaaggagagaacugacuccugaaaauauccucugauacacacacacucacucucucacucucucucucucucucucucucucucucucucucucucucucucucucucucucucucaauguaacauuguaacaugcaucuguaacucaagaguuggagguacaaagacagauggaaaaaaucagccaaaucaguucauugagaaacacucaaagaaagguagaacaugauaggggaagacacucuuugagcucugcccaugcccacacguacacuguuccagugcauaauucagucccaaggacaguucaucauagaaacaaaauuagaauuacccuuuucuaacuuguuuuagagccaaagauuaauuuccuucauuccauccuucagcuuuuucucucuggaacauggcaaggaguuaggauguguuuuugcaccucuguguuacuuguagcccaaaccaaaccugauguguaugauugguaucuuggauguucuagguucaagaauuuggaguaugugaaguucgugaccucaaacccaauggagccaacaucuugguaacagaggagaacaagaaggaauauguacaccugguuugccagaugagaaugacagguaggagaaguguccuuuagauagaccucugcuuguucaaggaaagaggucagccuuuuauuuauuucacauuuuuuguucuuauuuccuaugacauggccacaaauaccuugcacaaaaggagucagaauacuugaccaaaguacuuaauuccaucuacuauaauauaagggccuagaaacagugcuagcuaaggcaggcagauuucucaguauaagguguugucuuaggguuucuauuccugcacaaacaugaccaagaagcaaguuggcgaacaaaggguuuauucggcuuacacuuccauacugcuguucaucaccaaggaagucaggacuggaacucaagcagaucaggaagcaggagcugaugcagaggccauagagggauguuccuuauuggcuuccuugcucuggcuugcucagcuugcucucuuauagaacccaagacuaccagcccagagaugguugcacccacaaggggccuuucccccuugaucacuaauugagaaaaugccuuacagcuggaucucauggaggcauuuccucaacugaagcuccuuucucugugauaacuccagccugugucaaguugacacaaaacuagccaguacaggugucaaacugaggcuguauuaacucuguucaguuguaugaguucugauuccaugucacuuuuuuuuuuuuuuaaaccaggagccauccgcaaacagcuggcagccuucuuggagggcuucuaugaaaucauuccaaagcgccucauauccaucuuuacugagcaggaauuagagcugcucauaucagggcugccuaccaucgacauugaugaucuaaaaucuaacacugaguaccacaaguaccaauccaacucuauucaggugagcggagguauccccauacucuugagaaguaugaaacacuuaucagugcugguuuauggauaacaguauaccuaugccucuuuuuguucuucuggagcugauguucucaccuauccugugaaggaacaaaauauuucaaguccauugccauuuccuuaaauuucuuuacaagcucucuuuggcuuuuugugugucucuucuuacagauccagugguuuuggagagcauugcguuccuuugaccaagcagaccgugccaaguuccuccaguuugucacagguacuuccaagguaccccuacaaggauuugcugcccuugaagguaugaauggcauucagaaguuucagauucaucgagaugacagauccacagaucgccugccuucagcucacacaugguaagaaaacaacuuaaaaguuucuccuuuucagugauuuuauugagguuguagacuugaugacuucuagacaccuacccaagauugggagcacaaguauggccuagucuacaacuuuauaaagcucaguuuguuaggucuauggaggaaguugaggugagcagauaggcuaaacacaagagugauggcuggaaagacauuugcaaauagcacuuaagggaaucaugauguguuccaaagcuuugucuggcugggcaagggcuggauauacaugguucaacugguuaagagcuccuuccuacucacaggaacagaauuuaguucucagcaccuauggaggucaguuugugaccacuguaacucccaccugcaaggucaauaaugaccuccuccucuucuggauuuuauagguaccuccacuaacaugcauauacaucacuagugaaccaagauaccuccuuaaaggcaauuauuucuuaggaaauguaaugauuggaaauguguguaguucaguugguuaaaaggacuuuuccaacacaauaccaugauuccguuccucauaccacauaaauuaucuaggagguaggacaaucagaguuugagaccagccugggguacacaagaccaggucucaaaaauaauagaaaaagcuaaaaacuagaugaggggcuggauuagcagcuaagauacauacugcuuuugcagaagauucagauucaguucccagcacccacaugauggcucacaaccaucuauaacugcaguucucaguucucugaugccuucuggcaucaacaaacacacaguaaggugcacauacagacagacaggcaaaacacuuaauauacaugaaauaaucuuguuuuaaagugaagccuuaagggauagauuaaaauuuaccaacucacuauauaugugacugccagcuaucucuucuccagugcauuaaacuuuaaccuauagguuaaggccaugguguauaaguuauaguaagagccaauuuauguugcuaguauugaggccagauuagcaaguuggagaaaaaaaugggagagucagcaagaagcagugaguacaugagcucuggcucagaaaggagcagaagguuucauuguucuuuucucaugaauuuaaucuuuauucauucuaguuuuaaucaacuggaccugccugccuaugagagcuuugagaagcuccgccacaugcuacuauuggccauccaggaaugcucugaaggcuuugggcuggccuaauaaauaaggcccugccuacuucugugggguuuuucuaccauuguuggaccuggggagggggguggauuuaaaagauccagaaagaaaaugucaaaauccaauaaaugaaauucaccaacucaccaugugugucccagcugcccaucuucccuagugcauaccuguucgcuucucauucucuuuugucuccccuuuccucgccucucccuuuuccaugccguccaugauccccaccccauguguuaagaaggcaguagccuuuacagggaccuguuugucccaaaugaacagugugcuccucagauucuguguucagaaggauuugcugcauugagacuugaaaccuuuggauaggggaaaaauuauauauauauauauuuuuuuguucuguuugcauuucuuaauuugugcuuggaauguguugaugugcacagcuaaugauucaaugcgagacaagauuggcaucuguguuguggagguuucaaauaaagagcacucuucauaacucacuuuucacaacggaguuuuuuucaaacugaaaaagaaaaccccaucuuauacacauacuagacaaaugaacuuuccagaaaaccauuucugcccuuccugaucacccacccaccuccacuucugguauagaacuucuuccuucagucaguuuccccagagaaaagacugacagacaccgggaauuggggggauuuuuguuauuuaaaauggguauuuggaacacacugcagcagguacuaucaaaacaguuaacccaugcaauguuucguuugguaagcauuuaugauaaucucaaguuuaauuuucuuaaaaguuuuggucccuuucuaguaaauuuuaauaagcaaaauauuugacuagcucgccacaagaccaccuuuuuugucugucuugucauuuguuugcaaguauucacagauuaucuaguagucucuugugguuuuuacucuauccagcacuuuaucagacuuugaugguuccagccuugaacaaaaauuuaauaaaaaauuuaguuagaaaaacaauc

SEQ ID NO: 9783 - RNA, 134614 nt, Mus musculus
gauuguuuuucuaacuaaauuuuuuauuaaauuuuuguucaaggcuggaaccaucaaagucugauaaagugcuggauagaguaaaaaccacaagagacuacuagauaaucugugaauacuugcaaacaaaugacaagacagacaaaaaagguggucuuguggcgagcuagucaaauauuuugcuuauuaaaauuuacuagaaagggaccaaaacuuuuaagaaaauuaaacuugagauuaucauaaaugcuuaccaaacgaaacauugcauggguuaacuguuuugauaguaccugcugcaguguguuccaaauacccauuuuaaauaacaaaaauccccccaauucccggugucugucagucuuuucucuggggaaacugacugaaggaagaaguucuauaccagaaguggaggugggugggugaucaggaagggcagaaaugguuuucuggaaaguucauuugucuaguauguguauaagaugggguuuucuuuuucaguuugaaaaaaacuccguugugaaaagugaguuaugaagagugcucuuuauuugaaaccuccacaacacagaugccaaucuugucucgcauugaaucauuagcugugcacaucaacacauuccaagcacaaauuaagaaaugcaaacagaacaaaaaaauauauauauauauaauuuuuccccuauccaaagguuucaagucucaaugcagcaaauccuucugaacacagaaucugaggagcacacuguucauuugggacaaacaggucccuguaaaggcuacugccuucuuaacacaugggguggggaucauggacggcauggaaaagggagaggcgaggaaaggggagacaaaagagaaugagaagcgaacagguaugcacuagggaagaugggcagcugggacacacauggugaguuggugaauuucauuuauuggauuuugacauuuucuuucuggaucuuuuaaauccaccccccuccccagguccaacaaugguagaaaaaccccacagaaguaggcagggccuuauuuauuaggccagcccaaagccuucagagcauuccuggauggccaauaguagcauguggcggagcuucucaaagcucucauaggcaggcagguccaguugauuaaaacuagaaugaauaaagauuaaauucaugagaaaagaacaaugaaaccuucugcuccuuucugagccagagcucauguacucacugcuucuugcugacucucccauuuuuuucuccaacuugcuaaucuggccucaauacuagcaacauaaauuggcucuuacuauaacuuauacaccauggccuuaaccuauagguuaaaguuuaaugcacuggagaagagauagcuggcagucacauauauagugaguugguaaauuuuaaucuaucccuuaaggcuucacuuuaaaacaagauuauuucauguauauuaaguguuuugccugucugucuguaugugcaccuuacuguguguuuguugaugccagaaggcaucagagaacugagaacugcaguuauagaugguugugagccaucaugugggugcugggaacugaaucugaaucuucugcaaaagcaguauguaucuuagcugcuaauccagccccucaucuaguuuuuagcuuuuucuauuauuuuugagaccuggucuuguguaccccaggcuggucucaaacucugauuguccuaccuccuagauaauuuaugugguaugaggaacggaaucaugguauuguguuggaaaaguccuuuuaaccaacugaacuacacacauuuccaaucauuacauuuccuaagaaauaauugccuuuaaggagguaucuugguucacuagugauguauaugcauguuaguggagguaccuauaaaauccagaagaggaggaggucauuauugaccuugcaggugggaguuacaguggucacaaacugaccuccauaggugcugagaacuaaauucuguuccugugaguaggaaggagcucuuaaccaguugaaccauguauauccagcccuugcccagccagacaaagcuuuggaacacaucaugauucccuuaagugcuauuugcaaaugucuuuccagccaucacucuuguguuuagccuaucugcucaccucaacuuccuccauagaccuaacaaacugagcuuuauaaaguuguagacuaggccauacuugugcucccaaucuuggguaggugucuagaagucaucaagucuacaaccucaauaaaaucacugaaaaggagaaacuuuuaaguuguuuucuuaccaugugugagcugaaggcaggcgaucuguggaucugucaucucgaugaaucugaaacuucugaaugccauucauaccuucaagggcagcaaauccuuguagggguaccuuggaaguaccugugacaaacuggaggaacuuggcacggucugcuuggucaaaggaacgcaaugcucuccaaaaccacuggaucuguaagaagagacacacaaaaagccaaagagagcuuguaaagaaauuuaaggaaauggcaauggacuugaaauauuuuguuccuucacaggauaggugagaacaucagcuccagaagaacaaaaagaggcauagguauacuguuauccauaaaccagcacugauaaguguuucauacuucucaagaguauggggauaccuccgcucaccugaauagaguuggauugguacuugugguacucaguguuagauuuuagaucaucaaugucgaugguaggcagcccugauaugagcagcucuaauuccugcucaguaaagauggauaugaggcgcuuuggaaugauuucauagaagcccuccaagaaggcugccagcuguuugcggauggcuccugguuuaaaaaaaaaaaaaagugacauggaaucagaacucauacaacugaacagaguuaauacagccucaguuugacaccuguacuggcuaguuuugugucaacuugacacaggcuggaguuaucacagagaaaggagcuucaguugaggaaaugccuccaugagauccagcuguaaggcauuuucucaauuagugaucaagggggaaaggccccuugugggugcaaccaucucugggcugguagucuuggguucuauaagagagcaagcugagcaagccagagcaaggaagccaauaaggaacaucccucuauggccucugcaucagcuccugcuuccugaucugcuugaguuccaguccugacuuccuuggugaugaacagcaguauggaaguguaagccgaauaaacccuuuguucgccaacuugcuucuuggucauguuugugcaggaauagaaacccuaagacaacaccuuauacugagaaaucugccugccuuagcuagcacuguuucuaggcccuuauauuauaguagauggaauuaaguacuuuggucaaguauucugacuccuuuugugcaagguauuuguggccaugucauaggaaauaagaacaaaaaaugugaaauaaauaaaaggcugaccucuuuccuugaacaagcagaggucuaucuaaaggacacuucuccuaccugucauucucaucuggcaaaccagguguacauauuccuucuuguucuccucuguuaccaagauguuggcuccauuggguuugaggucacgaacuucacauacuccaaauucuugaaccuagaacauccaagauaccaaucauacacaucagguuugguuugggcuacaaguaacacagaggugcaaaaacacauccuaacuccuugccauguuccagagagaaaaagcugaaggauggaaugaaggaaauuaaucuuuggcucuaaaacaaguuagaaaaggguaauucuaauuuuguuucuaugaugaacuguccuugggacugaauuaugcacuggaacaguguacgugugggcaugggcagagcucaaagagugucuuccccuaucauguucuaccuuucuuugaguguuucucaaugaacugauuuggcugauuuuuuccaucugucuuuguaccuccaacucuugaguuacagaugcauguuacaauguuacauugagagagagagagagagagagagagagagagagagagagagagagagagagagagagagugagagagugaguguguguguaucagaggauauuuucaggagucaguucucuccuuccaccacacugagcccugggacugaacucaaaguaucaggcuuaccugcugaacuaucuuacuggcucugaaacuuuuauugaaaauaaaaaauuaaagcuagaaagauauaguucaguauuaaaagugcaagcugcucucuuuuccagauggcucaaguuugguucucagcacucacauuuggugguucagagcccuguaacuccaugggacccaaugcucacuucugguuuguauauaccugaacacaugggcauauacauaaauaaaacuauuucauguguguaugaauguaaguuuaugcgauaauaugcacauguaaaaaagccagaggauguugucuguguguucugcacuauuauucccuagacaaggucucucccuagaauuaaacuggcagccagccuaucuccagugauccucucuuuuguguugcacuccccaagcacuguguauucaaaaguuccaagcacucaaucaugaccauaccugggugucagaucugaacucaggccauaaggcuugcaaaacaugugcucuuacccacugaggagaaacuaggagacagcuuggacuauuuuaccaauucuauuuccuguuugaugaagucaaagugcuuucucagaacuguugauacagagagucaguuccaaaguaaucccccaacuuaccucagugcugaaggugaggucauagccuaauguagagacaucauuuucaagcagauaaacuaggcccugguagaagugguaaucuucacucuccauaucuguauaccuagaaaaaugcaauuagauagggucauggcuugaggaacagaaauaaaagggggauaaagauaagagagucauagggcuaaaaaggcagucuaaaggcuaccauaaucucaccugacagauuugcccaagauguguuuguagaaagaccuaguaaaguagcacuccaggaggcgguugucauauacagcuuuggcuacaauucguccaacaaacuugaaguagcugaggugguugggguuacagugggaagauggauugaugguguaggugacccggucaccaggugagguacggaacaaggcauacauaggguugaacaucucucgagagaugaucauguaccacucucgcaggagccccccagcauccugcccuucuucuccuucaaacacuauauaccugcauaagagcagaaauaagagagcugugcagaaagccaggacagaucugaccauucauguagcaucauguaagggagaaagauucugugaaucugacuuuggagaguccacuguuagaugaagaaguaaacagaguaccaggagagaccaugauuuuaaucugucucauuagcuacugugauacuuauggcuacaagcuaucaauuucuuccagguggcuucaccagugaacaauuacugacuggggguggagugggggguggcacucaagcacauggugccucccaaacccaggguuaccaaucugcuuugcaggcaaauuucuauuccuagccuaauaauauauuaagcuugcacugcaaaggcauuaaagacauccuugucugccuaaaacuuggugacuaagucagcaguccaaguccaaaugcaggaagcucaauuaacauuaucuaagccagaaugcuacugggaguuuugugaccacuuccccuaaacuugaggccacauuaggucacugcuacgauauagcauauaggcccugaaucaucuuagcuguuuucucuccugaguucuuacaaucgauucuucauuucuucaggagauuugcgaugcagcucacgauaggagucuucaaauacauggucacggcggacaugcacugccauaucuucuuuccggagcccuucguccaaacgcuccagcucuuggcggaaauaucuuaggauguagaaaaggaaaggaaguaggauugggggugauuaaagcaaacuuauaucugucuguucagaaggaaaacucacagugacauguucccuuugaucuuuuaacccccccacacccggaaagucuauagcagcugggcuagaucauuuauuacgaauucaaaauuuuccuauuucuagugaaugagagaucacagagccaauuugauuucugcaacaaucaagaaagcacauuuaucuguauaagaaggaguagagaugacaaggaaggagucuugaaccucauuuugacuauauuacugcugcuaugacucuaaaggcugagaggggacuuuagaaauguaguaccaccaagaaacccuuauaacccuaggaacaacuauagcuuuuuuccccuggaaggugacacagguaucguuuauauaguccuucaccccaauauaucccaggguacauacuugcgcuugacaucaaagucgaggacacggauauaaucuaccaagacagcaaaaggcccaucagcaagaugggugguagacugccguaguaucugguuuaacacagugcggugagucucugagagaaaagauaacagcaggaaucagcauauuauagguccuaagaaacuacaaaacagucuacuagcaaccaacuugguuuuauuuguuuuaggggccuaaaucaggaaauagcuaaaggcaagggcuacacuccuaagggaugaaugggcauuuauaacaccuagcuuuacaauaaaacccaaauccuuuggaacgcaaggaaucuaagaaguucuauagcagaacucuccuguaauuaacuaggucuauuuuuuuuccaaaguguguguuggauguuaguaugcaagcauguuugccaacucucucauuuugcuuaauuagauagggauaaaaucuaugggucuaagaguuccauguaccugcaaagcgaaggaacuucugugugucagggggcaggcucgaggaaaugugcauagaugagggcucccuggagaagaaugggucaagggaggauggaguggcugggguuaagggggcgggggagaguggaggagguucauccuugaugugugccagcuggcucucacggguaucucggacaggaggcuugcucucccgcucuguggcauggaccaaaaagaaggccucgacagcaggcuguagcacuggaggauagcaaugacagcaaagugacacuuuacaaaguuuaacauaaacuuuauaaaguuuaaccuucccauaaacacaucacaaauauaaaacauagaauaauuuaaacuugcaggguaauacaaauaaaaagaggaaguuagaaaagcaaaacaggcaaucaauuauaaagacaaaucacaaguaccagaguuaacuaagagagggcaguucuuuugaauucuuguuacagacacacagagggaguucaacaaacuuagacugaaaaagcaagauaaucgccagcaccauuaccagacagagaguguccaagagcagaccaaggggcugggaaucuguaaccucagagagcaacucaccuaauacugcaugcuggucaugagauuccuccaguucuuuuaaacauuccccuagcaugucccacaguucaucuaggcucaguugcucacugagcagggguaacucaggugguuucuccucuuucuccuucucucccugugguguuccaucugagauuacuagauacacaaaggacagucaaaaacuugcagagugucucucuuacuugagaguuuuucccagaacaaaagcacaggacacuagacagucugggcucacuggccaaugaguauuaaucauugaacaacaucuagaagguaaauuaaauaacaaauuugacuccucaaauaauacaaauaaaaagaggaugucagaaaagcaaaacaggcaauuaauuauaaagacaaaucacaaguaccagaguuaacuaagagagggcaauucuuucucucuuuuucaaauuuucaaaggccauauauuguauagucuugucauugcccccuuagcugagaaggaaccucuuauguuaaguaagggcaaugugcuacaauggaacuuuggaaaauugucuuccaguacaauuauguuuuagaaauuauguucauuaaauucugauaaauucugccuuuguaaucaaucagguugccuucuccauuucuuuuuuuucccuagagauaaggcuaggguaacacacacacacacacacacacacacacacacacacacacacacacacagaggguuucucugaauagcccuagcuguccuggaacucacuuuguagaucaggcuggccucgaacucagaaaucugccugccucugccucccaaguguuggaauuaaaaggcaugugccacuaugcccagcgccaaaauagauauuuugacucaauaauuuuaaauaaaagucucaugccucuuaaagcccuuaagaagccuuagugcaagaugaacaccucccuccucuccaugguuguuauuuuuuucuauccucucuggaaguuuauucacaacugcuuaauagccaaguagcaagucuagucgaaucuucuaaguaauagagaagcaacaccagaaccccauaagaucccugcuuugcuuaggcuucuuccugaccuucacuuuuguccucuaaccaaauccuaacuauucuucaaggcucuguuagcccuagguuugaguucuggcuguugcacguggagaucgugugaccuuggguaaaaaaagauggauacagaacaugggaguaauauuuacccccccaaaguccagauaauuaaauaaagcauuucaaaacuggauguccuaugagaacacuauuuuaaaguaauauguuuaaagggcaccaaaaauauucuguaugcaacuuauugaaaaaugccauauuuacuaugugccagguacuugguuaaguauuacacacauauuaaauuauuuaauuuuaacaacugugcauauuccuauuuuaacuaaaaauauuuuuaaaauuguguauaugugcacaaagaucaaucuuagauauuauuccccuagaucagugguuuucaaccuuccuaaugcugcaacucucuaauauaguuccucauguugcgguguccccaaccuuaaauuuuguugcuauuuuacaauuguaauuuugcuacuguuaugaaucauaauauaaguaucuguguuuuuggauggucuuaggagaacccuaugaaaggggucauuugacccucaaaguggucuugacccauagacugaguacugcucuaggaucuaccugucuuucacuaaccuggagcucacugaauaggguaggccaguuggucagcaaccucaaaccuaagcccagagauaugcccaucuuggcuuucuuuaguacugggauuauaagaguguguguuaccauguuggguguucaugaccuaggauugaaaucaucccccaugggaagcacuuugccuacaguggacacugggcuguuucccaucccaaauaguacugcuuaugccuuguaacucagagcuagaaaacgggggagccaagacuugaacaugcccccaccccacacacaaaauauacuagggagccaagacuugaacaugcccccaccccacacacaaaauauacugcacuuuuuuuuugagacagggucucaguauguaccucuggcugcccagaaacuuccuauguagacccaggcuaguagucuugaacuuagauaugcauacuuuugccucuagaauacuagaauuaaagacaugugccaccauauauggcucccuuuuuucuuuuuacauuaacauuuccccacuuauuuaaaaaaaaacuuguuauguguauacguauggguguguguaugcccucacauguguggaaaccagaggacaaaugugaaggaguuaauuucuuuuuccuccugccauauaaguaccagggauagcugggcaugguggcacacgccuuuauaaaaucccagcacuugggaggcagaggcagguggauuucugaauucgaggccagccugguuuacaaagugaguuccaggacagccagggcuauacagagaaacccugucuccaaaaaaccaaaaaucaaaaaaaaaaccaaaaaaaaaaaaaaaaaaaaaaaaaaaaagauaccagggggucaaacuugguaauggcucuguagcaaguacccuuaccugcuaagccagcucauucauuucuuuucgagauaguuucacuauguaacuguaggcuugguauaugagcagcucaaucuugccucagcuuuauguuauuuauuuagcagaaacacauaggguacauguuggaguaaaauuuguggucacucugcuuugacuauguggguucuggggcucaaauucagguugucaaggcuuggugacaaguauaaaugcccuuuacucacugacucaucucgccaggcacuaaucugcuacuuuaaagacagguucuuccuauguugucuuggcugaugcuacauuuauaaucuugugaacauuuauagauccauuaaaacuuuuuuauuuuuaaaacaagcagaaguaguacugaccaauggacugaguaucuugagcacuaggagauggcugguccacauccaugggcgauuccucucuccggacagaugucucugacugguuagaagacuccgacuggauaaaaggagaaaaggucacauaaaaggugcaacucugcuuuucucuggaauuagagguuggccccugaaagucucacacuuugagcuuagaagauacuuucuccuaucugguuaucaaaguauauagcucucuaggucaaaagaaugacaagcaugcuucuuuuucacuaugaaccaagagcucccggaugacugcauucucuauaagcugcucccauguaauucccucucagaucccacucuaccccuacacuggugcucugaauauagacaaaaauuguagguuuuucuggaccagguucuguuuguauacauacuuguaagguaggcagaaaguaugcuuccugcuauuucuauuuguucaaacugaacucaguauaaucuuccauaagugggguauuuaagcuaugucuuuaucagguaggacaugagacugggcagauaaaaaagaauagcagcucuuuauuuucucuuuuuacugcugcuggagucauuccccaaauccuguacuauguccagugugaucaguaauauacuauauuuuuugagacaggguuucucugguccuggaacucacuauguagaccaaauuggccuugaacucacagagaucccccuugccccugucccaagugcugagauuaaaggauaggguggaacaguggccauagauaauguauaccaagcucaggggacuuuggaguugucucuacauuauuucacaacacuaaauuuuuuuaacccuauaucccuucagaacccaggcauggagcauaagacaauuugcaaaacacugcuaacuggauagcugggagugagguaugauggccaagcuuuauauucaaccagauaucaaucaauacaaaccaguaaaacaaucaaugaauagcaagagaaacaccaacagaaaguaaccuuguugucuagaggcauucauuuagcaaacguaaugcaaaagcauacaagguaugggcaaugaacccccacugaugacauggugcaggaaggaggguagagaaaugaaugaggggccacaggcaucaugcuaaccguugcugcuuguugcugucuccgcgcccuuugacccucacguaccauuuguauaauggcaucagccucagccuccagcugccgaacagcugccuggaugcugcuagcugagccuaaaccggaggaaccugggagaaagaggaaaaggggaaaggcaugauauaaaauguaggaagugggaaugcccaaaauucuuuucuucuuucauggaugccauagggaaucuuguugaauuugaguuuuaguuuaggcaguuuuguauccucauaaucaagucccaggguagagaagagcaggggauugccagacaaauggauggugacauguagaguguucuaugggacagaagccaauguaugagaacauggcuaauauuuuaguuaggaguguuuaaggaggcagaaagcacauuuguaaguuuuucucagagaaaugcuggucuuuccauuucuuugccagauuucaauuaccccucaacuguaacuugaucuauucauucucaggugaaugauugaauggguuauacaauacagccaucaacacuugauaaaaaggggggugguggugcuuuuuuggaaaggucaaauagaaacaaaacaggacauuuuagcccagcuucuccagggacucuggacccacccccagccccaguagcagcagcaucaccaucaccaccaccacccucaauuagacacucuagcuuuauaccuagccugccugucugcuuggcuuucuuguuagcucgucgugugucaucccgcagcuggaugaugaccuguaguacccucaagaagaacuucuggguagaugucuuggaugucaacauggacauagaaggcagcuggagcucccggccacccaagggucgcuucugagaugccacaauuaccacauuuucagccaugucaaaccuguacaguguagagguggcuuauguauauugacaucaaaguauaaauacucagagcaaggagggauucugguauuaacuagaaaaaauaaccuuaaaaauaguauuagccauuggagaaguuuuuaaaaacaccaggucaaguauguuauagaacaaauagaaaaaacacagaagagaaaaaccagccaaagccacuuuucaaauguuucagauucuagcccacacccaccugcucugcauuuugccuuucaguuugguggucugugguugcuccucagguaggccaucaggagagagggucucgcauugggcucgccgcugcugcuccagauuauauucccguaguucagcgaguaggguaccugggguaggcagaggauucauguggucagaaauuuccuuaaagcagaaagcugaacuuuaccaggacauuguugcaggaaauauaagugaacagaaauuuuuaccauuugguuuauuguuuuuucuauggaccaaccacuugggggacuaccaauucauuggacugucuuacugaaucuacacaaaaagcaguuugguauagagaauaaaaagggccuuuucuggagacauaucaugaucuauguucuaucuauauagcucuuaaaccuacucagguggccgggcgugguggcgcaugccuuuaaucccagcacuugggaggcagaggugggcagauuuccgaguucgaggccagccuggucuucaaagugaguugcaggacagccccgguuuacacagaaaaacaacaaaaacaaaacaaaaccaaaaaaaaccuacucagguuuuugugguauucuuauucucccucaaaggaugcuaucuauagaacaaugagauaaucauguaucacccguggacaauuuucaagugcuagaacuuuugcaucaucaaaacuauacaaaggaggccauuauugugaguauaacuccugaaccuuaucauaguuuacguauaucuuugaagaugaaaaaaagccguuauugcaacuuuaucauggggcucuuguagauacuaauaauuagggagaaaaaaaaguaggucuuuuuguucucaugaauaauauuccccuacuccuucacuaagcacagaugaccagcuauauagcaguugcuggugaugagaaagucagacaaccuuguucucaaacaauccacagaugaaaacaagaacugagcuuuaggagcauggucuaauucagugugugucucugugugugucuuauaagaagacagaauagaauaauauuauuaccuaucuguuuacagaggguauaacccagauggcgggcuccauuuaguagcagcuuaagaacagugucccggguaccagaguccccacgagagagcugcaguaacacauuggccgcaucuuccaagccuucuucagaacaagagugggaugucaacaccuagguaaaauauaggagagguaauaaaagcccuaaccugagaacugaaaugucuaccccuuuccuucuauuucagaagguauaaagagcuuagacucaccucuacagagagcuguagcugguuuucagugaggccagaggacaccauuuugaagucuauaccacugccuccuucaccaaccuuugcuggagauuugcugccuuuaguaguagaagcuucaaggaaacagaacacauuaaagcucugugacugucauaaaccuggaagugcugcacuguacagggcuucaaaauggcaaagcagagaaaaugacaaccuaccuaucaaggccaaaucuuuuuggugugcugagaauugaacuuaggauguuauacauaccauggaagcauucuaccacugagcuauauucuuaacuaugccuuguaagguuaccaaaaauccuaaguauuucucuaucauaucccacaauuuauccuuuaaaaccuauacaggcaccgggcagugguggcgcaugucuuuaaucccagcacuugggaggcagaggcaggcggauuucugaguucgaggccagccuggucuacagagugaguuccaggacagccaggacuacacagagaaacccuuacucaaaaaaauaaaacaaacaaacaaacaaacaaaaacaaaaaaaccaaaccaaaccaacaaacaaaaaacuccaaacccccaaacuaacuaaccaaccuauaccugccgagaauccucugcuaccuggcuuauuuucucuucuuccugagaugucuguuaucuuaaagcacacugcauucauucagucuauuauuguauagucuggaaaucuuaggauuuaacuccaccacuuuugguagagccagagguuuggcuuuauacaaauguacaggugcauacaccauacacauggaagauggugguguggggaggggaaugaagagaaaacaggcuaagaaugaacacauccuguucucacaauaauuaugauuuagagaauauuaucuggauugggaagugagaguaagaugggagcccauaccccauagcucugacuuuaaacacuuacuugaaacaguagugguagcaguuguggggguagucacugugguagaagcagcuacaguaaugguggaaauagcuguggcagcaaccagagcuggagcagaagugacagggguaguugcagcugggggugugggcgugggggcaguggcaguaguggugguggugguaguaguagauguguuugagguggcagcaguggaggaaccacuguugcuggaguuaguuugcacuucugauacuuuguuuucugggagagcaauugagaugagagagaggagucucaggaguuucucaguuaagagagaacuccggcggaugacuggaugugacaacauguucaugagcugccccaguggagaggcuucaaggcuguguggggaaguuuccccuucaccaccagagcucacugguacugacuucacggaguucuugccuuuucggcuaacauucauguuguccaguuuuaccaauaagucccagaagucuguacagaugccacugcuggaggacugugaggagcaugggcugcaggccugcuuacugccccguucccgaucacucucacaguuuguuucuuugguccgcugcuguguaaaguggcugggaaacaccugcagggaaaagaauagguucgaucuaaggagucucuguaaaggauaagccugacaggaaaagacaauugcuucucagacuauuccuuuuccagcucugcuaauacaagacagauggauuauaugacuucuauccaguagauggugaagcagccuaaaaaaauaaggacuuugaagcaagacaaaauuaaaaaucuuucuaaaucuuuugucucucugcacuuaaugaaacaaggagaacgacacaaaguauuaaaugaggugaugcauuuugccuggugccuaguacaggugggcccccaauacauaguagcacuguuuauuauucaaaaaauacugagcuugucacuuucuagucaaacgacaaagccacuaaagugcucugaaucucagcuucuuuaucuguaaaacaagaaucauauagaguguaaacaguuguuucgaugacugagauaguacauuaaaaauuguaaagaacagagauaaaacuccaugaaguuauuuauuggacaauuucucagaaacagcaaauggcacaauauaaaauaaaucaacaaagagaucuguuagcccuuuacuguccagaucucacccaagguguugaugcccaaaaaacccuggggucaaggauuccuucaagcuccucaccuuggccaacugaaugaguguauccaaaacaugucugcaaacaacaggagcagccuggggguggauguggacaguggaaccacugcuugcaugcuucucuguauguuuacgcccuccagaacguugaaucuggaauauguuaguccuacagccuaaagcagcauccauugauacugagagccaggagagcugauuggaacuuuuggacuccaucuuguggagcagauccaggggacgguucucaugacugcuugaugcacagcucuugcuugauuucuugccccuuucuucacuuguggagagcuuaggugucucaaugcauaacucacuuucacugcugcgcugcaaaauggacaggaggcugcggaugacccaguggcgggucugggcaugauagcagagauuucucaguacucgguguagacggcuaguauugagcuuuggcucauccacaaaaaguaggaccaagaggcaagacagggcuucauggucuagaaggagucguccucggaggcggaguaguguguccacauuacugccagaaggccuggaaacagagcaugguuucuggguaacacuagcuaaagcacuaggaucaguauaugagguacaugagagaagaacgagugggauaaucccaggaagacuguaaaagaagacaaaacaauccacagcaacaagucuauuguguaucuaucauauaccagguacuuuacaacuucuuucccugaaggauguuguacagcauuauugagacugugagugaaaaaagcucaaacaaaucagauaauuugcucuuuauuacaugacuaugaagagagcagagauucauauuuuuaucauuuacuaagugaugaaaaucuaaggucuaugagccacagcuugcuuuuugccuuuucuagauuaaggagcugccauucuuuuauaaggacugaucuuuucuauaauuguuuuagaauguuaaaucuacugugcuucauccuaguuagucguaaguaacuccuccccuauuucuguagcauaucuguugcaguccuaaggccaaacaggccuccacuauuuuguuaaaaccauaacuaguaucugcugcuagccugccuuuuugagcuguggcacuuggaauuuaaacagauuuugcuugucuacucauuucaaggaaaauagcccagaauggucauccuggccgccacaaaaucuuuuagcuucucuacuuacaaaauuaagggacucagaagguaguauagugagguuuaaaaaaaaaaagacaaggguaccuauuauggcugcugcuaccccccaucuggaaggugccaccccucuguacagcaaggcgaguauacuggaccccacgguugccacucaggcgacugguaaaagcuacaagaaaagaaaaaggaaacugaauuuggugaacugaggagaaacuggguucaaacaacuaacagguaguaaaggaggcuaauuaaaaaacaaggccaagcaagauauuccagagcccucccacuugccucccuguguacccgggcuucggagaauggcagagagugcagaaguacuacuguguccaaaaagacgcucaugcaugagcugccgcugucgggcuucuuguucucgucuuagagcuugagccucagcugcaaugucagguggcaucacagcuaacacacugucuuccauauccucuaggacacuacggcgcagaucugagggcaaagucugaaugaaagucacaggguccaugggggugucugagcucgcauucugagccaguucccgucgcugcuguucagcucucugcugugcuagcaccuauagaagaaaagaaaucaguaagaguauagcucuuuucaagcuaaaacuguucucaccauguucccgcuuacauacuuccucuugaauagcuggagguagggcagccaggaacucagggcucacuucaguuacaccaggguuccccacuacugcaggagcugagcuauuugaggagggagcacuucggguugguggacguaugcccagcugguucuguaggacuucccgacggauaucaucagggagagcagccagaaaggagggauccacaccuucagggagacugauaccuaaagagauuguaagauguaaaggaacuuacaucuucauggauguucaaagguauacucagagaaaagaaacacaaaucauggguugaggaaaaucagccauuuguguuuccacugcuugcaaagauauagagaagagccauaacccaucuuccuaagcuucaaauaguucaacagcucaaauaaauuuaaaaaguucauuagugguauacacugucaagucaaccuuuauaaagacuuucauguagauuguguguggccaccauuauauaguagucucuuacuacagagaccaagaaacaacugaccaaagacugaaaacucuguaacugugagcuaagcuuaucguuucuuuuaaaaguuggcuauuucagacauuugauucagcaauggaaaacugacuaacauaguguuugucaaugaggauuagagauauuaaauaaugguccuauuuuauaaaaguagagaaugagugagcuaaggcuaaccugacuucuaagccugaacucauuccauuacgcgcaacaccugcauccucuuauugcuagucuaucuucaacaacccccacccccgacucacacaccgaccuggaggaaaguguuuggaggguuaugucuguccaagcaaugauuuuuuuggaaacagaaacuuaccagcaaggggaucuucuucuucacugcuuguugaagguaguggcucuucuagaauuccacgagaaucugcuccagagauggccacggcagaaucucuaguggaagaacucuccgaggaugcagggggggagcuagggaaagaaaucauccuucuuuauacaguuuccccauaaaaagcaaacacaaaccaaacaacaaaaacauuccuaauacccaucucagauagaacacaucaaucacagugcaacaagcaugccugauaguguuuagcuugaaauaacuucuaaugcauuccuaaucuccucuuggcuauauaguacuuaccuguccucagguggcugguuggauucucuugauacaucaggucugccuugcacuucugccacaacugauggcgcauccccaggaguggaacuaccugcugugggcugcucagaacugccagcugcuggagugucacccacagccucuucuaacguacaggaagccaggcugcugguguccaugggagaaccuuccagcugacugcugacagcuguuaacgcgucugaaucuucagcucucucuggggaaagagaggcuagaaggaaguuaagagugagaaauuagauggcuacuuugaaucaagguuaugacaggcaaagucuuugguaggguuguuuccuuuugcaacaguuaauacagacucaucuaccacuugauuaucuauugcccacucuuccaucucaacugcccuuaaguuccuuaagacuuuucuauguaccacacguuuguucuacacacgucuacaaugucccuagauaucugaaguagggauuuuguuacucuaauguuuccugcagguaccaguuacacaaacaugcuaguggucucaguuaucuaaaaaaaaaaaggcucuuguaaugguuacugucuugugaugguuauguugugaucaucaacuugaccaaaucuaauauugccuaggacaugggccuuugaaaaaacaucauuugggaauuagcacucccagggacccugggcuguuuaacuggagaaggggcacugagaagcaugcauguauuguuuuaugaauaaugauaugugaccagcucccugaaguuucugcugugacucuucccgcuaugauagaauauaaccucaaagugugaguaaaauaaacccuucuucccuuaaaauuaugucagauuauuuuaucacagcaacaggaaaagaaauugugacagucccugacaaaaacaaacaaaacuggcaucuuuaaaaaaaaucucuccaguccacagcauagaaauuaugguauagugaagucaguuucaguuugccuuguuaaaaaaaaguauuuuguugaaaauuuugaugcacuauuuuaaauaagugagcaguagguauguaaaugauaggaaaacugaaugauauagaauuucaguuuaugaaugaaggcaccaccaacucugaaacauuauuuucaaagaaguuaaauaacaaaccugacaugauaguuaguucagaaaugaguauugccuagauaaauuauggcaugcuuaguacuuaucauuaagauauacaacaauaauuaacugaggacacaaagaagaaaucugagcuucuacuaagaaagcuggaguguaaacugaggauucugagcuccuaauucuuuaaaguaagaaagcagagaaaaguuacaaagauugcaauucuuuucuuuuuuaugcccuuuuaaagaugacauucuacucacuuauggugggagcuggagacaauuccauuugaguuguuucugcuucuccacuuggucuugugggacccaauuccuccaacucuauaggcaucaauagcuguguagaguuugccacuucuucagcaggggacuguaguuccugaggaaucucuccuaaggaugguggggguggaagugcuggcuguugcugggaggguuguaggguaccaaguguuuccuuggacucagauguaggugcauccguugaagaggggguuguuggauagcugucaggcauaggagucccaucuuuauuggaaagaaugauauucgagguuaaggggaacuuagcgaaugaccaugggaagaauccaaucagcacaugcagccugguaaggacccauucaaauaaaagucaugaaaaucuuucucaaaucaaucuguucccagaaacaguucuuggauggcauaucauaauaaugagggcuaaauaacaauacuaucuguaucucaacaccagagauaugacucuaaugaucuagagaguacaauccuuucuauguuccagguagaagggaacaguugcauaccauagauaggucaaggcuacucagaaaaaaaaaaaaaccuccuaaaagcuuauagauccuuacauuuccugaucuacuuggaacaagaaauggucagaauuuauucauaauucuacauuccugcuguuguuuacagacagggucucaugcagccuaggcuaacacugagcucacgcuaaagccaaggcuguccucgaauguuugcuuuucuugccucugccuauaaaguuuuagaacugcaaaaguaugaaccaacaugccuugcuucuuauuaaaaaaauuccuacaguuuccauucauauucuucauauucauauucuaaaugaaguuaucauagaaucaaagaguagaagaauguccaguuuauacucaaugguaaaauaaacauaauaauguucuaauauaugggcaagucauuuaacauuauuugccucacucuaucaucuguucccuuccaccuuccuuuauuauauuccuguuuacugaauaaacauuuacaacuuuucucuaauggagucaauacugccaagacuuaaugugaauaugccacacaccaaggaaaguaguaaguuguauaguuaucuucuuacuggggccuaaaaucccuaccccacaacaauacaacuuacuaccucaccccagcaugugcagaugugucuaguaagggcaguaggcaaaaggccacuuuaccuuguagcauagauucuuucuuucauauacuuuugcuagauauuaagagcgcugggacagcuauucucuucagugcuuuuaaaauauuauguaggcuuugguaaaacaagucucccaauucaagggcagaagaaaguucugaauagauaugaggcaagcaugagaccacauugaccaaugacaaaaaugguuacugaccauuguuaagaugauuagaaggaaugagaaguauauguauguaauguauguauguauguauguguguguauauauauaucccacaaagcuaugauccccaaaaccccacuuuuaaaagacaauguucuuaaaacuuuuaaauuccauagaccacuaagauuuuagauuaagaaugaaaaggacuaaacuaggcauuacuuuugguuuuguaagaaaaaacccccaauaauuuaguaacaauaguuuguuauccaagaucuaggagaauauaacuucuaaauauaaaagacuuuugaauggaacaaaucuagcucuaaaacacauauuagacuucccuguguuaauuuucauugaggacuggcaacugagaaccacugccaccagguguucuaaugaagugccauacaaaaguauguaccucaaagauguauauaccgagugugugggggaaaagaacaagauaaauagcuuguguacauaucagaccgaaacacagcauaaccguaacaggaacuugaacagggcuaguuggaugggaaguguaccaccgugggaaagacaguagacuguauaguuaucuccaagaugggguaugacccuaaaacuauacaaucuacuaccucaucccacagagcaccagugucugucuucagcccauguggccagcuauuuagaaagaauccacugauuaauuagcaagaguggaagggagggaggguuaccugagacauucuguucaguggagucauuugucuuaguuacaguacacugcaaagagaagagagaguaaugggagacaagcacacaagaaaggucaaauaugagagucauuauuucuuaccuagacuaucaaggaauucaguggccuggccaugugggcauuucagaauacaaaauauuauccaauuccuuuacauacacuauacuaauguucaacagcuuuggagaggacuuggggaauacaggccagcuggagaguucaaaaguuuaccaugugugagguccuaguuuuuuaucucuagcaacacacuagaaagaaugcacuagguuacauaaagacaaaaguaugggagugagcaggaaaugaacaaugaaagaauaaaaaaagaacacauuagaaauaagcacaauugugagacaggaaacucuuagcuccaccuauuucccuucuuuggguuuauuauuuuuuccacucuagcuuuguuuugggguauugcuuuggaucaaaccaugcacaugccacugagcuauaauccaauguccauuuuaguuuuuagucauauacaauguugcugguuuuaaggcaaaguuuuauauaaauaaaaguauuuguuagagcaagccuguuauuauaaacaaauaccucaaugugucugcacuaauuuuagcauguuaggaaucaaaccuggaccuuguacagacuggaagagugcccuaucacuaagcuauacccucaauauuaaugcacccccccauuucuuugcauguguagcaguaugugccuacauauaaguaaguggguuuggcuuauauagagcaagcacauuaccacugauucaaucccaguacauuuuaguuuuuuuuuuuuuuuuuuugccuuauuauuuugggguaagagcucucugaacugaaccugguauuuguggcgauuuuuuguuuuguuuuguuuuguuuaggcugaaaacaaagaaacuccagggaacuggaguuagguuuuuuuaacgagacaggguuucucuguauagcccugguuguccuguaacucacucuggagaccaggccugccucugccucccaagugcugggauuaaaggcaugcaccaccacaccuggauugaaguuaguuuuaagcuguuacauuggugggaaugaaacugugguuaucucuagccccucaugucuuuauuuuuaauuuacccaauaaggagccagauaggucaaagauaccacaagaaaaccuacagaaucaaauaaccugggcccagaggggcugaaacuaggucccuccacauaucuaacagauauacagcuuggucuugugggagaagcaggggcuguuccuuacucuguugucugccuuuggcugccuuaucuagccucaacagaagaugcaucuaguccuacagcaauuugauauagcaagguggguugauauccauuggcagccuccuguuuucugaggagaaagggauaagagaagagggagggacugcgaggagaggagggaggggaagcuuugauugguaugcaaauaaagaaaaaaauuacccaauauccuaauagaugaaugagugggacauacuacagccuucauucuuuuuuguguuucuauuagcuuuuauguauauacauuaguuguuugguaauagaguucaggugggaaaauuuucuggaaguccacugugaaauggaagugagaaccaagaaugugagcugagugagagucuaccuuuaggccucagaaagaguuuacaaaguaggacuauuguauaagguucacauuuccccaguaagguaguggagaaauaauuuaccucuggguuugacuuuuuuuucuuuuugccuaaaaaccagaugaguaaauagucaaucuggaaaugaacaaucuuucauguucaacguaauguucuagaauuuucuaguaguuuaguacuaugagcagggcaaaaucauaauaaauacaaaaugcugcaucucuuaagucuuuuggagucaccucaccugugcacucugaucucuguucuccuugucuucuuugccuuugucuauuauuuuuguuucuuccucagccaauuguuuccugcguuucucccuucucucuucuagcuccucaucucucaagaauuccaggugauugacaaugggcacuuuaaccacuacaagaaaaagguaaaaaucagaggcuacuuuggaaagguugagaaguagagaggcagaguuaauagccagagaaucaaaaacaacucucugcauacucauucuagccggaaggcucauuacuacccugauauucaaguugucacagaccugaaacacagucaugcauacucucagcaucaagaacuuugcauuccucuguccaucggguuagagcuguugggaugcuggacaggguuccuauaagagaacaaaauaaagugaaauucuuggcuuuaugaaguguugauugaccuaaaaacugcauuauuuuccuaaaagaacccauggucugccacaaguuuugcuacauaacagguacccagaggcaacagaguuguuguccuuggcuaagucaccaagugguuuuggcuccuauaaaauguaguuucuccaagaaagagacuacucuucuucuuaggacugaagaagaaucaaagaacucuauccucccucuuacugaauaaacuugccugcuuggcuaguggcuguacucuggucaugaaaaaagucauccagcagcucgucaucagaccuggcgaugauauggacgucaucauugcccacuaggaggcgggcccggccucggcuuuguaauggaaggcugcugcucagcugaagaaugucagcagcugcagagggaccaagcaaccuguaggguaaugguaagguaccacuuucacuuucaaguccacagaagucuguuaaccaugagaucgagcauguacaucuaguaaacuuauaggauuauggguagauuuuaaucauacugaaccuaaaccuuuacuaccauucuuauuagcaugucaguuugauaacuucgagauugaacugcauauuauucuuuaguuaguuccuugaacacuaggaagcuuugauaugcuagguaccauguuagguauuaaugccuuuguuguacaccuuuauaaggcacuuauauucacucuuucauuuuaaaauuguuucacuuacuaugggucacacaaccuuauuuaugagggacuguuuauccuuauggucaagacaauguugaaguucaguuauaauucuuaagagcuucauugaauccaacuucucauugauucugcuucaacacaaacucaccucuggaguauaagaggaggguuaggcuggcgauucccaggguagugaacaugaaugguauggccuguauuggcagugagcugucugaggguccuuugacugcgaccgaugcccuggguaagacgaguuguggaagaaccacugcccagugucagggaacugugaucugcaugacguaccaucaaugggugggugguagggauauuuccuggggaugggggaaugucugcugcaaggaaaauaugcaaaaggggucagugccaaaaauaaauuucuuccauggcuguucauguguagaaccaugucuccugggcuuugcucacauggaaaugugaucuuuuuccuuucucccucauucucacaccuaauucaggaucugauacaaccauagguuaugccaccaccucaauguaauccuaccuuuucccagcccacuuucaagacaacagugaugucucuaggcacuucagaugcuggccccuuggccuagaagacucugcuucccuuccucaccuguucuuuuguucucaguccaagauguuacuucuaaagucuaacaggucagguuagauauaccuuuacucugugcauuagcauacuaaauguggugucuucuuacuuauaauuccuuacagaccauaaguuccuauagaggguaaaaacuccuguuuuucuuuaccaccuuauccccaguaccaaggacugguaggcacaucucagauauucauucauuuuguugaauggacaaaggcucaaauaaaaggaagguugacgaaaaccgcaaaaauucuaagaguaucauagaagauaucuugaaaauuaucuacugcucauuuuguuuuucucuucaugcuuuucauuuacaggugacaaacugaggcucagagguaaaagauuauggccaagacaacagaccaaaacuguuaaaaguguuuucagcuauauuaugcuugugauuugagguaagaccugucccaugaagacagcuugaggcuaagaacucgucgcuacaaaggaacguugauguugauagaaaaggaguggagagauucauuuucucuccggaucaguuccauccaugaugaacagugaauauauaaaauccacucccuaaugccaggcucagcgauguccauccaaaccuuugagauccagcguuacaaauaaaagauuauugauugcccugucacugcagugugauucaggugccucauguagucagacuuggucucauuuucucaaucaagcaaaacaucaaguuguccaggcucuaagagcucccuguuuacugagguggagauaguaagagcagccuccuccgauuccuucuugcaaggauauguaugcuauccagagagauggauucagacaucccuugaccugggaugucaagacaguaaaagaagugguguccucuaucagauugauggcugcuuuaguucugcuugguuuacccuagagaaggguauaagaaucaauagguaaaaacccagcugagccccuguaucuuacuagcacuggagaacauguugucaaacucaaugaugagaucauccucccggucaaagcgcucaaaucggaccaagggagaagcguucauaucaggguaauccucauccaauuccaucucagaaccaucgucgucaucaucuucaucuccuucuucaccuucaucauccuccuuaagggaaaauacgagauggagaauugcuggagguaaguguuuucugaagcuuggugucauggccacaugagcacaugagggagggaggcgacgaggcuagcuaguaacccagauuguccguuuuucuguaguucugugcucccauggaagaggucaucugaaccaacccaaacacaguccccccucaccugaucaucuuccucaucuuccuccuccuccuccucuucauccugacuaucauccucauccucguuacugccacugcuguccucuuccugaguauguuccuccucauccucaggguccaggauauucauggaaucuaaaacaaagggagcacauuggaggacuauacugaguagcuagaaaacaggccacugugcaggccggcagacugagugggaaggcgaugggguaucugacucuaagagaggaagaaucagaucuagggugguguacagacuuagugagccagcccaaauuuccugagagugccaauuaaugcaucgacacgcugagcaggguugcugaaauguggaagcuggcuccagggaggugcuugaggagccacgauguagggcuugaccaagucuguugguguccccuugccuuuccaguccuauuuugcuagugacugcauccuguugauaagagggaaucuggagcgaugacagcaggugggugagaagaaagcgaaccaaguaagaagugacaaacuuugggcaagcaguaguaaaacguuauuugaaaaacuggcugaggauaaaguggaugguguaugucagcgcaugcagacagaugcuuccuuauucugcacaugugggcagcugccuccaggaaaacccuaguguagugucugucagacgugcagggcaagaagggaggccuuuuuggccucggcacucucaccuucucgguuggccugcaagguggaagcuuggcugagguuggaaggagcuucauccaucagcacguccucuugugauucauccucuccacuucugcucacugaagguuacagagcagagccuucacugaacaacagaggacuucccuuuccagacugggugcgucuaaguagcuauguacaccuaauagauauccacguuugauuuuucuccuuuuucuuuuuccgaugagggagaauaccucgauucucugcugucaacuaucuagaugagcuuggccagucacuuuaccugucugagucucaguuuccucaucuguaaaauggaacgaucacaucugucuugccaaucccacuaauugugcaaucacagaguacgauggaugugaaaaagcuuuguaucuuuuaagaauacaugccuaguuccauuaauccuuugguuuucuugaccaguaaaauaaaaauauaaacaccuucacagugagguggcagcugguuuguuuaccuuugucauuuuccauuugagacuuaaaaggggccauccuuaaggaaugaccacucuuuuuuacauuuuaagacacaaaggcaaaaagccccuggauuucauugaagaacugaaagaaaagcauuuucucauccuacagccucuucuaggccuccaugaauaaacacuuuuggugugccugauguuaucaucuauacugauuguuacccucaccgccacccgacauacacaacacuucagaccuguuacaggccuauaaacaacuuguuaauuucuuuucuguuaagaucaucaacaucaagacaagcagcaaucuaggcuggcuaugagcccuuaggcagagcugagcaagcagaugaugagaaaaaugguccucccaagagagacugagacaaaggaagaggcuuuacucaguucuggggcucucaccuauaauuguacuguucccagauccgccaucccucucaagcaacucaucuaucagguccuccaguucauuuucaaccuggagagaaagagaacauacauauggaugcacacaacaagucuaucauugugcuagcacggaaacccuuuuauaaagccagcaagggagcauauguuucuauaauaugugauaggauguuacacagaaaccacauaauuggugcuauuaacacagagccuaccacaugcuuccaauaaauccacacucacacugucuguauccuggucaacaaauaccagguuaguguuuuaacacugucuaggaauacaugcagaucacauuagagccagcagcuaagguucacaggcacaauuuauuagauuuuuuuccauuuacauuucaaaugcuauccccuuuccuaguuuccucucugaaaguccccuauacccacccuccccccgcccugcuccccaacccaccuacucccacuuccuggcccuggcauuccccuguauuggggcauauaaucuuugcgagaccaagggccucuccucccauaaauggccuacuuggccauccucugcuauauacaggaacaauuucuuacccacugcuaccaaauuaccaugcuuucuuuaaaauccuuagaagacugguauuuaaauacuccagugagaucugguggcauggcauaagauagcgcuaaguaacuuucaauaaugaucagagccaaguaaaucaaagaaaccauacccaaagggcucuguccccagccccauuuuaacuaaaacaauuuaaacacauguuaagcauucugugcuccucugaagaccacauugaggcaagaucuaaaguacucacccacccacaacacuugggaguuugguucagcaccgcaacagaagaauguuggaaugaucugccucccuaccugcaucucuugugaacugagcaccucaggcugcccggcaaucaccacugagucgguuucagccuccccauccaugauauccccaucugccaccucugucugagugacaucaugauccuccuccugcacuucugccuccccaggcucgccugaaacaaucaaccaaccagcacaauaaauaaucaaaagguguuuauaugcugggcaucaugaggcaagcaugaacacagugauuugucuuuaggcaaauuuacaaauucucagaguauaaauauaaaugaaugugugaugaagaaaaagacuuggcuucaugugaggauagccaaacaaagcuguaaugugaagaaauuccuugugggacagauuuccacaccauuaugacagauaucugcaagaccagcaaguucccggguaaacaacaauaagcuagaacaguuuaauuccacaagcaacaacucccacccauccaguuuuugcaguccauucauucugauucccuaccuggaucuugcugauggcugcuggaguccugagaagcuccuugagcauccugcucagacuuguucuugcuagaagcacucuugcugccaaaaaggcuacuggguugauuuacaauccgggaaaguguuuccaaggguuuuagagcagcauugacuguguuggccauauugggacugagauaaagaaagauacaagaacuaaggauagaaauaauaggugccaaucucauaagcauacagguucuuauaauggaagcuaagagagaaaagggcgcaaagucuagaauuuucaacuuuccauuaaguuuaagaauaaaacccaguaaagcaaaaguuaagucgaugucauauuucaugaagcuaugacaagcacaugagaaauccuugaguagaagccagaauaaauucuggaugacuacaaauaucaauacuucuuagauuaucaaggaaaaaaaaacccagacccauuccaacuaauuaaccaaacaaaaacaucuccaaacuccuuuauuuugucuuuaaucguuuuuuuugggacagccucauguaguuacagcucaggcuagucaaagucucuaugaagacagugaacuucugauucuccuuacaaauuccaaguacugggauuauagauauaugcuaccacacaccuauuuuagucuuuaaaaacacaaugaccacuuuuaagucuacaaaauguaggauuuauagaguucagugaaaauaucauaguauuugcagguagagauguaacaugaggcuaaguugggcaccacugaaacuagagaggucauguggauccuguagaucuggccacaaucucugauaccaacuaacacuaaagugaaccaaagcucauggacaucacaaaugagguugggauaucauuauaucagaaaguuuucaaaaaaauaaaaggaauaugaacuguuuaaguaacaagaauacugaugagagagugaugaaugaacuuauggugauaaggauauaaaaggauuguuuaaucauugaaggcuaguugacccacauaucauauuauuauuguuuuuuuuuucuuaaaauguuuaacuuguauuauuuacauaauggggaaaucacauauagacucaggcaaucaucuguaacacauuuacccugaauucuucagcauugucaaaagugcaaagaaaagcaauaguuuuuuuuguuugagacuguuuuaugcagcuccaggugggccuugaauucuuggucccuuuucuucugccuucugugugcuagaguuauagcuauuugccaccaaccuugauuuaugcaacauuggggaucaaaucuacaaaugaagauauagugcugccuaggcuuuuugacaacaaaaugucauacaugaucuucauuuggauccuggaucaaaacacacucccaaggcuguugaagggacaauuaaaauaacugggaacauaugaauauagaucagagagaauaugauuauuaagcaucauauagcaagcuuuuaggauauaaauguuucaucuuuaggaauaauugcuuaguauuuggaguuaaauaguauguuuuaaaaaauuaauuucuaagaacugagcuccagaaaaucaaaacacauauggaacaaaaguguuaccaagauguaacuauagacuuauaccauuaaaugacuugaguuuggaagcuuaaaaaaaugguaguguuagggagugcuguuaauaaguguuauuauugagcuuaaccugaguuugaagaauuuagacaauuaaaaaaauuuaauguuagcugugcaugauauguguauacaugaaauuuuaguacuuggugggaaggcugagacaaaacaacugcugagauuguagguuccagcuuaguagucagucuuaacaaggauuacuaaugguagguggaaaaaaaaaaaaaaacaaacaagccccguggccgggugugguggcacaugccuuuaauccaagcacucaggaggcagaggcaggcagauuucugaguuugaggccagccugggcuauacagagaaacccugucuccaaaaaacaaaaaaccaacccuguguuuccacaugauauagucuggguuuaagacagguauaaguuguugcaguaguuuggcuaaauuacacugcaaggcagcaacuccaccaaaucuagaaggcaagacuuuuguagaaaagcagucaucauuucagaaaguaucaagaauaacauuaaaaccaacuaaaaucuauccacuuuuaguacagacaucauaauuuucaccuacaucugaugcuuucuuacgagagcagcugauuccuuaccaaccacaggauauuacuuuaccuggacaggucuaggcugugaggaacucuggccaggucauugacuagucccuucuuuaggaacagucgaaugauguuguucaugccauuaugcugagucuuggcuguagcacuacuguagaagcuggagguggaggggcaggauuccaugauaguacugaugauacacaucacugccugaagucugggagagaaguuugauaccucugucaagugaauacagcccauuuguaaaagaugucuuuacuauauauaaugccuuagauaauucucuuaugccuuuugcauuuucuucuggaaauaauaucuacaaagagaauuaccuuucuaguuaguagacuuuguuuacuacagaaaauuuaaaaucucaauuuugugucugaauauagcgaaaaauaucccuucgauuuuucuaaguugcaauaucuacuucaauugaccauggguaccagacauucuauguacauuguuggugugaacacaacucuuguucaaguucaaggaacuccuuagaccauggaguaaaagauguucuuguuuaucaguacuaggccagacaugggcuuuuaccuggcgugcuucucuguacucucagccauagcaagcgcccgucccagggcugcuuucacuucauucacuagggccacuugagcaucugugccacuccccgcagcagccagacuugcaaggaauagacgugccagggcagguguauccuugucuucugcauucugggugugugggaggaggugguccaggacaaaagcuagcacacugcaguccugaaaagucauuaauuaugacauuuacucaaaagugcaauuaauccacaccauaccuauaauagcaaaguagaaacuuuuucuuucaagucauccaagguacaagcuagguaaguagugaaccaauuagaaaucuuuaagaggcuguauaaagcuuccagauuccaucuauuucuuaccacauggcacagacagucauggaauuaucauguugcuuucuacuuuuuaucuuugagauguggccucucacacaguuuagcucgucuuggaacuuguuauauagacgacuguggccacuaagucucccuagugcuaggauuaaagaugugccaccacaccaccacagguaacaauacuugauauaucuuaauaauaaaaaaucugaggcugggaaucauauagccuagccuaggcuagcuugguagacuuucuagaguacugggauuccgggagacagcuaacaccauuguauucguaacaacaacaaaaaaauauuuauuuuauuuaugugagcgcacuguugcugucuucagacacaccagaggaggcauugggaucucaauacagaugguugugagccaccaugugguugcugagaauugaccucucagaaccucuaaaagagcagcuagugcucuuaaccacugagcuaucuuuccagcccauguauuugagugacuuuaauggaguugauuauaacaagccaauaaaauagacugaaguaaaucaagcauuuucuccauuugagaggagaauaaucugagaccuaaagaaaaguagcuugcacuaagaauuuagucaaggguagaggauucaaacauccauuuuuguauucuauaauuccuuuuaacacuugcaaugugccugagacccuguacugaaaacugggagcggaaugaaauauagaaucaccuaaaaauugcaaaagggucuaacaaggaagacggacccuucuuuuacucuauaauuucugcucugauuuuuaggaaaagaauuagguucuauuuuucagguagauuuugggaguaagaaguaauagcuguguaacacuuuaaaugucacucaacucacacuuuuuaauaaugauuuuaugucaaauuuauaucaauaaguaggguauacuucaggacucuagagauuggagaacuggacaaacucaaccucaaugaaauacaaagcuaaaacuucuugaaucuuaguaaugucauauaguacaauaugaaaagaauuucaauguaaccacacaacaagcacuuagcuuagaaucaaagacaaggguuucaauuuucauucuggcccuauacagugugcccucacuuguaucucugaaucuuaucucuuaacucuaaggagauacuucuacuaauaacucuaaaguggaguugucauaucaauguuauuuauaaaccaccuugccacaccuauaauauguuuggguaaguuauaagcaggauaccgaauacauuuauaguuaaauguuuuguuccauaaauuaggaauaaaacauaugaauauaaacuuugauaugaaaccaaguauauacacguugaauguauguaugacaaaaagggcucacauauacaauguauaaggaaucuaaugaaacacuugaagccaaguguuaacuggcauucaagcauaguuccagcuauucuugagaguggcucaggaugguaagauugggcccaggaauuuaaggccaacaaaagagucucaccacuaaccaaccaacccuuuuucaauaaccaaaaaacauuaaaauauggccaauaagaaaaugcaaauccuaaccacaaaacuacuaacaaaccaacuggaacaaauaaaaugaaauaugugauggcauaaggugagacaaucagaacucucauaaacuacuagaauauacacccugguaaacuucagguagcaucuguuaaagcuauauaaauucauguucuagagcucagcaauaauauucuuaagccuacaucaccaaagagauaugcaucuguauaauuuacauagcaauacuacaguguuagugacaaacagaaaaaugacucaaauaaagaagaaucuaaaaauuugucaagccaaacaagauacaaaagauuucaucaacuguuuccuugcaguuacucugauugcuucacaucauggugaaaagacuagcuuuccuuucaaugaguauuauaguuuccaacacagucuaggauauaaccaaaauaucaaagaaagaaaaaacuguaaauauuaccucuuugaucagcucagacuggcccacgguauagcuguaguuugcaaucaggguagcaauaccaacauaggaccucaccaacucugccagaagacgaaggauaguagagguaggcauuaaagguuugcugcccuugcuuuucugcuugccuuccucagauguacgguccccuucuuuaucuuucuucccuucucgagucuccucuggaguugaagcuccugagaaaacagguaaacacucaauuuuacacuggaauaacauuaaaaaccaagccacagguagaaugaagacaguauuucuucauuuuaggccacuuguacaaaucacuaauuaccacuguaguuaaaugacaaagaugaugaauaugcauaagacauaguaggaaggcuuggaccaaacauccaggcacccacuauuuccugauguuuaugcaauuucauguccuagaaauaaugaauuaguaguaauucuuuaaauauccaucuccuuucuuuugccuacuacacacuaugcaauucaacucaagugccaucuagauacauauggaaauauuggucucucuauaucucauggaaguauguguucauuccauuaguuacaauuguugccgucucccucauuugacaaaauucuuaagcuguagguaggcauccaauauagcaugccacauacuaagggcaaagacaguuuucuuugacuaauaugcuguuaguaaggccaguaaaauaacuuagcaauuauccuauugauguuauuuuuaauuguauguggauauguguaugagcaaagaugccccaaaaagcuaugagccaccagaaauaguguugggaaaagaauucggguacucugcaagaacaaauauggguuagagcucuuaaucauuacaauccaagcuucugaggaagccauuauuucaaugacugguugauuguaagugacauguggcuuuuaagaacugaacucagguccuguggaagguaagauagcuuacuuucucaccuuuuaaucucuuggaacuaguauauuaaccgaagugucuccuaaauuuuauuuuuaaagcucuauuaaaggaaucaacuacaaaaaguguauugcuauaaucaugucaauggcacaaacacuaugcaagccagcucaugggaaucgaacaaaaggacauauggacuaguacaaauaauacaaccaaaggacaucauuauagcaacauuagcaaguuaaugcaaauuacaguucuauuaacuucagcagccuauaccugcagaagaucagacacagcccuuagaaaucacuuagaugaguaaacaaauguaaauaugacacugacaccuauuauucuacucuagugcagagacaaccaguuucuuuaaguguucuuugcagcaaauaauaaagaaaggcaaauuauuacccucuccuugggagguuccaguuguggaaguuucagcaggggcaccaucugcagcaaaaaccugacucugaaagaauacaugugagcugugaugaauacaaguguuaugacuccuuuuacaaguaaugucugagaaugcuacagauucuucuuaguugaucuuucaaccacauucucccuauaaucuauaggaagcuaucacaguuuucagacuagucaaguucaaaagaaaaaacaaaaacaaaaaacaaaaucaaaaguaaaaaugccuaauauaccuuacuuuucugcaauaaauaauuuacacauauauuaaaauuaauacuuuuucuaaaaacagggucucaguauguaauccaaggugguuuugaauucauaaaaaccugcuuacgucugucuccugaaugcugggaucaauuaaaggugcgaaccaucauacugacaaaacuuauacuuuuaaagcuuccuuuggauaacccaagauacugagaaaguaggagcaguggaaagagaaggaaaauauaggacagcugaaauugacuuacauuuaaggaaaaaccugacuguguaucaaagucacugcucugacgaguaagugaccgguacugcugguauacaucgucacccaugucuugcaggagcuggccaaccucuugggucguucccccagguuuaggaucagauuugucugcuagaaaaauauaaacaaacaucuaaauuaaaauaugguccuuuaauugugcaauauuagcacaauguucauagggcugcauuuaagaguacuagugcaauaauuauguuguagaaccaacaaaacuauugguauauacaauauaaccuauguuuauagcacgguauaccaccaaguuaguuuugagcaaaugaccuuuauguuuacacaucaguuaaugcauuucucaaaauguaugccuaucauuacugacagagcaugguuguuauuccaacauuaauuagucuuaugaccaaagcaguucauuagucuuacauuuuuaaacugucacuaucaagcccccaacgaacauauuuagugcaaaaggcuuguauaauaugaggccagucaauagguacaucaauuagagcuaaaucauuguagauggaguaaugauauggggauaggaggaaaggaucagaauauuguaaagaugaauaaaaccaaaugaaagucucacauuguucuacaguuauuaugaucacugcucauuucacuauuuauagccugaauaaaacuuaaaagcauggcuggauuagaaccuuggguuugaagcaaaucaaacauaauuuuccaaucauucacauguaaaggaggauuaggauggaggucugaaaaggaagccaugucacacuaauaauauacuuuuugcuuuuggguauaaaagaauaaaaaaaaauuugggaagccggagagaugguucagugguuaagagcacugacugcucuuccagagguccugaguucaauucccagcaaccacaugguggcucacacccauccauaaugagaucugacacccucuucuggaguguuugaagacagccacaguguacuuacauauauaauaaaaauauaucuuuaaaaaaauuuuugguauuugaucacacaaugcugugugaacaaauaccaagaacuuuuuguucacagcuuucuguuuaugguauauuauuuucucaaacaacagacacucuguaaacucuucaucaauaucauucaagaaccauuaucagaacagauuuacacacauuaucuuaaggacucaccauuauucucacaccucuuguauuuuauaguaaguaagucucuucagguguguauuauuugucauaauuguuuuuuaaugauuuaauuuuauguauguguguuugugcaugcacaucugugugcaggugacugcagugcccaggguauuggauccucugaaucuagagucacaagugguugagguuggcugaugugaaugcugggaaauugaauccugguuuucuacaagaguggcagguguucuuaccuucugggccauuuaugucaucccuaucauauucaccuuuugauuccaggacuguggguauaaugcuuacuaagccaugugcuagcugaaaugauucaugcgagauaauauagccuucagaacaccaauugcagauacauaccuuccucuggagcaugguaugcagccaaagcauucagcauaucauagauaacuuccuuaauaguaucaggaaugacaggcagagaugagggcuucaaagguguugucuuuaccagcuguacagcauuaggaccuuuaauucuaagauucucaaauucaucaucugaagcuaggccaaaauuaaacaguaaagucagacaauagaacacugguauucacuaucaacaagaaaguacccagaacaaggauuguguaguacauaaaaagcaggagaaauaauucuuuaaaaauuaaguucaagucuuauaguaaagaaaucuaccuuuuauaaacuauaaacaaauuuuguuuuguuuuuuuaaguuuuucaagacaggguuucucuguguagcucuggcuguccugaaacuaacucuguaggccaggcuggccuugaacucagaaauucaccugacucugccuccccaagugcugggauuaaaggcaugcgccaccacugcccggugaaauguuuuuauauuucaauaaacaaucucacaauuuuuuaaaugucuguaugaacuucugagaaacuucauauauccuacaagucuccuagaaauggauccagaauccaauccaaguagaagugaccguucucaucugcugagauacuucaauuuuuccuuucaauucguguuuaccauggguuuaggcuagcuguucaguaaaauauuuccauaauuugauauaaauguaauuacuuccucaaugaaauacaggcauuaacuuuuugguaagaauacagguagcacuguaaacuuuucauuggauucugucacccaaacaaacaauuguuuuucaaugaucgcacuauacagaaaccaacugcaguuaauuuaacuucuauugucacaucaaaaugaacacuuuguagguaaagacuagagugaauccuugggaguuguauuaagaggccaagagaaauuacugagaauuacauacagaauuuacuaagucaaaugcucaaccaaugucucaauaucugccuaaagagaauuuucugaaagaauaguagcaaaugaaacugaccaguuccugagccucgaggggcuggaagggcaaugcggauacagcaauuggcuacuucugugaauaugucuggauugcggcaggcagcugguccuaggacucuaaggauauaguugaucucccgagaaccgaggcugccagauacaacaccagauguaguacuaccagcuccacuuguggcugccgagcgaacaaccuaguaaaaagcauugucaauuuaaguaaugaaagauacgcuuguucuucaagacucuuuacaauuaaaauaagucucauauacaagucauaaagguuuucaaaacuaaauucuuacaugaauguuauugaggugcaucugauuacacaugcuauauagcuuccacauuuaaguguaggcucuaagacuccgcaaaugcugugauuuuaagcuauaauaguucaauuauauuuaacauaauagaacaauuucuucaugcuuuauuuagucaaucaucacuuugagaugacagcuaaaagagcuaucaaauuuauguauaguauccugcgauuaaaaacuuuuagaaauauauaaucuuuuggggauauuguauuuuaacaaacuacucauguuaucuaguauagcauauuguaauuguuagaagaucuggcuuaucuagccaguuauauuucuuaauuuaaaauacagaaguuuugcuuuauauguaaagccaugauuuauacuuuauacaguugucuacuccuugauauuagacuuguauuuucuugauauuauauucuauguauuuuuguauaaccaauauuuaucaugaggcaaaucuuuagcuauagauuauguagauguguaauggaaagaguguguacaguugcagagacacuaaauucaguugccagaacccaagaugaacagguuauaacaggcuauaacuccagcuccaggagaucuacuggacuuugagggcacuguacuuuuuuguacauacauaccaacaaauuuucagauuuggugcaguugcuuccuugcaguguaauuuagccaaacuacugcaacagcuuaaacagcuaaacuggucuuaaaccuagacuauaucauguggagacacagguuuuuuuuguuuguuuuugauuuuuugagacaggguuucucuguauagcucuggcuguccuggaaaucacuuuguagaccaggcuggccuugaacucagaaaucugccugccucugccuccugagugcugggauuaaaggcaugugccaccaagaaaguaaguuuaaaaaaaaauuucuagaagguucucuuacucugcaccaugaaacuguccuacaaugauguagccuuaccaauaaugccuuuugcuacuuaucuucuuuuguuccuguuguagucugcuucaauuuaauacuuaagucuuucaaagauucucuucauucaaucauguucuguauauacaucaccuuagcauuuuaaacauuuggguuuuuuaaagcccaaauucugucuauauguaacuauuucuucccccacugaccucaaauaugcugccuuaaacagcucuaagucucgugauuuuggacacgugaugcaaaaccaucuugaaggaagaauaaaaaauucuaauguuccaagaaagagggugaaaccuacuaauauuuauaugauuacugaaaaugauuuaguaagaagaauaagaauucagcaaaagucuuuaggagguacaaagauuugcugauuaagauauuuaucucuuaauuauacuuaauguaaauauuuuuauaauuuuuuucauuucuuccacugauauauucauuuaguucuaaaauauaagaaccuauuuucuaauuuuuacaaugguuaaaggcccaucagugcacaacauaccaggaacauuaaagaaaaaaaaaaaaaacaaauauacagacaggcacaagacuucaaaaauacugaccuuuuccauaguaugacgaagaguacaaggauccucaaugaugugccuuaagagaagggugacuaaggggguaaacccauugaaaccugagcucugggucaaauucaagaucauucguguacucuucaguucugcaaacaucauggcauauuuguggucucgggugagccuuaaacagagacgaaggguggcaugcaaagugucuggguccacagggacucccagcaugcucacacaggcacggauuagaacagucaccauaucuucugucaggcccuggauuaggaucuccccaauuuuuguuucauccaggcuugccucuuuuucaguguuugugcucucuagagcuaaggggauaucuacaaauuggaaaaaaaaaguguuuucaauuugacauuucacucgaucucucuccuuccaaaauaaucagccaucacuugagcugaaaaacacaccuaauucuaagaccagauguaaaggucuuaggaaaagaccaucucucugucucuuugaguuucagauaauaagccauacuaccuuaaaucauguuaauauaacucauaaugagggggcuggagauauggcucugugaauaagaucauguacagaagacugaguucaguucccagcucuacuguggggcagcucaugacuaucucuaaguccggcuuaaaggggacuugauauaaucuucuggccuccaaagguacuaaauacaauuaaacaaauccauucuuucagaguuaaaacaaaaaaaaggauuaaaaauaaaugcaugguacaaaaagugcacaccucuaauuccaacuacuugggugguugagguagaaggauuuugaaugagacuagcuugagcuauauauccagcaagagcaaccacuuacuuggaaggaaaaacaaaugcaaaauguaaggcacauaccauugccuuuauuuucuuuauguuugauaucggucuccuugcuuucuuccagugucuucucuaguuccuguccauugcugcuuuuugaguucuuacucagucguggcacccugaggagagucagcaucacagggcgucgguuuccuguuucuucauuaaccuaagaauucagacaaaacaaagcuguccuuaaaaaacaaaguccuacuccuuagccugagaggacuauccccuuuucaauaaaguuuacauuauaaguugagcauguaccugcaccauuguagugaacuggacaguguaucuucgucggccagcagugaaucuuacacuuguuucuccagauuuccaggcagaaucaauggugcuguuguugcuagcacuguaacuacaccaacgcccagagcggucaucaaaccagcgccaguuguugcuguuggacuguagguacuaaauaaaaugcaaaugcauaaaguaucuucauauuuccugcaacuuuuauugucaaaauaaucagcagcuaucaguagacagcugcuuaaaacuaaugcaggaaaaaaauguacugggcauuuaauauacuuucaagaggccuuucuucauuucuuggucuuuuuccaagccaaaaacccaugacaauuuccuaucuugacaaccuauucuuccuuuuguuuuaaauuaucuuugauaaaagaauuaugaucaugagagauauaaggaacaaaugcugcuaagaacuuacugagauauuauggaauacuacaaucuuuguuucaggaaaauauuucuagagagacugcaguuuuuuucaaguagccaaagagcauacuaauucccauaguaagaucuugaggccuuuaccaaaugguuccaaaaauacugacaauggugcugcugcuacugcuaacaacaacaacaacaacaacaacaacaacaacaacuugaacuguucauuuaaaagagaaacuuaacuaaugaaaucccucaagaguuguauuuuugugggaugauuuuacaguuuucacuucugaucuuuacuuuuuccugucuacuacugccacaagaaaugaaauggccauguaaaacaaagacauagugcuucacauaccuuagucauuugggcucuucucuuugaugagauggcugucuuuucauaaaaaucaauaaggagcaacacuggggugauccaccuaagaagaaauuauuuauuuaguguaaggcagaaaacuacacaaauucggaaaaugucagguauuuuauaguugucuaaauaaagaucucaggauuucacauaugcuucagaaaagugauucagacccuaaacucaagggccaagucucagagaaacagaaguuaaaccaggauagauaaagagccacucacuuuggggucuggacuuccuuuugcucuuuggcagccuguaggcaggguugaaccacuucuaagaguuugauuaggacauuaagaaugccacuugauucaaccacccaggcacaagguaacuucaacuccugauuaaaaaagacaaucaaacaaagguuaacauuuauacaacuaauuaaaugcaaauucuauuccuuauuaccuaugagcugagcuauguggacucagauuaguaacuucagaguguucuacauuuugguuuccucaugaguuaagagaaguuauaucuacuuccucagucauuguaaugauuaaacauagcaucaggcauaauagucaccuaggcuacacacucuuuugguuuguuuuuuuuauuuuuuaguaagccaggguuucucuauauagcccuguagacuaacugggcuguccucaaacucaagagaucugccugccucugccucccaucaccacuaccacucaguagugacuaugcagccuuaacauuuaaauuguuuuugauuuuuaaggaagcauuaaaauauuccaagaaaacuaagauaauaaauaaugauucuuagcaguacuauuaaaguguuuugcuuuuuaacagaaaacuauuauaaguaacaauagaugguuauuuagaaaaaauaacauguauauauaugauauagggaaacaaucaugauuauuuaaaugaaaaagacuagaaaggaaaaauuaguaauuuuuuuaaacgagauccuaugaaucaccuuuuuuuuaaaauauuacaaugcuacagaggaucauaaacaugcaguucuuuacuuucgggcaguggugacacauaucuuuaagcccagugcuuggaaggcagaggcagguggauuucuuugaguucaaggccagccuggucuacagggcuaauuccuagacaggcaaugcuauacgaagaaauccccuucuauaaugguaucugacugguguguauauggcuuuuacacauguacauacucaacuacaaugacagaaacugaccaucaucuuuugacuuaacacuuguucuaaaaaguucuucucgcauuauauucauaagugauauauauaaacuuucccaacacagaaccuucuaccccuaaccucaugauguacauuuuuagucuauugguacacaugaaauacaaggaccauauuuuguacuucucuccaauucaauguauugcuaagugcuggguaauucuuuaauaaguggauuacacagggcaaaagaucuguuaccucaaaaaguaguguuaaaagcaagauucuaguagccaaauuggaggccuguggcaggguagccaucugacugauccacucugaaacuguuuuugugucacuuguuguuagaggaagagcagcuuugaucaauacaucagcagcuucccacaccuaaaaaaggcaacacacacacacacacaaacacaaaauaagcagccaagucauguacauauagaguaacccagucugugaaaauauuaaacauauucccuccaaccucaauauauuugcagaaaaguagaaauaacaaccuauuuaugauagugaauguuucaaaagaagacauaaucauuaacaaucauucuaaacaccuuuuuuuaauuuccuuuuuguguguaccauguggguucuuggcagguaauuacuuuuacacuuugcuaaaccagcuauucuuaaauuuuauuacagaaagccugaauucuaaaccagcaugaauguaaaaaaaacuuuucugguauacauaguaaacuuccaaaagauucugccaaucuuuacuucaaauaacuacuaaaauguuagaauagaagcauaguuuuaauuauuaaauuuucaauuccuuaaaauuaguauagggauaucacugaucuuuauuaaaauuuaaccucccucaaacuaauuuaauuuguguaaccacacauuucacuaaaagauuguguaucuaguuuuccuuaugauuaucuuucuauuuauuaaaaauuuaugcuuuggccagcugucuagaaaaaaacagaugcuugacuuagaaaagauaauuuugagccuaguguaguacacuguguuccagguucccaauuuuugugagguaucauccaugguaagcuuuagugauauaacugucauucagcucuuucugcuccuguaaguaaccccucacacauauuccugugauacaccuaccacauugguuccauuuguuuuuuuuuuaaagcuaacaaacaauccuuauguuuucauugucuccacagauuucuucuuuuaaaugauacccaagaaaagauuuuauaaaacaaaaucuuaaagacuuaaauacauauagugauacaaauuuauaaagauauacaaauaaaugcuacagggauauuucucgaaguguagauuggggauacuuuguuucuuaucccaacccaauaauuagaacagagaggaaacaaacacuaaaaauaguaacaaaacuggguugaauauccaucagaaagucauacaacgggaaaaaaaaaugaguauuuucuuaauaugaaauguaauuuaccucaaacauaagacuuuuauucuacguaacucugcuuuuaccuucugaagacuauuuuucgugugaaauaaauaaauugaggaagacaaccaaguagaguuagauugcaaacaaaagaauucaaauccagaauauaaacauaugguguagaaugcaagacuuuuucagaaaugaaguugacagauaacaguaaaacaacuuuacuaccaaauccgguauuuugagaacuuaccugguugacaacuugcuuuagaaucauaucacgauagucagcuccauuacguuugauagcugucaugaucagaucacaaacacgguacacuguaucaggcaacucaucaagaagauggaagcagccugguaacauuguaucugugaaaguguggagcucaucuuguuccaaggggucagcaucuugaaacuucucuagacauuuagcuucuuccucuucuuguuuuucucgagcuuuacgcucuucuuccuccuuccggcaagcaacuuccuggagguagaaaaggaagugggauaauauaugccagagguaaagaauaaaaaauuaaguaccugauucagucuuugaauaucaucuacauuguuaaaaaguugaauauuucaaaaggacauggcaacgaauguaacauaauagcuaaagagguuaaugcaauauaggaaaaacagacuaagagcacccaaaaacuuugucaguugaaauuuauaacaucguauguacuauucucaagaaaacucauuuuuagauccuauccaauguuuccuuccagugugguaaauuuaaguaacaucauauagcuaaguuuggacgacugguuacuacuaguuccauuuuggguuuuauugacaacaaagacuaauacuucauuugaaucaucgacagcuucauuuugguugauaaaaguuagcugaguauaucaaaacguugagaugaauaaguauucacucccccaacuuuuccuaccauuguauagugauuacagaauacaaaaaauaguauucacagaaauacacagauuaaugggaaaacauacuuuugaauguuagacuuuaguuaccucaggugacucugcccuuugauccauuggaauauccugucccagagacauagcaauugcucucaucaucugguccucuucugacaugcuaagauccuacaaaguaacaacagagaauccaauaaauauacaaauccccuaauaauaaaaccuaaauuaaaacaaacucucauaaggaaagggaaugagacuggaauauuacucucucuaauuaaaccaaaauaaggcuuauguggguuccaaccacuacagggacaauggggaaauuuacaaugaaaauuaaguaagaaagaauucugcaaacaaagcacuaaaaaaaaaaaaaaaugcagcauggccagggaauagaagauccuagcagcuucugaagcuuucagaauuaguacauaaagcauaggcaaaggacguggguaaaaaaggcucagcagcuaaaguaauacaguaaaauguuaagauguuucugugucaacucacccgaacaacuccuccuaugauuggaggaggguggguuaaaagguacucuguugcuuguuccaucguacugguauucaacagugccuccauggcauguucucuugugaaacccauguccaugagcuauauuaaaaacaaaacaaacaaaacaaaaaaaccaagagcccagagccacauuaacagagaaauaaaacaaacaaacgaacaaacaaacaaaaacagaaaaaaaaauaaguaacaacuuguuuaugugaacuaacaguacuuauaagucagaacaguaauuuaucaucaauguucuuuucauuuugguaguuauauaauauccaaacauuaaaguugcuuauugaugaaaagaaccaauaugucucaauuucaucaucucaaaauggaggccaggguagaugguuacuauaacuugagauacacugaaguauaaauuggcaccuguauucugaauuagaaacuuguaacaacagaaaaucuaucuacaaaacugaucaaggauuucaaugaucacaaagugauugugaaauaagauauaccuauaagaguuuguauauuaaaaaaaaaacuauaccauagcauccaacuaaaauagacuaauuuccugaauaagaauacaauuauauauacuauuauauauuaguauaaagucucaaaauuccuaaacaagaacuuauuuuuauaauaagacauagcaaggcauauauauauauauaagacagauuugaauaaaagaaacuucauacuuaaaaauuugaggaaguaccuagcacgaguagaaaacauugcucccagaagacauggaucauauuaaauaaaaaucuuagugccaggcauggaauauguuacuaaguauuauaauucaagaagccucagugucccuuuaaacagcacaggauauuaccuuuguuuuugguugccaaugauuagcuagguuguucagaccccaucacugaagaugcaacacacuuugguuacaggacacagagaaaucaaauuauaauggagcuagauuauguuucgaugcuggcuagcuuucacagugccagaaacugcuauguaggucacuuggggagaaaaguaauuaacagacuuacccggcugugaauccaggcaugcuacaauacagaccccaugcaaugguggcaugauuauuauggagguaacuaacugcuuccucauuggauuugaggauugguccacaggagggaccaauauauauaccuggucaaaagcccauggcugagaaagucauguacuuaagcuaacuuuucaauauuuauaccuauagauuaguguugcauucagccuuuaaaagaaguuucuuuuuguuguaggcaauaguuaaugcagagacuuuuacuccaaguauugagaauaagcaacuucaagugcucaguccauauuaaacccacccuccaaaggcuugcuuggggaguauggugggaagggggucagaaagaucuuaagaugggaaaugaaauggaaugcuucucaaaugcugcuuucuggacaugcauggcccuugcacucaugaacucacaagaguuguaguuaccugaaacaugaugaagccaaugaacauucaacuaaggauggugagggguucacaaagccccaccucuagcugaggagcuauugauaguuuguggcugcuggggaagagagaguaauucagggucuggcaacuguuaagcuuucuauguuccaguggcuggccauauaccuacauacaugcggucagcauuaacgggacucaguggguuauuuaaaaaaaaagaaaaauagaacacgaagguaggagggaaauggguuggggaaacuagggaaggagguuggagggguggcuauaugauuaaaauacauguguaaaauucucaaagaguaagaaaaguaagaaaaauaauguuaaaaugcucuuugaaacuuccccuuuuuggucuuuauuuuucaaaauguuauuauuuuaacgucauacagguuuagugaauaguuuuucaaaagucuuuuacuggagaauauauuuagcuauaauaguuugccuuaucguuuaaccagaaaguaguugacaguacuaccaaaaaaauuuuugcagguuccugaaaacaauguaauuaauauguuuaugaaaauauagauauguuuucugcacaaaguacugggaccauaccuuuuaccuuuccucacuaggaaaaaaaugcuuugagaaacuaagaaccaaggaaagcagugguaugaaagcuuagaaaauuuacaagcaaguugaguggcaaauaacucucagaauuugaagucagucuugccuacagugagacgagguuaaaaaucaaaaauuuuugagcauuagagucuauauauaaggugaaaguguagaaucugagcacucuaccuguuguagcuguugcugguugacuugagguucucugcgugagccaccuucuuccuggccugcuucuucuucuccucgagauccuuccuucucuuugcucagucuuucucgaaucacagguuccccucggagaauguggcacaaaauggccagcauagacucagccauucuucccccauauacuuuaagggguuuccgguuccacagguucuugauacaaguaaaggcugccuguaagccauuugaaaaguguaugaugacuuuccccaucaauucaaauccucagaaggaaaauaagacucacagacaugccccuuccacaaugagucaguuacaacaacaacaaagaguuagacuggcauguagaugguggguaugauagggugggaacauuuaagucaacaagaagaaccaaucagaagcauguacuucaaguuuuuuguuaaaaaaaaaagcuaaucugaaaaccaaguccauuuguuuuucaaaauucacauuuuaauauggacagaguguagugauaacuaccuagcaugaagaguuuuuuucccccuuugguuuuaaaauguagaauacucacuuuuugaguuacuacaaggaagcgaagggcacuaaauuguggaaagcucuggacuccuccaggcaauuuagcaggcaacgaauguggagauucaagcaccguggugggauuuaccaucuuuucuacaagcauaagccaggcaucuaggaauucuccuguaccaucagguagaucugaauguuccaaucccucagaaacaggaacuuuuccucccauggauagagcccaguugaaaguucuaaauucaaauaagacaaaacauguaaauagaguauuaacuaguauuuuacauugaaagaucacuaauacacuuguaccuuaucuuuuauccucuucguacacauuuuguuuuuuagguuauaauuguaucacuuucuccuucccucccccucacuccaauacuacacccauauacuacuacucacucuuucaaauucauggccucuuucuuuguugcuauaaaugcauauacauguauacucauauauugauaaauauaacauguucaaucuguauaauguuaauuguaugcaaauuuuucagggcugaccauuuacgcucuucccuagggaaaacucacacucugagcauuccuuaauagccuguauagaccuuuguauagguuugaguccuuguggccuucuccccacacuuuggaacaucuacuguuguuuucucuguucaauucauguauaggcugaaacacuggggaaacuuuauggucacaguccccgauacccggcucuuacaauuuuccuaccccuuguucuacaaucuucccugagcuuuagguacagaguuauuuuguauauguauccaauagaacuaggcuccauaacucagcauuuugaguggaugugguuuucugaaauugucuuucuuacugcagaagaaaccuuucuugacaaaggucaauacuuuauguauuaaguuaggcucaugugaaguucuuauuacuuuuaacaugccauuuacauaugcuuuaaagacuuuaaaaaauccacucaaacugcuuaaguucaucuuaaaauguuuuggccaaguaaaguaaaacagacaaaaaccaaauuuacuguacucaaagaaaaaaauguguaguaguaggaauagaaagccaaauauaaaaacaagagauccuauauacacucaugcacguacuuuuuuuaaaaaacuuuuaugaguguuuguugacauguguguguuuauugccaaggaagagguaaucauauacccuagaaugaguuacaggcaguaguaagaugccaaauagguauuggagauagaacaugggucccaggaaaaagcugcagcguccucuucucugcucaaccaccucucuagcugaaaugcagacuuucuucagaggaaauacauggcuugcucauaaaacacaaaaugauacaacuaauagcucucuuuauauauccuagcaucacaggauaaaugacuuagaaagcugugagcagguaagccacauaggaaagaucaaaguucaagaaacuauucuuugugaagcaaaugauccuuacucaaaaagagcauugugaccaccagagcagagaaauuucugcagcauaaggugguaaggauacuuucucucaucaaagagcauuggagaggugaauccaacugaacagaugaagaacgucagccuaaaaaauaaaacaaagaaaagacaaacaucuuuaagauacacacaaaaaagcaacaggaaauuaagugaaaaaaaaaaucuaaaggaaaggcuagcaaaguauuuaggugaaagauuaguuuggcacuccugugauaucugccacccaauuaagaauuagaagguuacuuaaauacuguuuaacaauaaacccuuuagaaauuuccaugcucuauacuaaguacaauaaaaauacuucauauggaauauauauaaagagaaagcaagagacuucuaaacuuuuccucaguagaauaggaagaaacauacaucauuuuuauugccacuuucuacuuccuguaccuaaaacaggaacucaccugaagcggggaguggguguauauggugggggcugccaugauaagccuuuugugaguagcuuagugagggcugaagcuguugaucuagcagcagguguuggugcaguggugguacuggcagcaugauggcuccuccuuuggcggacaggagaacccacacaaagcuuaacaaggaguccaaagagcucagcaagugcucggccuaaucuggaagaagcugaaacccagaagguaguauaauucuauaaaguauucacacaauuuacaguaucacaccuaugcuccucauacuuuaaaaauaauuaucauuuuuauaguaagucuguaggucagaggacaccauuaagaagucuguucucuccuuguaccuuuacaugagcucugggauuacaggaaauauguugucacaccugacuuuccaucuggguguuaaagaccuaaacucucauuuacacuguagucacuuuagucauuucacuagaccuuuucuauauuuaaauuuacaaacacacacacacacagaacacuguuauaaauaaaaaauacaaauuauguaaauuacuaaauaauagaaccuuuuuauucuuaaagaucacgcuuaaaacaguaagauuaugcaucuauacagaaaaguuauucaucuucuauucuacauaauuuuauauuguauaauauuaauuauggaacaggcuacugccuagguggaaguuuuggcauacucagaaucuaaaaacuuaaaugaauuuaagucaaaaggaaaaugcaaccaagcccuguuucucaguauuacucacauaugaacagauagcaaaacagcucaaaaaucuaucaaagguaagaaaacaaaaugccugaucagcaaggaaacagacaaaacaugguucugaucuaccacaaaccuuagaauguucuaagacaauaccaacaaacaucaucuaacuuuacuucaauucagggauaauuaguaaaauucauaucaaaacaagcacaacgauaaaaucuuuaggauuugaaggucauucucugcuuuugggaguuagauuuucacuuucauauguguguguauguauguauauggauguauguauguauguguauauauauauuuuuuuccucccccaagacaggguuucucugugcagcccuggcuguccuggaacucagaaaucugccugccucugcuucccaagugcugggauuaaaggugugcacaaccacugcccggcuuucuucuuauauccuaaaugguaacuauuaauaaauauacaaaauagguccucugaaugaugguaucauauaaaggggcaaaagguggcaaacacaaucauuuuacaucuuuaaugcaggcuccuugaaagcugccaaaguaacuuuaauaaaacacaagaaacuauguuucuggauaaucaaagcaaaaugagacuggugaaaauugugauugcuuggucauauaaaaagcuaagaguuauuuuuaaaaaaaaguaucugguagacucagcaguaagguacccugggagacauuccagcagaauaauaggagaugccauuugcaauaacugaagaacaaacaaguaaaauuuaaaaggaagaguagauaaagaucaggaagaaguuaucuccuuuuauaucuuuagcaaccaauuuagagcaugagacacaauagggauucaacaaaguacaugugagagucacaacauuucuacaacauugacuuauuuaaaauaugguuuuuccaauuuaacuuguuugaggaauacuagagcucugaagcccaaagagggaguucuaaaaauggagagucacugaccugacagcaacggcuugauuuguuuaauucuugcagccauggcaggugugauuuuagauuugcccuuagaaucugaagaagaagguucaucugucuccaugggugccagugugucaccaucuaguucaauuccuucuaauaaacccugggcagaugcauccaugcuuccagcaguuccauccuguucuccaucuuuagaaguaaaaggggguaauaagauaaugcagagcuaguacuuaccaggauccauuuuugaagggucucaaaaaauaguuaucuauggugcuuaucccuauuuaaauuucaauuaguucuuaagaagcucaaaccaaaccaaucuuccacauccaaagcacaacaacaauaagaaugacaccaauaugcuuuuaugucuggagcucuaauaaguaaauacuugcuggcaucuccaaaugaaaggauaugaagcaucuuaacaccgguaucauauuugaagcuaucacugaagaaguccugguagaaucuuauaguuuuuucaaauuaaaauugaacauuauagaauacugcuggacaguauucuggacaguauucugacaguauuucccagcauuuaauuauuguaauuauguauguguacugaaagacaaacuuggauucucaugacaguguagcaaaguguucuuaaagagacaucucuccaaccaaagccccacccccuuuagaggcaaguucucaaacugguuccacacucaguaugaagucagaggugcuaauccuccuugccuuuaagccacaaugguaaggauuaccggacuuugacuauguauuucuaaaccucagaauuccucuuuaauaguuuuaaggaauugugacuugaguguuaaccaaauugcuagaaacgaggugguaaaaaugugaagacugaccaaggcuacccacgcccccaaacaagaguguaaacuauugggagaaacaauucuuucaggauuuuaauuucauuccuaguucuuaauaaauuuuauugaguuguauuugaaauggacuaaaauuugaaauauacauuuucuucaaaauuaaccucagaagucuguguauacuuauucugacuccuaacaaacagcugcuguaagcucuuauuuuuaagauauauccauuuugauuuugguugcuuagguuuccuucucaguaauuucaauucauuuuaaagaauaucugacagcuuuauacauagaaucgucaucguuauuuuucaguuuuagguacuugggucuuuaaaaucucuggaaauuuuuuuuaucaccuucacauuugcuacaucaagaucagagaauuuuaugugauuucugauuauacuauuauggaacuugcaaugcaauuaaaaaaaaagauaauuccaaagcacuacugucuaaaagaaacagaauguaagccauacauacaacuuugaguauccauuuuaaaaaguaaaaauagguggaaguuuuccauuaacaaaucauuuaauccaguaugaucaauauuauuauucagaaaaaugagaaaaauuauuuucccaacagguuacagagaauuuauacuaaaaguugagaagucauaaaugaaauuaaaauauuaccauaccuuuagguaucauaauugucaggacacuaucuuguauuuauaaaaaacuacaugaaagacuuuuacuuuccuaaguagcacauaagcugggaauagucaacucuuggcauuuacaaaacaaagauauauauaucuaagagacucuuaaauauacuaaggaaaaguaucaggcagauaacucucaaauguuugguggcaaaauauguuguuaccccaguauuuuuuuauaauauguguauguuuuuacagaagaaacaacaaaaacuaaauuuaauaaaaaaaaucaacuugaagacuaaggaugauggagagcuaagucucacaguaagcacaugaccuguggaagucacagggacauaacuuagaaguaacagucauuacauuuuauuuuucuuacaguuaccugaucuuuuuccgcccugggucguaccugccuucucauccuuuggaacuaguuucugcauguccgcuugaccaaauucacauccagaugguaggcuacaacaagggaaauaaucaaacaaacaaaaaaccaaaacaaacagaauuaagugcuauuacaauuuauauucugcauauauacuuauauacugcuugggcaguaccucuaagagcaccuaagcuauccuaagugcaauaaaaaaaaauuuugauucuugaagaagcaacaaacaagauuuguuugcauugugcuaacacaacuaucuccaggaaaucauauuaaacauucagaggauguuauaauuugucaguuaaauccauaggcuagaagguaggaaggauaaaaaacuggaccuuuuuaaucaaacucauccacccuguucaaacuuugucuauuagaaaaacaaagagagauguuaagagaaaugagcauucucuuaccuguuggggguacauagagagaggaggacagugcuuucccacaccagagaacaguauaacuggcuuagcuugcucagaacacucaaacccaauugugaaccccacugguuuacugagauagaacgaauuucacucugcaaccaaaggauaaguauuugagacugucuacaaacaauuauacuuuaaaaauacuauauuuuuaaaauaucaaccuuuacuguuugguucgauaucaucugccuauaaucccagcauuuuuggaggcaagaaauacugagugcgagcaaugucugggcuacauuauaguguagcugguagaaaacguacucuuacccaguuuuggaacuguugaacaacuuuuuguaauaaauuacugagacauaaacaugguaaaaauagugaauacacaaacacagagccaggagauguacuucuguuaccacauguacgaguaucuaggcguauggaggcuagaaaacaaccuguuccucaggugcugaccaccuuaaguuuuugagacaauuuuuggcuagcccaaaagccccagaaaugcaccuauuuuuuacaguguugggauuauaagcaugugcaaaguugucaggcauuuauacagaauuucugaggauugaaacccaggucuuugcuggacauggggguacaaccuuuuaauccuagcuaccacucgggaggcagaggcaggcagaucucugaguuugaggccagccuguucuacagauugaauuuaaggacaguugggacuacacagauaaaaccugucugaaaaaaaauuaaaaaaaaaaacauaaaaaaaagaagaaaacucaagucuucagauuuacacagcaguuauuuugaaacugaggaagcuucccugucuccacagcaguuuucuuuaugaacaagaccacagaaugcagacauagcauuugacacauuuucuucuuguugcugucugcuaacuaaacgcuuugugguaaaaaaaauuuuuuuugccauuccacuguuggaucuauauguacuuauauagagauuaggaaauaauaauuuuuuugagaaggauuagggauaaauauagguaccagggaagcccaauaaccugagcuugauacuuagaaucuacauaaaagcauaaaagaauggacuucaaaaaguuguccucuggccuccccaaaucccauaugguaugcucaaaacccaucaaguuaucaggcccacacaaaaguaaacaaaaguuaaauaaaugcaaugaaaugaguuucauauuugcuauuuuaaaaagauagcgguaagaugcaauggccacucaaauaauuuuugccugcaaaaacagucauuuguuauagauaguaauaaaaaauaauaauuaugguuuuucuuaaaguucuauucauaugauaaauguauaugccuacacaacagcuaauaaaaaauaagagaaugaagcuccauggcaauuuaaaauauaaacccacaaccaccaccagauauauuguucagaaaaaaaaaacaguacuaaauaaaaauaaugcauuucuuucagcuaugacuccagguauauuuguucccaagccaguaaucuagcagauggauauagguccuugccauuuuauuggcuuuaagcugaaaccauagccccaugauuauucuuaccuguccaacucugcaagugugaacaaacaucaugauguaagcaugggcugcagugagugcaugcaacagaggcguggccugagcugagaggguagcaucagcaacauugccugcacaugccaauucucucaguaacacugagcccccaggggauucaaucggccgauguaaaggcuccaaggaggaaaggaucaagucuaauugaaggagaccuucuugaagaacuuuggguucaugugacagggucugaaacaagaauuaugaaugugucuccacguaaugaaauacauacauuauguucuuaacauuuacaguaauagugacuauuacuuaacucuccgaaauuucagucaguuacauuucucaauuuauaaauggcaguaccaaaauaugaagccaggaaugauauauuucacuacuuuguguaauagcauauuauuuuuaagcuugaugagccaaucauaacaugaaaaugucaaacaagacuguuuguuguacugcuguguaagagguuaguuucaaauuuugcuuagaaaggagcaauguuaggcaaaguuccaaaucuuaaaaaugagcuacauuacaaugguguuuucuauuuauuucuaaugaguaaaucaauaauugaauaaaguaaguauuguauuaaauauuguugagggaggaggcugagagggcaugugaaacucaaccucauacaauguuacauaaauuaagcagcuguaucuauaucuagcaguacaaauggugcagaaggaaauaagggagaaagcaacuauuauaaaagcuacugaggcuagucaaacuaucaagaaguacuuucagagcuauaaaguugucuucuuuccaaaauaagaguggugacucugagauuggcaucaggaaggcaaauuauuuuaauagacaaacccaaauauuacauuucuuuucaaguuaaggaagaaaaaucuggcaauuaaagauuaccacuuguuaugcaaagcuagaaauuauuugccuuccuauggcuugaaauaaaucuaucccuccucacagagcaucuuagaggugggguaguuagaucaguccuuuccccauguucucuuaugaaagcacuuuacaccugcaaagagugaaacaaaauaaaacauuaaauugcaguuucucaaaauuauuuaucacugcacaaaacagccaacaaaggagcuuuauuguaauuacuaucaaaauucccccaaucuuuuuuuuucuggguuggaggcagauauaaaauuucccucauaauucauuuacaacuuuucaaagaacccccccccccaaaaaaaaaaacaaaauauuucugggguaugagaacacaacucaauuuggaggucucacacuuccugauuuccaauuugauuuugauuaguuauaauugauuaaucaaaauugugcuacuggacaaucaauggaaaagaauugggcugagaaagaaaacuccaaauuuuuuaguuaaauuguguuugaagagauguguugauaggagaugguuuaauaaaaguacagucuuuucaaugaaugauauugggggaaauauaaaauaaacaaaugaaauaaauaaaguggaaccuuuucggucucuacuccaaauguaucaagaccuaagaauuaaaaacucauaauaucuagauuaaaguauaggaauuaaacugucugaaauuucuuggaucagcaccaaaagcacaaaaaacaaaaaugacaacgauaacaaaagacaaaaugggccuggucagcaucaaaaccuuuaguaugucaaugguaacaaacaggcaacugacaaaaugaggauauuugcaagugauguaucugaaaaaaagaggcugguguucaauauauacagagauauucgauaaugaacagaaaaacaucuuaauuugauuaaauauaaaauaaagaacacaaguauucguuuagcaaaggaugcacacauagacaauaacucaaguacacaaaucaaacguuaugaucaauaccaccaauuauuuaggaaaugcaagucaaaaugaaaacgaagcacuacuuuaucuucaaggauggcuauuauuuaagaaaacagaaagaaagaaagaaagaaagaaagaaagaaagaaagaaagaaagaaagaaggaaggaaggaaggaaggaaggaaggaaggaaggaaggaaagaaggaaagaaagaaagaaagaaagaaagaaagaaagaaagaaagaaagaaagaaagaaagacagaccgaccgaccgaccgaccgaucuggcauggaaauggugaaauuacaauccuuauguggcgcuaacuaggaauggaaaauaaucuuggaaaaguacuuugaagguuucaugcaagcacacacacacacaaauagaauuaucauuugauuaaguuaugucacuucaaaguauauauccaaaagauucaaaaggcaaaucuugaagugcuauuuauacacucaaguuuauaacaguauucaucaggggcuaaaauaaaagcaaccucaguguccaguaacagaggaacggacaaaaugaucuagaguguauuucauaaaauaucauuuagcuuuucuuguguuuuuuuuuaucauuuagcuuuaaaaaggaaacugacaaaauuaauaaauauuuagugucacuguaacacucuuaaaugcuauacaaugcuauuacauaagguacuuucaaguugaguaaauagaaugauaauuacuaacugaaggcauuaggggugaacaaguaacuugcaaaaaucaaagguguuguagaaauaaagaaacuguuuuuggcaaauuuuaagcaauaaauuacauaucaauuuaugacuaauaaagcuuggggaaaaggaacgaacacugcaaagugaaugcgcauauuaaaacaaaaaaacaguaccauaacaacaugaagaaagcuagaaagcuuuccuggaaauaauuuagacgcauaugaauucaaauggcaaaacuacacgcaaaugcaaaaacaaagaaaauaaauaauuuuacuaugggaaauaguauaaaauauaaaacacacaaauuuaucaauuuuuaacuagagguccuuaagcgagaacacaaugaaaauacauacagagauguaaaauauuucgcuagauguuucuuaccaauauggauuugcagacaccugcaacagccugacaggcagcagaugugggaaagucaaugggcagauugggaagacccaaaaugguaaccaaagguaagaguccuuucugguuuacaaauucuugacaguggucaucuguuguauuguugcucaaaauagauuccacaaauuucaucuaggugaugaaaguuuuuuaaaaacaaguuagaggcuaacacuuggaaguaaaaggucaguuuuacuucaucaggaucaggauagggacaacguauuugcaagacaucaguuauuuucuguaauaccacuucaauuaacagggacaaauaauuagcacauacucauccagaaaauaaggaacccuucccauucuaccuuuuuaaccacuccagaagucaauuugaaagcaaagagaagcuaaaugccuuguucagagcaacauucugaauuaguggcagaaacaggucuaugucuuaacuguauauacacuccauuuguuaggacaguucccacgcauccuuauaauauaaauaaaaugaacuccaggaaucaggauuugaaucaaaacaauagggaucuuugagggauagaaaaaauguauuaauguacacaaaagcacaagaaaaauuaucugcuuaauagucuagaauaaaugcuaaguggauauuaaauucugggaaaauuuuagugcucuucacauuuucuuaaugauacagggaacguccauacacuucagagaggggcaggggaagggguaaaaugggggaaaaacauguuggguaaauucugacagaauauugguuuaacacacuaaaucucguuaaaauucaaauguacaauaauaacagugaacagacaguugaaaauauaaaaaggcugagaauacugguucauuuacugaaaauggggcaagaacaaauauuuccaauuuugcacaccuuuuccucuguacuuuaauagcucuagagaaaauaaacauuaaaugcuauacaauguuaucacauaagguacuuucaaguugagaaaauaaaaugauaauuacuaacuaaaggcauuaggggagaaaaaguaacuugcucugaugacaaccugauguauuuuccugaaaagcacacaucuuuagcucuacaaugaaucuuaccacauuaaggauguaauccaugagggguauagguauacguuccucgguaccaacgacccuguuaaagagaaaagaaucaguuacacagaaauucauagcaccagcguaagggaaaaaaagugaagcccuuuuaauaagucaugcuccuagaguauauacucuuuuaguauaugaaccuuaaaacuaagacaugaagaaaaagagcugaaaucaauaaugaagguagaguucagaguauaaaauaaacaggccauaaaaauauagcaauuuuauacuuaccacaaaugacacauccuuucuaagagaaauuacuguuagaaaaaaauucaacauuauaaaaauacugaaaauaaacugaauuaaaagaccaaacaugugcuuacagggaaggaccaggcaaugaagcaaacauaaaacagucauaaucuuauguuagauuaagagcugagaaagaaguggauuuuugguuuuguucaaauaucuuuacuaugagccaggaguaguggcauaugcuuuuaauccucguacuuaaagaggcagaggcaugggcaggaggagcuuucagggccaggcuaguguacaaagucgguuccagaaaaaucaggggcuguuacacaaagaaaccuuaucucaaaaaaucaaaaaugcuuaagacugacaaauacuuaugaacagucaaagcuaaagucauuuucgaaggccuccuuuuacugcuaauuuguaauugcaggaugacaguuccugaauuaugaaacaauuuaucauguuuuuuagcuuuuucaaauucuucaauacuggaugcuaauuagguuauagauuuauaaagguaucuuaauauuuuuuucuuuuuuguuuuuuugggacaggguuucucuguauaucccuggcuguccuggaacucacucuguagaccaggcuggccuugaacucagaaauccaccugccucugccucccaagugcuaagauuaaaggagugcaccaccaccgcccggcaaaagguaucuuuagauuaaauugucuuuugcaagaaaaugagagggggaaacaaccauauauacuguacugagaugaaaagaaaauguaacucauaaagacagaaaagaagaaaacuuaaguaggaaacaacauaugaugaugcuauauguauccuugggaucugaguaagagguggcaauggaggaacagagauagugguguugagagaaaagauaguaaaagagacaagcaagauaaaaugcuaauaguucucauaucugacaaauuauaaaaauugacaaccaugaaaacauuuagcagaaaagugaaaaagaacaaagaagcuuuaagaauagcuucaguaaugaaacauccaaggcuuuuaaaaaagguuuauuuauuauuauguauaauaaguacacuguagcugucuucaaacacaccagaagagggagucagaucucauuaugggugauucugagcuaccaugugguugcugggauuugaacucaugaagaguuuggaagagcagucagagcucuuacccgcuugagccaucucaccagcccaggguuaaggauuuuauaaagauccucaacuuuuaaaagggcugaagagauagcacagcagguaaguacucaccauacaagccuuacaauuugaguucaguccucagcauccagggaagcagagaaucaacucaugaauguuguccucugaccuuucacauguguguaugagauuauacacauauacacuaaaugaagaaaauugggggaggggacuugcaaaagaaucuuguuaaaauuuacuuuauguuacaugugaguauacacgugagugcaggcuaacuggagauacaagugguuguaagccgccuaacucaaugaauacuguguccugucuucauuaagagcggcaaauccagcuuuuuuuucuagucccaugggcaaagaccuuuguacaaaaaguggaaaucuuuuuguuuguuuuguuugaucuuuauuaauaaaaggauuuuauuggauuccacuucauuuucccugcuuuguauauuauuaaaaaucgcaguagagacacuaaaggaaauggcccuuuguaccuacagaaagugcuguucaaaucaggaagaggacuucauuagagccuucuggacagaguacaaagcaggguggcagugcuggccuugugaggaacuucaaauggccacauuaccaaauuagauaaugagaugauggugaaaucugagaggcuguuuuaauccuuacauugcaaaguuuaucuuaggucuuucugggucucugaacuacccuuuguugacaacaaaaggcacaagaaauaauaguaaacuaguauaguccuuuccccacaauuuaucaggcacugugcugugugauuuucaguaucagcuuaaguauucauaccacucugagaaaguuaaguccuucaaaggacuaagacccuucaaagaaaggaaaucuuuaagccaggauugaaaagaacauuuccuagauaaugcacaacugcagcauuuuauuaaucaauuaauuauccuuuucaacuaagccucaccucccuagaaagaaccuaaagauccaccucuaaaacuacaaguacagauaccacuccaauggaauucuugccucuuuguauaugucaaauaugaucuaguaaagagcacagguuaaugcaacgaaaugaaucccaggugugccuuucauugcuaaaaaggaagcuguagaaaaaaaaaaagacaaaccaacaguauuguucuuaauauaacuccaggaacagacucauucauauauguaucuauuguucuuuccuacuacaucauuuaaaaauaaaaaugaucaguuaucuccuaaggaacucuaccuacaagccuagguuuaaccuaauuugaagcagucacaucccugagcaacaaaagucuguuuuuguaaaugaguuauaauuguccaauucuccucugcccaaucucuauucucucaaacaaaugcuacagagcugcacagaccacagacuuaugcauauuauuuaaaaguuccuuaauaucaaggaucaugagccuguacuuuaaaauuuugagugcugcuugaaaauuugcaacagccuggagguaucaggcuacauuccccauaucccagcccaucauuuagaaugaagaacugacugacaggcacuugcagggacuguuagggaacacaggccuugguuggauaaccagguccagccccucuucuccucacaguuuaggaccaggaaaaacuuaaacuaugguguuuauuaucaaccuaagucauguaggagaaugccacacuaugcccugaaaagcagcaagaaucaaaaagccucuuuguaggacuugaaaggcuuguuucagagaccauagaguggccagaaacagagucauaauccucagcacuuauuggauggaucacagggugcccaauggaggagcuagagaaaguauccaaggagcugaagggaacugcaacccuauagguggaacaacaauaugaacuaaccaguaccccggagcucuugacucuagcugcguauguaucaaaagauggccuagucggccaucacuggaaagagaggcccauuggacaggcaaacuuuauaugccccuguacaggagaacgccagggccaaaaaaugggaauggguggguagggaagugggggugggggguggaggggaauuuugggauagcauuggaaaugucauugaggaaaauacguuuaaaaaaaaaagaaggcugaagagggaagacugaguuugaggacacuguacaaugaauucccagcuacucuuaccugcaaagcaagaccuuaguuugugaauagcacauuagaaaccuaagaauuuagaccuaaacuaccuaagcguucuuauucuacacauccaacaaaaacuauuauuucacuaucauucauaagccaucaugacuuuaaaaaguaagaauaaaaaggaauuagccucaggaaaauaaaaaccaaguucauuaagaggaaaacuaaauaaauguaaccauaguuauacaacgcacucaagacuacagagacauguuacuaauauggauaaauucccaaaacacaguaaguaaaaccaaauuaaagaaacuaugcauuagaugcacauuuguauuaucauuguauuuauaggguauuuuugaauauacaaaauuauuucauguauaauagaaguaagaucaguagcuccauuuuuggauggagaaauauuugaacauacauauaaaaauuacauuuggauauauaccuauggcauuugaagaaggauagaggcaaagaaacaggaauuuguagguccaauugagaauguaaacuggggggcuggugagauggcucagcuuuaagagcacugacucucuuccagaagucaugaguucaauucccagcaaccacaugguggcucacagucaucucauaaugagaaacaaauuaaaaaaaaaaaaaccuauggccuggagcgagcagggccagggccggggggggggggguaaugugaacuggaaagagggcagauaagagaaaguugacaggcacuugaucuaaaguucuuugauaauucuauuaaauagagauaggagucacugaaacagauuaauacagaaaagaaucagcauaugggaaaauauaagcuugguuucccaauuggaagauguucuggaaugaggaacaaauguggauaaugauauacaauaucucaaguaaggaaaauaguaugaaaaaugaguaauauucagaagauguuaauuuacuuuaacagcagcuugaauuuggaauauauuagaucuaagaucuaauauaugcagauacacacaacuugauuuguaaucaccaccaacaacauucuacauucaacaaaucuuuuuuucauuugugaacaggaaaagcaaaucagcucugcaggguuacuggcaauuggagauugggaauaaauacuguaacuucuuuauacuguauugagaaaugccauaauuucagaaugucagaaugucucccucuuuuagaaacaugaucuuaaugguagauugaggacaacacuagagauuuaugccugcugucucaggcaaauggagauuaaguaaugacuccccuccaaaauuacugacaccaccaagugcacugcugaguuccaguaacucuuuuuacuucugcuauuccugggcuuuauucauacucuacuagacuauuuuccuaccuccaauaugccaguuuaguaccagaucaaaacuauucuuacucacagcugaaauauugaccccugucuagagacauugcuuccacauuugaaauaaaaguuucauauauuacuuggaauacugaauucugauuuaacaucaugaacuaaaauuuuaagaauagcaauuuucaaaggcaaccaaugcuacuacaacacagaacucugacacuacagaggaaggaacaaaacaccuaaaaggccagaaagaacuuuaaaaugaucugauguauuuuuuacuuuuuuauagacugaagugacauaaaggguauggaguugcuuugcuugaguuccauccugcugaucauaaaaaaaaaaaauugagcccacaaccccaaucucuccagccagugucucucucuauagcccuggcuggccuccaaacucagagaugggccauaguagaauuagaagugccaccacaaccaucaccauaaacuauuaugauacuaaguaguaucauaaggaaagagaaucugaccuauuaacacuuacugcugauuaggcucaguuucauucugcugggcagaauuaaagcucugcauggccuguacuuccucuuccuccucaucuucacuggaagccucuucugcagcaugauuagaccuuggaggaggagcaguagcaguaccauccgcuuucugaauagauggcuucugacaaauguauuuaggaucucuuccaagauuacagauuucuucaaguaacuaaaagucaaagaggaaaacauuacuuauuuauaaugaaggaaugacauuuugugagaguuuucuauguguaauauacacaacacuccugaagcauaaccauuacauccauuuuuuaaaaagaaaaaauuuaaguguaaaaaguaaaaaaaaaaaaaaaaaaaaaaaaaaaaaucacacaaggucacaugccaguccuaauuuaaaaaucaucauuaucuuauaugcagaaucaaauaauccacuccugauggaggaaggagaaaugaggaagggaaaaauucaagaaaagaagcuagcaaggaugcucauacaaacugaagccccugcauauuuguuaaucucauaagaaagcaauacaaacagauuuacacuaaacaaaggaacuguguuaauucagaaaaugauucaguauaaauaaaaaggauggaaucaacauaaaguccacucuuguaaagacuacugguuauaacuuuugguuuugcaaagaacaguccaaaaaagcaaggcuuagaaauuaggcagauaaaauacccuucccaguuaagcuaggacacuuuguaaaagaucaaauuccuaaccauuaucaaucccuaccuugaugauggcaguuguugcaucuguuuugaggguaggcuggugucucaugagcucaucaacagcacuccccagguuggaugcaguauccccuuaaggcaaaaaaaaaaauuuuuuuuacugauuccaaaaauuuuugugccaauuuaagacagaaagaaaaaaacugaacugcuucuugugacuaucuaccaacacauaagcuugaaugaauucacauaagcuucaauccaccaaaucauggugauggugguggugguggugguugaggaggaagaggaggaaagagaucaguuuagcaaacgccacugucaaggucugagcuacucuauuauagacaaaggaguagaaaagaagaaauacuuucuuauggcauuuuuaaaaaauuagauaguuccuccauuuacauuucaaaugcuauccccaaaguccccuauacccugacccuugggaugucuccaugaagacugcuagaaugauacaguggugaauggaaguacagaauacauuuauucaugaaaagggggugagggguagggggugaaugcuguuguguuguccccucacuauauugcccaggcugaauucaaaugcccagacucagccuagguaauauacagguacacuuuuacaaacuacaguauuuuucucucuuuugccuuagcaauauacacucaaaauacacugagaagaaaauauaauuauuuauaacuguuuuagaaaaaaaugagaaaucuguucacaacagaaaaauuuguauauuagaugguagacuugaaaauaaaccacuggggaaaaaagagaagaggagaggagaggagaggagaggagaggagaggagaggagaggagaggagaggagaggagaggagaggagaggagaggagaaaagaaaucaccauucccuauaccuguuuguuaccaacaucaguaaagugaacuauucagaagcauggaaauacuaugaagagagaggcuaaggaugacguauuccuuccuaccuguaauauuagaauacauggugauaauucccguuaagcugagcauaccuaaccagagaaacgauguguagucaaggaaaacuuuccuugccaaaaccaacuuucuauuuuaaaauaaauaguagcacaacucaccaaggggaucagaacuccuccuccuccgcauggcugggagguaaucaggagacagaagaacuuugaagagacguucaaauggcugacauuguacaaaagacugaagaccucgggcauucaagcaaagugcacugaauacauuugggagggaaccgaggacuucccuuguagcaggaaccuagucaagacgaaaaggauuugaaugcaacucaaaaaaugucauauacaaaugcaaagaaaauauaguuaggguuaccacacugaggaauuuguuaaacagguauaaaauaaauucaacaauacauacauaaauuuuuucacacaauaacauuucaaacuugcuucuaaagcauguggaagauguaucugagaaaacaggaaauaaacggaguagucuuuuuuauaaagugguagaaugaacucacaucuuugaugagcagugcaugcagcaugacaucugucaguccauuguccuggagugaggacagcagugauggcucuugaaauacaaacacagucaccacuucaguagcuaagaagaaauaagaaaaauuaugggaaacugagacucuccauagguauuaaaaguaaauaaaaucuguuuuuuuuuucaagacagaguuucuuuguguagcccuggcugucguggaacacacucuguagaccaggcaggacuugaacucagaaauccacuuuccucugccucccaagugcugggauuaaaggcaugcaacaacacugcccgucacaaaaucuuaaaacacauacacuaaauauuuaauaauuuaaacuugugugcuuauuaugaaaacaauuuuccagcagaauaccaagaguaguccaauaaacauuaagaguuuuauguguuaucauuccuuuuuauguauuuuucucucauacaucacauaucaguaaacagauucccucucuucacuccucccaaccccaucuccaccacccuuuuaccccagauccacucguccuccauuuccuuucagaaaagagcaggccucccagggauaucaaccaacacuaacaagccuuuuuaaaaaaaacuauauuucuaccauacuaaccuucuggugugucugaagacaacuacaguguacuuacauauaauaaauaaauaaaucuuuaaaaaaaaaaagaaaugucaaauuccuuauuuguugaguuucaguguguaguuacuacagaucacuguaaccuugccacauacuuccucguuaacuuuccauuuaugaguauuauucccagauacuuaacuaaaagcaugugcaacauccuuuguuaaggcuauuuuuaacugucugucugcuaugauacaaauuuucccaguaggaacucuuucaaucuaccuuaggcugauuuuccuuugucacaacuccaacuccuuuacaggaccugaccuguacucauauuuaguaacuggaauaucauagauccaacuacaaaguauaccugcuucaugaaguuucacuaaaaaaaggaaauacugggucauauugccauccuuggaguaaauggaaacauuuugguucauuaacagggaaaaccaaacuaguaaauucugcaagaucacaagauagaaauacagauucauaaacuguuucauuagcaaaaagguaaagucauaauaaauacaaaucucuagacugcccauaauguauuuguacaauguacacuccacuauguucaaagaaauugcaauuucuacaucucccccuaaauugcuuuauagaauuuuaaauggaguuccaacuugcauuugugaugccaaagugcguagugggauaaaacaaugggcuuuguagcauuuaccaggaagugggaguagguggguuggaaagcaggguccaggguagggagugguauaaaggacuuuugggauagcauuugaguuguaaaugaaaaaauaucucauaaaaaaagaaauuaaaaaaaaguucuaaaagcuugcgugcacacacaugcagcaagcuggcauugaacucaagagaacugacugccuuuugccuccagguacuuuauaaauguaugccagaacauucaaccuagcccgaacuucaauucuacucaccuaggaggaagagugauggaccauaguauucugcauugcugaugauguguuucagagagguagguaaagaaccauccaucacuaaaagaaauaugaacaaagaccacauaugauaagucugggugaggcacgaagaucaagggugauggguagcaauauguuauacuguaguaaauaaaugaucaagucuauggccucuguuucauauaacgccuuaguuuauucaugcaguuagcuugaauagagggucaaaauaagaacagacauggagacuaugagagguggcaguaggauagaagagaucagaauccaaagcugggaaguggaguuguguaaguaacccucaugucuaagaaacauauuaaguaacaaaaagcuaucaguuuacuaaguaugcuuuagaaaaacaucaagaaaacaugaaaaagaacaaucuggauaaccaaguggucuuagaaaacaguauacagaaucaaaauaccaugucguaugccaucugagaaagcagggucuugaauggccuucuugaggaaauucaacauggacuugagaagugcugcucguuguggaauacacugaacuccuaacaugggagaaagaaaaaaguaucauauugugcucauuauuaaaucacagugaagaggcacacaaaacauguacuaagagacccgucuauauccacuaaagcaaaacuagcagacauuuaaagugagaucucuggacaugagagagaguauucugaaagcugaaauuaaaucaccaaagauagcauaugaccgguauuaaaaucagacagacagaggaacaaaaagaaaaagauaaaaacagaaauacuguagaguaaaaagauucaacuucaaacuucacuuuuggauauuaucugcccuccgaaaugucuguuuugauacugugugaacuaacagaagaccauaaaauguugcaagacauguucuuauaagauuauccucaaauguaccaauaagugccguguaauguucucuucuucacuaguuuaauaagucagucacuguaaaagacuguguaucuaugugucuacgcaccaggacgggguccagggccaggaccagggccagggccggggccagggccagggccagggccaggaccaggaccagggccaggaccagggccaggacccggaccagggccaggacccgggccagggccagagaugcuagugcugcuguuggaacuugaugcccuuaauucaacauccagccggugcuccauagauauggacgagccuggacugcuuuccauaguuacaucugcaacuaaaguacaaguuaugauaaagaaacuaauuagaauaaaagguacuaagaaaagaaagauuucugagaaaacuucguccacugagugagauguaaaacaugcaacuuuguauguuacugcuaagagggagguaguaagucaagacuacuaacagagguuaauuaacaaauauaaaaagcacugauguucauagggaaggauggcuaugauacauagaaugaacaauaaaagcagaauguguuugugcucuccucucucucuguucuaaaaacuauauacuuguagaugugaaaaugaaaaggaaauaaaguuguauugagucacaucaaauuaacagcuaauggcagaggguuaagacugagcauuaacauuuacuuuuagauuugaaaagcaaauauuuacuaucuacaauguuucaguuauguaaacuuuaaaggggaucuuauuaauuuuauaaauguaacauuuuaaaguuauuuuaaugcaugcaccuacuuacacaaguaguaaggacgaacagcuguguaacuuucuuuguauugaguauguaauuucuuugagaauucaaugcaaucguuuggauuaguuuuaaauacuuguuuccuggucuucaguugcaaauuuacugaaucaagcauuucagauggcgccagaaucuaccaagcacuuauuguucugcuuauuaaauucugacaauugcugauuuacaauggauagucaacaauuauuuaucagcaguuaauaaacacauuuuauucaacacuuggaaucucaccugugaacuuaaaugucagcuuguucccaauaaaacagaaacagaaacugagcaaaaggauuucuguggacugcaacaugcacagauaauggugcccaaaaacaaagucagaaaaaggaacaacauacuauuuacuauuaacaaaacggcgcguuacauuuguaguacuuuuaucauaaacauaguaagauacacaauaauaaucucugucauuaagacuauugcaaauuauaagaaaucugcuuggggcaguauuuuuuauucuauuaugaauuuuuauucuauuaggaaagagaugaaaguguuaaaaaaaacccauauaacacacaugaaaacuaaaaugaucugguuuugcaauuguaauuuugucacuuaaaagaucccuaaacaauaaccaauuaaaaucucugaucuuaagauaguuuuccaaggucucauuuaugaguuuauagucuccagguaauuuaucagguaaaaaaaaaaaaaaaaagacaguauuuugacuacacggugcuuauuagguuuuaguaguguaaauaagauaauaaacuaaaaaaauguguagagugacuuuaguggucuacuguagcuuuaccucccaggucuaucccuaacaauuuauauaucauuuauauaaaaaguguugaaagauauaccuggaaaccugugugccuuuuaauuuaugaguaagaauuagaauuuggauaggauaauagaaaaaucacauacauggaaauaucauuggcuuaauaacuuguuaauuaccauccauaucaguuuccauuucuucuccuucuugagugguacugggucucuggaucuuuggcuugaucacgaaagggcauucuuuacgacacaaaucuacuucgugcuacaaucaagggaaaaauauuaagaaacuccuauacauuuuugggauuaaaaaauuauaaugaagaauaacaagcaaauuauaaacucaguuucuagaaauuuaagagagguaagaugguugcuuaugauagguggaaauuuuccuagacucagcacucacugggauccaauaaagucuaugcaaauugucuuaagaaaauaauaccucaagucuauagaugaagauagaaagaccacuaugagacugaaaagcugccauguccagguuggugauaaggucaaccacucugacagcucugguuacaaauguuaucuggucuuguucaucaccaagaaacuuuaugaccugcaaggaagggagggguaaacauaauaauuuaaaaacagagcuauaaaaauuaauauugcuuuucgaaaauauaguauugguguccccuugagucagcauaguaugaaacuggagagaagauaaagacauaugcugaauguuuugucaaauaauaaaguuaugaauucaaggacuauauucaaccuccugaggccacaugcauaacaauucauaaagaugauuaaauauauacagcuuauuuuauugcaagccagagaggccaagacccauugccucaaaauaccuacugccaaucaaccaacuaaucuaaauccuguuauaauuaaacuaaaacuuuacaaggacucuuacauacauuuuucuuagggccaugcauaaugucacacuacuaugcauguaguacugucuagacccagggccuccagucuaccaaauuacgcuggauuacaaaaagucccaauauugacaauagauacauguggcaacuagaacauaaacuauaacucuuuuaggauaaacuuucugugcuauuuacucacuguaaaacauuaaaaaucugcccucucuuauuugauuuucacacaauuauauuagaaagcaaaagcagaguaccuuuaguaaggcuuccaucauuccacaggagaccaaggcuucaccaccagcaucguagcuagccagaugguacaaaaaggagaaaagagcuguggcaaacugauggggguauggguccauggaaggaucuacaaagaaaguugggauuuccucaguuacuuaccuagcacaauguuaaacgaugaaauguuccuagguaaauaauuaccaugcaaaccuaccaaucauggccugaaugcaguuccgcacaaguacaggcaaaaauccaugguaggaggcaguuccaguacagucaauaauacugcugagcuugggaguucucuccaaaugaacaauugauguuaacguucguaaagaagcagcuuuaauuuccuaugaggacaaaguaaacagugucaaaaacaaauggacaacugaacgaaggugcuaauaucucaaaaucaaauuuucaguaauuuuauuaaaacuguuugaggaaaauggggucaguagagaauaacaauguguauuugguauucaguaauuucacaguuuaauauccaaaaagaaaaaaguaaaagguucaggcuccacuucuaggauacuuuuggacuucuuaagaaaaacagaaggcauaugcaauauaaaacuugauagguacauauuaauagauacuuaccaugagcugcuuaucuguuauuugaaggacaucuaccaacuccucuaucaacccauuauacaagauacuguuugcugacucuugcaaggcauuagaauagacugcaaaagaaaagcaaagacuuugguagaaaugcaguuauuaagccaccacuguauaacacacauuccaaucagcacaaaaggguaaaaucacuacauuauaugauugugguaaaaucugaauaaccacauauuuuucuacuaaaauuaucagaaggaauuugggggaaguuuuguaggaaaagggagcaaagaguucauuuucuuaacuucacuacuugauugaacuguaacuaugcuuuggauaaagguauagacuuggcuucuuucuuugcuuauaacacaaauccuuauuaaaacaaagaaaauuuauagacuauuguacacugucaaauucauguggcacuacuaaaaguuaagaaugugcauaaucgcugggcaugguagcgcacuccuuugaucccagcacucuggaggcagaggcaaggggauuucugaguuugaggccagccuggucuacagagugaguuccaggacagccagggcuauacagagaaaccuugucucggaaaaccaaaaaccaaaccaaaccaaaccaaaccaaaccaaaccaaaaaacaaaaccaaacccaaaaaacaaacgaacaaacaaaaaacccaaaaaggaacaaaaacaaccccaccccccacccccaaaaaagacuuuguaauaucgagaaggcauaguagccuaccuauaucuuaaaucccaggauuugggagacagaggcagguagaucucugugaguucaaggauagccuggcuuauaccaugaguucuaagauagacagagcuauauauagugagacccuggcucaagaaaaugcauauuuuuuuuuuuuugcugaaucacacacugagguaauaguggcauacacucugaaguaaaauauggccgagacgugaguacauucauuaacuuuuuggauaaucauuauaaugccagaaauuguacuagguaugaacacaaacauagcaauguagucaguucuaagaguauguaggcagaaacuaaaugaaaguagguaguaauagugauacuuguccuuuuuugccuuguaaugugccuagcaugugacaggacaauuuccaggauuuucuuucauuucuuaaaauagcuuauaaauacuguccaaauauaacguacuugaaguugccugagggaauacaguguguagguauacaauucucagaaccauggugggagccucaaaaacaugugacuuccacauaaagaugaaguuaugucauuuguagaaaaacagaugcaacuucaugcaaaauggacaaguaacauaucucucauuuguaugucacacucuuuacacacauaaucaguuaugugcugaugacauaauaauagaaauaaaauuaucuggggaacaaauaugagguaaaauuggccaaaaaggagagaaaugagcuauaguagguauuacacacucaaagugcauuauaugcuuacaugaaaauggccuguuagaauucugcauaauuaaaaacaaaaccuccuauauauucuccuauagcaaaguaaaaguauagaguauuaaccauuuaauuauuuucagacuucaaaauuauaccucugaaaagaugggagaacuggacaagggauuaucaagaauaacagggacaagaugaugacaaccaagcccauguaacugggcaauaaaaguuuccuuuuaucuaguacauaaaggagcucaagaugaugaaugacuacaguaguaacugggaugagcaaauacauuuauaauuuagguugccauaauaaagccucguagcauuaaagauagauggcacucaucagaaaucaaauucaaagugccuacuuaggaccaguuaauuaguguuuucuuaccuaauauagauauugcaugcagucuggccugaacagcuuguaaccgcuuccugugauuagaaaagccaugggccagucguauauguguaaauaacagcaucuguagagauguaagacuuauauuaguaaaucacuacaaaggauagguucuugagcuguuguguacuuuuaugcugcuugguaaaauaguuuuguugcuagaguaucaaacugaacuaguauuauuuacucugagauuagaugacagaacuagaguggcaaaacagggaucucucaauauacuacuauuucaaaaauugucaauacacauuaauagauaauaauucaaauuuucaauaaauauccgaccacugccaaaaagaacagaacaagcuaacacaauagaauucuccuaaauguauccaaaauguugagaaaguuaucaccacuacuagauaaucauuuugaaucagcuuacaaguuuauguuuccaaucuaucauaaggugcuagaaguuauuguccucaagaagaggaaacaaaucuagguagcgaaucugcuauggucagacuccaaauguauaucaauuuugcuauggcuucuguuugcccaacuuauuaguauauuuggaaauccacaauaugcaagauauuuuucagauguauuuuaccugcuuauccuuaggaaugcuguacauuuugguaagagauuccauuauuucagaaggacuuucugaaaucuguauuagaaaaaaauuaguuaagaacaaggcuacaaacaaaaaugaacuaaccaguugucaaagaauucucuuaccuugucaaguuguucuaugugaauauaauguaguguauuacuaguugucugaaauuaaaaaguugaaauaccuguuagggauucacuaaauacccuguaagaaacacugagaaucaagguaauuucauagucauuaaaagcauccauuucccacauauaacagucacaagaugcuucuuucaaacugguaguauuuaacuauaauucuguuagccaggcauguuucauauuuuguguuccuuuuuaacccuugucuaacuaucuccacaauuuuaguauucauaccaaagacagaauacaugagaauacuuucucauguuuugaagacaauuuuauucuggaaaaaaaaauuuaacaaugaaaguggaagaaaaaucauuggggaguuuccaugccaaaccaagucauagcagaucauccaggaauuuagaacaucauuuaaguaacauuuuacaugcaaaccagagcucuuuuuaauagacugagauaaauacagaaacugaaauccaacuaagacuauuaggauacauuccagagacucugagcaaacacacaaauaugguaaugcccaauaaaaggaguuguaacuuuuggcaggucccagcauaaaaccuaaugauggggguggggugggagaggagagcacccucuuagaggcaagggggaggaggaaugggaugaggaacucugggagagggaacuggaaagguaagguggaauggaauguagauaaauaauuuuaaaaaauuaaugaugugagaaguaggcauaugauuaauuuuuccuaaagagcuucuagguauaucuagcuucaaagggcagugauagagaacaaaacauccccucauuuaaacuaagagagucuauaaauaacaacaaaauaaccugacucacccucuucucaauuuugaccucagcuccaggaucugcauaaaauucaaaguguagugugguugcacuggguggauauuucuguguauaaaacagaguaacauaucgagcuuaaacugauuuuagacaucuccaacacuuuccucaaacacauugugacaguaguagauuauauaucaauagugucuuuaaucagauauuugguagaagcagaaucagaaggcucaaguuuagagauacaaaucuguuuucaacaucuagauuaacuguuacucuuucuuuuaauacauaaauuuugacuauaguuauucuugugguggggucaagucugccaaguaacaaugcauacaacuuuaauaaauaauagugaacagggucaaaaucuuggcaucaguuaaagaaugaaaaagggcauucuuguaaaaauaucuuaacagccuccuuauggacacuuuuucuauuacuucaaacacuccuuucuauaccuuucuagaacauuuuucauggcuuucugcauugauacacaccaaaccaaaaaaaaaaucuacacccucaaagcacaucuuuuuauauaacucuacaaaaguaauacaagguaaacaaugauagccucauguuuucuuucuagggaauguuguaauggacaggguacuaucauuuuaaaauuuaguucaacguguacauguaccauuuuaaaguauaagaauuucaaacuguuaacaugccaaaucucaaccuugauaaagccaaggacuaaaacaggaaaacagucauggcacaaacccagaaagucuuaacaugcagaaugagcuucagaauucuucauuaaaauauguucucaaaauugaaacuccaaacugaguaagauuuaagacauauuucccuuauuaccaacauccauucacagcuacuuacugaagaucaucuaucagcuaagguaagaaaguaaccugcuuuaauauguagauuucugcaacuaaaaauaagaaccauccuacuaagggauaaacauuuccagaagauaaauuaguuagauuugaucauaucuacuuaaugaugaauaugacaaucuaggcucuacuugaagcacagaaagcagaagggaggauagccuaaauccuuaagagaauuggugacaagguaagaguauaccuaaguuuuuaaaaaacuauuuuuagaauguuauuuguaucaguguuuuaccugcaugcauaucugcugugccaaguaagugccuggugccuauagaggcuagaagaggcuaaucauagggcuuggcacuggaguuacaaauguuuuuaguugccacagggugcuggaaauaaaauguaggucaacuacucuugauuugucuacagaucccuguaauaaauaauucuuaaaaaaaaaauuuccuaucagucauuccugaacacugcucagaguucugauacuugugugaguacauaaguaaauguagucaaagcuggucuugaagucgugcucuuccucgugccauaucccaaauacagauguggaaguacuacucuucccagcuuucugggauuugauuaaauaaauucaacuuauuucagaacugguuauaugaacacacacuacugagacuuuuuuaucuauaacaggaacaauaauagcucaaauuuccuaaagauauuaugcacuaauuuuucaaguucuacaaaaguccuaaugucaagugucaauuuauauaucauacauucauuguuaagugaggcuuagaacaagacuuuaucauaucccaaauaguuaacucaccaacauuugcaagucucugcaacauucugcaaguccaaagccauucuccuuuccaccccagcucuugguaaagaaaaaaaaaaaaaaagaguuaacaccacgcuuauggucauaaguuuauaaaguguuuaaugaaaaaacaaacaaugcaaucuauuuuaugguucuauggagcugcucaagauaagaguacaaagcagcaaugcuagccagcuacuacauuccauauguauaaauucauacuugcuggaauuuaguuauagcuggccuuucucaccauucuagguuuuuuaacccuuuccuucaccaugguggaaccauguuuucuugacauaaaccaagagcucucuaagauucuauauuauuugcauguugguuugaauaagaauggccuuuauagacucauauuuucaaaugcuuagggaguugcauuagaaguguggccuuuuuggaggaaguguguaaccagggauaggcuuuaagguuucaaaugcccuagucaggccccaguguuuccucugccuucugguccagauguagagcucgcaagaucccucucagcaccaugucuacuugcaugccaccaugcuuccuagcaugcugauccuguacgaagccccugaaccuauauagcaagccccaacuaaguacuuuccuuaauaagaguugcugugguuaugguaucucaucacagcaaaagaacaugacuaagauguuuugcuaaccuaaguauaaaagcuuucaaacaagugccugugguaaugaguagcacaguuccugguaacuuccauaucccaaauucaaaccauauuauuuuugcuuauggacuagucugcaucuuugaccuuugaaauagccaaaauuuuauuagcaauauauauauacuuuuugagacaaggucuaauuguauaucccuggauggacuagaaaauauagaccaggcuagccuugaacuucuaaagauccacuugccucugccuccugguguuguugguauuaaaagauccaugccaccacaucuggcaagaauagcauuguuuuuguuuaaguaauugcuagucaucucagcuacaacuacgaacuuuaauaagcuacuuuuacucuugccuuaagguaagucaugccuggcccagcucaaacacaaacgccuucauacaauucucacuaauccaguaugugucccaaccacuauuuggcuguuuuucuacuaggaaagguuaucauuuccuucuuuagaaauauaaucacgucagcauguuuuugauaaaucuauaacacaauguguaucacugaagcugucauucaaagaucucuauuacaaaacccuacuaguagacaaaacaaaauuugccuaaucccagaaaaguaagcuuuuuguaagucuuuauuaacccaaaagcacaggauacagaaaagaggggucaaaugaugcuaacaauuucaaaacccaguuuaguuuucucuccgccucauuccugugggucaaggucuaaguucucaccuacugcucuccaacacuaugcccacuugcugcuaugcuccucaccaugauggccaugaacucuuaucucuuagcaccaaauuaaauguuugugugugugugugucuaaaaacuacuuucaccauacugucucuuaucacaacaauuuaaaaguuacugacaaaaggugguaccagaaaguaggcuacugcugugacaggacugaccauacuauuauuugaaaagaauguagaagacuuuagaaguagcaaagugguugaaaacuguaagcuaggcuuauuaggccauccuaccaggaguuuugaagacagcagugcugagaacaaagugaacuauggaggcauagcucaagagguuucagaaaacagcauuagcaaauaaagauccuaacuccugauauuuugguaaacaauguggcugucuuuguccugguccgaaaaaucucccuggagcuaaacugaaaauuuuuggacuauuuugaaacauagagaauccaagacauccuauuauugauucuuuuuugagauuaguaauaaucaccuuuauucaggccuacaaaggaaaaggccaagcaagacaaaaaagaaauaugaaauauacaauuuaaagagaaaaggaacagcagaaaauuaaauguuggugccauggcuugugcugaaagagauaaagagauaaggccagacacaaaauggaauagaguaauaauacccuugggcuaagacccccacacccaguuaguccuacaauuuaugaaaggaaaugcuuaagggauuuucuguuccuaaaaaggaguaucagaucaacucuuaugcaaauauaauuuaaagggaggagcaggcuccauuccaagaaggcagcuaaaguugacgguaucaacuaugugguucugacuuuaaaauuaugaaggauacaggagaaacaguguuguauaaucauucuaauuggcuaaauaagagccccugaagccagguuugugacauacaggaaguagaaccaaaccaaaauuaagaauuauauugcagucagcaaagguauuagggcagaacuaucuaaguucuuugacagaagccaaaaauuauguuuaugaugaugaacauacuauguauaaaaauguaguuuguaaagggaacagcaauaaaaacagaaaggaaagaaacagaaauaaagaggaaaauauuaaugaacaaaaagaauuuacuaugacaauaggaaaaaugcaaauuacccaaauagaaaggaaacugagacaacgauagaugccauaauuugacuguauucaaauuuuucacauaaaagguuacgcuuucucaauuggagaaagaacugauuucuuccuucacggaaaaagacuuuuuaccgcuguguuguuuucucuuuucuuuccaaccucucugugaaaugcaguuuugcuguacagcucaggcuuaccaacaacuaaacauccuccugcuucuguugcccaaaugcuggacuuaagugguaugccaugccuggcuauuacccuucaauuauuuuauagagucauguuuuuguuuaaggcagagccucauguauccuagauuggucuugaaauugcuacauaggcaaggacuuaccuucaauuucuuaucuuccugagugcuaggaauacacauuuacacuaccacacucaguuuaugcauguuagacaagcagugaaacuacaucuuuagccaaaaauuuguauuuuuaagcauucaguucuuuaucuuaacuuugcuuuuuaccaaauuguuuccugaauaguaacacugaaucauaacaauccauucaucuucgguuacagucaucuuuagcauaaauuauguguucuccccacucucucucaacaggguuucucuguauaguccugguacucaagaaaugaucugcccacuccagcacaaaccacaccaaccccaagauuaaaggcaugcacuaccauugcuauaacuuaauuucuuacauguuugcuguauaugauuuuggaaccuacugaaccaucaguugaguacauuauucuaauuacuauaccuuuauaaaacaguuuaaguacuuccucacuauguuucuaguauucuuuuggcuauuuucaggaauuccacggaagaaauuuguugaaaaccauauggauaggaauauacaaagucuacaggcuacacaaaagaaacagguaagaaaaaaaccacaaauauaaagauacaaggcagaagcuugacacaaucauuuuuuuccuucuguuuccccaaguaauagauaacacugaaaaacacuuagcuaguacacuaauaaagcaugauauaaaaguauauaugccgccgggcaugguggugcacgccuuuaaucccagcacucggauuaguaauccugguugagucagaacuccucagaguuuugaaagauaauaguaaaugaaccuugaccuagucuuagaauaauucuuugugaaauagauccugaacaacgagcaagaaauaguuucuugccaggugugguggcgcaugccuuuaaucccagcacuccagaggcagaggcagguggauuucugaguuccaggccagccuggucuacaaagugaguuccaggacagccagggcuauacagaaaaacccugucucaaaaaaaccaaaaacaacaaaaaaaauuauauaugccauaagugcuaauauacauauugagaaaauuuaucaaacugaccacaaccaauuuccuuauuuuguauuuguauuuuaauacuaggaagcaaaaucugcuuugucaccaaaacaaauguuuauaauuuuuaggagacacuaaacaggacuauuaaaacagcacuaguccauuaucuuuuuuuuaaucuuauguuuuuguacuguuuucucaguuauaaaugaauuugucaaagacaguguuucauccaggaaggguuggguauaaaguucuuuaaugguaccaaguggaaaugacucaggaacuaguuuacaggcuuuaaagagaccccagguaugaaauaacaauucuccagcaauuccaaacaccuaagaacauuacauuuugcaucucauaacuuuucuaggaacuaagcccauauacauuuccccccaaaauaauacucauuaauuuauuagccuugcuguauguacucaccuacccaguggggauuaucauaugacccugguaauuaaguugguauauaucuaaaaaauaacuaguauauaucagucaugcuuagagcaugcuuaaagcaccaccuuacaagaugagauccuaaaguauucagacgugagaaaaaaaaaaagacuugagguuuuuaaggaugaaacuuuaauuaauguuaagauuauuuucuaacuuuacccucagaucggugucauauauauauuaagugcuacucccaugugaugauuuauugcuuagcuaucacacugaauuuuaacaauuuuuugagacaggaucuuucuauguaggccuggauggcuuggaauucucuauauagaccaggcuguccuugaacucaaguagcccacuggauaauaguuauuccuucuaagugcuggauuuugaagauguauguuuccacauacuggccaguucuaacaauuuuguaucaucucccuaggaaaccaaaagaaaaccccacugucugcaacaaacacuuuuaaaauaauuauugcaaaucauuucuuucauuacacaguuaaguccuuaauuguguguguugaauaauuuguccaugaguucuggugcccaaagagaucagacuugucaaaugcuccugaucaaccaugaggcgcuguguguacauugggaauugagcuccagcccuccacaagaguacgcuccaaacugcugaaauccucucuacagauugcucuacuacaaauuaaaagacaaagaauuacuuggcauuuugcucauuuuuaaauuuucuucauccauuaggaccacagguuaauuauuuacaaauuuaaaacuucugagcuuccugaguuuauguacuuaaugucuauuuuuuuaaguucuuacuacauuuuuacugacuuauuuaauaagcauguggcaugcacaccugcauucuauaguaugcauguagaggucagaaggaaacuuuuagaagucauucucuuauuauauagugucuggaucaaacucuggucauuacuguuaagcuuggugguaagcaccugcugaacccuaauguuugauuaacgugaugaauagaaauuuauuauguaucuggcuguccuggaacuauguauaucaggcuagccggaaacucacagagcucucuacuugucuuugccuccccucaugaauauugagauucaaggcuccccccagcuccuauuauccauaauuauccuuccguuccuccccccaaccaacucuucuucccaacaagaccuccuacuuucaugccuuuguguauggaccacuuaauuuaacugaaguuguuugcaaacauuauguuaauuaucaaagauuaaacuuuuucuuuugaacucuagaucccauauugaacugucuuacauuucuuacaaugaggaaacacucaaaauauauuuagaaagcagguuugauggcaagagguacaguuuagugguaguauugucuagcaugagcaaagccauguuuuaucccuagcacugauaagucauaaaauuuauuaaacuugugaauaaagaaacuaaaauagccugaaaagugagucaaccccaagguaaccauuaaauugacuauuaaaacaaacaagccuccaaucaggugugguaauacaugccuguaauauuagcacuagaugggaucaugaggguagacuucagacuaucgcaagugugguugauugagaaugggccccauauaauuacauguuugaaggcuuaguccccaguuaguagacuauuuuggaagaauuaggagguguggccuugugaauaguuguggccaugucaggggugugcuacugauguuuuagaaagcucaugacagggccagucucuacucugccucuugcuugcaaaucaggauguuaagcucucagccacuguuccaaugccaaauggaugacuaccuaugaccguauuccucugccaugaugguuaugaacuguaaaaaacucucaaauguuuucuucuaaaguuaccuuggucaucauguguccucacaacaauaggacaauaguaacuaagauaaagacccugaaaaaaaauucuaagacaacuucauagcaaacuguguguuaucaaucaguuaaccucuaggaauaccacaaucuuuggauagaguuaaauuuuccuguaggaaaucuugacuccaauacaauaccaccauuagaaaauagcacuaacugaaaggacugaaggagcugaagggguuugcaaccccauaggaagaacaacaauaucaaccaagcagacccccccagaacucacagggacuaaagcaccaaccaaagcguacacauggagcaagccaugacuccagaugcauaugcaacagaggauggccuugucaggcaucaaagggaggagaggcucuuggcccuguaaagguucaauguccgaguguagaagaaugccagggcagggagaugggaguggguaggugaguggggggaacacccucauagaagcaggucgaggggggaaggggacaggggguuucuggagagaaaaaccgggaaaggggacaacaucggguuuuuuuuggggggaggaagggagaacaacaucauaaauguaaauaaagaaaauauccaauuuggaaaaaauagcacuaaauguucuccgauuauucuaaacaauucuuauuuaaauuccgaaaugagaaaacugguuaucagaauuaaagauucgaaucuaaccuuuuucucucgguaugcuucuuuuucacauagaauccuuauucugaauuucuccaaagcagcacuaucaguuuugaaacaagaauuuuguuucuugagcagaguugaugaaauauuucaaauuuaauuaauaguugagaauacucgugcuuuuugaaacuuuguuacacugucacaaauacuuguaaaccucagaaaguuaacaaaaggauucuaauccacuuuggcaaaacaagaaaugccuguuuaaccauaugcugauaucuuccccaaagacucaccucugccaaaugcugcagccgugucaguagcggaguccucuugucagauccaagacgugugauauaguuugaucuuuugcuaaauacauauagaagguuaaggacugccagcaccacuugcauaucagaggaagccaauaaaguugucaaaugcuauagaaacaaaaaagggacaaaguuuaguggaucaaguacuuggcacuaaaaacuucaaaagaaauucuuuuaauguaauaaugugugucaacauuaaaagcuaucaaguuauugagccacaauacacaaaaauaagucaaucucuuacaauauauaauccugcauccaaggaacagcugacuagaaaguucaauaacuguaaacacugaaaauugcagcucgauauuauaucuguaucucauaaggaagaauuucaagauagaaacaugcuauaauacauauguaggacuaaaaauuuauauuucuaagcauugugaaaugaaucuaaguguaugcuauuauuuccuuuauaacaaauauauaaaggacacauagaaacuaaaacuaucaacaacagcugugugcaauuacucaaaacuauuaaaguacgacaagcuugggaguaaccucuuuuuuuuccaaacagagaacauucaccaauauguugcagcacauaacuggauaaaacuaaaaucacuauguaauugaguuagaaauuaacaaaaguauuuuauuuguuuacuuuauauggacuuccuugggcagcacaucuauuucuuuaucaagacugacuguuuauccauucccacuugauguucaaccauucuacuacuuguccaaaaucauucagaaaauaaaacaaaaacaacagggugguaucaaggucaucaaguuuggcuaaaggaaaauaacuucuauuuaugaccacuaaauuuaagauuucuuuaauguguuuugucugaauguaugucugugaaccauguagccgcaaacaucaaguagagggaauaagauccacuggaaguggaguuacauauaguuguaagccuuccaugcuuacaugguaggaauucaaaccugaguucuacgcuagaaguaaucaacuguuaaacccuuuucagugcccuuuugaccauggauugauuaccucagucuuuauggguacaaagaauacaauaggcucuuauaagucccacccauaucauucauccauucaacuuaccauggauagacauauauuuuugagguacauucccauacagaguuuggucaguauuccuaagacaaaguuaacuauaaacacugcacauacacugcuacaauuugaguguaaaaugccccucuauaagcuuguuucugaacccuuaguuagccacuagucaguuuuacaagguuguagaacuuuuagaauuagggcacuaggguuuaagccuugggcauuauagcuuuuuuugguucaaaaaaaguaguauguaacugccaugagaugaagcugacuaccaccauccuugaagaaugaaaucuguuuccucaaaaacauuccucccuuguucuugucagcaauuuggucauaggaacaaaagugauauaauugugauggguauuacaaauaaucuugaggugaguuuaaguauuuacaaagauauauguagguuacaugcaaauauaccauucugaauaaggaacgggugcuuaaacucaccccccccccacagguaugaugggaggaguguauguguuuuggcaaaagacaucgaaaauuauaagcacauuaauaagaaaaucaaacuauuuuuaauaguuuaagaauaacuuggaauaccucuaaauaaucuuugacaaagauuacuaaauaguccauaaaaugcuucaauacagguacuauauucuuuaugccuugaaguaugaaacagagaaacuuucacaucaauccuaagacagguaauacuuaugccuaagaaaugccauacuauuaucucuuuccccuugugguucugaggauuaaacccaggggccuauacccauuaggcaaguauacuacaacugagcuaaauccccaccacuuacuacuacuuacuaucuuaagaaauccauaaugaaaaggaaagcaaacaaccaucagaaacagaaauucccuuguuugugcauacacacgauuaaguuaaaaacagaccacauagccuuauauucucuuaccucuauggaacuguacagaugccgagaaaagcuguacucaaugagcaaggcugugaaguucaauacagccaauagaagcauuuucagcuguucuuuuucuggccuaucacauacaagcauccaugacauauucuccacuguuuguccagcaucugccagaauuccaucaaagcgguccaacagauccacccagugauauaacucacacuagaaagaaggauaaagaggauauaaaauuaugauaaaaguggcuuagugguaugcucuaguaaucucaguauugaggaggcuaagguagaaggauauauaguccaaggagccuaggccacacagugaggcccaucaucaaaauaauaaugguucuuuuaacacuaaaugguucuuugaaguagaguuuuauuaacacuuagcuuuguuuucacuucuucaaacaucaauguauuuauguggguaugugcacaccagagaauacauguagaagucagaaaaaaauuugguggggggaggagaagaauugauuccuuccauccauuaugaaggaugcggggauuagacuugaucucucaagucaccagacuuggaaauaaaugcuuuuacuuucugaacucucucucucuggcucagcacauugguuuaucuuuaaaaaauaauucuuggcaacaauucaggcuaaauaccaguagccaagagcugugacacauauacuagauacuuaaguaacuauagaauaaggcuauuccauuacaguucucuuguucaucaucaaagcacacaaaaugauguacuaauagcauguucccuauccucuguuaucauggauuuuacauaccuugccaauguuccauguuuugauuugcugcaguuccaagaggaguugcucaucauuacaaacuuugaguuugucuauuaaggcucugcagucugcaggcuaagaaaaacaaacaaguauucauaaaagguguuuaggaaugaggaagaaacaaagagaaugggaaaagggacccuuaaacccacaaagaaauucaacuuuugcuuauauaaaacuaaauaguuuagauuacaauagaagccugugaggaaacacuuuaaucccaacaauccacuaugcauuuguuuaaaucugaauaaaccuguauaugcaaacuacuugaaguauacggacaauagaaacaaaggaaauaaacuaagcagcacuaaaagcaaaaauaaauaauuugcaacauagcuuaaaagguaaccagaauguuagaaggagggaaaaugaggggauggaagagagaagagagaagagagaagagagaagagagaagagaacgccaaccagccugaaaggaaaaggcuagcaaugauuuauuuuucuauaauauuaaaccuugaauuagaaaagaucauagagcuucugaacuuuguaaaacuaagacucuauucuuacuugguauucccauuuccauacauuccugauaucuuguauugaugaacaggaccauuaucagguaucaaggaguggauugagaauuuauaauaaagguucugaaagugguaaggaaaaugggauagggacugagacugggaaacauucuauuaauggacaacaggugggaaagugauuuuuuuuacuuaauucuauaaauggugucaugggaauaaacuagcuuuggaaacaaacaaaucuauguucugauuuugguuuuaugacuacuaugaugaauccuacuuacuauccauuacuuaccaggaaaacacaaucuaacaagcuagcuugaagaguauauucaaguaccugccacuuaguaaguacacacaagagaaaaauuuuaaaaacgaaacaaagaacaugagauuuagauuuaaagucauucuuacuuugaaucucaguauccucaucaagaaagagaugaauaguuagauaccaccuauauauccaacaaugcuguugugaaaucuaaaacuagaggaaacccuaaagauucccaucuccuauaagauauuuaaaacuaugauuuucuuuaagccaaauucucaacuuugcuaggaucuaccucaaauuuuggugaugauauguaugaaaaacaccuaacaccaaauucuucuauaaaccaggcuugaccucagccucacacccuuuuauguauagauuguaggaaaaacaguaaagaagaauaaauaacagaaaacauggagaauuugagacaccuguuaacacaguucaucugucccuuuuucauuuacuuggauuuaguaucaaaugcauguauuuaaauuucuaaugacaaagauaggcuaauucauuguuaugauucuguggguuagguaauacccauuuuguuguuaacaucugaguccuguaaaaacuugguaugucuaccauuacguggcauuuaauaucucacaaaccugguacccaagccagaucuugcuugaaugcaauauuguuagcaaaggauacuauggccuugccaaagacucugcuuggcaucaugaacaguuaugagauaucugagucuaacuggacaagccauacaaggcacaaaggcagcuugccuggaccuuuuaccaucuuuccuagaacucaaccucacuaauggccacugaaugcuuuagagguuaccaaggacuagaccaaaauaggauacuuaaaugcuacuucccaaacucaaguauuaaauuucucuaucuuugugguauaugaaaaaauuauaaacaauugucuccuucucuuucuugcuuaaauucuuucuuguuuugagacagggucucccuauguaucccucguuggucuuggaacucagauaucuaccugccucugcauccccggugcuaggauuuaaaaaguuugcaccaucauacccaaccuuucuugucucucuuauuuucaaagaaauccuuuaaacuugugagugagagacuuguuauugcugagaggggaaagagggaaggauuaggggacagggaggaggaaauagggaaggaggaaagaagggagagagaguaaauaugugcagaugucauaagacagggacaaucaugcagaguugguuuucuucaccuuauguucuaggggcugagcucauugagauuaaauuguaagaagacuuuuaccuggugaaccaucucaugggauuugguauaggcccaccuccaacccaacuuuucacaggguucaucuauuacacacauuuaaaucuaaggugcucguguuuucuaauuauaagguuuacuucucuuuacaguauuuuuccuauuucucuguacauaaaugcaaaccaagugggacugucccgacucacaggaaaaggcaagccaucugucaguucaaagcugcuaccaggauuuaccugaauuuguuuccauuaucaaaccuaugggggaaauccuuugaaauacugccaauauucuaagugaucaaugaaagaccaaaaauguuucuuaaaaauaaaaccuaguacugauaccaguaugaucaaugaaaaaaaaaucuuaaaaacugaaccuaguacugacaccaguaaaaucaaugaaaaacaaaacauuucuuaauaaaaccgaguacuaacaccaguaugagaaacugggcaaucuucuauguugcuugaguaaauaaggcaacccaagccuuaaaacacaccuagucagugauuuuauauucuuaaauaaucugauagaagcuaggaaauuuacauaagugugacuguaagagccuuauaauucacuuagcauaaaaaauaaaauuugcauuucucugaucaccuguaagagagacucuuucuaguuuacuggcuuugguccuucucugaaagguuuuaugcccauuuugucauugggauauucauuucuucuacugacaugguacaaaagauauuaacuauuuuggguuacaaauauuuucuccagcuugucaugucccaugacucccccacacaacugagcuuaauugugaacauacaaaaacagcacauaauuaacauaauuuggugaguuuauauggauccauacacucauuuuaccaucaccacauuucaggugaaaaauauaucaccucuaaguuuccuuguggcccuuuguguauuuguguguauuaaaaacacuuaacaugaaguuuauccucaacgaaauucuuaaaguacacagcaauuuaccaguaacuguaaguucugaaacuuauccuuuuucuuuucaaauaggguaacacuauguagcccugaacuuguggcucuuuugccucagucuccuuagacaggagccaccauacccaacuuuuuauucacuuuguacucacuuguuuuacuaaauuauacauagccauagaacaauuccccauucccuccccugauaaacaucauucauucuguugccuacuuacauaccuuuugacuauuuuagaugccccauaguagaggaaucaugcaguauuuguuccucuguaauuaacuuauuucacuuuucauucuucuggggggaguuaauuuuaaaaauauaagaaauucuucaacuucauaaugaaaaacccccaaauaacccaauuuuaaagugggcaaaggaauuugaaaagacuuuucuccaaagacaauggccaaauggcacauacaaagguacucaacaucacuaauaaucagggaaaugcaaaucaaaaucauaaugagauauuaccucauaccuguuagaauggcuauugucauguguccuuuuauuuuggauaugguauuuuacauuuccauuuugguauuuuguccuuugccuuaaugcuuggaagggcaauccccaccuaagacaagguaaacauucaccuguauguucuacuucuccuauaauuucuuuuaaaaauaucugacuuuugaugacuuaucuacaauuuacuucaguaaaacagucccccgcaccaucccacccaaaucaaauguaauugucuuggcacauuuuauugacuaauacuguucuuucccacaauauauaaucccucuauuaaguucuuauguaugcuaaguuguccugauuuucaacucucguauaaauauauuauuacgcugauggcacugucuuguuuuuaaaaaucuuaauuccuuaagacuuuuuuauucuucacuuuuaaauauaauagucaucaaaacuuauaaauaccaaaacacaucaaaaacagaaucaaaugaaaacuuacagaaacaauauuaauaugcucaauauauggcauuuaguaaaaacacugauauuccaaugucaaaauacaaaauaaaaggcuaauaaaaaagucaaugaacuuaccauuuuugucuucaaaacaaaacaaaaaacucuuaaguucuauuagcuauagucaauuuuaauucuacaucucuuuuccauugucauacugucuuucaaugcuuauauuguagccugagagucccuuucagggaacaaauaccuaaaguauuauucacuauuccuuuuuccacuggucacuuggcuacuaauuuuuaaucaaaguaaguuaaaauggcaagguaguauuauuuuuucugguaguguucaggaugcaacccaaggccucaugcaugcuagacaaacagagauauuccuccuaguuucacaaguuacuauaguuaacacuuuguauuaacuggacauacuuauuuggaagaucagaacugcugaacuggucacaaugauuuuuuuccugaaauaaagaaaaugcacaaagcaaauuuggauacucacagcuucaguaggugucuuuuucaguuuaguccugucuacuuucauguuuucaguuuucugauuuaagaucugcaaaaaaaaaaaaccaaaaaacaaaaaccccaaaguaaugagaaaauaaaguuacagauauucuacagcucuacagucuuagaaauacaaauauuagaugaagaguaugcaagauaccuaguguaacacuggaguuauguuaauucgaugauaugguuauuagacagaaaauggcagaguaucuuuagauaaaacuaaccaacauuccccguuacaauaaaccccaaaccaaacuaagccaaaacaaaaaagcuuuuuuucuucuccuauuauaaagauuucaaacucuuuauugacacaguuaaguaugcaagguuuuucgauaacuugggguggaaaacucacuauaagccucuaguuauggggggggggggucugggaauuuaggcaaaauuuuaaagauguacacaaacauuuaacauuauuaaucuauauugcaugaguagguacaaaagugaaaaaucagaaaguaccaaaagccccaauuaagauguuuaaaguuguuauuuaaaucaaauuacuuuauguguguguuucguucacauguauguauguacaucauagaggcguggggcccagaagccauuagauauauugaaaguauaaggaugguugugagcuaccauacagguaccaggaaaaagugaucuuaacuguuuucucuucagcucuagaauugguuuuugaauugacuauauaacugcuagaaaauacugcagacaauuacauaacagaaguuugugauuaaguaaaaguuauaacaugaaauauagaucuacugaaucagacaucaugauucacaccuguaacuccagacuggagcagaagaaggaucaaugggaauucauggcuaggcugggcaacagauaauaaaaaagcaacuaaauauuaauuuaggucuaaagaaaauacucgagaaaggaaaugaaaauaucacuuaauaaugucucuaucagacugccuaaagucuauaggacauuuucuuaauuaaugauugguguaggaagguccagccuacuacagggaugugaauagugacaucccuggugguccuggaguauacaagaaggcugagcagggcagaaagaacaagccaguaaauucucucccucuccauggccuaugucugguucaguucacgacuuuagauuccuguuuggguuucuucccugacuccuuuuaacaauagacuguauaauguggacgcauaagccaaauaacgcccccgccccacuguaauguuaacucacagcuaaacacaaggauuaaggcuaagccaugugaugguuuuggcaaugugccuuuuaacaggaagauaaauuaugucuuuuuguauguauguauguauguauguauguauguauguauguauguaugugagugaguauacuguagcuguagagaugguugugagccuucaugugguucuugggaauugaauuuuaggaccucuccuugcucuggucagcccugcucacucuggucaacuccacuugcuccagcccaaagauuuuuaucauuauauguaguacacuguagcugacuucagacacaccagaagaggguaucagaucucuuuacgugugguuggugggguuugaacucaggaccuucgggaaagagaagucuuaacaaagacaauucuuagcuggguggugguggcacacgccuuuaaauccagcacuugggaggcagaggcaggcggauuucugaguuuggggccagccuggucuacaaaguaaguuccaggacagccagggcuacacagagaaacccugucucgaaaaaacaaacaaacaaacaaacaaacaaacaaauaaaaauugaaaaaaaaaaucagagaauucuuuuuuaaaaauacuaagaaacaauguguaagacacuacuaaaacuguucugacaguuuaacacaaucacuuugguaagaccaaguaauuuagaaggccccaaaauagguaacagccuaaucagacccauguaaugccuguaacauuuaauaacagauaaguccuugaagauacacugaccaaauuguaguaagaaaucaacauuucuccuacuaucaaaaaggacacaugcacagugguagagguagauuucaggcucuucagaaagaucuggugcuauuuaagguaaccagucaugaauacauacacaucccagguagcuucuguccuaauuaucuguuuugcuuacaucuacucaaucaaugaguauuaaggaagagaugguuaaaagauuaagaauguuccacaguauuuuauuuuaaugauaggcacauuaaauauuauguuuaaauauuaacauuugaggccaugucauuuuugacauacauauaaaucaaaguuaauauauuuucaaauauuuaucacccaaaacauuugguuuauacaguauuugaacauuaaacaacguucuccuauaauuaauauuuaggaauauguaacuacaaauucccuuguaaaauuaccucaucaucuaacacaaaggacaagauuaacuccuaucaacaacuucaaaauaccuaaaaugaggccaacuagauccugacaacaaucuuaaccauggaguagaaaccauauacugaacaauuuguacacuuaacuaccaggcuuuuuuguuguuguucuuacaaaagauuuuacagcuaacacuagaucccauuauuggagauacagguauauguagagaagcaauuaaauugcuucugauaugagaaguagcaaucugccccaacauuguacaacucaaguauauaauggugcauguuuucccuuuagaaugaaugaggaacugaacucagaguguacucaucacuuuauucaaagacaauguuggaaguucuugcccuuaauaguacaacacuagacaguaacgagcacacagaccagaaaagaacacaacuuucccuauuucuagacaaguuuuaucuacauuuuuuuuaaaaaaucccauauuuauaaaacaccucgcagaauggccaagcagauuuaguagugauaaaaguacuugcaguauaagcacaagaacaugaauacaguucaccagaacccagguaaaagucuguaacuacaguguuuggggcaggugagaagaaaacagauccuggggacucacuggucagucagucuaccagaaguagaaaaccucagguucagagacucaguauuaaaaaauaugauagagaacaauagagugacacacucaaaguugaacucugcuucuacauacauaugcacugacaaauacuauacacgagcacucauaacauccugaagauucaacaugguagaugucaaaucuccuaaaauugauagacaauacacaacacuauuccuacuccaaucccaguaagacucuugaguaaaccuaaacuauuccaaaauguguaugggaaagcaaaggaauaacaauagcagaaacaacuuggaaaaauaaaaaugucaaaucacuauuuuugacaauucacauguuuacauaaaaaauuuaguuuguaagccccacuccaugucaaucugcucuuucccauuccugcuggaaccccuucuucccagcaagaccacuccuacuuucacuauuucucuuugugugugccccacugaguugaaauuaaaaagcauugauaggagguuauuugcugaagcaagaacaauucaacaauuguuagacuauugcauaaaaugacaugccacccccaacaauccuuaucuucccaacagacaggaguagguggggguggggagguguuugucuugucucauggguuaaacacuauuuuuggagacagaguauugcuauguagggucaguuagucccccuguagugauaggauaacaagcaugcaaggcucaaccuaacccucuugagggguagggucaaacagcuuuuuaucucagccauaccucagaaauuuuaaauugcuuguguguucacaugcaccuguguuaugcauauaugcauguggaggucagaaaacaacuuggcaagcgcuaguuucuuuccuuucaccauguaggguugagggguuagauucagguugugaggcugguucucaguuuuuuguuuggguuugagggauuuuaauuuuuguuguuuuaaacgagaauaaagaccugcucuggcuguccugaaacucacuauguauaccaagcuggccuugaacucugaagacccacuugccuguuucuugaaugauaagcuuaaaggcauguaccaccauuaaauaucagcuacuaacuuuucuggcuuuuucaaacacgguuucuguuuaucccuggguguccuagaauucuucuagguagaccagacuguccucgaauucagagaucgaccuauuucuccucccaagcacuacuucuggccagucacuauuuuuuauauuaaacuuuaagcuaagagauacaaaccauucauuuauggucuccaacauauuuugaacuaugcacaaauuguagaauugcuaaaauaguuaaugagguacugccucauauaaauuuuggggguauggagaaaaacaccuaaaagucgacucucaacaauuuucauauguccauuaacuauugucaucaugguguauaauguuccuagaauucauuccuccuaaacugaaaucuuguauucuuuggacaguauuuuccaaaccccuagcaaauacuauuacuaccacucuauaccauuuuauacauuaagacacuauacauguauacacacacacacacacacacacacacacacacagaguaguacugacugagagacauguauaucauuaagauagauuaaaaaccccaauauacaaauacacccaagugacaucaaggaagcauugucaauaaaaguugucagaacaagaauaaauccauauacaaagugauaaucuauggcccaagugucacagcucauauaaauuaauucaaagaacuagagagauagaucagcaaauugugcugcucuugcagaagacccaaguucgauuccaagcacccacuucauauagcucauaaccacauauaacuccagccaaaagggauccaaguucucuuuuggacuccacaagaaccugcacucacauacacaguaacacacauguauauauucagauaauuaauuuuuaaaaauuaacucaaaaugucccagaauuaaacaaaagguauauaaaauccuauugggagaaaauaauuacaaaucauguauaguacuuagaauauauaaagaacucucaagccugcuugccucuccagucaccuugaggcuguacuucaacuugguauccuguuagccucuggcccaggacucuacuccauuuucuuguagcagacugcuuuggaaacuccaccaagugaccuaccuccccuuggcuuccuguuaguggagugcuuaucugguauccugggcuagcccagaggcugggugccccaggggucuauuaacugggaauccccaggggcacaacaggagccaugcuuaggaauaaccacaaguucaggccucugacuccaaagggacuaagaagacuaugauuagauaggucuccagccccaguggcacccaaggaucccugagagacuaaagcuuugacuccaguggucuuaaagggcaaugauccagguuuugacugagguuccaguggucagucgguuggugugugugugucugucugccugucuaucugucucugacacacacacacacacacacacacacacacacacacacacgagaaugaguaugaaugguauuucuaaaaauucugggauacaaucaagaggugaaauguaagaauucaugguguagaaagaaggaacagauaaaaucaguagaaacacaggcuauuuauuggcauuauaguacaaguagauaaaacuacacacauaaagacauauagaaagaacuccacauagacaugaccagagaagaaacuccaugauacauuagucaggaugucaaaaauacaaaguaaauaaauauacuagaaguaacaugaggaaaauaucaacuuacguacaaaggccaaagaaauaucagacauagcccagacuuuucaucaucaaacagaaaccaacacaaaggaaguaaugucuuaucaaacucugaaguaacugggagccaagaauguuagcuagcaaaguuuaucuuucaaaaugaugaagaaauaaggauaguucaagacaaacacaaauuauggcaaucaauaacaaccaagcuagcacuuugaaaaauuccuaaugaaauauuauacccuauagguggaacaacaauaugaacuaaccaguacccgggagcucuugucuuuagcugcauauguaucaaaagauggccuagucggccaucacugcaaagagaggcccauuggacuugcaaacuuuauaugccccaguacaggggaacaccagggccaaaaagggggaguggguggguaggggauuggggggguggguaugggggaccuuugggauagcauugaaaauguaaacgaggaaaauaccuaauuaaaaaaaaaagaaauauuauauaagguggacgauagacuccuuuauaagauuguacacgaaagugcacaaucuaugaaaaaaugggugaauuaaguaggcugggaaaagaaucaaccauuuauaauuggagccucgaauuucauaaaagaaacagcaaaaggcauaaaaaacacauagguccaaguacaauaauagugagaaacuucaauauaccacucauuucuauagguguucugaaaugaaaaugggcaaaggaacuucagauggaaucaacuuaacagauacauuaaaaauauucuaccuaacagagaauaugcauuuuucucagcaguacauggaaccuccaaaauugguaucauagaacaaaaagucccaacaaauacaaaauaaaaagaaaccacacuaauuccuuguguccuaucagagcauaaaagaauaaaagcagaaagaauucuacaagagaaacuacaaaaauauuuggggacuaagugauacauuuugaaguaacagugugcuauccaggaaauucaaagggaaauuuaaaauuccuagacaccaacaaaaugagaacaaccuacuagaaccucccuucugagacacaaccuaggcaguccuaagaggaaaauuuauaguacucauauuagaaagugagagauguggggguggagggagauccagugaaggagagcaguggggaauauggagccugaaguggccaccuccuguagccaggcaagacucucaguggagcaauagagucacuaaaccacccacaaaacuuucaacccaaaauuuauccugccuacaaguaaugcagggaauggccagccaaugacugggucaacuugagacucaugccacgggcaagcaacaaucccugucacuauuaauacucuguuaugcuugcagacaggagccuaucauaacugucuucugagaggcuccaccuagcuaacagaaaaagaugcagacccagagccaaacacuggaugaaacuaggggagucuuguagaagaguugugggaagggcuaaaggacccagaagggauagaaauuccauaggaagaccaacagagucaacuaacuugggcccuugggggcucccagagacugaaccaccaaacaaaaagcauacaaaggcuggaccuaagucccccccccauauuuagcagauguauagcuuagucuucauagggucccccaacacuugauguggguaacccugccugcugccugcuuggggauccuauuccccugucuuaucuggccucagucgaagaggaugcaccuaguccugcagugacuugaggugccaggguggguuaguacccagagggggaccucccccuucucagaggugaaggggaaugagguaugugugaggcaggacuaugagaggggaaauggggacaggggacuaugaucaggauguaaggugaaugaauuaauaaaugaauggaaaauaaaaagugagaaaucucaaauaaauaaucuaacaaagcacauuaaggcuuucuaaaaaacugcaauucaaaagccaguaaauggcaaggaauaaugaagacuggggaagagauuaauaaaauaaacugaaagaacaauacauuaaaaaaaacaaucagggcuggugagauggcucaauggguaagagcacccgacugcucuuccgaagguccggaguucaaaucccagcaaccacaugguggcucacaaccauccguaaugagaucugacucccucuucugaagugucugaagacagcuacaguguacuuacauauaaucaauaaaauaaaucuuaaaaaaaaaaaaacaaagauuuauuuaaaaaaaaaaaaaacaaucaaauaaaauuagauuccuaucuuucucuuuauacauuaaucagucagaaauugaucaaagaccuuaauuuaaucccccaagcucagucagacagaacauucaauguccaaccauuuccagcaaaucuuaugguuuuguacuaaauaguccauuuuacauauguaccagauuuucauuauccauuuauccaucaauccaucaugauggacauauaaguugauuccauuuccuuggaauaauaaauagagcagcaauaaacaugggaguggaaauaucucuacgguaggauauggaguuaugaguauauguucaagaguggaacgaugggucauccgguaguguuuuuuuaauuuuuugaagcacucccacacugguucccauauuaguuguauuaauuugcacgcuaaccagcaaugaauaauuggauaauuguuuuguguauuuuuacucuaucuucugguacuugggaaugaaguacccuauuucauucuucuuucccuauuuccuuucccucaaacaucuggauagguagcuauccucauugagugaaaugguaugucaaaguaguuuuauuuguauuuccuugauggcugggaugugaauacuuuaaaauuguguuucaacacuggagaaacggcucagagguuaagaacacuggcugcucuugcagaggaccuggauucaguucccagcacccacauggcagcucacaguuguaacuccgggggacuuggcucacuucuggccuucaagggcacugggugugcauggugcacauacacacauacaagcaaacagucguacacauagaauaagguaaagacaucgcuuaaaaaucuacuuacaaaauuguguuucuucugaaaacugcguacucaaucucaucauucagauguugacugcaaguuguauuugcuuaguguuuacguaauucucaguaaaucugaauauaaaccuuuuaucugaaguauaccuuguaaagacuuuuucccacucugugggcugucaaugugcuuucuuuauaauuuuauuugcuguguagcaacucuguaauuacauauuuaguuugcugauacuugguucaguuacucugcucuuaaaauucuguuccaaacuugcuauuuacccccagugccuagaaggguauucccuauguuucugacugaguuuggaggauuaaagucuuugaucaauuucuagcugauuaaugugcaaggugaaggauaggauuuuuguguauuguucuuucagcuuauuccauuaaucucuucccuaaucuuuauuccuugccauuuauugguuuuuggauuggcagauuuuugaaaccuugaugugcuucaaaagauugagaucucucacuuuuuucuauuaauuuauuuuuaaguauuuuuaaaauacuuguuuaugggagguccaaaauaaagguaaguaaaagacacauagauuggaaugugucuuaucauuucaucuauguagaaaauccaaaaaauacacccaauagccacaaagaaaaacucccuccugaaaccuccagaauacaagguuaauguaucaauuacucuuacauaugcuaccaugaacaacuggauuugaaaugaauaccauuuauauaagcagcuuaagaauacuuaaauauguucagaucuaggaggaaaacuacagaucauuaaugcgguacuagccaauggggguggggggaagaacaaaucaauggaacagaaaaugaagcccuaaaauagccccauauaaauuggucaacucugacaaagaaucaaagucaauauaugcaugagagauuuuuuuuaaaagguacuggaauagcugugcacccacaugcaucauaaaaacgacaaaacaauaaaauuccacauuuuucagaaaaggcaauucaaaauggaucauagaccuaucuacaaaauguaaaauaauacaucuccaaaaagaguuagaugauacagguuuuggugacgauguuucaaauuauaaacaaggguauccauccaagaaaaaaauauuaaugcauucucuuuuaaaugaauaaaaaaaaagcuagcuagcauggagaaaauauuugcuaaaaaaggcaucaagguaacuaggacauggcucacgaugaagugcuugguuuaauccaaaguagcaaaagacagaguaaagacauagaaaacaauuauuaaaaauauaaaaauacacaaagaaagccaggcguugguggcgcacaccuuuaaucccagcacuugggagguagagacaggcagauuucugaguucgaggccagccuggucuacagagugaguuccaggacagccagggcuacacaagagaaacccugucuccaaaaaaaccaaaaaacacaaagaauagagaaagucaacaaaaauaaaccaauaaaaauuuuaauggauaccuuaccagagaggauauacagauagaaaauuaacuaaugaaaagaugcuacacaacaagagacugugauaaucagcacugagauuucacuaugccuauuacaauaaccaaacccagaacacugacaucagaauguuagcaaggauguagaauaagaagucccuuagauugccuggaagauggcuaaaauggcuuuagagaacuaagcauauucauaaaauauaagauauuauuugcauuguaacugucaaacuuugguguauaucagacaaaggaauauuuaguacuaaaugagcuaucaagaaauagauguggaaaaaucucugguuacugaacaaaagaagucaaucugaaaggccagauauagagccuuuaaucucaguacagaagcagauggaucuccagagaaaaugaacaaucgaaaugucaaccugauuuuaaaacaaaccaaacaaaacagacuacucuaauuauaugguauucugggaaaauauugagacuacugauugccaggaguuaguuaauagaguacauaagauuuuuuaauacagugaagucauuccauacgauagguuaaauacaugcuauuuuaaauauagucaagaccccccaaauuccuaaugccaaggguaaauucaaauguaaacuauagauaaucuuuggaugauucauuaacuguaacaaauaugccauucuaguaaaggaaugcugauaauguggaaucauuuacaguggggacauacaaauucuuugagacaaauguuuuucuacauggcccuaacuauccuggaacucagauccacauaccacccaagugcugaaacuaaagauacaugccaauacuguucaauuucuaugugaauuaaccacuuaaaaaaaucuuccaaagaacaaaguaccaaguaccuuacccacuaaauaaaauaaauauaugaccacuuugcuguuauuuaccaaaaacuguagaugagaucacugguaaaauauucccagaaauaagcaucuggcucuaauuaaaacuguuuugacuauagauacuauauuauucaagugucaaggacaacauaaaagccagguaaugcgggaaagcaauuuauugaaagaguaucuaguagcucagagaacuggaaggagccuacaucuacauucggaaaaugguagaauuuaagggaagccagguaaccauauccaagggagggacacaaaagcaguuuaguuggggugcuucugcugccaauaccagacuuuagaugcuggucgaagcagaaagaccuguaaaucaucucaggucccaaauuccaaguaugagcaucugauauaugcugcucaccaacacacaugaggagccaaaacaaauaaaugcucccuauaaccagugaacagcuagucuguuuucuaucacucaagugcaagaaauacuaacaguuaaaaaaagaaaugaaagauaguauguccuugagauaucaauuaaaauucugaaguucuguucucaguucaaaccuacuauuauaacaggaaggagaauauuuacuuaguguucaucauaagccaaacaauauccuguauuuaaaauaaauguuaugagcauuuaaguacccugccaggcugacagacauacuuaaugauucuaaaaacaacuuuauuuaaggaaggcacacaacaguguuuucaaguagugcuuauuugguaucuaacaauucaagcauucuaaagaauauacuuugaaacaugucaguuagagacuugauguauuauuacuucauacacaaauauucuuucagcccaauuugucccuauuuccaggaaaaaaaggcccacaggaaaaucagcaccuuguuugguuagcgaaucuugagagacuaaauuuuaacuaguauacagugucacaaauaaagagaauagugauuggggaauggauucuaucuuagaggccaaacaaauaaaaacuccauuacauagaaauucccaacaaaaagaagauaguuuuuaaaaacaaaauucuggaaauguuuugcuuauaaguaucaaacuuguucaagugguucuucuuaaauuuugcuugagaagauagaacuauuaagaaaauggaagaauuggggugugguggcgcacgccuuuaaauccagcacuugggaggcagaggcaggcggauuucugaguucgaagccagccuggucuacaaaguaaguuccaggacagccagggguacacagagaaacccugucucgaaaaaccaaagaacaaaacaaacaaacaaacaaacaaacaaaaaaaccccaaaaccaaaaaaaaagaaaauagaagaauuauuauuaaccaccaccaaugcuacuacuuaaauacuuuuauuuaaucaucuauuuuuuccacuucaucauucucccaaccuuaauuuaccuuugaaguuuaaauuucguuuacauccagaacaaguguauacagcuaaaguacauggaguaaggagcuggagagauggcucagugaauaaaagugcuuguuacagaagucugauagccugaguucauaucccugaacccacaaaaagcuaggugcaguauuguuuuuauaauccuagcaguucuguucagugagagacagaauaagaauugccuacuacuuaaguggaagauaacagauuccuggaaguuguccucugacauacacacaaacacacacacacacacacguacacacacacacacacacacacacacguacacacacacguacacacguucucguucucucucucucucucacacacacacacacacacacagagagagaauaugacaccgaggacaccuguaguucucaaauaggacucaauagaacuugcgugcauggguagauagcauuucuacucagcaugguccaaggauaagcagcacugaugaauuucuggacccacuuguaagugaaaaaccagaaucuguauuuuaguuaagauccuuagaugguuucuauauuaaauuuuaagaagcacaaggacaagacuggcauaguggcauagaccuuaaucuuagcaagcagaugcaggcauaucucugugaguucaaggccauaaaaagaaaccugaucuuuaaaaaaaaaaaaaaaaagaaaagaaaagaauuaaagaaagaaaaugcagcaccaagacagaaggaucuuggcuugacuuggaggccagucugcaugacauagcaaaacucacugaaaaagcuaacauaacugaaagaguccccauaguaccugugacaguuguggguacaaaacaauuaagcuucucauuauauucacauaauaaugaguacuuccaugaguuuugaauagcacaaauacuaggaucauauucuaccuaaacucuuaaaucuuuacuaggaaauuuccacuucccuugacaauuaaugagaaaauaucuaccacagggugaguacauugaaaaacaaacaaaacaauaucaaaaaacccaccgaacagaacaguugcacacagggauucaguuauuaagauaguacgcacaagacaugcgcaagcuccuaucagacaaaauaccaaaaugaauaguaggagguagacaugaaacucuaccaacuaacugagaugcuauuggcauuugauagcugcuaggagagucagguuucuuuuaugguggguggguagagguugacaacacuccaggauaggccccacucccaaaaguagcuggguaacacaaauuagacucaaugaguguuaaaagaaacauuucaaguugaguggggaggaaggugaggguggaucaggaaggaguacaagaauaugauaaaauggcauuguauaaaacuaucaaggaauaaaaaaauuuuuacaauauuagaauuugccucuaacuaggugguggugacguacauguaugccuuuaagcccaguauucagggggcagaagcaggcaguucugugaguuugaggccaaucugcaacagaaaguuccagaacagccaaggcuguuuaaauuaaccuugucucgaaaaauuaaaacuugccucuagaugguagaaaaaauacauacuuuuauuuaugcuuuauguuuuucaaauccuuccauuuuucuguaagucauacauucacuuauaacaaaccuucaucgcuuguaauuauuuucauuacagaagauuagugguuccugagccaaauaacaugggccaaauuuaaagcaguauuacaaaugccuuagauuaguuguuuuguguguccaaaccuugacauauaguacugaauuuucuauugguaugugaaagguuccauaaacagacacagacagacaggcaaaguaguacacaaaauuaauuaauuucaacugaaacugugguaacauuuaaacaaacaaaacuagaacacuaaacucaaauucccauaaaagaauauacuuaauacuuuuugccucuugcccuucucuaaccagaaaauuuagguaggaacagcacugaccaugucagaaagcaauaagaugcaccuugaaauaaaaaaaaaaaauacaaugaauggcugggcagugguggcgcacgccuuugaucccagcacuugggaggcagaggaaggcggauuucugaguucaaggccagccuggucuacacagugaguuccaggacagccagagcuacagagaaacccugucuugaaaaaccaaaaaccaaaccaaaacaaaaacaaacaaacaaaaaaaaauuaaugaaaagagacuguauggggcuggagagacggcucagugguuaagagcaccaacuguucuuucagagguccugaguucaauuccuagcaaccacaugguggcucacaaccauuuguaacaggaucagaugcccucucuucuggugugucugaagacaaaaguacucauacauaaaauaaguaaaagaauuuuuaauaaaaggaaaagaguaugaauuuaaagaagagggaagguaucugaaagguuuggagguacaaaggggaaggaagaaauuuuguagacauagucucaaaaaauuuaaaagaaaaaucacuuuuagaauuccugaccaaacuaaacaaacaaaaacacaacaaaaccccagccuauucacuauugauuacagaguuauagacaucacugauugccugaaggaggacuaagcauaauuuuuaagccuuucucuaucugaccuaaguuccaauuaauauacagccaagacuuuaccuaucacacauuaauaucuaacccucaugacagcuugagaaaugaagacugugaccaauuuacuaaggucaaaaaaugucuauaggcagggauaagaaugcaaauucaaacuaccaaccacucccaccgccccucacuacaggcaccaguaucccuauccuuagcuacauaaaauggcaugggaggauugcucagcuaaaucuaugaccuggcaguaaaaugaaauaacaaaacaagcagccuuuacucaccccccccccaaaaucuggaaacucauuugcagacauugcuuggaagucucauacaaaaucugaauauacuaaaaucucaagauaaaauguguaugcuccccccaggcgccuuuaaucccaccacuuaggaggcaggaacaggugguucucuauggguuggaggucagauugaccaauagagcaaguuccaugacauccagggcuaaacugagaaagacugucucaaaaaaccaaaagggaaaaaaaagcauguauguuucucuacaaaaacaaacaaacaaacaaacaaacaaaacuaccuaucggacuggagagauagcucagugguuaggagcacugacugcucuuuccagagguccugauuucaauucccaacaaccacaugguggcuuacaaccaucuguaaaggaucuaaugcccucuucuggugugucuggaaacaccuacaguguagucauauaaauaaaacaaaucuuuaaaaaaagacucuuuuuuuucuguuuuguuuuuccagacaggguuucucuguauagcccuagcuauccuggaacucacucuguagaccaggcuggccucgaacucagaaauccugccucugccucccaaguguugggauuaaaggcgugcgccaccaaugccuggcaaaaagaugauucaucacauccaguuucuaagauuauaagugcuuucuucaccauuguccacuuccaaaagaaaauuaagaaauuguccuuuaaacuacuauucuuuauaaaauuucagaaacuugucuacaaaaaaacaagugggaguggguggguaggggagcaggggggaggguauagaggacuuucgggauagcauuugaaauguaaaugaagaaaauaccuaauaaaaaaauugggaaaaaauccaguccauaccuaacaagcaaauuucauuacagauaaaucaaugaguucaggaaaguauuuuaaucuggcagaaaucaagucacucaguuccccugaaacucuuuuuagaaacugaaaauaccuaguuacacaaauaccaaacucgguucugggguggagacugucauacauuuuuuuaagcuguauaaacagauuuggcuacacagaucagccgugagagcugugccaauccaugaaugacuuagaaaccuguuucaaaauaacugaaagagggaguaggguauaaauaaauaaaaccacauccgcaugcuguuuuaacuguuaguagcuggguggcagguacauagguuaucauuguaccaucucuauauauuaaaaguaugcuaaauuaaggcucuauccugccagaucucuaaucccaucaucacauuauuaccaaagcaauauuccuaaaacuaacuauaaguacuaaagcagcacccaagaccugcaucucucucucuuaauggcaaaauggcauuauauaguauucuucucaugcuuuggucuuguuaaguuucacauucccuagcacucaagacuuuugaaaaguugacuccugaauaucccuaaaaguugagcuuaaauguuaccuccucacuaugacaccucucucaagguaaaauuuuacccucaauccacauaccauuuaccugacacuucccucagaaguucugaaugauugggucuguaccauaucugguuuuuuuuuuuuuuuaagauuuauuuauuuauuuuauguauaugacuacacuguagcucuuuucagacacagcagaagagggcaucagaucccauuacagaugguugugggccaccauaugguugcugggaacugaacucaggaugacuguuagagcauuuucagcaucuacauuagagcucagaaccagauuauccaaugucuuuucuggucuccacagacaccaggcacaaacaagucacaaauacacuugcagacaaaacauccacauauuuaaaaugcaugcuuuuacuuacauacacaaaaaugcaaaaccaaaauuuucaguugauacuacccucugauucagggucaacuagguaggaaucaacaacugaguaugauuauaguacauuacuagucaaccaaaacucuggauguaauaagaauugacaaaugggaaaucauaaguuucuacacagcaaacagaacuuagaauaaaacacuaaaagaauggaagaaaacucuuugccugcuauuuaucugauaaagauuaauauccaaauggucaaaugaacaaaagaaaagcaaauggucaaaaaagccuguaaaaacaaaguucaucugauauaugcauuuuuuucuaaauagcaaauauaccacuucacaauuuaaaaguugagaaauaaaugggcuuugaaaacauuuucuuuuucagugcucacaccaaauccaggacuuggggcaaaagaagugcuccacuaaugaacuacauucccaguucagaaaacacuuaaguuuuauggaucgacauucauucccacuuauugacauacaguguccacacauaugugugaaaacagagacaagaguuagcugugggaucuggagagauggcucagugguuaagggcacuggcugcucuuccagagguccugaguucaauucccagcaacaucuguaaugggaucugaugcccucuucggaugugucugaggauagugacaguacacucauauacauaaaauaaauuuuaaaaagucuuuaaaagaguuaacuauaauggcucuuauuugaaauucaaacauuagggacuuuaaggcagcaggauuggcacagguuugaggcuagccucagcuacauagugccaggucagccugggcuaaaaugagacuaucaaaacaaaaauuccuucuaaaaacaaaccaacaacaaaaacacccuuaaaaaccugccaaauuaggcuaacccauaagaggaugacaguggaaauguucaaaauacacuguaugaaauucucaaagaauagaaauguuuuuaaaaggcuacaaauuggacucauacuggaauguaggucaaagguguguuuauagguggggggcuuucuuuggaguccugccuuuuacuuaaguuuuuuuuuuuuuuuuuuuugucaaauuucccccagugaggaaacuucuguacuuucauagaugacaccugguaacacauuuagaaauaaaagcaaguugcuuaaaggaaaccuacagcauaguggcacaguacugggcuguuuaacuugugccuaacuuggugccuaacuccaccacuauacuauauacuauacaugacuauauaauaacuauagccaguuauuacccuuaaaucugggcccacaaaaugagucugauauguauaauaaguucucuguuccaacuuuucugguggaauauaaagaagauuuuacuauuuaaaagcugcuggugaaugaaucccuuaacagaaauauaagaaaugcacuauuagggaaacuucauuauuguggaaacauccuaaaauaaaugucuacaaaugucauuaauacaaucuuucaccaucaauaggcaauauaaauuucuguaucuguaauucauuacugaucucuaccaccagcaacaauaaacuagucuugcacaaugaauguuucaauuacagaaaucuuaaugucaccuuccacuacagaauacauuccugacaacuauacagggaguuucugggcuacauaagguaucuucucaaaacaaaccacaagcagaaacuauauuguuagacagcacaugacuauaauuugucuucuaaagguagacagaucuaugcugcccaugaagcuagucuuuacuuuuuuucauaguaaugggauuauuuuaaauuuuuuuuauucauuguauuuuucucucauauauuacauucaacugcagauuucccucccucgucucaguccaucccuccaccuucccuauaaacugcuguaacauuuugcucauuccucccacuguucauacuagcauuucagugugauuuauaaaucucccggcaaguuccauuucuguugcuuaucuuuguaaacuacauuuuguauggucuacauaggaaugugggugaguaugccacggugcauauaugaaugucagagaacaaaugccagacguuaguucucuccuuccacuauguggauuccuaagauagaaaucaaacuugcuaacaguugccuuuaaacuguugaaccaucuuaccagcaccggauugcucaucuuuuguaucuccacuauguggcaccaaugaguacauccuuagaaaaaagguguugcauaaauauuauugcccucauuuaaagggugaggaaacuaacucaauuugcccuaagugacauagccauuacauaaacuauaauggccucaucuuuacagaguacucuauaauugcaguaccuuaaaauauuauuaauuuuuuauuacauaauuuuauuacauaucaugauauuaaaggcucagugcaaccuauaaaguacauuuuaaguuuuauauauaccuguacauacacaaacauguaaguguaggauuuugauaagcaucuuauaaguaauauaaauuuaguaaaauagccuagacccauucaaauauuaauuugcauacuguuucucacuauuauguacaugcauuuuagggccagcagaaggaaagagggaaaaaguuggaagcaggcagcuaaaaaagacaggacacaggccucaagaccagauacagguuuauccaaagacuaaacuagcacaguaauagcaauugaauguaucacugugaacucucaccuuggcccaaacacuuguuauuauuacccuguacucauagaagacaauugcaggguuucucaacauaacagucuuagaggcugaggaagcacacgagaauuagaaaaccuaugucuauucaacuaaaggaagagaggcaagauacaagaaugaaaacgaaaaccuuaaauuacuuaaaaaugaacagagcuaggugugcuaaugcacaccuggaaucuuagcauucugaaggaugaggcaggagaaucacaugcucaaggccagccaguaccaaauagucaagaaacaaaaacaagaacaguuuccacuuacagaaccauacaugguaauuuagauacuacauaaaauaaaugguuuuaaagaaguuaauauugaauaacucuuuucuaacauggugaugaaacugguaacuguugcaaggacucucaccacagauuaauaagguuguggcagaacauugaauagaaagacaauuaacaguaaagaaccauguaaaaggggaagaucauggcaaacaaugcaguacauuaaaaccacaaaacugauuccaauaacaaaugaagguauuuccaaagacgaaacaagaaguugacugagccaaacuguaauuuggaaagucccaaaucuagaacugccugcacucuaugccuucuacuuuuaucaagauuuuacaaaccuuuccccuuaaauucuagcaaaaauuuuuuuacuaaaggaaaaaaauguaggaccaauaaugaaacaaccugggaaggugaaguggaaaaggaaaauagagacuggguacaaagcucuuaccauggcaaagagaaaauuuccuucaaucucacauuuugucuuaucacauuaguugauuccagcucuagggaagaaaucuauaauaauccuaaaauaaccugacauacuaauaguaaggaaacuacccaagacuacuaggguuuauaccaagaaaaaucaaaacgcaacuuuauauuauagaauuuuccuaguuagaagaauggacacuuugaauuuaaaacauuagccucagaauguuuauauccaugaguaccuagguauacacauuuacauaaccuucugaaucuagcagggaaccaaaacaucauaucaaaggcuguauuuagaggcuagagacagcucaauuauuaagagagcaaccugcucuucaagaacuggaguuugguuacaagaaccacaguggucuguaacuacagcuccaaaggauccaauacccuuuucuggccuccaugggcacauguacauugcauacacuaaagcacauguacacugcauaaaggcauuaggcauuuuuuuaaaauaaagcuauguuuagaaagaaaaaagcugaguguagaucauaccuuaaucccagcacucagaaaacaaaagcaggaggauaaaacugugagcuuaaagccaagcugggcuacauagugaauuccaggccagaccuaaaaagagaaggaacuaagaagauaaucaguaauaugcuuacuugcaaguacaaggacccaaguuucagaacccacauuuaaaacaaaaccaaaccaacuggguguucauauaaucucagcauugagaaggcauagaagauccuauuucaaaacuuacaauaaguaaauguggguggacagcaaaggaaugaugauaccuaaugcuagucuauggcuagcuuacacaugcacacacauacaaaacacaugcacauaccauuuuauuuuuaggguacaaaaacugaguguucauucugucuguucuacaucaacuauguauuugaguaaccaaauaagaaauaaggggaaauaaaauauuaggaaaaagcaaaauguuguuauugaaacaucaauucacuguccucaaugauuuaaugaauuaaaaagauucacaucauuaaaacacgaugucaugaaugaacauauacccuauguuuaccaaagggaacgaaccugaauuuaucacaccucuggacccaguugccauugugcaagaaaguaaggauuucaaaacugcuuuuagcugaaggcaauacuaaauaaacugcucucaaucuuagagaaacuucuuuuuugcagugacuaguuaaugcaggaagacuaagugacuaagugcucaggccuaaaaugggaaaucuauauuaaccaugaaguggaaacuucuggcuucuuuggaaagucaguuaugguuugcuggggaacacaggugaaaggauguuuugcuaaagaaaacagagauuaaaggauguauugcuauagcaaaugcaugaaaggacacaugauguucagaaagaauauaaauaggagccaacaguaggagcucaagcauuggcuugcuuugcucugcuuuacauuguauuguugaacuccauaccaaaaagaagcucuccaaagaacuucuccgggcggugguggcgcaugccuuuacaaagugagugccaggacagccagggauauacagagaaacccugucucaaaaaacgaagaagaagaagaagcagcagcagcagcagcagcagcagcagcagcagcagcagcagcagcagcagcagcagcagccaccgccuuccccgcaaagaacuucccacgaggagguuuccugcagcuucuuggugcuuuugcagagaccuuccuguugccaagcuuugugcuuucuucuggauugaacuccccuugcugguuccuguauggagacugccaaguagacuagaccgcagcugcugauuuauauuuggucuucccuacuggacugaacggcugguauccagacaacaaagauuggacucacccccaaacaacuacuucuaaagagauccaauucccccauguuguaauaacuuuucucuucuacuaccucugguggguggugggcuagaagagguuugaacccuauuaaaggaaauuggaaaaaaaaaccugcaaggcucaggaaauaggaagaggcagaaagaacauuaaugccagaggacaggggaaaaugccuuaaaauaaugucuucuggauacgauauuuccauugcacuuguaaacucacaguagcugugauuaccugucuguauaagaucaagcuaaucaaaauucuagcauggauaggggaaggacacgcaagaccuacacccuaguuugaggagccacuggcagccaacggccauuguagagggaaagucauuuuucuuugggaaaaguggacauugguaaguuacacaugauccacauuaugcacauuaagaacaauaaucacuuuuuaaacaugaaacugggacaggaacugggugguuaguuaaugaccaaaaugcauuguauacacauguaaaauucucaaagaauguauuuacuuuagcugaaggugacaguaaauaagacuaaagaguaaaguguuucacucucugagaaaucaguccagaaacagaaguagauaaaauucugcaccaacuacaauuauaugauagcaccacuaucaccuggaaacccacaaaugcaaaaucuauuccccaucaaauuauggaaucaaaaauuagugauacagcaaucugguuuaauaaaccuucuaggugaucugauguucccuaaaguuuuaaagccacuauuuacuauuaaugauucauguacuuaguucaacuuauccaaaauccuaugugaugauagguaacaaucauuauuuuacacuccagauuuuaauuuuuuuaauuagauauuuucuuuauauacauuucaaaugcuauccugaaaguucccuauacccacccccucucccccugucccccccaccucccgcuucuuggcccuggcauucccuuguacuggggcauauaaaguuugcaaucccaaagggccucaaucauuacuuuauaaaggaacaacuucacuauagcauaaagaggucaauuuguacgagaugacacagcagauaagaaauuggaucagagcagggcagcgguggugcacgccuuuaaucccagcacuugggaggcagaggcagguagauuucugaggccagccuggucuacaaagugcgucccaggacagccagggcuguacagagaaacccugucucgaaaaacaaaaacaaacaaagaaauuggaucagaacuugaacugagggaauacucuuuaucauuguauagaaagaagucuuuccaccaauaaaaacucaauuccuagaaugcuguaacagugaaaggagagcuuccugcaguggcaaauaccuguaguuucagcuacucaaagcuaaagcuaaaucaccaauaucugugcacaaacauauaaaaccaacuuggggugaggaaaagagaaguguauggaaaaacacuagcaaagacuaguauauacuucaauuaaaaaauaggcaaauaaauaaauuuagcaaauaacaaccauagaaaaacuuucucuaaaaacuguuccaaaauguaagcaccuaccaaauacaauaugcuuaauuuuaagaacuuaaaaccugaguugcuuaaggugauucauuguaguccaucugcacuuagcaaccuucuagguuuuuaaaaauuauuuauuugcaugaauauuuuauuugacuucaugcauguauaugugcacuauguguguaucuggugcacuaagaggucaguagaagguaugagauccccuggagcugcaauuucauaugguugugagcugccaugugagugcuagaaaccaaaccugugucuuaacugguaagcuaucucucuaggcccuaaucuuuuuaauuuuaaauuacaaaaaaaauuuaaguucucccucuaguuuuuacuuuuaguuccuuuuauuuaccacuauuuuuuaaaaaaagauuuuauuuauuccauguaugugaguaaacugccacugucuucagacacuccagaagagggcauagaucccacuacagaugguugauagcaaccaugugguugauaggaauugaacucaagaccucuggaagagcaaucaguuuucuuaaccacugagacaucuccaacaccaccaccccgcccccuuuuuaaaaaaaagauuuauuuauuuugaguacucuguugcuuucuucagacacaucagaagauacacccauuacagaugguugugagcaaccaugugauugcugggaauugaacucaggaucucuggaagggcauuuccuagccacugagccaucuguccagcccuacuuaucacuauuaaaaaaguaaaacugcuuucuuucaacucuuaagauuaugugaacaaagucucuaagaugaauauauaccuaguucaaucagcugaaucagauuuauaauacaacuugcauuuuauaguacuucauaaaagcacaaauuccaacauucuguaaaaucacuuuccaugucaccauuaugauuuuuaaaagacaaccguugaacuacuuuuuuaagaaacucaaaguuggaaacuauuagguuaacaccucaaacuuguuuuccucagagugccacuccuucauuaaaagcauuucuauaaccagaaaaccaagauggucaacaaguacaucaaguuuuaccgacucaaccucuaugacacaucaacuaagaagcuuccagagaaucuuaagagcugaauuaucccugacauuaacauauauaaacauuugguaaccagucauugaaggggucaaaaaaaaaauacaagaaaauccuaagaguacaagcaccugugaccugucuggccgugugauccacugcaaagcaguccaacauggucacagcuacacaacagacuuagaaacuuaaucuuauuccaugagaggcaauguggaaugugaagggcaaauauuuucaaagcaaccaaguuggcauuucaaugauacuuugaacugguggcuaaaaacacacaacaaaaggagaauuaaaaagccaacacuguuuccauugugaacuuccaguguuaagaagggggugauucaaauauuggaaugucuacugugcacaauucuguaccagucauccuaguuucauaaaauaggauuugggucuaagugguuuugcuuaaacuauaagaacuuaaguguuaauauuuaaucacuauaucuaacaugcucguuuuuuuuuucccuguugaaagcaugagcuugcuggaaucuccccaaaauuccuuuaauauuuaaucaauuuucaaacagggacuuauuucuccaaugaugaacacagcugaaauaccugaacaccugaccagugauucauaaucguauuuucuccaaugaugaacacagcugaaauaccugaacaccugaccagugauucauaaucguauuuaucuaaauaauucaaaauuuuucauucaugacuuuucuacuuucuguuccuuuaacuugcaguucuuacuauuuuaaagauaggaacaaaaaccguugcucuguccacauuuguguaugagcuaaaggcuggcuggaggcugaaggauauguguucaacucucauuuucugguuuugaccauaguacagacccagaauggcuaacacugcacaagcaaaauaauucaucaaccaguucuuaauaucuaagcucugaaucagagaaucuaggauaacagagcauaaaaacaacaaaacaaccuaaggauauuacaaauacacauuaaaaaaaacuuuuucuuccagaaggccuauauuucauauggaaaacuaaaaucagguaucaaaucagagggccacagaaaaaggaacccaugacuagcuauuuuaguauaccaacuaagccagcaguaucaccuaagagaucacauaagagauuacuaccauuauuguuucauuauaauagauuaccuauggucuuuaacaagaaugagcuagacaucacuauagacuguaauuuucaaaugugaggaaaugcaaaaaggacuuaacaaauaaauuggagaaaaaaaaacaagagaaauauaaccugaagaauaaaacagacuuaaagucuacauaaacuauuucauaaauggacuuuucucuggaucaugagucaaacuuaaaauaucacggaaauuuuaaaaugagcccauuuucuaccuuuaaauuuucaauuucuucaacugaaaaugaauucuggguuauacugucaagaacucucucaauaucuauacaauuuuugguauggauaaaaauaacacaucaagagagguuuauuucaaaauaauucuaugggaaaggggggugccauaggguaaaacuaaaaaggcuaaaguugauaaauguuaaaaauaccugggggaguagacaacauacuacucaguuauguuucaaauuuugugaaaaucaugcacugacaauauacauuuaaaacaauuccuuuuaauugucuaaugagcuccauccaauaaaauuauuuaaaaaaaaaaauaaaacaaaccugacccauauaauggaaccaaagcagcacaagcaaaaaauguaaauuccagccccaucuccauuucaagauguaaaauacaaauaccaaccgcaaagaucuuaaaaaaaacaaaaacaaaaaaaaaacuaaccuaaaaucacagccaaucauagucauccuggugggaaaucccaacacugcuccaauagcuuccugaaacuuccugaccaaguucuggucuacugguuuguuccucugaagcacuaacacucaggucaggcuacugaaggaccuacaaaaaaagauuguggaaaagaaguauauuauucauuagaauuggguaguuaaccacuguaucaauagacacaaucaguuauuuuugaagcaauagcccuuaaaugccaacuugcauuuuuagaaccugcuuugagcaguaacuaaacacucugaaaaagaacuguauaguguuucuagugacacuuagacaauaccccugaaaacuguuuucaacucaaacaaaaugauagcauguuuaacaaacugacacuaaggaaaacauauuuuaugaaaagaaaaagcuguacacauuaaaauuauuuuucaccuucauaagugcuuuuuggccauacugggagacaaacgauaaacauccuggaaauucagguugaacuuugucacugaaccuuagacaaaguuuuuauuugguacugccacuccuuccucucuucucagagaucuaccuagaauaaauuaaaccuuuuaggucaugccuugaucaucauucccagauuuaguauaauucuaaaggacaagaguuagugauuauugcuuaacccacuguaaaaggaaucaagacaagagucucaaaauaaagugaccugucuuucaaugaaagaggaaauucauuuuccuaaagcacuuccaacucaaacccugaagcucaaaacggaaauccacaaauaguuaauuaucagauguuacccacuaaaaugucaaugauaguauacuucuugcaacuauauuccuacuugaaccccaucacccaaccaacauaauuaaggaaaaaaaccacucuaguguugaucuaauaaaaauauaguaguaagaaaaacuacuuccgaguaaaauguuagaaaauauaaaauggcaaaagcacaacaggagguaguuaucaaagagucaucugugguugccuuugagggggaaaugaugguauuuaauuagaucaaccuuccuaaugucuugcauauagguauuauccuacuuaaauaaaaagacugccaaauaugccccccauacugacccaacuuagacaaaguuugucuaaaaaugauagagguaaagagaaauaaaugagguaaagagaaagaaauaaaaacacuugaagcuuaaguucucuuuaacacugcaaacuggcaauggcaugaaauuucaagacuuuugugaggugaaggacaggacagacuguauuugaaggaguggcaaaaaugaguaggcaagggaugaggcacucccuuccaaaagguagaacacuugggugugguucaugaccgaaacauagcugguggucauuccaagagaaugauuuugcauucaaaagucuuacaccaguagaagcuucaaauagugagaacauauucaaacaugaaccacugaucauacaaaguggcuuaugaggaaaaaauuaaaagcagacaggagcgaauagguauuauuccuaaacauagaaaaauacagcugaagaaauaacaauuuuuaaaaaccuuaccaggcuauaaagguagaauauggcacaaaaacauuuaucuaccaauacaguuucacauuaaaaaggcacccaaacuuucugaggcaaauuuucuacaagguaagcauuacuacccucauuauauaaacaaacaaaaucugaaaaguaauuugcccaaggucaugaguucaaugugaacuggaagcaaacacuaacuuucuaaaucaggcugcuuccuaugaauuggaaauguuggcagcaucuccucaaucuaugcaacacuggugcuaaauaaaaaguaauucaaaucauguuaucuacaaaggaaacacgugauagggaauuaauugucuauaauagaagugauuugaggagaaaggaaguaaauuuaaauuuaaaaggagcgugacuguuuuagggguaaaacuccuggaggaaggaaaagguacugggggucgacaccuugcuaggggauucagcuccugggggugggaggaagagcaguuaagagagaaauauaaggauuaagaagugagacuuaguucuuaaauguugguuagcuguaacaaaacaaaaagauauacagaccagcagacuacagaaacauaggcgggaaagggggcgggucccagagcuuguagcguggaagggguuggaaaggcaaaguuucaccuagugggggcacgaaggagaccacuaagacugcaauuauccgaccacugacccguuuauuguucugcccaaguauggucucaaaacauucaaaguugaagaaaucaguacgcuguccccgcgucagggauaaacaagcaagaggaccuaggaaaauggaagguuacugcugauccauccacaaagauggaguaaaugcagggaauaagauaagcucuuuuaacaucugcgccaaaagcaccacggaaggacaugggacaggguagaugauucaggcuaggcucuaaauuaggacuacagaggaggagugauaggauuuuuuuuaacuucuccccuuaauaaugcaucccgauauucacguagcugagcgauuugacagggagacagaauuugggaaagggaagguacucuaaugacucuacagauugaccucucaaaccuuagcccgaaagccgcgggagcagggaagcagagcccaccucggaucaagaaaaacuagggguuucauaugggucgcugcaagggcugagaagcagcaagcgcgcaauaauuaugagaacaaucuuaggugcgucccucucucccacuuuuuaaucuaauccccagcccacuacccaaugaacuauggacucccucccgcacuucccaacccgcccacugcgacgacgaaaacagaggcgaagagcgauugguggggcaaaggcaggcccacacgaggcagaggccgggggaaauggugucgcuuuaaccgguaagaaacaggauggucuucagcucaggaaggauuuaccggcaccacgacguuucgccauucgucaucuccuuaacgucugguaccugagaagcgucacaaacgcggauagcuaaccccuugguaccguguaagagcaagacaggcagccgccgccgccgccaucuuaacaggcggcccgacccuagucacugcccccccacccccaagguaucuccgccaccgccggcgaauccccacgaggacguaacccugcucccgcgagaacucaccggcuaagaacggcagcaccagaagacgcugcucgcgccuccgcagcuccugcacucaguagccaaccucggccgccgccuucgcgugaucccaggagaaccuccaccggaccaggaaaaacugagcccagcccgucccaacccucgcuugccaccaaaccccaaaucgccaccgcuccgcucucaccccacgcgaagcgaaaagcaaaugacgcacaaccucacggagcacuacggggcggagccagcaugccgccgccggcucccgcaugcgccguaggaacuaucgcgauauuacguucagccucgccgagaccuucguaauucaccgcaggagaccgcccgcgccucgccuuuaggaaacaugagaucucgcgagaccaggugcacgcuccuaaaaaggagaaaggcggagcuucgugaaaaugacugggaguuuuuucggggaaagggaggaagcucucguccuuuagggaucucgcuuaccacgagguuuccgacccacugcggagcuugcuaccaaaccucgcgaugacacagcucagcgccaaaucucggccaugucuugaaaacuaccuccgcccccgauuuaggugucuggagccugccuagugcuuaaaaagucaaccuguuuauucucacgcuuccagcagggcuguaccaauuagccaaacuccauuccgaaagcgaaaagaauggguucccauuguuaccugccucgaggaauaacgugcuagucuuaacuaacgcauaaaagauguucaauuuacaauaaacacacaaaugcaaauggaaacaaugacacaccaguuuuugugcucaaaacauggggggaaaaaucuaaagaccucuaauauccauacuucuuccuucgccgcacugcaggcuaaccugaauccaucuuuucacuaaaagcucauaucauuaguucuaccuccggagucaccaguuuuaaauauugaggcuuuccuuaccuuauaacaaaaaagacccaauaaagugguuuucuccaaacaaaggcgucugcccucaaaagcaaauucaagcuugggguggggagaaaggcgcuuggagauuuuaauauggcaguuuuugcaugucuaaccaacaauguuucuccaauaaaucgggauccagucuggcccguuugugagcuuuuccauucuaauccauuguucugucuauucuaauuuaaacaugcuuccuucagaguacaguuuaauuguacaagcacccccaucuuuaaaaacauuuucuugguuauucuuagccaucccccccucauaaacuuuagaaucgucaaguuccaaaaacuuaguauauuuauuggaauugcaucaacugcuugaaucaauauagaaaaaugaauaucguuacagaauagaggcuuccuaugcagaagccugauauuccuucuccauuuaugcaaacguucuuccauuguauuccugaaaguuuuauaguuuacuuccagauauuuuuauuuuucuugaaauuuagaguggggggguugguauuaaaauuucaaaauguuuauugcuuauauacaagacuguucauauuuaacuacugacuuuuguaauuagaaaaaugaaaauaugcucaaacagcaguaaaaugaaagcaacgacaugugauuuuuuacuguauaacugaaaagauauaaagauaaguaacaauucauguuggcauagcuauggaaaaauaggcaauaucguacuacguuggagaguguaaauuauuauggccuuuggggaaggagauuuagauaaaucuaucaagauuugaaauacauacacguuuugauucugcuauuacuucucgaagaauuucuccuacaggaauaccuucguacaugugcacgaaacauacacaagcccauucauuacuugcaauagcccccucucccccaaagaaaacaagcuaguguacaacaaucaggaaacgguuaaauaaacuguaguccaagcauacaauauagcuauguaaaaaugggacacaauugaaugcugugauauacuaagauacauaaaauaguuuuaaaaauuaaugcaaugaaacaaaaugaauguguguccugcagcaccauacauaucagaacacacacacacacacacacacacacacauacauaucaggacacaugcacgcgcacgcgcgcgcgccuaguagugaccaugaagcuugccugcucgccccucaccuuccuuuuccucuugaagccgccuuccuccaacccuuaagagaaaaacugaaggcugggccuuuacuucuuuucuagggccacuaggccagggccaaugccgguaccucgcauccccacuguuggccgcucucuugcgcgcuguucgcugcuuccccgcuguccugcuguccccaaagaugcagcuagcucucugcuggaggccgcagaggacugggggaggggagaggaggagggguucgaggaaggcugcugcuaccgccagucuggcccuucagcagccuuucccaaaggcucuccaaagcggcuaccuccgagccucagagccagaucccgugggaacugcccccuaccucgaggagucuaaaaccgccccguccccccaggucccggaagaggggaggggggaacuaagcucaccuccgccgcaggggcuuggcgaggccugcaacagugugcagggucugaggccaguagcaaucuugucccccccccccagcccccucccucgcccucggcuuacaaagccccccccacccccacggcugcacagcucacacu

SEQ ID NO: 9784 - RNA, 60852 nt, Mus musculus
auuccucaggcucuauuuauuagauaaacccuaucugugucccggcucuuucccagcaaccaaaacauccagcaacucccagagguggccaauccuucugucccuugcaagggucagaagcccuuccagacccaggaacaagacuuguauuuaaagggcuagcaucgaguagugcuccauacauagauaaguuuuuaaggagagcaugauaucauuaaauccuaugaggaaggcaaauguuagcuccaucuuauaaaugagggaacuaagacaaagaaaggucaaaugguuuguucagcaacaaaccauuaaguguuaaguaaaaccagaucuguaacugccucuccccagagcauccucuacucuuagucccugacuaaaucuuaccaaauuuucaaggucugcucaaaugugaguuuucccacaaagcaugaaaaugauaauccucuuaucaagguauuugugacaucuggcuaaucaggguaauuuacaaaccgagcccauuuccuuaccagaaagacauggucccugacuaaacucagcauuuaaacguagagccagacaaauaaaagguguccauuacgugucugaugaacacacagaugaaugaguacaugacagaguaaaugagggcaguuuagugacugccacuccuaugaguacuuuugcucaucugauguacagcuauccuguauucccuuggaaucaaauuuagauuaggcuccuuuaaaaccaaucuccaauauuuauuuugcaaacaaucuaacaugcacacaagcauaaggggcauggugucaggcgauccaugauaggggguaaugauauccaggagagaagauggacacaagggcagaugagggauccagacaagaagauagaguuccugcuauuguucauugggguugggguuggcaucuggguacuuggugaggucgaaagucaggacuuugcugaucacacaguccccuugcugaaggaaagagaaaaacaaaaaaccggucaggagagaauuaagaaagguauacagcccaggacuaggggcugaaaaacgacuucccuacauaucugcucaaaggccagacaaugguucuuucuggaugagagaaagcauucaaucucaugugccuucuuucuuugcacuuuuuccccgucuucacggacuggcugucucuuccaggaugggcuggcuaaacauucagggcaggcuccaacaagcccagaugacugcucagaaccugguccucuacaccccucuacccuuugccccuccacuguagcccaacccauuguaccucaggauagacuccaaugaggcucucagccuugguguagaauuccuccuugagagagauaacaauggccuggaaguugcaaguugacuguuccuugauguaauuugccaccugugggaggaguauuuaucguggcucaagauucaacacuuaacauuuucuagucuaaguaaguaggugggaguggggaguaagagagacuaggaaaaggcuacugauuaucaaaggagggugacccaauccuccugguacauagaauaggcagcaguaauagcuagggcacaaucaggaaugacuccuugaaacccagucccaacuuggggucuucccuuccaggcuucaccuuucuugaaccuaccuugccaauguugguguuauccaaggcagcgucaaucucauccaggacgaagaagggggcuggcuuguagcugggaggcaauaaauaagugagcuaauauugagaaaugaggacagcaagaagaguaggccauccccacagucggaauaggccaaauacauucagagccuaaguaacccaggucucugaauucccucauuugcaucugguucuggguaccacuaucccccuaagaccaugaaaaauaggguuuuuuguuuguuuguuuuuacaggaacuguucuuaauaagcaagugauccgagggucuacuaugucccaucauacgucaugaugacacgccuccuugacuucagacaugcuacagguucagcauagaaugcuuacuggguuucuuggcaaacuuuucuuuuaaaaaauauuuuauguguaugaguacuuuucuugaauguauacaugugcaccaugugcaugucugaugccuacagaagucagaagagggcacuguacccccugaaacuaaaguuauggauguuucugagcuagcaucugggugcugggaaccaagcccaaguucuuuacaagagcaacaaguacucuucuuaaccacugagccaccucucccguccccaucacuacucaugcuuuuuuuccugcccaucauacacuagguuagguggcucucuuuuauguaugcacacccuccgcacuacugucuggguaugugucuggcuuccucuaguccgugggcuccuuugaccagagaccaugucugacucaucugucccuaagcucccaauagggucuguacaaagaaguacucaagaaaugcucaugaacuaaugcuuuauaaucaaacguuaaguuguagggagucauaucuaagcacuacuggccuagggcagagguugucaagguaugccagaggucaaagaggguuucccagaggaagggaaggaaggagaaugaagaggugugucaagcugguauguauacaaagagcuuacuagccagcaaccaugugaggaaaagccuagaaguggaacuaaauacaugcagggaugaggauaggcugaauggaugagggcacauggagaaaaaggccuccaagacaaaccccaaggccaagagugauaugcuguaguagcuagggaaaaggguaucuagaacuaaaccaccuucacuuaugcaggucucggaauaucccugggccccagagccucggcuugccucagcugucucuccacauuaugaggcaaagccuuaccuauggauggcaaaaagcaaggccagagcugcaacugucuucuccccgccugacaaauuguccauaggccggaaacguuugccaggagcuacacaguuguaguugaugccauccaaauagggcucuucaggauucucagggcccaagaaugccuaggggaagauagaguagggugaggacccgcaagcaugaaugagcaugguuaugggaagagggaagagcaacuaagaaugguaggagcugguggcauaaggaguuucagucuaccugggcacugcuguuacgggacagagccuuauagaucucaucaauguugguagccacagauucaaagcaagcauugaaucggucgaagcgcuccuucuuuaucuguucaaaugccugcuuggccuucuuugcucgcuuucgugcugcuucaaacucugccagaaaaaaagagcagaugauaaucucucagugcccuggguucugccaggguugacaaccacaccugccaagaaugaccuguaaauccuguaaauaaaauuucuagugauauccuacaaagggagagaaaugccugaagagggccuuacaaggaucaguauucggugaguuggcuaccauguagucuaggcacacaaacauagauuccuccauggguucuaccagcuaccagcuuucuugacaccaucauuugcucuguagcaagcaaguagauaacccccacuguuuagggcaucuaacaauuuuaaguauaaaauuauaaguaaaaacaggagcugguaugauauagcaguauacccuuaucauaccuucagucuucuguucucaucugaggcucagaaagaaaugccaggcuuaccaucugaggucuccuggaacuugucucggacacucuccagcuuuuccauggccuucauguuaggggcagcaauccgcugaagcacacucugcugcucauucagcuuuugcuggaguguguucauuucuugcuugauuucuuccuccgccugugcauccuguaaccccacacccagcaauaguaaggagccccugagcccgaguccaggccaccugagagaugaauggugcuugggggucugcuccuaugcagaaggccaauucuucuccagcuuggcaucuuucacaacugucacuggaaacuguaggugaauguggcuuugucaccuauaguucuuccuucagaucccgccaaccuaugugucuccggaggaacagcugauaguggcccucuuuggcuuuuagcccaagccaugagccagcaucaccccacgguaaccuaaagcccuacacaaauugcucuggcuuccacuuacagauccacgauaacuaaggcaauacaagcuuuucucucaaaucauuguauuugagcaaauuccacucaguuuugguuuagggcuccuuauagcuacuguaaaugcauguuugaacuuaagccucacugccacuuuuaacuuaacugaauauccaucaagaguaguuccuguauucacagaauucaggacacuaacauagaaacacagcuaaguaaauaaucagaauaaugcaagaugaaugugaagacagugacaagcaguguugaaucagcacacaagaaggaaaccugacucagacuguggugagggaaagcuucugggcgugugugcaagcuaaaggcuacaggaugaacaguagaagaggaaagaggagauguaguuuuauacaugaccaauaacaucacaggcaaaagcugggguggagguuccucauaaguuagucacugaaugagaaguaauuccggaauaaucaacuuuagaagucaaaaaaccuuuuuuaaaaaaucaauauggaacuacuaacaaugugugugccuacaugaucauguucaugauuucacagaaauaugcuggggaaagcacaaagagaagaaacuagauagacaagcaaaggacagaguacaaaaggcccuacaaacauaaauuuuuaucucaacggagaccaauaugauuuaaagagcaaggacacagauauacuuauauuuuagaaaacccuuuuggaaauagagaagacccuugguaucccuggaggcuagaagacagcaguaacugucuuagaaccaaagauuagauagcugugauccaucauguggguguuagcaacugaaccugggucuacugcaagcacucuaauacgcuauaaaaucuaaaugaagugguucauuucuaaaugcacaugauccauaacgaagaaugagacuaacacaauaaauaaaguccacagagagaaaagcccaggaccagaugaacucaacacugaguucuaucaaacuaacuuacucccuuuccuuuccuuuccuuuccuuuccuuuccuuuccuuuccuuuccuuuccuuuccuuuccuuuccuuuccuuuccuuuccuuuccuuccuucuuucucccuccccccucuuucuaccuaccuacacaugcacacaauccauaaugaacaaugagacuaacacaauaacugaaaguccacagagacaagcccaggaucagaugaacucaacacugaguucuaucaaacuucuaucuaucuauacacacaugcacacaauccauaaugaacaacaagacuaacacaauaacuaaaagucuacauugacaagcccaggaccagcugaacucaacacugagguucuaucaaacuucauccacccacccauccauccauucauccauccaucuauccauccaucccaaaacaagauaucuuugucuaacagcccuggcuguccuugaauucacagagauccaccugccucugccucccaaauucuggaauuaaaacaccaccaugccuggcaaacuuuaaaggaaaaucuaauaucaauauuuguuaaacuguuccaugaaauaaaaaggaaaguaacauaaccaauuccacucuuugaagccagcauuacccuaauguccaaaucaguuaaagacaugaugacaaaaggaagcuauagaccuaguguucccaaugaacacagaaacagaaaauuucuggaaaauacuaauucaagaacacaucaugaucgcauaucaugaccaaguggguuucaucccaaagauguaauagcgaacucacaacuaugauuaucugcacagagccacguauguaagacagucccugucaaaaagugauggaagaaaaagaugcuuggucauuccacuuacugcuuacugaauuucugacaggcgaaaucaccugcuccaguauguacccagggcugagaccacaaagcuccaacagguagccccaaaucuguguucaucuggauaaccucaguuaaaaacacuaagucacgaaacaaguagaagugggcuggguagaacagaggcaguagagaugggagagggugugagugauaaguauacauuauguacuuguaaugaauuguaagauaacauuuauuuacuaaaacccaugaauaacuaaaacaugcaaaccaauaaauguaauuugccaaaguaauguuuuugacuuacuuuuagauauuuuauuaauucuuugagaaucucauacaugcauaccauguaucuugaucauauucacccccgccuucuaauuccuccuagaucugagccugugggucacauccucuuuggggauugaacaacacuuucacaggggucacuuaagaccagugaaaaacacacauuucauagcaauagcaaaauuacaguuacaaaauagcagcaaaaauaauuuuauagucgggggucacuacaacacgaggaacuguauuaaaggguuguagcauuaggaaaguugagaaccacuguccuagaucuacuuccauuccuucaucccucaacuuccugacuucuucuguaaauucauuuaaauucuuucauacaauauauuuuauucauacucuuuucccucccccaacuucuuccuauccacccaacucucauacacuaauaagucugaguaaugaucuaccugucaaauuuaugcuuaaaggaaacuuccucagaauuuaucaacccuauuagcucuucagcuaggugugagggcuccucagugugcccuccaauuucaugcuggauuuuguuuugccguuuuaaaaauuauguguaugcaccuguguaugaguuuguacacaagaaugcuggugccaaguggaggacaaagaugucggauccccaggagcugguauuauagauaguuagaagcugccugagaugggugccaggaaugaaaagucggguccucagcaugagcaguagcugcuuuugaccaugcuagaaaauugacugccuugcaguuauacagaaccacaggcaccgugugugcauaugcaugugcauggccuuguaugcaugugcaugugaaugcaggaacccaggaaggcuaaacgugccagaucucccugcagcugaaauuagacucuuaagccauccaacgcaggugcuggaaaccacacucuguccuccugcaagaacaguaagcauugcugaaccauccauccuucuagucaucuauauaaacaaucuuaaggacagaaauacguggccaucucuauauacuauauagauacagaaaagguauugaccacaguucaacaugaccucaagauaaaaguccuggagaaauaaacaaaugaaacauaccucaaaacaauaaauaauauauaugacaaacauauggccacaucauaauaaauaaugaaaaccuaaaaauauuuccucuaaauuuugccgugagacauggaagucagcucucaacauucuuacccaauguugugcagaaagucuugcuagaacaguaagguaagagaaagcuauaaaaaggauuuuaaaaaaagcaaacaagugaaauuacucaauauuugcagaaaauaugaucuuguuauuauuauaaccagaauaaguuauuaacugcauauauucuaccagaaaacuuuuacauucaauaaacacuuuuaguaauguuacaagauacaaaaucaacauucaaaaauuaguagcucucauauauacauaccaacaacaagcuuucugagacagaaauuaggaaaaccauuccaugcacaauaacuacccccaaaauaaaguacuccggacuaaggauguaaagaccuaggcaugaaaagaguaagguacuuaaagaagacacaaaacaacagagagacuuucuaagcgucgacaagcagaauuuaugugcaaaaauggcuuuuauuacuaaaaguaaucuacagauucaaugcaauucccaucaaaauuccaauggcauucuucacagaacuagaaaaaaaucuaaaaaucaauauaaaagcacaaaagacaacauacagccuaagcaguccuuaguggaaggaacacugcugaagguauuaaauguaugacuuacaaucguaguucacuaguuaaggagcaguugauagcugcugggagagagggagucaguuuucucuaaggguguggccccuaguaggcugaucauacuguaguaaaaggccacaaauccaagaacaucuaggcagcacugacuuuacuugcugggguuauaaaaagaggaagaagaagaagaagaaggugacaccaaguuugguggguagggaaagaaggugggaccugagaagacugaggagaggggugaauaugaccuaaaacauucuacauacauuuuucaaagaauuaagaaaaaagggauaucacugggcaauaaaaacaaacuacauguuggcacaaaacaaacagguagcccaaaagagccaagacagaagacccagaaauaaacucacuucuauggucaccuaauuuugacaaaagcaucaaaaauauauaccgaaaaauguaucucucauccuaaacaaaaaucauuucaaaucauaugaaaagacuuacuuuaaaaccccaaacucugaagacauuacaggaagauacaaagaacaugcuugaaguuacagauauaagcaagaacuuucuauacaggagugaaauaacagaauauaguccuaagaaucaacaaaugggacaugaaacuaaaaaccuucugcacagccagagaaaccaacagcagaagaaacagccuacauacagaacgggagaaaaucuuugccaguuaagccccagacaggggauugagaucuagaauauauaauuacaaaaaguaaaaaccccgagccacaaaacuaccagucaauaaaagaguuaaugcaauaaacagauaauucucaaaagaagaaacacaauggccagaaaauauuucaaaaggcccagcagaugcucagucaauaggggcacuugucaccaaacuggaguucaaaguccagagccuacaagguaaaggagagaacuaacucuaggagguugucuuccgaccuccacacaucaguguaugcacauauaauaaaaaacaaacauaauaaauagauuaugaucaagaaaacaaauaacaaaugcuggugaggcugugggaaaaagcacuuuauucacugcuacuaggaaaguaauuacugccauuaaagaaaucguuauggccccucaaaaaauuaaagcuaucugggcauggugaggugcaccuuuaauucuaguacuugggaggcagaugggagaagauauccaugaguuugaggccagcuuggucuacauaaugagcuguaagaaauccagggcuacauagagacuaucucaauccaucacccccucaaaauaaacaaaaacauaaauauagagcuaacauaugacccaaacucuugggcauacauuccaaggacucuagauccugacacacucaugcucacuguugcacuauucacaacugcaggggaauggaaccagacuagacguccuuaagcagaagaacggauaaugaaaauguugaaugcaucaauaauagaguuuuauucagcuguuaugaaaaacgaaauugggaaauuuucaggaaaauggauggaaguggagcccaaucucagacaaagauuccauguuuucucucauuuucaguguuuauacauguguuaauaagguuuggggaaguaguguagacuguaaaacuagauaggagaccacaaaagguauugagaaaagaagcucaugcagggguggggguguaaugugauaucaaagugagggugggagggcacaaaggaggaaggagacggagagaacaggggcgggagagaaagacaccccaaauuuuguuagagaaaugccauaauggaaaaaaaaaacuacacugaaaagucacagacauuuaacaauaaagaacuuaagaaagaacuuaggaagaaagaaagaaagaaagaaagaaagaaagaaagaaagaaagaaagaaagaaagaaaggaaggaaggaaggaaggaaggaaggaaggaaggaaggaaggaaggaaggaaggaaggaaggaagggaagggaaggaagaaagaaaggaagaaagaaagcaagcucuguuugaagaacacuacaaauuguuauggaauagucuguagaauaggcuuucaaaugaaaaugaaaaguaagaauaguuuacuauuaucuaaaaggagaauaugaauguuauugcacguaaacauauuuguguuuuaaaaccgcaacaaaagggcaauguaaaaacuaauuaaagagugaccuacugaugaagagaaggaaacagaaauagaagccaaaacucucuucauguacccugcuuuauacuuuugauuuuagaaccuuaugaugcugcuugguuauaaaacaaaacuaaacagacauaugagaaagguuagguuaaaaaaauuauuggggaacaagauguucacaagaugacaaagcaaccacucugaaaauucuuugcuaauuaauggcaaaacaaaaguguaugcuuagcaaugaggagccuggcaauugacacuuaaacagcaucauuaguuaauaaugauaagaugaacuucauggugaaauacaauauaaacauacugcuucugcaucccaagggcuauaacuacaggugugugcccucacuccuggcuuuagaguugaacuaccuuacugucuguguuuuuuacaaggcucagggaaaaaaaaagaaagaaaaagaaaguguacguguaauagagagagaaggagagggagagaagagagaugagagaaagcaaagaugguaaaauuggguuagcaaguuggcucagacugacaacucaaguuugauccucaggauucacacaguggaagaagagaauuggcuccauauaugacuuguacacucauacuaugguauucacacacacaucauauacacacauaaaccuuauuucaaaaaauuguuaggaaauaagauuucugguaaaaauaagagucucaaauguaaguacaaugauguuaaacugaaaauuucgauuuuaaucagagguaucaauaugaacucuguaauaauuuucuuuuucccucaaaauaaaaauaaauuaaaaaaaauaaaauguauuugguggcccaaaucuacugaggaguucuagaaacacuaaccagucagcuaucuugagcagucaaaugcucauauuaaauaaauacauuauuaaauaguaguguuuuccacugaacaagagucaagagcuucucauuccuccuuggggugagaaauccagaagaugagccuagucauaucaggaacuuagagagaugaacaaagacuacaaagggugaaugcaccccaccucccgccccagcuaaagacagagcaccaagaauuacaacagacugaacacugcauauguacuuaaacccauacacucacaaugacugagagugcugagaaugccaagaaagcaacccagaauugugugcagaagugacaaugaaaggagaguuaagcugccuuuccuauguaacuggaccucaggguuaccaaguaacaagaugaaacuucucuauuuuggcuaauaaaaaaaaauuaaaggcuaagauguccaucuuccaauugggaccaaugaaaugauauauuccuagguggagaucucauaaggagacccuacagauucccugaaguauauauacugccccugggaagcacaacacccacccuacauugagaaccacugcuguacacaauaaggacuuuuggaaaauaaaaccaccuaccauuccuacagcucaaaauauuaacauuaauucuaacaucaaaacucaauauugaauucuuguuuuauaaauuauuucucaaaggcuuuacaaagcugaauucaaauaaggugcaacuucugaauuccccccucuaaguguuuucucuaucccguuucucugcaguggguuuaugcacacauuuuggacugacugguuucuuggucuguacccaaugauauuuucuuugcucuacuagggauuaagccaagggcacuguauguaaguacucuaucacugagaaauaucucuaguccucuuuugcccuuugaaacccgcccucccaccacccccgcccccauccagcugcucaggagacugagauaggaaaacugauugugcccaggaguuugaggccagccuaagcaaaagaugagacccugucucaaauaaaaugaaaaagauaagaagaaagaaagguucccacagacuacacuugggcagcugcaucugugcuuuacuuuauugguugcuuuggcaucaguguuucucacacaaucaggucugugguuucccaaacugaacugaaaauaucuuuuuaaaaauauuauuaguagaggcuggagagauggcucaccaguuuaagaucauuuguugcucuugcagaggaccuggguuugcuucucagcaccuauauggugucuuacaacugccgguaacucuagucugacgggauccaaugaccucuucugaccuccauagucagugcacaugaacaugguacacauacauacaaggacauaaaauaaauacagucuaaaaaaguuauuccuguuacuaaauguguaguuuuuucuuguuauuauucccucaauacaguauaguaacuauuuacauugcauuaugcauuauaacuaagcuagagaugaugugaaguaucaggaagccaagugugguggugcaugccuuuaaugcuagcacuugggaggcagagacagauggaucucugagaguuuaaggccagccuggucuacauagagaguuucuaggcauccagggcuauccagugagauccugucucaaugaauaacuaaaugaaugauaaauaaagcaugaggaagaaucuguuuaaguuacauaggaaugcuagagcauuuuuauauaaaggacuugagucuagaggagggguuccuagaacuacucugagagcagugagcaugugcaaggaacugugucaugacagcaaauagcuauugacaugaugcagugauguaccuaccacacacuccuacauucuuacuaccaaaaccaagaaagaacucaaauucaaacucucucuauauaccaguuuauaggaaauacggggaaugaagaacauaauuaaguaauaucacagagauauaauuagucaaaucuagaaggcagaaaauccuauaggaccaaugcuaugguuucuuccacaaauagaaggaaacaaacaaaaaaagaaacagagagagaagaaaaguuauagauuagcagaaaccgaucuuaauauguggaccuuaauauuuuguccuggucagucuuuuaccaacuuggcccaagcuagaguuaucuuggaagaagaaccucaauugagaaaauuucuccauuagauugccuguagguaucugaugugggaagguccagcacacuucaagcagugccaccucugggcauguggugcuaggcucucuaagaaagcaggcagagcaagccaugagaacaaggcaguaagcagcagcccuccauggcucugcaucagcuccugccuccaggugccugcucuucuuugaguuccuuccugggcuucucucaaugauggacugguacuaggacacagccaaacaaacccuuuucuucccaagacguuuuugaucaguguuuuaucacagcaauaaaaaagcaaacgaaaacacacuugaauacugacuuugauauagacaaugcaaaaacacuuacugcauacuagauagaacaaaguaaugcuuguuuauuuguaagaaccucauauucuguagauauauauuaagguaauuaugaacagaacaaugcuucaaaucugcuuuacgauagucccaugguggggauuauaaaaaacaagauugacuauacguaacuaagugcugaagaugggugguaggugccugacauucauuacaucauuuuccuuacuucuauauauauuugaaauuauuuauaaauuaaaaaaaaaucagaucucccuggacauaaugauaaagaauauacuacaaaguagaaaauauuuuggagauuaguuccuauaggaacuugugugucugcacuacggauaugauauagcaacaguaagcaaucaaacaagcaagagagaaugccuaauguauuuacgaggcaaaauugacacaacacaguaauuaguaauuagacagaguaagagagggaaagagucaagaaugaagcuucaguuuuguuuuugaacaugugagaagcacuagaggugaaggagagcuagaguuugaaguaaccugugggaccaauuguagagauagcagcuaaagugagcacagugaaggagaugauaagaaugccaaggaaggaggauaggaccugugacagagcccugacaaguaccuaaggccuggucuguuuacuacagaggaguuugucauuuuuccucucuguguauaccuggacuuaacuuuucuugggccagcugagaagaugcugaugccucccacccacaguucuuaccuucagaucuucacacaggucaccguagucaaucucaaugagggccucucgagcauagauacuggauguucucugggaaccacucacugacucuucucccugggagcuacccugcaauguuggaagaggcagauggagcagacuagucauuuguaucccucuagagauuaggaacuccuuugcuagauggcacggaagcagaggccaacaggaagguccaaaccgaaaacugggcucuaccuuuuacuaaguuucuucaugucuaaugugaacacaagcucagcuagcacagcugagauuaacauuaggaaugguuaagucauggccuaccaguaucuggaauacuaguguucaaaauauuuuacugaauuaaacugaaaggcuaccuacaaagaguuacucaguuacaccuguccaccccucacuaccaucuugcacuuccaguugauagagugcuuuaguugcucagauguuguuccuuccccuccaccuaagcuuccuuaguucugccuugcugaguccccuacccaacccucuucuggccaaccucccuuacugcagcuaagcuaucagucuccuuagguucuccaguuucccaucuuccucugcuccucaauucucacuccuacccaugcccaguaucugcugcagcuaagagcucaaauccuuaagauuaaugacccauucuuggucuuucugaguacucacuggcuugcagcucuccucucaaaucaaugucucucucauaccaaagccugacuucacuacuuccaccuugccacauuucuucugcauccaucuuuaugccccucacaacucuaugugguccuaucuguugccugcccuuccuggccaucuguaaucucccauuacugguuaaauauucauagaugacuccuaccacccaccauaauacucacuucuuccugacuaauaucauccauggugcccuuugacaguggcaguuugauguccugcaucuuacaggccuguagcagguuguggcggucacugcgcuucuguucaaguuuggucucaauggcugucacuuccuucuguaaaugagucauuucccuaaaaaguccaaguagcuuagguaagaccaaaaucuggaagggagccugcuuuaccugcuuccaccauccaagcaggaauccacucacuuguuggcacccccaagcuucuugcgaaucucuuccaucucaugauucuugucguuuacuucugacuuuuuggccaggugcugauucuuaaggucuugaagcugagccaugguuucaucuauuaucuucaugugucuuuguuccuccuggucccagcaggggaauagggcaagaaugaagauuuccccuuggaauuuucuccuuuugcacuauccuucccaacaggcaguuuguuggaguaugugucaaugauuucugcuuucauacaaccccucagacuucuuuuauccuuuccuaaaucaucugguugcuuccuccaacuacaauuauguaaauugucuguuauagaagaguucaaacuauagaaaaauaagggagaaggugugaagguucacuugcaaccccaccagucagaaauaaauaacuaacauucuagcauauuuucuccuugcauaauuuacauuucaacacuuaggguugaaauuaguuuuuuaauuuuguaucauaaucaauguucuaguuuuaagcacuuuuccaaaccaaaacuuugguuauauaaaguauaauauuuguauuuauuuuccuuuuguauauaugguguguguauguguacgugcucaaucguaugcaugcauauacuauagggauauaucaagugucuuccacaaucuauuuuuuaaaauuuauuuuaguuaugaguauaugugugaguguguacaugugaaugcagguacucaagaaggccagagacauuagauguuuugaagcuagaguuacgcagcuggagccauaacccaggugccaggaaccaaauuuaaggccucuaaaagcaguaugcacuuuuaacuaccaagccaucuuucaagccuuucuacccuauuuuuaaagaccaggucucucauugaaccugguacucaccaauucuucuaacaaguccagggaugauccugucucugccucccaagcacugggauuauacucagcuuuuuacguaagugcugggaauccgaacucaggcuuguguagcaagcucuuuaccaaaugaucacuucccuagucuguaacauuuguguauuuaaacuuauacaagcaauauaguauauuuugugaauagauauuaaucugggauuaucacuagaaaaaaccaagaggacuaggagaguggucaacaaaccaagaauuacagccuuacguauaauguucuaauuuaaaguuguuuuuauaaaauguuacuuguucgugugacugcauguuauauguguguagguaccgucagagagcagaagagggugucagagcucccuagagcuggaguuagauagaugugagccaccugggccaacggggagagcaguacaccacgcucugaagugcugagccaucuccccagcccacauuugaacuuuuucaaggaaaauuguuuuuguucuuccauuuuauuauuuuauuauucccuuaaaaucacauuaagggaaacugucagacuggugaugugaaucaguuggcaagagugcuugucucauaugcacaaagccauugauuugaucccuagcacugcauaaaaccaagugauucuacaugccuacaaucccaccauguggaggucacauaaugagacugagaccagcaugggcuacaugagaccuuaucacaauaaaugaaugaguaaaugaaugaauaaauaaauagaaaaugaaaauacaucugaauauaauucucaaauaaauuauaaaaauaauaaacauagaaugcuaaaggaaauuaugacaacacaaugauaacugauaauuuuucauggauuagagugcuuuaacagucagucagccuuccguauauacaaaguuuguauccauggguucaaaagaacaucagaauuuggcaaaaaacuguacucugcuagguguggcgcacaacacugagaaggcagaggcaaguggauuucucuaaguuugaagauagccugguuuauuuauauagaguucugaccauccaaggcaacacagugagaugcuuuuuuuuuuguuuuuaaaauguacugaauguuuagauuuuuuuuaucauuuucuaaaucauaaaguauaacaagcacuuacauuguauuagauauaauaaagagacaauuuaaaguaugagagaggauaugcauauuuaacagacaaagaauguccauuuuauacaagggacugacauuuuggugcuagggaggcaguucaaucgccugugaguaucaaagaaugcuguacuauucugacaucuuucugcuaacuaauuguuacucaaaaugaaauuuuaaagucauuauaaauauacuaucuuggagcauccuaaaguaaauuuagcccugucccaguauuuuacuaccuauucugcaagcgcauguaagauuccaguaacacuauucaagauggcuaaguguuaaugaagaaaauacacaagcagcaaauacaggcagaaacaaaagccgagggauauguucaaaccaagagaaccaaaccaccucaggaaggaaugcuauaggcaauaaaggcuucacagucauuucaagaggaagaauauaaggaaagucacgacagcgacacaggcaugcuuaacagccugauuguagcaggcacgagcacagucauaccaugaaauggcugugugucaguaaaacaucaucuguugcacugauuuuauguggcuaaucugaauuuagggucaggacacuuggagcuauuccucuaauaguacuugccagccuguucuuucacugcugcuuccugcucccaccuucuuugugggcucccagaaauccuucaaaucccaccaacauguuucaggcuaagugugagaaaggaggcgcuucaggaugaauugagcagaugaugaaauacuguucacgcacagccacuacagagcagugggcaauaucaauaugaaagacucaggucacuagaccucaaaggcuaagcgggaauugguagaacuuguaaagaaaaugcuauaaaagcuuaaaaguagaagagcuuaagaaaaaaaaaugaauuuuaagagaugagaucuaguuaccagccagacaaccuauacugaucuaaucucuuguuuuuaucaaauacuacauacaugaaauaacaaaaauacccuauggcucacucaacuaguugaugagaacauauguugaucaaaaaauaaucagacaacucaguuccucaagguuuucaggaccgggcuucuaacagauuaaaggcugaaacauacugaucucuacaucauuuuucucuaacaucuauuaaaaguacaagguaagauccaagauggcggccagcaggaggcugaugaaggagcuugaagagauccgcaaaugccgcaaauguggaaugaaaaacuuccguaacauccagcucauuuauugacuuggcaagggcuuauuguuccugacaacccuccauaugauaagggagccuucagaauugaaaucaacuuuccagcagaguauccauucaaaccacccaagaucacauuuaaaacaaagaucuaccacccuaacaucgaugagaaggggcgggucugucugacagucauuagugcugaaaacuggaagccagccaccaagacugaccaaguaauccagucccucauagcacuggugaaugacccccagccugagcacccacuccgggcugaccuagcugaagaauacucuaaggaccauaaaaaauucuguaagaaugcugaagaguuuacaaagaaauauggggaaaagcgaccuguggacuaaaaucugccaugagugauuccagcaaguuugagcagagaccccgagcagugcauuucagacaccgcgcaaagcaggacucuggaaauugacaugugccaccaacuggcauccgcuuguggcaguuacuaacuuucuacaguuuucuuaaucaaaaguggucuagauaaccuguaaagaaggauuaaaaaauucagauguucuaaaaaaaaaauuacaagguuuccuuuuuaaagguccaaauuuuauucaguuugcuaguauuucauuauuaaguuugucuuggcuucugguuaggcauuaaagacacaauuuuuuuccucuuuuuuuuuuuuuuuuuuuggagacagaucucucuacauaguccggcugucuaggaacugccucuauagaccaggcugguuuugaacucacagagauccuccugccucugccuaggaucaaagucauguuccacauaccuaguacaaacauugauuuuuauauuaaaguaauaacagaauguaagcagcucuggcuaucuuagaaaauacuuuuugcuuuaaacgagaucuguuacaaaaguguaaagaccacuaaauuauauaaguauugaaugcagcauaauuuuucuaaauuccuacuuuccaagggcacugccuagucuccaccuuggaacuauaaauaauguugguaauaaacaucaguguguuugcacaaggcuuugccagcacucuggauuaccucugcggguacuacugaguuagagggcauaaacgcauucugaagcuuuuugauggauguuggaauguuauguaagaauacuggucuccugcaccauaugagguacuaagaaauauuuuguuuuuguuuuuaauuuuuaaauaaugugaggcuggaaagaugacucagugguuaagggggcguacugcucuuaagaagacccgaguucaauucucagcauccacaucaggugacucaaaaaaacuaucuguaacucuagcuccaaggggauccaaaaucuuugacuuuugagggcagcagcacacacauauauaccauacccugacacacaugcacauauaaccacaaaggcacauaaugcaauguaaaauaaaagcuuuuuagauaauguagggcaagagagauggcucaacaguuaagagugcauacuacucuugaagaggagccaaguuugauucccagaucccacuugcuuauaauuccagcuccaggguaucugaggcuucugaccuucaugggcaccugcauucaugugcauauacccaacacagacuauuaaucagagcccaucaacuccccaccaaaaaccaaaauuccucaaaucuuuaacuuagagaaaauuaaaguagacucaauugcugcuuucaucgguauuucuuugauuccuggaaaagcuaaguuauuuauguuugugagcuacuucaaucuuuugaaauguucugcgccgcuuaaccacuucuccccuauuaaggucuuagugguuuuccuuaaauaaaaacuguauuaaugauggguacuauauuggugugcauaauaucuauuccagcuuccuccugucuuuuaccuuucuccuuccuuaccuucuuaagcuuuucuaucucauuuucauccuuuuucaccgucuguucccacauguguacuuuauccugguccuccuucaacugauucuuuucaaaauccaauuggaugcccaagcgagucuucugauucucaaauuccaagcugcagaacgaaaggggaaguagacuuagugcucgggaccucuuggucacugcugagucucaguuaaauggccucauccacucacauggacaccaaagugugcccaaaagccuaagacaggcuucuaaacauugaaacuccagcaccuucccaauuuucuaggagacauuuaaaaaagcucaccugaaaccaguuagccgucucuucaagcuuuauauacuuuaugcagauuaucucuauuucuuuacucaaaauuccuauaacuaggcauuaauauccauauuuuacacaggaaacuuaugguaagaguuuaaaaaaaaaacuuugcccaaagccacacagcuaaugguaacaaauaucauaugagacuggaauccaagucuaacaccagaaccuaggcucuuuguuauauaucaucacuguaguagaggcuaauauaacaaauaucccaauucuucaacuuagaaguaguguaauuucaguuacauguagcuuuucuugaguuaauauuauauauaaagaaagcauucaguacaugcuagcuaucaucaucaaugcaagggauauuggcuguagucagcuuauuuuuacccaagggcuucaguucuuucuagcaucuuaagcugugccccaagacuuuagaagcuccuaaggggcagagauuuggugguguaagaacauaaagaaaacaaugaauuucugcuauuuugcuauugcccuuucccuuaccucuucagaaacucaaaguacauuaacagcauauaggaacuagcagccaagcagagcuagcuuccaacugcuccaccaauccucaauauacugugauagaugcugccagaugucaugcuagcagcuuaaacuuauuagucacuauaauccaaauggaauguaauuaacucuacaauuuugagguauauguaauguuuaggccaaucuaaguaugacucauaaagcccucccuccaugauccggccccugcugaccuuuccaccuccccugcuuuccuccugacccuguuuuuauguuccaggcauucaaaacuacuuaguauucagaacaaggcauacccugucacaccucuaagcaugcuguucuuacuggcuggaacuccuuucugucccugcuuggcuggcuaaaucccacucauucuucagaucucuaauucauuacuccuuguuguuuuaaugccuuuucugauaguucagggcagauucuaaguuuccuuccuuuuucaauuucagaugaguugcacuagucaauauggcaguugauaacagaugugucauugcucucuaugcaaaacccuuuccuuaucuucuuuauucaacccuacauuucuaucccauuaucuccucuuacuguaaauauacuucaaagugacacacauccugagcuagagagacagcucagugguuaaaagcucuuugcucuuucagaggaccuggguucccagaacccaaaccaaguaucccacaaccaccucuaaugccaguuccagggaagcugacagucuucuggcuuuugugagcacuagcacacacauggcaaucuccccccucgacacacacucaaagaaauaaagauaagucuuuaaaaauguacauucuuacaaaaugucacuaucuuacaugaaacagcuuauucuggagagauguggagcaagggggaauauuccuccauugcugaagggagugcaaacuuguacaacugcuauggaaaucaauauggcgguuucucagagaauuggaaaucaauuuaccucaagacccaacuauaccacucuugaauauauacccaccaaaggauacuccauccuaccacaaagacaacaguucaccuaugcucauagcagcuuuauucauaaauagccagaaauuggaaacaaacucgauguuucucaaccaaagaauggaaaagaaaaugugguacauuuuacacaauggaauacugcucaguuguuaaaaaaaaaauaaucaugaaauuuacaggcaaauggauguaacuagaaaaaauuauccugaaugagauuacccgacaaacauaguauguacuuacuuauaaguggguauuagcuguuaaguaaaugauaaccaugcuacaauccacagacccagagaagcuaaauaacaagaagagcacaaagagggagggggggaugcacagaucucccaggaaaaagguaauagaauagauuuugcagguagacucggggugaaccgguggggauggagaguacuggaagaggggacuggaauuggggcacguuccaggugugaugaggaaacuuaguacaauggaaaacuuccuggaaucuauaagggugacccuagugagacuccuaguaaugggggauacagagccugaaccaagcaagaguuccaggggugggacuaggacauuaaccuagccacaaacccuuugagcuacaauuuguccugccugcaacauaucuuggaguaaugguggaggagaacuugggagugcccaaccaaugacuggcccaacaugaggcccauaccuccugacacugccuggagccaggaaggaaccacaggcuggauaacccagagaucuaggauagaacaccaaacacgacuggcaaagaaauaaaaaggucaaugagaugauuccuaaugauauucugcuauacucaguguacuggcuaguuuugugucaacuugacacagcuggaguuaucacagagaaaggagcuucaauugagaaaaugccuccaugagauacaacugucaggcauuuucucaauuagugaucaagggggaaaggccccuugugggugggaccaucuaugggcugguagucuugguucuauaagagaggaagcugagcaagccaggggaagcaagccaguaaagaacaucccuccauggcuucugcaucagcuccugcccccugaccugcuugaguuccaguccugacuuccuuggugaugaacagcaguauggaaguguaagacgaauaaacccuuuccucuccaacuugcaucuuggucaugauguuuuguccaggaauagaaacccugacuaagacacucagagaccugagcuuauuagcccaaucaucaucagagaggcuucauccagcaauugaagggagcagaugcagagacccacagcucagggaacccuaaggaagagaggaaggaagggcuguaggagcuagagggcucaaggacaccauaagugcauggcccacagguugacugagcagcacugguacgugcucucagagacugaagagacaaucaaggagccuguaagggucugagcuaacuagguccucugcauauguuaugguuauguggcuugauguucuuguggaacuccugauaauguuaguaggggauguuuauuguucuugguaggugcucuucauuauguugaauaauucacaaagguuauuucaucucaucuucuucauaaugccacaagauaggcaucacugucuuauuuuauaaaaacuauuauucaagacuucucuguucuuucaggacccuacaauaaguuccuaugguucuaagaauugguugcugcccuaggacacacaugacuaucaaggacggcagagugcaggcauacaucccauuaucucauaaagacacgcucacucaccguuucuuggcaauuucauucugccgcuucaccuuuucuuccucaaauucucggauguuacgcacaccaauuucccgacaaaacucuucaaacaccucaucuuccaccugagggaacagucagggaaggcagagguauuacuggcuaaacuccuacuuacaaaucuagucuuguccugauacauauguuggcaugcccacccccuacuaaccugguucaucuucuccuucaagucuuucauuucccucucucggcucuguaugauucucuugauaucauuaaugcgaggcccgaaguuggcuaguucacucuccagcuuagacuuuuccuauagucaauagguugaaaaauaagacaccaggcuuugugaagaaaaagaauuuucuugucaguacuagccccauggucagcaaacacugagaaagccugacuuaguaccaaugcccaagucacaucuccaaaaaucucuuguuagaacucucauauuuucccccguucccaguucagccaccuucaaucuauacggauggguguacguacaguaauaguuauagguccauuaaucccuuauugauaaccccugggccaaauaaguuuuagaaguuggacuguuuuucacaagaagguaagucuagguauuauguaacaauucuaguuugaguaagcuguaacaguacacaaccuacagacagugaaaugccuguagaucauuguguguguguguguguguguguguuuucccuugagaugugaucccacuauacagcucagggcggccuugaaugcuccaaucuucucuccaauguccugggaccacagguauaggccacuacacuggcccuguuguucacucucaauugacuuuuagaagucccaauauuuagugacugaaugugcuaauaacagucccuaacauuuauuuaaugucaacuguucuaagaacuuuauagguauuaauucauucgaucuuugcaauagccacacaaaauagacaauacuuuccauuuguuagaucaagaagauaaaacugacaauaagaaguaaguuguuuaauggaauaaacacaggggacagaagaucuagacaccuccaccccgucccagugccugacuauacucugcuaugcuauccugaacgaaauggaagaaaaguggauaauuccccagucccagugaaaccuaggaugauaugggaggccaggcugaaggccagccccuaccuggagauucagggcaagaugccuugucuuagucuguucuaggucacucugugaguacuucagccgcauuugaagcccgugggccugagacugcacuugacgcaguucugccucuuuccguuuugccuucaucugcuccuaaagaagaaaagaaaaaaggaccaugugcuaaguggccaaccugagcucaggaacccuacuccuaagggucaggguuacuugugccuuacuuucagcuccucugucaaacguucuuuuuuuucuuucaguuugucuacugcuuucucaucccagcgccgugcuuuugccuugagaucacuggcuccaccagagauaacuccugacuucuggaacagggugccauccaacgccacugucuauacgcaucagggagagaagagaagaaggugaacauaggaaucuccaauacugaguguacuggcuaguuuugugucaacuugacacagcuggaguuaucacagagaaaggagcuucaguugaggaaaugucuccaugagauccaacuguaaggcauuuucucaauuagugaucaagggggaaaggccccuugugggugggaccaucucugggcugguagucuuggguucuauaagagagcaggugaagcaagccaguaaagagcaucccuccauggccucugcaucagcuccugcucucugaccugcuugaguuccaguccugacuuccuuggugaugaacagcaguauggaaguguaagccgaauaaacccuuuccuccccaacuugcuucuuggucaugauguuugugcaggaauagaaacccugacuaagacaaauugguaccagcagagugggguauuccugugacaaccuggccauguuuuggggaggacuguggaaggacuuuggaacuuugggcuugaagauccauucauuguuaagagcccugucggauguuguguaggagcuuggaagauaauguugagaacacugcagaagauggaggucugguuugugaaauuucagagggaaaauuaaagacucuuuucagggccauugcuguuuugauugugaagauucuguaguucugguuagcuggggcuaaagaaucagcugugauuaacaagauaccggaacuacuaaagcaaaaacuuugcauuacugggacuauugaugcugguuagcuggagcuaagaaauuagcggugauuaagaagagaccagcaucauugaggugacaucuucugggaaguguuuucugaaagcacaaagaggcuguguuccagagauggccaagguuguacuccugcugcagcgggacuugguaauauguaagggucacccaggugguacugguuuugaaggcaugaaggggucacgcagaacagcugaggcucggcacugugagaggccauggaaggccauuggugaaggugcagccucaguugcaauugaaggcccaggacugaaggggucaugcaguguuuuggagaugccaguaccaugagaugaccaccaagagcagcagcaucaguggaguacagucaucuggagccuagaggaugacgcgugugcuacaaagggcauggcuggagaagugacccaagcccuuggaggagcccagaagaucgugaguuggaucccagacauuggacaguuagagauugauuuuugcuuuugauugugacugugcccugauaguuucccucuugaaggaagaaacaguuuuaguggagcgcacaguuaagacacuuuuaauuguaaaaaaacuuuggauuuuaaagagauugaaaauuuaagaauauguaaagacugugggacuuuuaaaguuauuuauaauggggaugaauaagaauguaaggguugaggcuuacuagugauguguuugugugucaaguugacaaggggucaauuguacuggcuaguuuugugucaacuugacacagcuggaguuaucacagagaaaggagcuucaguugaggaaaugucuccaugagauccaacuguaaggcauuuucucaauuagcgaucaagggggaaaggccccuugugggugggaccaucccugggcugguagucuuggguucuauaagagagcaggugaagcaaaccaguaaagagcacccuccauggcucugcaucagcuccugcuuccugaccugcuugaguuccaguccugacuuccuuggugaugaacagcaguauggaaguguaagccgaauaaacccuuuccuccccaacuugcuucuuggucaugauguuugugcaggaauagaaacccugacuaagacacugagccuguccaacuccaaccugagaaagggggggagggugcauaccuuguggcguuggugaccuccaaaggcaaugcgucgagcauccuccacauuaucacaaacaagggcauugccacaagcauacugcagagcuuuuuuaaugugaggugguucauaacgaauuacaucaaucacuagcuuggcccccuucagcucccggaguuucucaucaguagguuucaccugugugaagaaucuuaugaagcaacagaauacauaaagccaaggugaggggcccauaacacugccuugaccccaaaccccuucacaagccuuaccuccagguagucaagaggcaagaaggucucaggcucuccacguugcuccuugauauacugaauacagucccgaccugucuucucugagucuacaauaauagcauccauguucuucccuaaaaccuuggucacagcaaucugauacuucuuuuguguaggcuggcagaggucaaugaggcggccauacugaauauaaaggaagaagggaaacugaagcacaaggcuuaggaaucccaauuacuagcuuacaaagaagggcaagauaaaaaucuguauaagcuaccaugaauacacucauugcugcuuguuggugcagucaguccucuacuuuuguacuauaugauaccacuaagauaggaaggggaacagcccgaggggagggacuuguuagacuuguauggcuacaagcaauuuagacuaguacagcagucaauucuaaugcuccuuccaaagauagaaguuuggcuaagaggaagauuaaggacugaauaaacauguuaaaagauggaagacccaauuagcaccucagaaccgaguaagaaaucacauugccucuauguucacuuauaucagaagcuuaaaaagugaagcuauauguuuccuaagacagacuauugcuuuuggaaucagacaagauuaacuaaaaagccacaagacuuaacagccucccccagaaaacauucuugaauacgauacacuaauuuuucuguuuuugaaacauggucucauuauuuagcugggacuaaccuagaucucccugguuaccccagguugacuucaaacucaugauauuccugccugugccuuccaacugcugauauuaaaggcaugcaccaaagaaccuagcuuuagaaugguaacucauuaacuuauagcuaaaugagauuauagaaacacaccaguaucuucugacuuacaguuauuuugauguaaaagauuuauguucaaagacgaaagggggggacuaugaaauuacaaaacauacauuuagcuugacuaugauuucugauacaguuucaaaaacuaaaaucauaaugaguugaccgaucagugacuacuccuagguaacuuucacgagagcuagucauuauagagaccaaggcaggauuagaggauugggccuucuaguccccugucccacaccuaaaaagaaaugaugacuaaaagcugaguucaucagcaauaggcaaugacuuaaucuaucaugccuauaaaauaaacccuccauaaaaacucaaaagcucaggacugagaaaugaaaucagcuguuaaagaguacuugcugcucuugcagaggaccugagcucaguucaaagcauucucgucagguggcucacaaccacauauaacuccugcuccaaaggaucuucacucacaaauauauacucacaaacagaaacacacacacacacacacacacacacacacaccccuacaauuaaaauaagucuaaauagauaacaaaaccaaccagaaaccuugaaaguucuguguucauguagagcauggucaucuaaaucuuuauucuugggacucaggaagcagaggcaggcagaucuuugugaguucaaagacagcuugcucuacauagugaguucuaggccagccaggagacuuuagucuagggaccuugucucugaaaggaaggaggggaggggaggggagggugggaaagaggaagggaagggugggaaaggggaagggaagggugggaaaggggaagggaagggugggaaaggggaagggaagggugggaaagaggaagggaagggugggaaaggggaaggggaagggaagggugggaaagagggagggaggaagagaaggaggggcaagggagggagggaagaaggaaggaaggaaggaaggaaguguucuguguugagggugcuucuagauaauucaagaggaggcucaguaaguaagggcacuuacauuccuagaacaaacacuguagaaggagagaacugacuucugcaaguuuuccucugaucuuuacacaugugcugugagggacagacagacagauguguguacacacacauacaucugguauuagaaaugaaaugcuguauuuauuggcugugugagaguagaaggaacacuuugguuuuaucccaucucacagagcagaccucauacuauauaggaaaacccuacucuugcuccaaagccagugacagcuucaggcagucacaucugaaucuauuaucauuuuucaaaaugucuuuaauuauuucauagaccauuaccuagcaagcacugacagauaucuuaaauacauuaucucaaauucugacaagcacccaauaaaguagguaacuuuuacuagauuccuuauuccagcccuagaaucaagcauagcuucucaagagcgaugagauaagaguaaucacuucagcugggcggugguggcacacgccucugauccagcacucaggaggcagguggauuucuauguguuucagaccagccuggucuccagauuaaguuccaaggcaacauagcuccagagcuacauagaggaacccuuaggggguuaaaaaguacauacugaguguaacuuguaaguauuuccacuucccuaauaguacuuacaggcaugaugaguguguaugugauguauagaaccaaacuaaguuaaacucagaaacaaaauaguacagaaggauaacaccugggaacucagaauuaggugcagaagucaaaaguucugauaaagcccaggguccccuaacaaccaauggaauucauagaaaacuacagaaagcuacuuuuuugaagagcaauuacuagucuaccuauccucuucccaaaaccuucuuuguuguccccaucccccaaagaggaauggauauagcaagacaaacgcaucagaaagauguaauuguaauuaaaagagcacaugacagccauggagauggcucagugaguaaaguugucaccauguaggaguuaagacuuagaugugaaucccuagaaccgauacaauccauggacaugguagcacacauugucugcaauccaacuaguuccuauggggagaugggaaguggaggcagaaaaaucucaggaagcuugugggccacccacccugguauacauagcagaagaaaacaugagggucuggagagauuucucagcuguuaagagcacucccacuuacccacaugguggcucacaaccacccauaacucuaguuccaggagaucugaugauuucugaacuccacaagcaccaggcaugcaugugguacacauacauacaugaagaaaaaagucaaaaaccaacacaggacucuugucucaaauaagcuugauaacaaggacucacaccucagguucuccaagccccauucuugaugugguacauguccuuacaaauacacacauacacaguuuuuacaauuauguguaagagugucugcauguguguaugugccaugcccucaaaggcugggggcacuggaucccuuggagcuguaguuauaggcagcuguaaaccaacuguuacauuaaguccucugaaagggcaagugcucuuaaucauugaggcaucaucucucuagcucccaguaaauagaaaauuuaaacugaaaacaaaaccaggacaugaacaguucucucauaugcuuuucuuuucuuuuuaucauuuauuuauuuuuuauuuuauauguauguguguuuugucuacauguauacccaugugugauuugucuccucacaggccagaagaggguaccagauccccugaaacugaagucacagacauugugagucaagauguggguguugggaaccaaacucaggcccuaaagaagaguagacagugcucuuaacucugagccaucucuccagcccaagcuaugucuguuugggcaggauaaucuaguugaguuuccauuuucccugauauaaguguaggaauagcuacccugucuucacagaguguucuauagcaaucucuucccaacuggcagaagggaggagaaugcuccugagacucaggagguaggcacuuuaguuucaugucugggaaaguggaaacuuggaaguuucuagaagauguuccucagcuuuauaggaguaaacaccuacuggaggaggagucucugacagacagcuagagaaauaggagauucuuagccacugagcugacugagaacugccaagagcuccagcgcugcugcuucugugagcugucauccaccauagggugggcuuuuuggugauacaucuacguuuuaaaagucguuccugcucuuaaguaaucucucacucauacucuuguuaguaaugccaggaaaaacucaucgguucacuauacuggacuuuguugcaaccauuacuuaggacuauuguacguucccuuucucaggugaguagguguguaucaugucucugcauaggaaaucuaccacagaacacagaagguugacagugagucugaauacauacucagaaaucugaguccccuccagucuuaccacagagccaggguagagacgcuugaugcuuuccauuauuucugccuuucgcugcuggcggcuacucuccugucggucaauucgugcauccccuaauugcuccaucaccugguucagcuccuuauugaucucaucaauacgacgcuuggccaucucuacuucuuccgucaguucucccucuagcuucuucugcuccucuagagacugccuacaaaguaaagaagcacaggaguuaaccugccugguaagauaagacuugugacuaaagggcucugguagacccgccuaaagaggggcaggaugagcauggaagaacguggaggguaaagagaggauugcagagccacauacuugcuagugguaauauauucuucuagcuucucaauccguuucugauucucuucaaucucccgcaguuuuugcuugaucuuggccuggauaauaaaugcauaccacuauuagaggcugaaccaguuaacccaaguucauguggucucgacuuacaccgcuauugaccccacuuacccaaaauuccaacaguccaacagaaucugucaugaucuaauacaggaggccuacuacaaggcgaaacaaaguccagucuacugcuacauuagggcuucuaagggcuccaaaaucucucaggaguacuguacccaggccaggguuccucagcaaucuaaagcucaaacccaagcaaaguaaagcuucacagacgucucugaccuugcugucucaucuguaagcuguaguaaguacuuagucuaggguacacauuaauaguaguaggagaauggcagugagugaaguauacuuggcaacagugugagcuuuagagacagacugcccagguucauccuaaaccugcagcugaguaauuaugggauugcuguuauuauuaagcuccagcuuacuucaccacuggaauaguuuccucguuuugaaagugaggauaauaguaaccaucccuuaaagguaaucauagaugaacuuaaauaagugaauauauguuaagcauaguguuuagcacacgguagcugccugauacauacaaauuucuguuguuauuaaggcuaucauuauuaccuuauuuagggauuaucaccccugauuguuuuguugugguugaugcugggaauugaauucaggguaaauaugcuaagcacacacugcugcugagcuacacucccacacgucauccuucaauuuuugccuaccucuguuucuacuuucuuccgcucuuccagaucuagacgguccuggucagcuuucuggucucgauugaacuucuccagcuccugagccaaaguagcugcucucuugcuggcuucuucuuucaaucggugguauuucuuuaccuguguuaagacaggaaaagaggacaggucacuaagucagccgauguuaagucaccaaucucuuugccaggacccuuucaagacuuaccugguucuccuccagggucaagucucugcccugacucugacucucuuccuccauccguucuucaaacuccugucgggccuucuccacugacagcaucuccuucuccagcucauccaugucaccuuuacguuucuuauaauguuucugagcauuuugaagagacuucuuggcugcuucgagcuucuugauuuugugggauguauucucuuuugcuuugauguacugaggccucuucugauucaauuccgaguccuuuucccuuuugccaaggagaaaggaaaccaguuaguccugcagaacgcagggauccugggcuuuuuacccuaaaagagagaccuauguauuccuagccaaccucauggaaacaccuuaaagaacaagggccugaugcccuauaguuccucaaaaacaagcaaaagaccccaaaacaacaaaaaacagagagggguacaguccaaguacuuguuggaaucuacagcagcagccucacauuuuagucacuccaaaagacaaaauuaucacccccuuuucaacccucacaacucuuugggguucuucauggcaacagauuccacugcauccugauaaaagucaaaacacuaucccauaauguugaaagcaaacccuacaacaggucucucauuaaaaacuccccccaaugaguuaccuucuucugauauucaaauuccuguccuuuaagcuuaagagaaacagugcuucucuucuaggauagaccucuuggucacccaauagcugaacuugcuaaauugucaacuaugagcccagaucuuuuuuuguucauuuauuuguaucacacaugcacuggcaugugcguacacacacacacacacacacacacacaacuaguuagugcaugcagaaauuggaggacaacuugugggacucagcucucucuuuccaccauauuggauccuaguaauuuaacucaagucacuagacuuggucucaagcacuuuuaccagaugagcuaugucaaggcugaguuaccuuacugccccaagcuugaauagucuacaguauuaauugaaagucaagaaaugugccuggucaaggggaagauaaauuaguacaauaguagacuuuaggcucagaggaucccaagagaagagcaacagcugcuuauaguuuuaaacaaguuacaggucugggcaugccucuuacuugaucuccuucucaaucugcugcuguucccgcaucauuuuucccagcucuuucuucuucuccuucagcucauccucuaccuuguccauccgcuucuuguccuucucaauuuccuuguucuucgaggccaguuccuuguugagcuucucaaucuccacuucguugugguagaguuuaaagagcugcaacuguaccugugcucguacuaccucauccuucaggcgcugauagcgguccgccuaagcaaacaagaguggggacaggguguaucaguaaggcacugccuuuaucuuggucccucagaucuaaggggcagccaggccaccaaccucuuccuuuucuuguuuggccuccuuucguucagcugcaauauuuuucuugcgaugauaauuaaacugugugucuucuucagccuucaccauuucuuucuuucgcuugucauacuccugugcaaguuccccagagcgacuaauuucuucaaacagagcuguccucuccuugggguucuucauggcaauagacuccacugcacccugauaaaaggucaaaacacugccccauuuagccgucuacuagcucaauucacccugcccacuuccaaaguuuacagauccuccuuuccucaacuagugccacauuucaagggguuuuugugggcaggaaagaguuuaaguacagagaacugaaagucaguauguacuccaccacugaauugcauucucuucucuuccuuuacuuuucugauuuucagagaaucuugauaaguugucuacccauggcuugaacuuccucuguagcccaagcaaacuuugaacuuacaaucuucuugcuuuaguugggguaugggccccugcuaccaggucagccauauugggcuuuaguggcacauuuucugucucugagcacaaagagacgaacacaaagguaacaaugguauauuguguacaaucacuaaagcagcccagaaaauucaaguaugagaugcaagaaacagguagggaguucuauuugggaagguuuuauacagguacagcugacuuuggaauauaugggaaaacuaaacaagaaaaaaggacaacagacuggggauagcauaugagaggcacuggguuuaaucccuaccaccucaagugugugugugagagagugaggugggggggagaugcguaaaacaaagacagaaauggucauuugacaauuccacaagugggaaacgaacaagcaaaggccugcaugccaaagacagcaaaugaaucugagaacuacaggcgguaguuuaauuggacuagaguaggaaacugaggaacagacgacuggcagacaaagcuacuaaggcaggaaagaauugaacauaguguuuuaugaacaauaggcuugcaaauuugcuuguucauucuaagucaacuguuuucaaacuucagguagcaucacaauagccuuaagagcuugcuauaacacaaacuguaccccaccacagagucucuucagcucauaaucuggaauggggcccaagaaugcacauuuagaacauauccucauaugguguuaauacugcuggucuagcaacaacaauuuaagaacaaucauccuuagacaagaaggaaccacugaacugcuuuaugaaaagacaggaaaaaaaaaagacuucugucuuuauuagacuaacccagcugaggggagaaauaggaaggggucagaauggaacugggaagcccacuaaagcaugugcuacacauuagucuaaggaagacacauuaacuuggagauaagcagcucuaguugggacaggcaacaucaacaaacagcaaauagccaauaaugauuuuuaaacacucaagggggcugaauagguggcucaacaguuaagagcaccacagucaucuauuggauggaacacagggcccccaauggaggagcuagagaaagcacccaaggagcugaaggggucugcaacccuauagguggaacaacaauaugagcuaaccaguacccccagagcucgugucucuagcugcauauguagcagaggauggccuggucggccaucauugggaagagaggccccuuggucuugcaaacuucauaugccucaguacaggggaacgccagggccaagaagugggaguggguggguaggggaguggguggggguaaugggggacuuuugggauagcauuugaaauguaaaugaagaaaauaucuaauuaaaaaaaacuaaaaaaaaaaagacaacaaccaguuaagagcacuagcagcucuuuguuccagaggauccagguucaauucccaccacccacaugguaguucacaacucuagucccagaggacccaacauccuuuucuggcuuccauagauaucgcaugcccuggugcacacacauauauacaaguaaaacacucauaaccauaaaaucauuuuuucaaaaugcccacagucugggcaugguggcacaugccuuuaauuccuggacucaggaggcagaagcaggcacaucuggcuagccaggacuacacagugaaauccugucuuuaaaaaaaguccacagacgauaaccuacuucuucuauccuauuacuaaauuaauauaguuugcaaugcccuucuaaauauuucuccauauuaccacagauaaguacaaguuucauaucucauugaagaaacgucuuuuugucuuccagcagaaagaaaacagaucaacaaaaucugucaaaaugcaggaaaaaaguaagaaugccuagccccaaaugcaucaucuauaacacagccccuaaaucaugacucaggcaacaucucaggagagaggacagaaagauuacuggagccggaaggcaggaugacugcuguaugauaguuucuucuggccuggacaaagaugguguucccaagaauucucaauaauauggcucucagcacaagauaugugaagacuacaccaaugaacauaccaauauggauggaggaaacuuucaaaaggucacugaugguugcuaagagagggugaaccauuugcuccccaccccucacgaagaccucagcucuaaacacauacaaauaaggcccaauacaaaacuggacucaacagaggugugugaguaaacaaacaaaacaaauauggggccuguagagauggcucaaugguuaaaaguacuugcugcucuugcagaggacucugacuuaauucccaccacuuaaaugguagcugacaaccaucuguaacuccaguuucagggggucugaugcugccuucuggccuggcaucagacacacaugugaugcccauacauacauacauagaagcaaaacacucagauauauaaaauaaaaaucuugaaaauaauacagaagagaucauauauccugaucucuuccugaggaggugguaagggagauauaggaauugaaguggggagagggacuguggaaaugaugcaaauaguguauaaaaauaaaaaugaaaguaauuugcugagcauggcaguacauaccuuuaauccuaucacccaggaagcagaggcagguagacguuucugaguucaaggcuagccuaagcuacauauaaguuccagggcagccagggacuacacagugagaucgucuuuaaaaaaauuauauaucucaccuggaagacgaggaaguuacgagcuuugaugagaaugcccaacuucucuaacucuucacuguauucauguagcuggacaacuuuguuguugaucuuguacucagaagagcccccuacaaggcaacaaaugagucaacaaggaucagguauuccuccuauccugacaacuagucuaucugcuucauuggacccagggagccuucugagccucacucaccuacaaugacucgggcaaagguacgguccucagcacccuccuccgaguagaccaugcugacaaaggcucgguuggcagccggcuugcccacaggugcuccauguaucaggucccgcagggucuuuacccucagguugcuggucuuuucaccaagcacaaagcugauggcauccaugagauuugacuuaccuaagggagaaggagucaaagcagaagagggaacauugggaagaagggaagaggaaaauaaauaaagggcauauugagaguagaaacauggucuaaucacuuagagcuuggacuaauauaauacaagagagaaaauaaaaucuguugucagaagauugggucaguggcuuaggaaaaauaguuccuuugcaguuaucacuuauaguaaccauaaacuaaaaccccauauaaagaaacagguauucauugaauggauucuucuacaaccuuuacuaugauaacacugacaaauauuauuuuuacccuguaaacuaaaaaaaaaaauaaaagcaggcuggacagagaaggaaauuaguugcuuuuuuaaguaacuguaaacuuuuaguauuccaagacagaagagccuagaauuuuuuugcacaaaaaugugaauaccuuuaacacuauuaaaacaguacacuuaaaacaguuagguuggggcuggugagauggcucaguggguaagagcacccgacugcucuuccgaagguccagaguucaaaucccagcaaccacaugguggcucacaaccauccgcaacaacaucugacucccucuucuggagugucugaagacagcuacaguguacuuacauauauuaauaaaauaagucuuuaaaaaaaaaaaaaaaaaaaaaacaguuagguugguaaacacaaugccuuuaaaagggcauguuccuuauaauauaauaugaagcauacaacauuggcuaugaaauaucuugccaaaaaaaaaauuuaaccugaaucuaaguaagccauuagaaccacacuucaauuucuaggaaauauauagcaacuaaaccaaccugguaaacaauacaaggaaauuguaagauaaaaauaaacuguggagcugaguauagugguaaaacacuucaaaaggcuggaaagacgauauggaaaccagugugguagcaugcuccuaacuuuaacacagcacucaggaaacugaaacaggaggauuaagaguuuaagauuggaacugggagagauagcucaaugguuaagaguacuagcugcucuucagaguaccagguuugguucuaguaccuacaugauagcagacaccugucugaaacuccaguuucaaggaauaagacauccucuucaggccuccaacagcaccaggcaaacacauggugcacagacauacaugcaggcaagacacauacacauuaaauuuuucuuuaaagaguucaaggccacccuuagcuuuacaaugagccaaaauaaaacaagacugugaaauguucuauaauacaaauggccugcucuuuuaaacaaacaaacaaacaaacaaacaaacaaacccucacuaucuguaccaggaauuuagcuaagagguagaacuucagaagcacacacaaggccucaggucccaucaccauugcuaaauaaaggcaauguuuuaaaugaauguagaacaguacugagauauaugcaaauagaacauggauguuauuauuacagguuauuuauuuuuagaaggaaaacauccacauaguccagacuggcuucccauucacaagcaucuugccuccaauugcuagaauuacaagugugugacacaccacccaaguugagaacauaacucugauuggacuccugucccccagcccccaccaagaaacauggacauuuugcaaagcaauuagggaaacuugauuauauauuagauaaacugagcaaguauauagaaacuugaaaaaaaaaacaagcuaaaugaugacaagagaaaauuaauagugguaagauggaaugauuuuauaugaaugcugaagcacuuaaaggugaaaugucugauuuucaaaugguuaaacacacacaugaaagagagagauggauggacagacagacugacugacugacugacuggcuauacuagagcucagauaauacaaaacuuggggagaagcaaaagaauaagaaaaccuaugaacaggcuggugagauagcucugcagauuaagguacuugcuaccaagccugauaaccugagugugauuccuaggauccacauagaagaaggggagaacucauuccugccaaguuguucucugaccuccaugcaugcacuaagcuugucauacaagcaugaauaccugaguuuggacuuagugccacuuaaaagcuagaugugguggugcauuggggaaguggggacaggaggaugcuuggggcuugcuggcuagccacuauagcccaguuggagaacuuuaagccgguaagacauacuaucucaaaaaauaagcuggagcugccagacugauggugcacaccuuugguccuagcacuuaagaggcagaggcaggcagaacucugaguucgaggccauccuggucuacagagugaguuccaagacagccagggcuacauuaaaaaaaaaaacaaaaacaaaaaaaacacugucuugaaauaaacaaauaaauaagguagaguuauaaaaacaaaagcaaacaaaaaacaccuaacaccaacuucugacacacacacacacacacagaguaauuuuuaaaauaauuaaaaaguggaaacuuaguauacuccugagucacauacuuggaaaacuuuuuguacuuuuugaagucacuugguccacucacuugaucaaacaaggaggaaaagaaauuuaacaaguaccuggcgugguagcgcacgccuuuaaucccagcacucaggaggcagaggcaggcaguuuucugaguucgaggccagccuggucuacaaagugaguucgaggacagccagggcuacagagaaauccugucucaaaaaaccaaagccccgcaccaccaaaaaaaaaaaaaaaaaaagaaauuuaacaagaaaacaagcuugaguaacaaaaccaauacuaaguuuuuuauuuuuuucugcuaugcagcucugguccucauuaugcuguccagguuggccuggaauucauagcaaucuucuuccaucagccacacuaguacugagauuauaggugccaucacaacuagcaaguaccaauucucaaacuuuuaacauuuguuaucaagauuauaccacuggcauacuauuuuuaauauaggcagcuucuuuguguguauaugcaggccagagguugaugcugaguaucuuuuuuugauaacugcccaccuuacuuuugagacaggaucuguuggccuggaagcucaccaacuugacuacauugacuaaucagcaagccccaggcauccuccuguuuccaccuccccagugcuggguuauggguauauauaccaccacacccagcuuuugaagugggcgcugaauauccgaacucaggucuucaugcucauguggcaagcaccuuacagacaaagcuauauccucagccuucucuuuugucugacagcacccugggcucuuuauacuugcuaaaauaccaaugcauaaucagcuaccuucuuaagaauacugccucacaugauucaugcaaguuugugagucagguucucauuaauuacccaauuuagcuuauccaaaagccuuaggaaacagguauuuccucugcuuuaaagcggaagaaaccuagucauuccuuaaguuaaaacugucagcgaguccuuuacuucaacugacaggaugacaaaacagucuccguaucaucaggcuucaagcccaaaguccuucauucugcuacucguuuguuaaaaccuuaaaaaauaaaccucguggggcuggggacuugacccagcugagagugugcucgccaggcacgcacaagaccuucagcucaaacccaaacucucaaguaaaccagguguggaaguacacacuuguaauuccagcacucugaagauggaggcaggaagaucagaaagucagauuugaaaccaggcugggauaugagauccuaucuuaaaaacaaacgaacaacaaaaacccaagaucuacuuggugcucaauaaguggcacaucuaucaguauucaaucuggagucaacucucucuccaguugcagcagagcuaguaaaucacauaaauuggaauuagucuuguaaccaccaauuuccaaucuuuggacuucucccuugauuuucaaggaucacaucucacaaguacaauccucuuuuacuauagucauuaaguguuggaaagauucuucuaaugcaaauguuaacaauaacuauauaccaauaaaacaucucaaggaauggcaucuugagaacacucaugcacuagugaugaagaugaaaaaaaauguaccauaaauguguaaccaaaaauaaauuuacaaagugggaaucagagaucaaaaaaugcuucauggugccaagcuuugaaggguaugcagaggcagaaagcaggugugguaaaacacagcuauaaaucuagcacuugggagguaggggcaagaggauuuaagaguuugaggccauaagaaauuaucuccaaaacaaacaaacaaacaaaaggugggacagugguggcacacaccuuuaaucccagcacuagggaggcagaggcaaguggaucucugugggauggaggccaccuuggucuacagaggaaguuccaggacagucaagacuacacagagaagcccugucuggcaaccccucccccucaaaaaauagagagguaagaacccaggccuguuccaaacagcuggauuuuuaauucuaacaacgcugagagaacucgauuucaacaagugguacaaccaagcauuuucuacaagagucacaagaccaaaauccuaagaaauuuaguggaacucaaagcaucaacccucuaggccagugguucuuaaaccguaguaggggaaguaaguaacccgucauuaccacccccacccgcacuccaaacucugacauuguccgaacacauuuuugaugggcauuucaggggaguggaggugcugucauuuaguggagagaggucaggaaaacagcuaaacauucuacaaugcacagaaccaaccgcacagagaaaguguguggcuaaagagcuaguguuaggaaacaaugcucuagacagagaacaaaaccgcaagcaagaguccagugaagguauucgcuaugagcuacuucaagguaaggguggccuagcaggcuagaaaaugaguaaacuagaauaucucuggaguggaggaacacagcaaagauucauaacgaauacuucuagagaugggugagaggaaacuacgagcuauacagcaaaaacuaagauaugaaauaguaggcuuaaguaugaaaaaguaggguuacuaucaaagucacucuaacuuaucagccuaaccccuuuucuacaaaacauuuauaauggccuaaguguuaucuuauuuuguacuuugcuucuccuuucccgcgaucucggauuugcucuccccgcauaaacuuaacugauaaaaccccaaacccuccaccaauuuggcaagcgaacaaguucaggcuuauuuacgguuuucugguaggaaaaaggcaaaucaaagcaacaaucucuuaggcguguggggggcaugcggagggguggggggcaucgcaaucccacgcugcugagcggaacgcugggucagaaauucaaaagugccacagcagagagggggggggggaaaggaaucagaguggagcguuccaucgggaggugcgggugcggggagggcugaguagagcacaaaguacacagcuugggaucggacgccaaagcagaguuacgguucccaaauuuucccagaggugucaaacaaguuuaggaagguggaacaaugcagaccggaaggaagccgcgggccaaacaacuggcagcaaauuucgggaacgccucuuuuggcgggagggguagugggcggggcgacgcacgguucggcccauaccauucgggccagagggggucugcgccgaacuccgccaacugacaguugggaagagacucgaguucaguguaugccaaaagggaaagcaaguucagauccaagccccaccaagaggaucaaggaacauuucaggguucacaaugucucggguugcauggggguagguuguacuacuuugcagacaagcagggggaaccggaccgggacgcgcgcagggccacagccgguuuuaaucucaccagagccauuggguccaaugauggcgguaaaccucugaaaugguccgauaaucugucgacccuuguacgauuuaaaguucucgaucucaaucaguuucaggaaacccaugacagcggcgcuggcguaggaaaggccgcgccuuacuccugggaacgagguuagcccgcgcgggaaauagcgcagugcaagccggguguacaguaagccucgcgauaauaaguccaagccaaucacgauuuccuguuuccggggccagaaauggucacuuccgccugaaauagcgcuuuuguugaauuguugcccggcuggagcacgcgcugggcgcucaggccccgccccucuacguaguuacccagcaacuguugaaguggccgccaacuaggacgggaagcguuagugcucugaucacuucgggggaaaucagagcaagcaggcggggucugagcccacgcuugcugggaaagaagucacuucaagguucugccagagcuagugggaggcagaagcucggcugggguuuguagucuagccagcaaggggggagacggggagaagcgcuucagccaaggauucagucgggaaugggaaggcgcccucggaagggugggcaguuugggauggaagagggaucaaagggaggacuuagaugaggcgagcuuagagugugaggacgaugagaguaucucuuagacaacagagauacaaguugggaaaggcuguguucugaaauacugccccuaucgucugcuucucucuuauuucuccaagcagaauuuaaagacugccguuguaaauccaagagucaacuuggguccaauccauuuucgagcuucaaaacuggaauucuguacugagaaagguaucuugugugaacacuaggaguccagguccuuaagccagugcuccagcucuguccuuuucccucccuguuaaaucaaguuucccccauuuccaccacuuccccucugucucuuucccucccccuuucucuccucucucccucccuuucucuuucucucuccucucucccuuccucucccccuccccucucucuccucuccuucccucucccucucuccucccucccucucucgcuccaacucuguccuuuucccuccauuacaucaaguuucccccauuuccaccucuucaccucucucucucccucccucuuucucucccucuccccccucucucuccccuccuucccucucccucccucuuuuucuccucucuccccccucucuuccucucuccucucucuccuuuauacccuguccuucuccaauucuuuuccauccccuuuuucuucauucuuucauuccccuucuaucaccuuauagucaugaucuuagcagcccaggaugucuacugaaucaucccccuauugugacaacagauugucuuuauaggccgggguuagugccauuuucaguuagauauggaaagagucuggugguuuccacagcuauuccuggguaucuucuuuuauuuuuucaaaaguuucuccaucuagcucugacuguccuggaacucuguagaccaggcuggccucgaacucagagauccaccugcugggaucaaaagugugugccaccacugcccggcuuuguaacugugugcaagugcaagcgugaucaaaugugugcacaagccacagacauuaggcaucagaucccuuggagcuggaguuacagguaguugugaaccaccuaacacgaguacucaaagaacucugaaagaacuggaaguauucuuaaccaccaugccaucucucuaguccuauuccuguaacuauuuuuaaauaaugucuaaaagcugggaagaauccuaaagagucuaggaaggugagaaagcucaguugauagaaucugauaugaagcucuuuugggaaaccagucacaggcaacaugagggaauaaaaucaucagaggcuugaaaucucacauacauuuuuaaaaguuacuauuuaauuuucaaagauuaaauguagcuugggagaaaauuaaauuggagcccuaucucuaaauauauacaaaauccaguuucaaauggauucaaaacaaaugauaaaggcaaaacuuuaggaauuguggaauauauaggagaguaucuuuauaaauuuagaauauggagagguuguuuguuuuacuguuuguuguaguuugguugauuugguuuucuucuuuuuuggggggggggagcagggucucugcauuguccuaacuguccuggaacucacuuuguagaccagacuggccucaaacucaagagauucaccugccucugccucccaagugcugggauuaaaggcgugugccaccacaccuggccaguuuuuuauuuuuauuuuauacuuucauauauguaccaaugaauaugggucauauccacccucauaucaacaucuguccucuaaagccccaucguaucccacacauuuuugugauucagaguccaauugguccuacccacaugugcauaguaugcaccugcaagaaaauugacaauuccuuggcagguaucaacuucuaauagcucuucaacuggaaaggagccucguccauccaugcuggaagguucacuggcuugcucuuuuaccggucuuguacaggucucuugcaggugaccacagcugcugugaauucacaagugcauggcucugucauaucuaaaaggcagcauuucccaguacugcccuccauccuccagcucuuuccauucuguccaguccuuguagcauaacggccccugaacuuuggaguaguggugauacacacacaucucauuuagggcuaggcacucauucuagucacuuauucucaacaguuugagcguugugaguuucugcauaaacuuaucuagagaaaaaagaagcuccuuggagagcagcacuaaacuaugaauauaaauacagauauuuagaaggcagguugacagaaaugaccauuuagaaaaacaguacuaguagguucucccccuagggccuaugaccugcccagacauggacguuugaccagauuuauaguagcaggcaugaauucccuuuuguggaccagaaccaggucucaaaucuaaucagagugguugguuacacccuauaauagucaugccauuacuacaccagugggcacaucuuaccuggaagguugguauuauagcaugcaggguccacugcuggguaagaugucuuuucuacccuagugacuuggcuagcaccuggaacucuugaaagcuagucagccuagaggaaauugccuugucagucccagauuucucuauucucagcagcuaagugugugaugccauuagcacuaggcucuuagcaucuaauuauggugaacaaccaagagaaagcagcaguagccuauguguuaggcuccucugggaaccucccuuaccaauaacuuggcauugagauuuuuauuuaauaacucauuucuucugggaacaccuaugauuuuuuuaaaacaugauggccuguaacuuacuauuuaguccaaauuggccuccaauuuuuaaguccuacaucagccucccaacugcugggauuauggguuugacccaacauaccuuauaagaaauuucuucaaugacuagaaacgcuucuuucaaagaaaaagaugggcacauaugacuaaauuuaaguuuaccaaaauucaccauugggaugugaaaugagggcuagaagagggcucaguggauaggaacacuuacugggccaugguagagcacacauuuaaucccagcacuggaggcagaugcagacaaaccucuggguucaaggcuagccuggucuacagagaaaguucuaggacuacagacaggaacccugucuuggaaaaaaaagaaaaauguuuaaggagauaaauuuacccuaauuugaaugcuacauaaaauauguaugcauugaaacaaaguacccaacagauagguauaacuuuacuuaauauaucugugaaaaguaaacauuuuguauacaaaacaucccuaaaaggaacacaagaugaguagacauuacacaaagcaauaaacaaaacgguugaccacaugaaaaggcgugagaccucauuaacaauaaaggaaaaucuauugaagucaguaauuaugggcugauaagauggcuuaucagguaaaggcauuugcagccaggccugacuugaguuuguuugcucucuggauuccacauaguggaaggagaaagcuaacuuuugcaaguuguccuaagaccuccacaaguacgcugccguguaagugcauaugugugcagacacagagguuaccaccacuguuuuaguuuuuuuuuauuaugugagugaguguguguguguguguguguguguguagcagucagagaacuuacaagggucaguucucuuucaccauguggaacaaagguucucuccuuccaucaugugcauccaagggauugaacucaccgggccugguggcaagcaccuuuccccacuaagccaucucccugaccccugugugauuugaauauuguauuuuauuucaccccauuguaucucacuugacuauucaauagguacagagggcugguggcuauagauaagcuaaguucaucuugcaauaaauacuggcugagaagcuauauuaguuucauauuauaauaaaaaaucccaaacuuaauaaacccauaaaaacuuacuuucauacagcucuggaaagcagaauaccaaaaugggucucacuggacuagggaucugaacucagguccucaggcuugcuagcaagcacuuauucacugagccauuacccccagcccuggcaacauucuuuaacacagccuucaccucauucuuuguguguguguguguguggggggguaggugugagcuuuaaugaugagccauuucuucagccuucuuuaaaagagcccuacucaaagccacuauccuuaucuuuuugguuaacuuaaguggucucuacauuggccuucuagcuuccuccaaauuguuuccuauugcccauucaucacacaaacaagcagcuuucuuuucugaaauaccauuuccccuuuauuuuauuacuuauuaucuaguaagauaaucaaccccagaugcguucauauuuugggaagcccaguuuugacauguugggggggcagguuacaaacauaaaccuuuuauuucucuaguguuaccuccuugaaauccuccccuaaccucucauuacauugaaauucaaacucauagcagggucuuuuuuggagaugguuuaaaaacaaacuuuuuauuacauuuuauuuaguggggggggggcacauggguauguacauguggaggucagaggacaacuuguaggaguugguucucuuucuaucaugugggaccaggggacaaacucagaucaucaggccuguuaacaaguaucuuuacccacugagccauuucaccugcccuugauacacuuuucuugagacugcuucuuacucuguaguugaagaggaccuugaacuugugaucuuccugccuccaccucccccgaguacugagauuauaggcaugcacuacuugguucagguuuacaugguacuguggauuacacccagggcuucauggaugcuagcaagcacuucaccacacuccaggcccauuacuauaggcuucaaagagccaguccuuacacaccuuuuuaauuugucucaugccacuaucucuuggguauaguacuccagguacacuggccucucgacauuuuccacuucuuucuauagcuauaacuuccacuaaccauuuuguagcugaaauaguuggcauaaacaaggaacaauauauagcccauaucuaaguuuggaagccugauaaaacagaaaccaacauaccagcuccccaaguuaagauagguguaguuguaaucuuaguccuuaaagaccguuaaaguauuacaacuucaaacaacccuggguuguuuucuggucuuuuaaacacuuggaagacauuuacuuuaaaguuguuuaugaagauuuugauuuugauuuucuucguucuuuguguuuugaucaucgucacccuguuuccaauccuucucagacccaacccccuuucccugcccacccaacuuucuaugcuuuuaauuuuuuucacccaucaagucuaauuugugcugaaaacauauuauuugauuuguggccuucuacuggaaccuggucaacucaagagugggcuugcagagccuaguacacaccuuuaauccaggcaaaggcaggcaaacucugaauucauugccagccuuccgggucuacagagugaguuccaggacagcagggcuacacagagaaaucuugucuuaaagaaagaaagaaacaaacaaacaaacaaauaaauaaauaaaaagaguggguucuccccucccagcagcugucuauugccaacagcucuuucacuaggacugggggcucauacccccuuccuuuuugcaugcugggauacagucuggcucgagcuuacacagguuuaugcaugguaacaagauaucugugaauucagacaugcagcuuccccugguaugugcagaagacacuauuuuccuguauucauccaccaccccugacucuuacaucuuuccaccccuuguacaaugauuacugagacuugaaaaggggacgugauauagaggucccauuuaggggugagcauucugcagucuguuauucucugcuuacaagcacuuuaacuuaaagagugcaauagugagacuugcuuucagagaauuuuaacauggauuaacaaaggccaucagggauuccgggaauauugucugacguuagaccgaagcuugacuuagugugaugacagcagagcuugaagacacagauaaugaaacgucauaaaguaaaaucaagauauaaaacaucagaaaguaaaaccaggaucauagcuagugagauguuauaagagagaaagaaaugaagguaugguauagucaaggacaaugucagcauuaaagagccauucuaccucucguugcuccagauguauaaauuagaccuuguaucagaucccagggagcuggcagccauugaagcuagaagaaaucgugaaaaggaacgccaaagccgauucuucaaugugcggaaccgagucaugggggugaguggguaaugaguaacuguacaagacugagauuacuugccccuugugccuugaaaggaauguggcagugcauuauaacccuucuagacucaagcaugcccugggacuggaaaggcaggagcugggggaccaaccucauaugccuggacagggcuuaggaagagaggcaggacugugaagagagagaugaugggugacagcuagcucuccucuggucaguucuugcacuauagcugguucuuaagaaacaauguggagccauaauaggguguaaaaaaaauuugauacuacauaaaccuaggguauuucugcaaggcuaaauacgacauuguuauauuaguugcuuuucuuauuacugugauaaaauaccugacaaacacugggaagggagcguuuguuuuggcucaguuuaagcauauaguccauuauuggaggaaaagggcuggagguggcuggucaauuugcgcccacaguuagcaagcacagaggucagcucacuuucuccuuuguauucaguccaggacacuaguccaugguaugguacugcccacaauuagggcagguuugcccacuuaaaauagacauguccagagguuucucuccuaagaaacaaacaauuguagaccaggcuggccucaaacucagaaauccaccugucucugccucccaagugcuaggauuaaaggcaaaaaaaaaaaaaaaaaaaaaaaaggcaaaaaaaaaaaaaaaaaagagaaauaaacaauugccaggcagugguggcgcacaccuuuaaucccagcacuugggaggcagaggcagcagauuucugaguucaaggccagccugaucuacagagugaguuccaggacagccagggauacacagagaaacccugucuugaaaaaccgaaaaaaagaaaagaaaagaaaguaacaaacaauugcugaguggguggguagaaaaggaucuaggaaagacaccauacuuguguucaaagccaagucugcuauuagauauguauggcuuuugguacauaaccuaucuuuuccuccucuggaaaaugagaccaaauaaagcacugagauguuaacuuugaaaaaaaaucagagcuuauuaccugaccacaagcaaacugaaguuugaguagucugagauucugguugcaagaauuuccucagaaccuacucuggaccaagcauuaugguagacaguggggaauacagugauagcuaaggccuagcuucuuccccccaaacagcucacagccuaguggaagagauaauagagaggcuaaugucaauacaauauggccaguggacccuagauuaugaggguagaagcuuccugagcaagucuugaaggguaaacugaaauaugggaaaggguggaaugaaagacuguucuaaggggaggaaccaguuagagcaaaggcuugaaacagcuuaagaugugcagagaacuagaaguacaguuccuuacacuacugugagaggaggcagggaaaggggaacaaagagauaaaggcagagaagcaguggcuagaccacagagguauuuacaggcuucguucagggguuagaauuuuauccaguagguccugaagaguugcagggugacucugaagagggucauuccuaaacagcauccuuuagggcauucaguuuacaugcucagacccuacucuaacuuagcuccuuucuuugagauucagguggauguggaagcccucaacuaccagguggaggaacgaaaguuucgggaggcaauagagcgaaacaaagauaucgcuuaugguaaauacucaaggcugcagcaaaaccagaaagaguggccugaaguugggcaauucugccuccgcauagagcccgaggcucugaggggugauaaaacauacuagaugacccugggaagaggcuuggggguagagguugacugggcucuguucuaggugucuucaugucccugucaaucacacuuagguaccaagcaugcgcacuaugaucugguagcccagaugcuagagaaagaagaggcagaacgagcauaccggcuguccaagagaguacaggauuuucgggaacaaaggcagcagcaauacaagaauggacaugaauuugacuucugggauccagaccaauuccaggaguuucgggucccuuauuaugagaaggaugcauacuuuggcccagccagcaugcaguacuucuuuggagaggaccuggaaagggccucacacgugagaaugcagcaggaacagaugagauacaaccuggaaaaacagcuacaggagcaacaggcagccagagaagaggaggcccgagcagguaaguagcacagcagggaguugauccagucuggauccagcacugugugagaagguacuuuacccguacagcugaggcacaaaggucaggcuguacaagcccuaacuucccucacuccuuucuuggcacuucccugaggaaagcauuuuacaguucuacuuacuuucugcuuugggcaaaugaauguuccucucuauaauugcauuugucuucuuuucuucauuucaugagacagggucuugcuguuuauauucaaccuagucugggcuggaacucagcaauccuucuuccucagccucuagaauacugggguuucaggcacaugccaucuugacagcucaguuucuucauuuuaaaauagggauuauaaucugcaucacauagaauagcaacuauucuuaugauacagucuggccacaucuuucuuuuacacuagagaaaaccuuuccagggcaagagucaugucuuucuacucauuuugccuuccaaucaccagugucuuacagggccuaagaacaaagaagccaguguguggcuugaaggggggaaauuuuaguagcuuugcuuaugcuguggccaugacugacaugccauuuucuucuugaucucuguacuuugacuuuuauaguuguuauuguuauuguucuccuccucucccucuucucccuccuccuccuccucucccuccuccuccuccucuguuuucaucucuucaguuuuggugcuggggauggaauccaggacuuccuauaugcuaagcacaaacuccuacaacuaugugauuuccucagcacccaaaaccuuuaauaugcuuauaugcaucucugccauuggccuuaccagguuguagucucauuauuggaucggucucuccuaccagaggaggagguuugggguguguguguguguguguguguguguguguguguguguguaagguauuaagauuguuaacuugcuauguaaccaaggauaaccuugaaauucugauuuuccugccucugucucccaagagcuggaauuauaggcauacaccacuacacuggacuaggcagggaguugucugggauaguaucuaauucuaugguauccucagaacccaaaaaauaaccuuaagacugagacuuaaugaaaugacauuauuuacuuaaagcaacaccacugaauggugacagagcuucauugucacccaauuugcuacgcuuugcccaccccugaccccaaggaguacuccuuccuuaucacuauaacuuuagcauucaaauauaaacacacaaaguauguugaacaaauaacuacugcaugaaugggcacuagaauaggcaaguccaauacccugccuguauuucucuguguagcuuugcucagugaccaacugcgccuagcugcugacacgcgggcugcugaacuggcuaggcuggaggaauccugucgagcagcuaugaggacugcuauggccaaugccaacaaagcccagguauguccugaaccagccaguguacuuagcacaucccaauuccugaacaaaguccuaggggaccuuaguccuggggaaucuuucuccuuauaucccauuucaaaccagugcaagcauucuccucuacccaagccuuccaccuaagacccuaucaaagcacaagucccucccucccuaccccuagauagagggugcuuuaagaacagguauugaccuuucaucucugaucucucagcauaaggcuuuccuaagugcagagaaauucccuggcuauucugccuccaucaugcucauaggcucagucaaaauccaugcuacgucuuucucuucucucugggaugaguagggcuguaguuuuccaauccauucaagagaguuuccugaggcugggcccccaaauguuuacauuugggggucccuacuaggcagccaagcaagcccugcagcagcgccgugaacagcagcggcaacaggaggccaaccucacagaggucaagaaacaagucaccagugaccugcugacugagaauccucaaguugcccaaagagccaaugcuccucaccggguccugcccuauuguuggaaggggaugagugcagagcagagagcugccaucagaaaaacucaagaaacacaacgacaagaaaaaaaggaacagcgccaagccgaaaaguuaguggaagcugaguggggaaggcaaaacaaacggcuggcugaagcggcccuggaacuggaagaacaggagcgggaacugugugcagaguuccgaaggggacugggcuccuucaacagggagcuagcuaaggagcagcaagcucagugaguucuaggcugugccaauggggaggaagcccgggguaggugggaggaaugacgaggaccagagagagggaaaacgcagcaccugaggccuuuguauuuucacaggcaaaauuaucugaauucggucaucuacaccaaucaaccgacugcgcacuauuaccuacaguucaacaccagcagccgcugagcucaggauggucaccuuccuucucacagguggccaggagucaaaaaaaaugcaacaaauccucauuucuaauuucuacccaguaggagggaacuaaagccaaaccuccacugucuacucuagguaauaaagucguucgcuacauucaacugugugucguaagaguacacaaaaggugugagauaccaccucucacacuccacacuggaucucucauguauucaaccucagagccuuuacucucuuccccaucucaguuccccuagcacacaagacugcacacaccuuggaaguuugagaauuuauuaggcaccgagggugaguggagcagaguuacaaaguggcuguuagcuuuccuucaaauugaaaaggagcugguguuucuccugccuuggcccuuuaaggcugcauucgaauggccccauccagccggaugaccucuccauucaagaauggguucucgauuauggucuguaccagaugagcauauucagcggggucaccuagucggcuggggaaggguaccuggcuggccaagaaguuucgcacuuucucuggaagggugguaagcagugggguggcaaacaaaccuggacaagaguaccagaaucagagguucagucuucuuuucaguuacuugguucuuccucacuuuagugcuaagcugcuacauuuagggaguggacaccuucucucaucugccuacaggucccacccaguccuaguauagcaaaaagguaagaaagagaaaugucuaccuggagcaauuguuaccacacggaugccuguaggagccagaucucgagcaaugggcagugucaugcccacuaugcccccuuuggaugcagaguaugcagcuuguccaaccuggaaaaagaguggagaacauaugugggagaucccccaaaagucauucagcuaagagcuucccuccuccguucacauaccuggcccucaaaggcagccacacuggcaguguuaaugauaacuccacguuggccucccuggucugguucauucuggcccaucuccccagcaaccaggcggaucacauugaaagugccuauaagauucaccuggaggaugguagaaccaugauguaggaucuaggacagaggcugccuuuuguuuccuuacacgcuuugggaauauucacugccacacccccuuuauccuccccguggagaucugccaaggccuuacauugauaacccgcuggaaguccuccaaaguauggaucuuguucuucuuuuggugguaugucuuaauggccacugcaauaccugcacaguugacagccacaucuauacggccaaacuuuucuuuugcuagagucaaagcugcuuguaucuccuucucagaggucaccuagacaggaagagaugaaggagagguauuucuuuccuaccauacacacaccacuaaaccuggagaggaagacagacccagaucuugggugggaacagaacugugugagcaaaggggggugggcaagaaagaguuguaauaaaacaaaugaagaugaaaggggaaaugguagauacuauagaagaguguugcaaaacauuucccaaucuguauucucuugauucauaugccucggguuauucucaguuaauacagaucagggcacuauaaacacuucugguuuuuuucucuugcaaguacugaugacuaaacccaggugccucccacaugcuaggcaagaacucugccaccaagcuguacuccaauacgaucaguucugaaaauaacaggaacaugaccuagcauuaaaagaaaaaaaaaaucccuaccugcugaguugaaguuuuuuaacucuguaaauguaaaaugucugggcaagauaugcauuccaacugaacauaucuucuccaggaaauccugguguguccaauccucucauccccauagugcugagcccggcuuuagcuuucuuacugcagggcucucacaguauccaagacuccaguccaaagcuaaaaggaaaugagucccgccccgccccgcucccccccaccccaccccccaccccccacccccccccccccgccuuccguuuaugugugugugugugugugugugcaggaauguuccugccagggcacacguguggaggucagaguuggaucuuuccuuauaccaugugguucccagggaucaaacgggggugucauggauggcauccugugccuuuaaccacuaagccaucugaccgaccccagauaccacucuuacggaaggaauccccaaguuuccucgugcacgaggagagucacgacucacauuugcuggggcaaauaugcagcuuucuccuaacuucuuggcuugggcuucacccucugagucagguacauccagaaguacagcuguggccccuugucccaccagucuuuuggccguagcuaggccaaggcccgaggcuccuccaguuacuaccgcgaccaagcccugugaaaagguacuagguaaacugcuauuauccagaccacuccccaccuuuucauuugccaauucuagaguucugcgaagaagaagcggggacggucagugaccuaaaugugcuuccucucccccagcgacgaaacuuggggggcgggggcgugucucaucccaggaauguuuuuucugugaccccucacacacagauguaguugaacauugcuuguucaccgauugagcccaaccaccgcaaaaccacgcguucuccaugcaccgauaucuccucucuuguuccugcccgcgcaguccuagccugcauaaaaacaaagguuagaggcacagagcagucuaccuucacgcuccgaacugccgcagccaucuugcacaagccucgccaccagaggagggcuuuuagugccuuuugcacaugcucucgcugauug

SEQ ID NO: 9785 - RNA, 11718 nt, Mus musculus
cguaguuacccagcaacuguugaaguggccgccaacuaggacgggaagcguuagugcucugaucacuucgggggaaaucagagcaagcaggcggggucugagcccacgcuugcugggaaagaagucacuucaagguucugccagagcuagugggaggcagaagcucggcugggguuuguagucuagccagcaaggggggagacggggagaagcgcuucagccaaggauucagucgggaaugggaaggcgcccucggaagggugggcaguuugggauggaagagggaucaaagggaggacuuagaugaggcgagcuuagagugugaggacgaugagaguaucucuuagacaacagagauacaaguugggaaaggcuguguucugaaauacugccccuaucgucugcuucucucuuauuucuccaagcagaauuuaaagacugccguuguaaauccaagagucaacuuggguccaauccauuuucgagcuucaaaacuggaauucuguacugagaaagguaucuugugugaacacuaggaguccagguccuuaagccagugcuccagcucuguccuuuucccucccuguuaaaucaaguuucccccauuuccaccacuuccccucugucucuuucccucccccuuucucuccucucucccucccuuucucuuucucucuccucucucccuuccucucccccuccccucucucuccucuccuucccucucccucucuccucccucccucucucgcuccaacucuguccuuuucccuccauuacaucaaguuucccccauuuccaccucuucaccucucucucucccucccucuuucucucccucuccccccucucucuccccuccuucccucucccucccucuuuuucuccucucuccccccucucuuccucucuccucucucuccuuuauacccuguccuucuccaauucuuuuccauccccuuuuucuucauucuuucauuccccuucuaucaccuuauagucaugaucuuagcagcccaggaugucuacugaaucaucccccuauugugacaacagauugucuuuauaggccgggguuagugccauuuucaguuagauauggaaagagucuggugguuuccacagcuauuccuggguaucuucuuuuauuuuuucaaaaguuucuccaucuagcucugacuguccuggaacucuguagaccaggcuggccucgaacucagagauccaccugcugggaucaaaagugugugccaccacugcccggcuuuguaacugugugcaagugcaagcgugaucaaaugugugcacaagccacagacauuaggcaucagaucccuuggagcuggaguuacagguaguugugaaccaccuaacacgaguacucaaagaacucugaaagaacuggaaguauucuuaaccaccaugccaucucucuaguccuauuccuguaacuauuuuuaaauaaugucuaaaagcugggaagaauccuaaagagucuaggaaggugagaaagcucaguugauagaaucugauaugaagcucuuuugggaaaccagucacaggcaacaugagggaauaaaaucaucagaggcuugaaaucucacauacauuuuuaaaaguuacuauuuaauuuucaaagauuaaauguagcuugggagaaaauuaaauuggagcccuaucucuaaauauauacaaaauccaguuucaaauggauucaaaacaaaugauaaaggcaaaacuuuaggaauuguggaauauauaggagaguaucuuuauaaauuuagaauauggagagguuguuuguuuuacuguuuguuguaguuugguugauuugguuuucuucuuuuuuggggggggggagcagggucucugcauuguccuaacuguccuggaacucacuuuguagaccagacuggccucaaacucaagagauucaccugccucugccucccaagugcugggauuaaaggcgugugccaccacaccuggccaguuuuuuauuuuuauuuuauacuuucauauauguaccaaugaauaugggucauauccacccucauaucaacaucuguccucuaaagccccaucguaucccacacauuuuugugauucagaguccaauugguccuacccacaugugcauaguaugcaccugcaagaaaauugacaauuccuuggcagguaucaacuucuaauagcucuucaacuggaaaggagccucguccauccaugcuggaagguucacuggcuugcucuuuuaccggucuuguacaggucucuugcaggugaccacagcugcugugaauucacaagugcauggcucugucauaucuaaaaggcagcauuucccaguacugcccuccauccuccagcucuuuccauucuguccaguccuuguagcauaacggccccugaacuuuggaguaguggugauacacacacaucucauuuagggcuaggcacucauucuagucacuuauucucaacaguuugagcguugugaguuucugcauaaacuuaucuagagaaaaaagaagcuccuuggagagcagcacuaaacuaugaauauaaauacagauauuuagaaggcagguugacagaaaugaccauuuagaaaaacaguacuaguagguucucccccuagggccuaugaccugcccagacauggacguuugaccagauuuauaguagcaggcaugaauucccuuuuguggaccagaaccaggucucaaaucuaaucagagugguugguuacacccuauaauagucaugccauuacuacaccagugggcacaucuuaccuggaagguugguauuauagcaugcaggguccacugcuggguaagaugucuuuucuacccuagugacuuggcuagcaccuggaacucuugaaagcuagucagccuagaggaaauugccuugucagucccagauuucucuauucucagcagcuaagugugugaugccauuagcacuaggcucuuagcaucuaauuauggugaacaaccaagagaaagcagcaguagccuauguguuaggcuccucugggaaccucccuuaccaauaacuuggcauugagauuuuuauuuaauaacucauuucuucugggaacaccuaugauuuuuuuaaaacaugauggccuguaacuuacuauuuaguccaaauuggccuccaauuuuuaaguccuacaucagccucccaacugcugggauuauggguuugacccaacauaccuuauaagaaauuucuucaaugacuagaaacgcuucuuucaaagaaaaagaugggcacauaugacuaaauuuaaguuuaccaaaauucaccauugggaugugaaaugagggcuagaagagggcucaguggauaggaacacuuacugggccaugguagagcacacauuuaaucccagcacuggaggcagaugcagacaaaccucuggguucaaggcuagccuggucuacagagaaaguucuaggacuacagacaggaacccugucuuggaaaaaaaagaaaaauguuuaaggagauaaauuuacccuaauuugaaugcuacauaaaauauguaugcauugaaacaaaguacccaacagauagguauaacuuuacuuaauauaucugugaaaaguaaacauuuuguauacaaaacaucccuaaaaggaacacaagaugaguagacauuacacaaagcaauaaacaaaacgguugaccacaugaaaaggcgugagaccucauuaacaauaaaggaaaaucuauugaagucaguaauuaugggcugauaagauggcuuaucagguaaaggcauuugcagccaggccugacuugaguuuguuugcucucuggauuccacauaguggaaggagaaagcuaacuuuugcaaguuguccuaagaccuccacaaguacgcugccguguaagugcauaugugugcagacacagagguuaccaccacuguuuuaguuuuuuuuuauuaugugagugaguguguguguguguguguguguguguagcagucagagaacuuacaagggucaguucucuuucaccauguggaacaaagguucucuccuuccaucaugugcauccaagggauugaacucaccgggccugguggcaagcaccuuuccccacuaagccaucucccugaccccugugugauuugaauauuguauuuuauuucaccccauuguaucucacuugacuauucaauagguacagagggcugguggcuauagauaagcuaaguucaucuugcaauaaauacuggcugagaagcuauauuaguuucauauuauaauaaaaaaucccaaacuuaauaaacccauaaaaacuuacuuucauacagcucuggaaagcagaauaccaaaaugggucucacuggacuagggaucugaacucagguccucaggcuugcuagcaagcacuuauucacugagccauuacccccagcccuggcaacauucuuuaacacagccuucaccucauucuuuguguguguguguguguggggggguaggugugagcuuuaaugaugagccauuucuucagccuucuuuaaaagagcccuacucaaagccacuauccuuaucuuuuugguuaacuuaaguggucucuacauuggccuucuagcuuccuccaaauuguuuccuauugcccauucaucacacaaacaagcagcuuucuuuucugaaauaccauuuccccuuuauuuuauuacuuauuaucuaguaagauaaucaaccccagaugcguucauauuuugggaagcccaguuuugacauguugggggggcagguuacaaacauaaaccuuuuauuucucuaguguuaccuccuugaaauccuccccuaaccucucauuacauugaaauucaaacucauagcagggucuuuuuuggagaugguuuaaaaacaaacuuuuuauuacauuuuauuuaguggggggggggcacauggguauguacauguggaggucagaggacaacuuguaggaguugguucucuuucuaucaugugggaccaggggacaaacucagaucaucaggccuguuaacaaguaucuuuacccacugagccauuucaccugcccuugauacacuuuucuugagacugcuucuuacucuguaguugaagaggaccuugaacuugugaucuuccugccuccaccucccccgaguacugagauuauaggcaugcacuacuugguucagguuuacaugguacuguggauuacacccagggcuucauggaugcuagcaagcacuucaccacacuccaggcccauuacuauaggcuucaaagagccaguccuuacacaccuuuuuaauuugucucaugccacuaucucuuggguauaguacuccagguacacuggccucucgacauuuuccacuucuuucuauagcuauaacuuccacuaaccauuuuguagcugaaauaguuggcauaaacaaggaacaauauauagcccauaucuaaguuuggaagccugauaaaacagaaaccaacauaccagcuccccaaguuaagauagguguaguuguaaucuuaguccuuaaagaccguuaaaguauuacaacuucaaacaacccuggguuguuuucuggucuuuuaaacacuuggaagacauuuacuuuaaaguuguuuaugaagauuuugauuuugauuuucuucguucuuuguguuuugaucaucgucacccuguuuccaauccuucucagacccaacccccuuucccugcccacccaacuuucuaugcuuuuaauuuuuuucacccaucaagucuaauuugugcugaaaacauauuauuugauuuguggccuucuacuggaaccuggucaacucaagagugggcuugcagagccuaguacacaccuuuaauccaggcaaaggcaggcaaacucugaauucauugccagccuuccgggucuacagagugaguuccaggacagcagggcuacacagagaaaucuugucuuaaagaaagaaagaaacaaacaaacaaacaaauaaauaaauaaaaagaguggguucuccccucccagcagcugucuauugccaacagcucuuucacuaggacugggggcucauacccccuuccuuuuugcaugcugggauacagucuggcucgagcuuacacagguuuaugcaugguaacaagauaucugugaauucagacaugcagcuuccccugguaugugcagaagacacuauuuuccuguauucauccaccaccccugacucuuacaucuuuccaccccuuguacaaugauuacugagacuugaaaaggggacgugauauagaggucccauuuaggggugagcauucugcagucuguuauucucugcuuacaagcacuuuaacuuaaagagugcaauagugagacuugcuuucagagaauuuuaacauggauuaacaaaggccaucagggauuccgggaauauugucugacguuagaccgaagcuugacuuagugugaugacagcagagcuugaagacacagauaaugaaacgucauaaaguaaaaucaagauauaaaacaucagaaaguaaaaccaggaucauagcuagugagauguuauaagagagaaagaaaugaagguaugguauagucaaggacaaugucagcauuaaagagccauucuaccucucguugcuccagauguauaaauuagaccuuguaucagaucccagggagcuggcagccauugaagcuagaagaaaucgugaaaaggaacgccaaagccgauucuucaaugugcggaaccgagucaugggggugaguggguaaugaguaacuguacaagacugagauuacuugccccuugugccuugaaaggaauguggcagugcauuauaacccuucuagacucaagcaugcccugggacuggaaaggcaggagcugggggaccaaccucauaugccuggacagggcuuaggaagagaggcaggacugugaagagagagaugaugggugacagcuagcucuccucuggucaguucuugcacuauagcugguucuuaagaaacaauguggagccauaauaggguguaaaaaaaauuugauacuacauaaaccuaggguauuucugcaaggcuaaauacgacauuguuauauuaguugcuuuucuuauuacugugauaaaauaccugacaaacacugggaagggagcguuuguuuuggcucaguuuaagcauauaguccauuauuggaggaaaagggcuggagguggcuggucaauuugcgcccacaguuagcaagcacagaggucagcucacuuucuccuuuguauucaguccaggacacuaguccaugguaugguacugcccacaauuagggcagguuugcccacuuaaaauagacauguccagagguuucucuccuaagaaacaaacaauuguagaccaggcuggccucaaacucagaaauccaccugucucugccucccaagugcuaggauuaaaggcaaaaaaaaaaaaaaaaaaaaaaaaggcaaaaaaaaaaaaaaaaaagagaaauaaacaauugccaggcagugguggcgcacaccuuuaaucccagcacuugggaggcagaggcagcagauuucugaguucaaggccagccugaucuacagagugaguuccaggacagccagggauacacagagaaacccugucuugaaaaaccgaaaaaaagaaaagaaaagaaaguaacaaacaauugcugaguggguggguagaaaaggaucuaggaaagacaccauacuuguguucaaagccaagucugcuauuagauauguauggcuuuugguacauaaccuaucuuuuccuccucuggaaaaugagaccaaauaaagcacugagauguuaacuuugaaaaaaaaucagagcuuauuaccugaccacaagcaaacugaaguuugaguagucugagauucugguugcaagaauuuccucagaaccuacucuggaccaagcauuaugguagacaguggggaauacagugauagcuaaggccuagcuucuuccccccaaacagcucacagccuaguggaagagauaauagagaggcuaaugucaauacaauauggccaguggacccuagauuaugaggguagaagcuuccugagcaagucuugaaggguaaacugaaauaugggaaaggguggaaugaaagacuguucuaaggggaggaaccaguuagagcaaaggcuugaaacagcuuaagaugugcagagaacuagaaguacaguuccuuacacuacugugagaggaggcagggaaaggggaacaaagagauaaaggcagagaagcaguggcuagaccacagagguauuuacaggcuucguucagggguuagaauuuuauccaguagguccugaagaguugcagggugacucugaagagggucauuccuaaacagcauccuuuagggcauucaguuuacaugcucagacccuacucuaacuuagcuccuuucuuugagauucagguggauguggaagcccucaacuaccagguggaggaacgaaaguuucgggaggcaauagagcgaaacaaagauaucgcuuaugguaaauacucaaggcugcagcaaaaccagaaagaguggccugaaguugggcaauucugccuccgcauagagcccgaggcucugaggggugauaaaacauacuagaugacccugggaagaggcuuggggguagagguugacugggcucuguucuaggugucuucaugucccugucaaucacacuuagguaccaagcaugcgcacuaugaucugguagcccagaugcuagagaaagaagaggcagaacgagcauaccggcuguccaagagaguacaggauuuucgggaacaaaggcagcagcaauacaagaauggacaugaauuugacuucugggauccagaccaauuccaggaguuucgggucccuuauuaugagaaggaugcauacuuuggcccagccagcaugcaguacuucuuuggagaggaccuggaaagggccucacacgugagaaugcagcaggaacagaugagauacaaccuggaaaaacagcuacaggagcaacaggcagccagagaagaggaggcccgagcagguaaguagcacagcagggaguugauccagucuggauccagcacugugugagaagguacuuuacccguacagcugaggcacaaaggucaggcuguacaagcccuaacuucccucacuccuuucuuggcacuucccugaggaaagcauuuuacaguucuacuuacuuucugcuuugggcaaaugaauguuccucucuauaauugcauuugucuucuuuucuucauuucaugagacagggucuugcuguuuauauucaaccuagucugggcuggaacucagcaauccuucuuccucagccucuagaauacugggguuucaggcacaugccaucuugacagcucaguuucuucauuuuaaaauagggauuauaaucugcaucacauagaauagcaacuauucuuaugauacagucuggccacaucuuucuuuuacacuagagaaaaccuuuccagggcaagagucaugucuuucuacucauuuugccuuccaaucaccagugucuuacagggccuaagaacaaagaagccaguguguggcuugaaggggggaaauuuuaguagcuuugcuuaugcuguggccaugacugacaugccauuuucuucuugaucucuguacuuugacuuuuauaguuguuauuguuauuguucuccuccucucccucuucucccuccuccuccuccucucccuccuccuccuccucuguuuucaucucuucaguuuuggugcuggggauggaauccaggacuuccuauaugcuaagcacaaacuccuacaacuaugugauuuccucagcacccaaaaccuuuaauaugcuuauaugcaucucugccauuggccuuaccagguuguagucucauuauuggaucggucucuccuaccagaggaggagguuugggguguguguguguguguguguguguguguguguguguguguaagguauuaagauuguuaacuugcuauguaaccaaggauaaccuugaaauucugauuuuccugccucugucucccaagagcuggaauuauaggcauacaccacuacacuggacuaggcagggaguugucugggauaguaucuaauucuaugguauccucagaacccaaaaaauaaccuuaagacugagacuuaaugaaaugacauuauuuacuuaaagcaacaccacugaauggugacagagcuucauugucacccaauuugcuacgcuuugcccaccccugaccccaaggaguacuccuuccuuaucacuauaacuuuagcauucaaauauaaacacacaaaguauguugaacaaauaacuacugcaugaaugggcacuagaauaggcaaguccaauacccugccuguauuucucuguguagcuuugcucagugaccaacugcgccuagcugcugacacgcgggcugcugaacuggcuaggcuggaggaauccugucgagcagcuaugaggacugcuauggccaaugccaacaaagcccagguauguccugaaccagccaguguacuuagcacaucccaauuccugaacaaaguccuaggggaccuuaguccuggggaaucuuucuccuuauaucccauuucaaaccagugcaagcauucuccucuacccaagccuuccaccuaagacccuaucaaagcacaagucccucccucccuaccccuagauagagggugcuuuaagaacagguauugaccuuucaucucugaucucucagcauaaggcuuuccuaagugcagagaaauucccuggcuauucugccuccaucaugcucauaggcucagucaaaauccaugcuacgucuuucucuucucucugggaugaguagggcuguaguuuuccaauccauucaagagaguuuccugaggcugggcccccaaauguuuacauuugggggucccuacuaggcagccaagcaagcccugcagcagcgccgugaacagcagcggcaacaggaggccaaccucacagaggucaagaaacaagucaccagugaccugcugacugagaauccucaaguugcccaaagagccaaugcuccucaccggguccugcccuauuguuggaaggggaugagugcagagcagagagcugccaucagaaaaacucaagaaacacaacgacaagaaaaaaaggaacagcgccaagccgaaaaguuaguggaagcugaguggggaaggcaaaacaaacggcuggcugaagcggcccuggaacuggaagaacaggagcgggaacugugugcagaguuccgaaggggacugggcuccuucaacagggagcuagcuaaggagcagcaagcucagugaguucuaggcugugccaauggggaggaagcccgggguaggugggaggaaugacgaggaccagagagagggaaaacgcagcaccugaggccuuuguauuuucacaggcaaaauuaucugaauucggucaucuacaccaaucaaccgacugcgcacuauuaccuacaguucaacaccagcagccgcugagcucaggauggucaccuuccuucucacagguggccaggagucaaaaaaaaugcaacaaauccucauuucuaauuucuacccaguaggagggaacuaaagccaaaccuccacugucuacucuagguaauaaagucguucgcuacauucaac

SEQ ID NO: 9786 - RNA, 42359 nt, Mus musculus
ggugggggggaggagacgcugacaaaccaagauggcgguggcagcggugaaaccugccgcgacugggacuuaacuguaguagugaaggcuucaguaguugggaggcagcgguaagguguggaagaaacggaacaggacuaagaaccuguaaaaggaaccucagccugagacuuuuagagcacggcacccgccccccuaagcccuugacgggcgguggccguccugcuuagggccuagacuccgagaaguaccucgguuucagacagcggcggcgccaugcguccuuaagggcgaccugagcccucccgaucucuggcccagcccucgggcccaccauggagcugggguccgacgauuuccuaccgccgccggaguguccgguguucgagccuagcugggccgaguuccgagacccucuuggcuacaucgcgaaaaucagacccaucgccgagaaguccggcauuugcaagauccgcccacccgcgguaaggcugggagcugauggucgccagcggcgaguuuguggguggauccggguagccaguggugaagucccgggcggagggcagcaggugugggaagaauaugggauggcugguauuuuguggaugccucacgaagcggaaaaagggugcuggggucagggcuccucguuuuguggcauacaagugaccuggggucugagacccacucccacucugcucuugagaauuucccuugauucaauacacagaugcuuaaugggcuggggagaguucgcagggaggcacagagacucccaucuuuuacuuuguaucacccuggucgaggcaguuacaaaguaacgacuacugucauuauucccuuuaaggcaagcugugugguguaguggaaagaucacgucucaaaagggagucagacgugaguuuaaaacuacuuagaagguuagcagcuguaugaccuugggcauguaaaguaaucccugagccugugaauugugugcugggaauaauuagauuaaaccagguaacauagugcacucugguaagugguaauuacugugacugugaaggugcuugauguggucauugguuugcuucuguguguguugacucauguuuacucacgcugucaggccaauucaucucugauaauauccuagccugguggccagucaggaaaucauucucacagggagugcucuuucuggcuccugcguuuucuaguugaagguaaugucagaaccuucuugcacaugguccccacagccuuccuauggagaaguuuagaccaguuagcuugguauggccuucucagaagaucuggauucuaccucaggcucagaauguagaugauccuauaagauaagguuuucuuggguccccaggaacaauaguggagauauggaaaucuuccuuugcuucccaaauguucagcaaaaaggaccauauuguugcuucuaguccugacuagcccaggggaaguuuuccaaaggcuaggacaggcugcugccuugcugacacacuggaggaaacaauggugaacaguguuuaguaaccacuugagauuccugggcugguuugaauuuauccgcaacaauguaucuucgaggaggugcuucuggauguggaagccuuauucccacuugacaagagcaucuuaggucuucuuauccaauucagugcuuuuguugcccuuucauaggcugguuuuagauggauccuccgggcccuagagucuagaguccuuguuggucacaggugucugaagauggguuucuguugugagggagucacagcuauuagugacaagccaggaaggcuagcagaagggaaagguuggacuccuggauggccuuauggaaauauuccuugacguggucaggagacgccuaauauggggauaauugaggucucaauuucccuuuuuucucccuugggcuuuugggcagguuggccuuauguaggugcucuuaccuugucuuggggaaccaggauggaagaaaugacaaggacaucgguguguguguccauccuuucguccaucuguucaucuguccaucuguccguuuguccccaggggacuguucuuugguaggcuucuuuucuccacuccaguagcuuugauucuuuccaguccugacuuuuguuuuuguuguucaugauuuuguguacgugcccacaauucucuuaaaccaccuuuaggcucuaaagcaguuggcuuucuucuguuuggaacuugaauuacucacccaagugauucuuaggcccaggaugcaaaccugugugugaguagguauuggaguuuuucuuagaggggugguuuuggguuuguguuucauagcauguggcugcuugcuacacuuggcauagauggauggaggacaggguaguuaaugguggcaucacacaacuucuugaauucgccauccuguuugucaccacauucgaaaugccaucaucuugagcauuuguacuaauacaggacugagaugagagguuuguuggaccuuccccaucuacuguugcaccuauagcuccugccuuaggacuucaaauuguuuagaacuuggcagagcagagaaaagcagugcuuagaguuugggguuugagcaccuuucugucuggguuaucugugcugaggggaguguugucugaugggagauaagaggguauggaaagcuucaccuggcuuaagccguagcauuuuagccuaagguuuguuuuuuuuuuuuuuuuuuuuuuuuuuuucaccccuccugcuuucgucagccucaagugcuuucugucuauuaccauggguuggggaagaaugugugcacuugcaaauaugaggccucugguuccuuuuuuuaagagaaagagccugcauacagagaucaacagcucuuucucucuuuuccuauaccuuuucuguccuuccauauguguucacuugugugugaaugcugguagcuuaguguaguagaaagaaccagcgaucagaggacauggguucuaguguuggcucugcugcuaacuagcauaggauuuccucuccuagccuuacuuuccacgucuguaaaaugaagacguugaucuagguuauuuuagggucuuuuuuuuuuaaccauuuuaaaauuuuuuuaaagauuuauuuauuuuauguauaugaguaguuguacugaugguugugagccaucaugugguugcugggaaugaaagcugcucacuccggauggggcuccggacuaccccacucacuccuggccuaaagauuuauuauuauuauacauaaguacacuguagcugucuucagacauaccagaagggggcgucagaucucauuauggaugguugugagccaucaugugcuugcugggauuugaacucaggaccuuuggaagagcagucagugcucuuacccgcugagccaucucaccaacccuuuuaccauuucuuaagcaccagagcuccaggggagagagaggacucucuggggaagcauucaugaggcugcagaaggggagucuucauagcuaucuuuuggguaggacagaaaaaacuccagcuuggcaggguaaagcuuucccugcuuucauuaauuuuuuccuggcuuccccucuguaaauucuugcauucguugccaccacuuuugggcuucccacucacucccagacuucuuuccccgccucuuacagcagacaaguauaugagagaggacccacaggaagccuuuccaaccuggggagugaguaagaggugcagauucaucuuccuuggucuucccugcagugucuucugugagccuuuaacugagaaaacaggcauugauggccuaaaguauuaaucccugccugaaccagagcugagcuacucugcauguguauucauugguggggucagauuuagagauuuagauuuagauuuuauuuagauuuagugaggaagccaaggcaagaauucauaugcccaccuuacagauaagaaaacagauucagaaagguaagagcucauagcuaguaagcaguagagcuacaauaugaacccacaucuccugucuccagguccugcaugguugccagaacucugggcuauguguccugcccagggaagggugacaaugugggugugaggaggguuugugguuaacugauuugagcuuuuuuuauuugucaaaauccuagcacuguacuguuggggaagacuuagaaguuuaccagggcauguacaugcggccuugaauaugggccugaggggcuuuuaugcccuguuauaagucuuagguagaguugggaguggguccauuuggaugcuucccagguugauagaucugagguggcuagaaguuuuaggagguauuaauggauuauggcgcugcuuuugaugcugucugaucuugcauuaaaguaggauaacccaaguuccuuuccccuuuuuuuucuccuaggacuggcagccacccuuugccguggaaguggauaacuucagguuuacuccccgaauccagagguugaaugagcuggaggugagauuagcagcuggugaugggauuuggagaaaggauaagcgugccuaggacguagaagcagcuucggagcuccagauauaagggcaggaauucgcguuuuuuauuugauagcccaaaggcugggaaugcucuuuuccccauaaaacuuuguuauuuaagaguuuucccuauuaguaccuacguuaccuggaucagcaaaagguagcugagaccuuccuuccuugaccagcuuauuguggccuuauauaucuuauauaucugauuuauccauggcucugugcuucuuacauuccuucuuucauacuugguagaguggaugguaagguaaaagagcacaggaacuggucuuuguagaggcuggaaugguuaguguguguguguguguguguguguauacauacauacauacacacacacacacacacacacacacacacacacacuagaugcuggaaugauauauauauauauauuacgguacugguauucaucugggcccaguacucuacuagaauauuuaauaagacucaaagguacauauuaauaggaauuaauuaauuagugggaagggaacauacauuuaacuuguaucuucuaugaaaaauucuagaacuauaccuaaaaccagcuuuaggauauccacucuuaucaucccaggacagucucaagccugauauuguucaagucagaacaagaguaauguguuguaugugguaugaguuccuuggagaaauaaauguaacuaggucugugggugguacaucugugggcagguauuaccuagcaccgaacaagggcagucuuacagagauuucuugcuaguuaaugaggggaggaaggagcagggaugaggccaaguuuagaaagauaagggguucagauggaagguguuugccccuuaaggauuuuuacagccaaggggcuuuaguuuauuucuuaccuuaauucuucucaacuaagacucaaaaaacugaccuacauguaaccugguucucuagacugggacucaagugauaaaguuacagacuuaggaccuuugagaacccuucuuaggccacuugagauuucaguuaagcauggacagccuuauucuaggaucuuucauccauaucaggucuugaguuagccaguaugucauuuuaguucuucaggccauucucauaauucagccaccacaaaauauuuugugugguacaaaaggagaugaauaugcuuuucuggagcccuauguagaacuuagauacaauucugaaguuucuaggugguccucacugcucuucuuaauucuguaucucugggguaagugugcuauuuuccuuuuccuauuguuuguuuugagacagugucucgaguaacccaggcaggccucaaaucucauauguaauggaggcuagacuugaacucaucuuccugccucuacuuuucaaauggugggauuuacgggugugagcuaccaugccuggcacuuauuuucuaauaaaaauauggggaugcagugagugguacucauuugcucaaaugcagcaaaucaguaguagcagagagaaagcaaagcuuagagguauuugauauacauguaucuuggggcuugugugaauuaacucuuuuggcccugauuuuucaucuguacaagauauaauaauauauagacaaccuugucacaagaaugggaggaaagauauauaaagacuguaaugaccuucaccugggaaacgagagaaaagcaaggccaaggacugucuagaguacaaaucucauuucauugggagaagucuacuuuguucccuuucucuuccccuaaguuuuagccagaagaugggucacuguggaguguuggggggagggguggggugggauggaguauugaugguaaugggugggugguggccaguguuuuugagccauuucuccuuuaggcccagacaagagugaaacugaacuauuuggaccagauugccaaauucugggagauccagggcucauccuuaaagauucccaauguagaacggcggaucuuggaccucuauagccucagcaaaguaagaacagguuuuucucaaauauucaauaaacccaugcuacuuuaggaccccuuuugcuuuggauaccgugucucugggcuauaauggaagggguagacugguagcacaucagcguguuuuaccaccucuugcagcaguuugagauugggagaagggguagcuccuggugaagugagaggcugcaguuguuuuccuuacccuuccuguaggccuaccuucugcauggucacauacacagugcaucaugucccuuccugcucuuccuuucagauugugguggaagaaggugguuaugaaacuaucugcaaggaccgucgaugggcccguguggcccagcgucucaacuacccaccuggcaaaaacauugguuccuugcuacgcucucacuaugaacgcauuguuuaucccuaugaaauguaccagucuggagccaaccuugugguaaggaugccaggcaguaguggaguuaaggaggucuugaucugcggguacauauuggcauacuucuguuuuuguuucuuuuuauuuuuuuaauuugacaugaggucuuaauaucugacaggcuggccuagaaguuaccauguaguuagcccacugaccauguagcucagacuggacuuaaaacuccuuuuuggugagaagucuggacgugauuucguuauuuggaauuuauuauaguccuucaguuccccaaguacgggauuucagcuaccauguccuguugucuuagauucucuuuuauuuucuuuugaguccgaguccuauagcacuggcuggucucaaacuuuguagguaaagacaagcuugaaacaaacaaacaaaaaaaagccaggcggugguggugcacgccuuuaaucccagcacuugggaugcagagcagguggauuucugaguucgaggccagccuggucuacaaagugaguuccaggacagccagggcuauacagagaaacccugucucaaaaaaaaaaaaaacaaaaagaccagcuugaacuccugguccuccuuucacuucccaggucacagauuagaggcauguaucaccaugcugaguuugcccacguuaggcaaauacuaacgggagcuguauccccaggucccuaccuugaacuuuauacauuacauuuauugugagugcaucaauguauguggagguaagaggauaacuuagagaacuuuguucucuuuuuccaccaugugggucccugagccauguugcuggucccuuggccuugaacccuugauccucuuuaucucagcugcugcuuuuuuuuuuuuuuuaggauuuuauuuauuuuauguauaugagugcacuguagcuguacugaugguugugagccaucuugugguugcugggaauuugaauucaggaccucugcucacucucauuggcccagcucgcucuagcccugcucacuccagccuaaagauuuauuguaucuaaguacacuguagcuaucuucagaaguaccagaagagggcaucagaucucauuacggaugguugugagccaccaugugguugcugggaauugaacucaggacuucuagaacagcagucagugcucuuaacugccaagccaucucuccagcccuuucucagcuucuuaagugcugggacuauucuauugauugauugauugauuguaugugaguacacuguagcugagccaucucuccagccugggacuauucuuaauaggauugguuccauggauuggaaacugagaaaacuagaccuuaccuuuuccuagugauacuuucuuaucuucugauaguaucuguagucaaaaguccuaucuguagaacccuggguucaguuccagcacacacuccuccccuaccagagggggugggaggagaaaagaagaaaaggccucauuagugguaggcaaaugacucauuggguuaaugugcuugcuuccaagcuugaugaccugauuuugaccuggaaugcacaugguggagggagagaacuggcucucagggguuguccugugaucuuugcaugcccacuguggcaugaaugccauacugccacacacaucacacacaucacauacacacacaaaguaaauguuuuuaaaaaaaaggaaaaaaaggaauuaaaaaaacgaauuccuaaaguuuguaaggugucagcaauaaagaccgguugaacugggauuacugguguuggucagggauaugggccacaacuuuguccauuggccaaaggaagauuuuacuuugggggcugagguucugugcccugggccuuacucuuuacuuauuaucucuagcaguguaacacacgcccauuugauaaugaggaaaaggacaaggaauauaaaccccacagcaucccccuucgacagucugugcagccuuccaaguucaacaguuauggacgacgggcaaagagacuacagccugaugugaguucuuuucuucuugccacuuacaggggcuuugggguggaaagaaucaugcuuguugacugaaaccuuguauaacauuguugcacuucuuuugugccuuaagcauuagcaugcccuuucugggcuuuuuugaucauuucucuacucaguuuaguuggagagcuguuugaacuauacuuuuuguaucugaccugugugacugguuugcuccuuucuucagacaaucugcucauagaacaaauguccuuuuucuuuuuuucuuuucucuuuuugagauaggguuucucgguauaacucuggcaguauuuguacuuggcucuguagaccaggcuggccuugaacucagagauuuaccugccucugccucccaaaaccuaggauuaaagguuugcaccccccccccagcaauaauguuacucuauuuaauguuuuuaauugaaauagacuuaauuacauaauuuccuuccuccaucuacucccauuuacucucccucaaaucccucauauguguguauguggauguauguauguauauguauguguauguacauauauauguguauauauauguguguguguguguacauauacacacagcaaucaguauuugccuguaguucuuuguuuaggaaugagaccucaugaaauccccucccaccucuauauuaacauuuucacugauaauacuauuguuccuaucuuaucuaugcagccauuuuuaggagagacuuucacagcagacuucuugguguucuggcucuuagaaucuuuucauuuuccuccaugauauucccugagccauagacggaaaagcuaugaugcagauuuagucacuggggcugggcuccacaggauccauugaucucucugcauuauguccaguugugguuuucugugauaguuuccauuugcuguaaagggcggcuucuuucauuaggaaugguagcuauauuuauucaggaaagguggcucaaacaccacuuuacuucuguauauuaucccuaagcuauaagguagaaguuaauauuuuuauuuaugguugguaaaacugagauucugccuuuaauuccuuuucauuuuuuuaaagauuuauuuauuauuauauguaaguacacuguagcugucuucagacacuccagaagagggcgccagaucucauuacagaugguugcuuucucuggccucgcucgcacuggcccugcuccuuucggcccuucuuuucuucccuuuccuuuccuuuccuuuccuuuccuuuccuuuccuuuccuuuccuuuucuuuucuuuucuuuucuuuucuuucuuuuuaaaaugcuuuaaaaacuucuuucuuagccggguggugguggcucacgccuuuaaucccagcacuugagaggcagaggcaggcggauuucugaguuugaggccagccuggucuacagagugaguuccaggacagccagggauauacagagaaacccugucucaaaaaaaacaacaaaacaacaaaaaaaccacccuucuuuauuuuuagaguuuuacaaaauuuuauguauauggguguuuacuuucauguauguuuauguacaugugugugccuggugcccauggaugccagaacaggguguuggauuuccuggaacuggaguuacuguugauugugagaugccauguggaugcugggaauugaaccuggguccuggaagaacagcucacagugcccuuaaccacugagucaucucuccagccccuagacguauaguuuuuaauucuguguaugccauguguuuuuguggagaaguaugagcaugugaguaaauuacccagagaggccagaaagagucugauucuuuggagcuggaguuauagguaauugugagcugcuuguggguacucuuuaacaauucagccaucucucuuaagauuuauuuauuauuauacauaaguacacuguagcugccuuuagauacaccagaagagggcaucagaucucguuacagauggugagccaccaugugguugcugggaauugaacucaggaccuuccgaaggcagucagugcuuuuaaccgcugagccaucucuccagccccacuccugaaauuuuuauaguuauuuauuugaaaauuucauguuuguuuaaaguguaucuugaucauauacacccuucaccaccaccaccccuuacuuccuccuggauccucuaauuauaucucccaacuucaugucuuuuuaaaauauuuuuuaguuaaguaaaguuuuuuaauguacugaguuuaguuuguguugcucaucauacauggguguguggucauccaccagggcaugaggaaccuaccaguggccacuccuugcccuggcaacugucagcuacucaaagcuccucaccuagagaaggaaccuuaggaaccccuaauuuuuuuauugucauuauuagauuuauugugugaguguguauaucugugguuuugcuuugauaagcagguacuagagaacaauuuacuagaguugauucuucccuucuaccaccugggucccagggacucagcucagguugucaggcuugaugacuuagccugcugagucaucuuggugggcuugaguucuuggcaugaacauauauauauuuauuuauucauauucugagcuuuucuuuuaggauuggguagucugcuccaaauaguaaucuugacucauuuuuuuccuacuuucuuuguagccggaacccacagaggaagacauugaaaagaauccagaacugaagaaauuacagauauauggagcaggccccaagaugauggggcugggccuaauggccaaagauaagacucugcggaaaaaaggugaugucuaagauacuagagguggcuucauacagaggcagaaggcaggaggcaggacuguaaauguuucagauugaaauuuagaaccacuuuuuucuccuacagauaaagaagggccugaguguccccccacuguggugguaaaggaggaauuagguggggaugucaagauggaaucaaccucacccaagaccuuccuagaaggcaaggaggaacugagucauagcccugagcccugcaccaagaugaccaugaggcuucgaaggaaccacagcaaugcccaguuuguaaggacccagcccugacuuccuagagcucugcuucucaucccuucagugagcauuucuccagcauggcacuggacuaggcugcauuaaguaguaaaguggaucuagagggcccugccuacaggcaacacuuaauuggggaagacaaggucagcuaauuuggaacaaaaaccaaaacagaguaaauagcuacuguucacauaaagugcuaggaggaaaauccuauuguccagugcuucaggauaaaggcuaagaucuucauuaucuucauuauuguacaugauccagucccggcugaccucuaaccucauuguccaccacugccuaccucacuuuucagcuauugcuguucugaauuacuuguagguauauucuuuuuuuuuuuuuucugauguaccaguaugucuuucauagucuuacauuccuuguacauaugguuuuuuuucugccucaaagaauuggucuuugugcucugcuccaauugccaaauaccagcaugcuuucaaguuucuguuauuccaaguguccccuucagaauggaguacuuccuugcaguccucccucaucuccaaguaacacgagugcugcuuccuuugcuggauacccaaaguauuucuuaugggcugcuauggcuguuuucaguuguuaugaauagaguacugugugccucuugaaggcagauacuagauuuuccucaucucugccauagaacacuauuuauugaaugaauaaaacugagaagacugaagacuaauaaagacuucucauaucuguauuuaucuggggaagugguacaugcauucaacugaacuccaggccuugaaagacuagccuauuuagggccaugaacaacccagcaaacaccucuggcuucuaacagagcucucuggaacgggauauugucuggaggggccugguguuugaagacugggaagggucuauauucauaacccuuugcuuuucucuggcagauugagucauacguaugccgaauguguucccgaggagaugaagaugacaaacucuuacugugugauggcugugaugacaauuaccacaucuuuugccugcugccuccuuugccugaaaucccgaaaggugucuggagguguccaaagugugucauggcgguaaggccuucccagucccaguucacaugggauaucuuugccugccuuuguauagucuuaaggggagccuucugccucagcuauaguauuacuguguuuugggaccucaaguucugcagagcuuugugagaaaaagaggauguaauuuaugcuccuauccucugggagcucccagacuaucuaugggguauuacauuuagauggacugugugugauggugaacuaugugugcugacauguaagcagauauuaaaauugauguuagaaacccugaguugagccuggucuacaaagugaguucuaggacagccagggcuauacagagaaacccugucucgaaaaaacaaaacaaaaaacaaaaaacaaaaaaaaaaaacaaaaaaaaaaagaaaagaaaagaaacccugaguuguaguugaacagauagaaaagguggguuuguugguugguuaguugguuugguuuguuuaguugugauagggucuuauucuguagcaccggcuagccucaaaauucaguccuucuuccucagccugccagaggauuaugaguaugagccaccauggccaggauaauuaaagguagugaguaagaaugagcuuuaaaugauaggauuaacuagcuauagauagagcaucuuucuguuuauuaaacuuagggauuugagcaugcuaaagaaguguucucuaccacugagcuggaucuccaggcugugguuuuuauuauuguuucaaauucacuuuguggcccagguagguuuuacguuuggagccccccucagccuucaaaguaacuggaacuguaggccugcaccaucaguccuggcuagaaauaaaaaccuuuuaaaugcucuuuugacucccaaauauuuucuuuuuucugucuuacauauaauuaucuuuaagacgcuuuaaaaaaaaaucuuguucuauaguuuauaaaaaccucuagggcuggagagauggcucaucguuuaagagcacugacugcucuuccagagguucugaguucuauuccuagaaaccacaugguggcucccaagcaucuguaaugagaucugaugcccucuucugauguaucagaagagaguuacaguguccucaucauauauaaaauaaagaaaaucuuuauaaagacuucuaacuucauacuucuguauuaaaugaauugaagauaggaaauuuuaucaaaugaauauaaugauuacuugcuuuccucuuauuaugguauuuagauuugguucauuuuccagguagggaaacaggauuuuguaggaacagagguauucaggagaaaauuugccuagagcagguagguguaguguaguaaggaggagccacaauagcagcagugaggagggccagguaccuaacaucuagggcuacaggugguugugagcacuauguggguguugggaacugaaccuggcucuucugcaagagcaacaagugcucugaacugagcuaucucugcagccccugagagaaacaauuuaaaggaaaaaagaucuuggcucacaguuguagagguuucagcccauuaugauggggaggugcuuauggcuccacucacauuauuauagguagaaaucagaaagacaaagacaguguacggcugggcaaagauacugccuccaaggaacucaacguacaaccuacuuucuacaacuaggccccaccuccagaacacuauagaacauuccaaaauagcacuaccaucuugggacaaagucuuuaauaggugaacuuuuugggaaggacacuucaaacccuaacagugagcagaaguaugagagaaaugccuguggcaugaauacaugugaugagcuagcucaugugggaggaaggaaaagauagagcugcaaagcaaggcuuucccuaggauccuggaaggcugagugagagcaauucucccucccucccucccucccuccuucugucucauguuucaguuccacuugagaugauuugcucuuugccucuauuuuuaugauuuguucucguuuggguuacaggaguguaagcggcccccugaagccuuuggcuuugagcaagcuacccgggaauauacucugcagagcuuuggagagauggcugacuccuuuaaagcugacuacuucaacaugccugugcauguaggugaugcagggcugggguagugcugagacuagguucauaggcacugguacuguaccucccuaaauuaauguugacaggauaagaugucauuuacuauccuguucccccagaugguacccacagaacuuguagagaaggaguuuuggcggcuggugaauagcaucgaggaagacguaacuguggaguauggggcugacauccauuccaaagaauuuggcagcgguuucccugucagugacaguaagcggcaccuaaccccagaggaggaggugagugggugauucucaugguuauaugucauguuacaugagcuugggcaaguuauuuaguaucugaaagacaucaaaaucccuuuugaugccugccucagguaguuacuuugaaguguagaugaacugcuauagaguaaagaacacagccuagguaguaucuggaaugugcauggaugagaugcuguuuuaaaaauucuucuugccaggugugguggcacacgccauuaaucccagcacucgggaggcagaggcaggcggauuucugaguucgaggccagccuggucuacaaagugaguuccaggacagccagggcuauacagagaaacccugucuugaaaaaaaaaaauucuucucucauacauuacaucccaaccacuguuucaccuccuuccagccuccucaccucguguuuucucucccccauauccacuccucuucagaaaaagaacaggccucccaaggauauuaacugacccucugaaccuguuuccuuauguguaauauggugauauuccuaccuuuauucuuuuuucuaguuguuuuauuuugguuuuugguuuuguuuuucaagacaaacaggguuuggggggggcgguguagcucuggcuguccuugaacucacuuuauagauuagucugcccucgaacucagagaccucuugccucugccucccaagugcuuggguuaaaggcaugugccaccaccacacagccugcaaauuuguuguaagaaugaugugagaaguagguaaagugcccuaaggagugcugggucuuuucauauguguucuguaaggaggauuggcauguacagggagaauugagaguccaggcuuaacugaaugcaaaaaaugcauuuggguucagauuuuugcuuauuuuguuuuuguuucuggcuuguuagguuuuaauuugaacuuuugaaaaauugauguauaaaaauauugaaauucuacauaauggggcuggaaagauggcugcuuuugcagaagacccaaauuugauccaagcacccacauugggcagcucacuacuggcuguaacucuagcuccaggggauccaacaacauauuuuucuggccuguauguguacuuagguagaacacaugcacacacuuaguuaaaacuaaaaauuaaucucaagaaauaaauuacuuguauuuauaggauaccaugugauguuucuaaaacauaacuacauugugugagccagugcauauucugaaacauuuuuuauugugaaaacauucaaaaucuuuucauaaagcuuuuuaaaguauauaguacauaauuuuaucuagucgucccucugugcaauaauagauaaggauguccugcuucugucuagcuuuaacuuaguauucauuaaucaaucuuuucaugaaucucucuccccuugugcucuccugcuucuaagaaccaacuuuuuacuuuaaauaucaaagaaaucaacuuuuuuauauuccacauugggcugagaucacauggcacuggcccuuccugugccuggguuauuucacuuaauguaguggucaccaguuccaucugugaugucacaaauaauaugauuuuauccuuuuuaauggcugaauagcauuccaguguguauauuauauaugacauuuucuuuaauuuagacaucuuaggcagguuuucuuuuucuuggcuguuuuguaaauaguguuacaguaaacaugggagugcagauaucuuuucaaaaugccaauuuuguuuccuuugguuauagaaccuguaguagaauugcuacaucauaugguaguuuuauuuucaaagguuugaagaacuucccuguguuuacuacacuauuuggggcuucccacaucauugcuaguguuuaugaucauuuugcuauacuggagacugaacccagggcuuugugcaugcuaggcaaguacucuaccaccugcuuucaucccuugucugucugucucuuuuucuuuuuuuuuuuuuuaauuuaccaaaacuuuaauguacaaaacuuauaaguaaaaaucaucacauaaaacuguuuuuguuuuuugauuaaaguuuuuguuuuuguuuugagacaagguuuuucucuguguagucuuggcuguucuggaauuuacccugaaaccaggcuagccacaaacucagggaccuggcugccuuugcugccuuugccucccaaguguuagaaauaaaggugugcgccaccaugcccagcaauaaaagucauccuuacugaagccggcugauaguguuucuuuaaggauuaauuauauugaacauuuuucauauacuugcuugcuguuuauaugucaucauuuuaacuauuauugaaucuuucaauuguugguaacuguuuaucuacuauauuuuaaaucugauuuuaucuguuuuuuuuuuuuguuguuguuguuguuguugaauuuuuuugaggugguuuuuuuuuuuuuuuuuuuuuuuuuuacauuuuuaaacugugguuguuaaugucuuguuaggcaaauaguuugcaaauacuuauucaguauauugucuuuuugcuaguguguguguguguguguguguguguguuacucuuuuugaguuuuggcuucaugauuuuuuucuccuuugaaaccaggucuugcuauguagcccuggccugggcuccuguuaaacuuguauggcagucuuucuuuuuccucagccuucugagugcugggaugccaagcacguauaacuagcuugcuauuuuguuuccuuugcuaugcagagcuuuuuaguuuguuacaauagcauuuaucuuguuuuguuguuucuugugguuuucaaguuuuguauaagaaauuguugcccauuucaguguccugagauaauaagauaaauguucaauuuaucucauaaauucauaguuagaucuuuuucauucucucucucuccuuucuccucucuccucucucucucucucucucucucucucucucucucucuuuuccugaaacucacuauguagaccaggcugaccuuaaauucagagaucugucugcuucuuccuccugagugcuggaauuaaagguguaugccaucacugccuagcuguaguuuuaagacuuacacuuaagggcuggugagauggcucagcagguaagagcacugacugcucuuccaaaggucaauaguuaaaccacaugguggcgcacaaccauccguaacgagaucugacgcccuuuucuggagugucugaagucagcuacaguguacuuacauauuaauaaauaaauaaaucaaaaaaagaaaaagaaagaaaaaagacuuacacuuaaguuuucaucuguuuauaguuuacuuuuauuacugaguauggaucuauuuuuauucuuuugcauauagcuacaucaauuuauguagcauuauuuauuagaaagacuauccuuuguuuauuugcuaaauuguuuuggugagauggggcuucacuuuauauccuuggcuagccuagaacccacuauguagaccagacugaguuugaauucacagucuguguuugcuuccugaaugcugggauuaaaggcauguauugcugcauacaguuucauuauuuuuugacaaaagcuauuucaguguagaccagacuagccucaaauuugugaacuuccugucucaaccucccaauugcuaacauuaacugguauguacuacuucaaguuccuaggacuuguugaaaaccaguuugcagagcaggccuuaugguagauacauauacauaaucuuuaugaaauuaaagugaauugaauugaaaauuccugugugugcauuggggugggggggagcagagaagacucaaacguuguuugguaugaugcccauauuaagagucccuguacgaaagcaaauaacuaaguucuuguugagugugaucauucaacaucuguaaucucagccuucaagaggcucagguggcuuacugugacauugauguuggccugaucuacagaaugagguuuugucuuaaaccaaaaaaaaaaugaggcuaaagagauggcuuaauugguaaaguggcuguucuguaagcacgaggguccaaauuuggaucccuagaaaccaaauaaaagccagguguaguaauagcuugccucuuuaaccacuagcugagggaaggcaggcagagccaguuuuggcaacugcugaacuuugggggucagugauaggcccucucucaauaacauucucaauaacauagagaaugauagaggaagauaccugauguugaccucuggccuccacauguauauucacacuuguguacccacacaaacauacacugaaaauauacuacacacacauacacacacacacacacaagaaaauguaaaaaaaaaaaugcugggcuugguaguuuucaccuaugauuccccagcuacucaggagguugaggcaagaggaucauaagcucaaggccugcuaggguaacuuagugagacugugucucaaaguagaaggaacucagguuacagugauagaacgaacauuugccuagcauuugugagcccagaguucaauccucaguccuggggcagaaacucaguuccuuagcauaauccucauccuucuguacaaacacuugaccugacaggaguaugcuacaagugguuggaaccugaaugugaugccuguauuggagcagucuguacugugccacaucaaugcagauauaucuggcaugaagguaccguggcuguaugugggaauggucuucucagccuuuugcuggcauauugaagaucacuggaguuacucuauuaacuaccuccacuggugaguggggcuauggcaagcuggggagguagucagggugaucucccuacauaacuaugcacaugaccauucuguguccucuaacgugaacaggggugagccaaaaaccugguauggagucccaucgcuugcagcggaacacuuggaagaagugaugaagaagcugacaccugagcuuuuugauagccagccugaucuccuucaccaacucgucacccucaugaauccuaacacgcucaugucccauggugugccggugagugcccagaaaccauaggaagguauaggaaugauguacugaugacuuuuaugcuagcaauuguagucuucacuugugguuuaucccugcuuucucuuauuccucuucugccuugaugggacuguuuugaggucugugaucaucgugguugguuagauaugcaaugugauagugaguucuuuccauggguuugagggauacuuuaggcuaccuuagggauagcuuguuaucaucucuagguucuagcuaguaaaaaagggaauggagagaggacagguuuagaaagucuuuuugccaggcacugguugcgcacgccuuuaaucccagcacucgagaggcagaggcagguggauuucugagcucgaggccagccuggucuacagaaugaguuccaggacagccagggcuacacagagaaacccugucucgaaaaaccaaaaaagaaagucuuuuugcuuuucuuuuuaauuauauauauuuuuguguguaugugugugccuauguuucuguauaugcaccacguguguucugugcccauggaggccagagaauaaggguguuaaaucuccuagaauagaaguuauaggugguuaugagccacuaugugaguguugagaaccaaacucuucaagaguagcaaauucucuuauccgcugagccaucuccccagccuguccucuuuaguaucucugggcucuuuggauuagcaguauauagucuaauccaaaucaccugugauuuuuguuuuaacuuggcaggcuacaauuuuguguggugauuuuuuuuuuuuuuuuuuuuuuguaaauuuuguacaauaaaguuuugguaaucuaauaaauuuuuuuuaaaaaaaguuuugguaaauuaaaaaaagaaaaagagacagacagacaagggaugaaagcaggugguagaguacuugccuaacaugcacaaagcccuggguucagucuccaguauagcaaaaugaucauaaacacuagcaaugaugugggaagccccaaauaguguaguaaacacagggaaguucuucaaaccuuugaaaauaaaacuaccauaugauguagcaauccuuuuuuuuaauuauuuuuuuuaagauuuauuuauuguauguuaguacacuguugcuaucuucagacacaccagaagaggacaucagaucccauuacagaugguugugagccaccaugugguugcugggaauugaacucgggaccucuggaagagcagucuguguuaacugcugagccaucucuccagcccaugauguagcaauucuacuacagguucuauaaccaaaggaaacaaaauuggcauuuugaaaagauaucugcacucccauguuuauuguaacacuauuuacaaaacagccaagaaaagaaaaccugccuaagaugucuaaauuaaagaaaauguaauauauaauauacacacuggaaugcuauucagaaauuaaaaaggauaaaaucauauuauuugugacaucacagauggaacuggugagcacuacauuaaagcuuuguuuaagucuuuguaccaugucaugugugucacccaaccccaacauacacacuucccuuccuuugggaaaggucauuuauuuuuaaaaagcauaucuccuuucccaaaaauggaaaauugaucauucccuauuccaacuauccuaaacauauguuauauuuccguggugauuuuuuuuuuaugucaaguuugauauaucaguaaaacugugaauuuauaauuucuuguauguauuucuagcuuaauacccauuagucacauguggccaccaagcauuucagaugugucuagucccauaucaaauguacugagaguauaaaauggauguuguaauucaagauuuaguacuaauguaaaguauagaguaucucaugaauacuuuuguuuacuaccuaaauaccgagacaacaauauucuggcuuuguuaaguaaaauacacuaaaauuauuuuauguuuuuuucaaacuuguuuauuuauauauauuuuuuuaauguggcuacuaaagaauuuuaaaauagccaggcaugauguuaugugccuuauaacaugaacuguuugagaagcugagucaagaguucaaugccuguagcucagcagaacauuugucuagcauucacaagggccuguguucaguaucugugcucuagcaguaccaggcaaggaaagaaacuuuuuccaaguaccuuugugcuuagaaauauacuugguauauuucucuugacagugcuggucuauaacuacuauuguauuuuuuaaaaacaacuuuauugcaguaugaccuguauuguguaaaauucauccauuuuaaguguauaaccuagauguccuuagagauguuugcuguugucacuguaauucaguuuuaaaacauuuuugccaccccagaaaaaccccuuauucacagucauucuccauucuauccuauaggacuaggugacuguuuaauuuucugguucuauauuugccuuccuugcuuguucauacaaguagaauacuguuuggucuuuuguggggggcuucucucagugggucuuagagaccugaguuugaacuccaggguccauguagugaaagaaccauauuucucauuuuuaauagcuguaaaauagaaugacuacuucuuguuguuuguuuuguuauugaguuacuguuucacuguguaaccuaggccagccuuaaacuuguuagguaguucagccugacaucaaacuugugauucuccuacauuagccuuccagaugcugggauugucgaaauguaccugcaaauguaucuggauagggguguuuuuuuuaaaguaccaugaaacgaacagaaaaguaacacuggcaaaauaagcuuaagaggaaauuaggaacauucuuuuccuggucugcuagcugaggcuucucuggaacuugguuuuuacaucuaugaaauuauaaaauagauauugcuaaaguacuuucuguguauaaaaccacuggucaccacccugaaggucaauaaaacaauuccugccuugggugugugcccauaaguggaagaaagagaacaguaaacaauuaaaauaaguugggagacaccauagaacagcagagugggccuuuuaggauuugcguuaucuggaccagguuuuuaaaaguauuuauauauuuaauuuguuucuuuaaauaagaaguuucacaaaguuuuagaaggugaacauuuggggcuauccauuucacaguccuauuuaaaagaguaagaauuuaccugcuaaacuuuaucuauguaaucaugaaauuuauucuagaggcuuugggugaggcgugccauagaggaguuguuguuguuauuauuuacaaaacauuucuggugauugguggaagccauagcaauaauaaaagcaagaaguguuuugaggcugacuuuauuuaagaagaaaaugugauggugauacaucaucaauaggaagauuuauauuagauauugauaugcuucaaauuuuucuggaauuguagcagauuuacugagcugaaacaaaccagguucuugauguguauuagcagguuagugagauggcuauauagucaaagaucauggcuuuaaccucucgcaccaaguaaauaaauaauaauaaagaaagaaagaaagaaagaaagaaaauguacuuuucagggagaauuuaauucuuaaaccuggcauuuauccuuucacuacguauuaaauguucauuuuaaaacauuuugugaaacuucuugguuaaagaaacaaauuaaacauguaaauggcuacuucuacuccuuauugagacccaguaaaaugacaaaaagugauuugaaaaagauaaaucauaaagauggaaaaaacaggacagaaugauaaaauccuuuuuuuuaaauugacguuaaaaacaguauuuuuaccuuugugccugaguguuuuuccugcauguauuuauguguacuauguguaugccugugcgugaggaagucagaaaguaucagaucccagcacugacuauaguuacagaugguuagcagccaccauggagguacuaggaaucaaaucggaguuuucuauaagaauaacaaguguuaaccauugagccaucuuuccagccccaacaauaaaagucuuaacccuaaaacggagacacuacaauucagucugguuuuuaagaaauuagauuuauuuuacuuuuguguauaugugaguacguguguaugagcauguacauggugggggugcaggagagcugcccuuggaggccaauagaugauuaauccccugauccuggaauaacaggaggcuguaagcugccagauguggguacuggaaacccaacucaagucuuuucuagagcaacaaguauuauuaaccacugagccauuucuccagccccaaucaauugaaucuugagccccuacugagaaaauaagagccaacaugauuuaauacuuuaugaucacuuaagggcuguacucagcaguaccuggcauucuggagguaauaguggaugauuucauguccauaaaagaaacugaguuuccaucauuuuauuugauaugugacaucaccucacauauuucugaagacuuauuucugaaaaaauuagaacagaggauugagaucuccaugguauagcuaguauaguuaaaggugguuuuacucuaaucaggguaaaaacaggauucaucuuuguguacauaauggauccuggccacuuuccucauuugccuauuaguuuguugacaacugggucguuuccugcagacagaaaguaugaguauuuuuuagaagggaaggggaauuugagaaucuugacugguguaagaagaaaacagcucagaauuucccagaucauucugcagugaagcucacaaguugauaaaugucaccuauguacuuuuuggaguggagcuuucauucagcuuuuuuuguuguuguuuuuuguuucuuaagaauaaguagggaggggcuggagagauggcucaguggauaagagugcugacugcucuuccaaagguccuaaguuccaaucccagcaaccacauuguggcucacaaccauccguaccauucggacaucuggaguguccgaagacagcuacaauuuacuuacauauaaugaauaaauaagucucuuaaaaaaaaagaaaaagagcuaaacucaggucuucuuuaaaaaagaaaacaggggcuggagagauggcucaacaguuaagagcacugacugcucuuccaaagguccugaguuccaaucccagcaaccacaugguggcuuacaaccaucuguaaugagaccugacgcccucuuuugguguguuugaagacagcuacgguguacuuacauauaauaaauaaauaaauaaauaaauaaaucuuuaaaaaagaaaaaagaaaaaaacaaaaaaaacaagagaauaaguagggaauccuagacuaucagguaaucaaaaugaaacaaacaaaaaaccuaagaaaaaaauagaaccaaauaguaagaaagcaacuuggagaaauuggcuugccaggaaggaauaaacuuuaaaaggaaaacagacucuacuaacaugaucaaauauucauuauuuugcuuucauagauccauggucaacugcagcccaaagauacucaguaagaaauuccagaauugaacaauugcuuuaaaauuauauuucuuuuuuuuguauaaggucgugagaucuaauguuacuguacucuguccuaaggcccuaccugagguaugaaucuguccguugcgccaugcccuagaugcuacccauauuguuagucacugagucugucuugguuaguugacugccaagguaugguagugcuugcuuucaaacaacccuugacuuacauaauaauauccuuaaguauaagaguagugauguagggagguccgauaaguauaacaagagaaguuuauuuuuuucugugaaguuucaacuuaaaaaaauauauaaacugagguugcuaagaucuuauaaaggggggaaaagggugccagguuuaucacacugcagacugcaaagaguacauuguuaagaugucccuaucaaauucccauuuauauguauguguaggaaaaacauacauuuauauguauguuauauauggggggcuuccacaaaaagucuugaauaagagggacugccucucugaaaagugguaugcuguuucaaaaaccauauagagaaacuacugagcucuuggggcauugaaauuuugauagcaaaagugaaauccaggaaaggggguaaaacagaaaauaaguacuugaaauaauaggaugaaaagauaaaaaugagaaaagguaggaaaaaguuauaaaaucuguauaguaucagauaauagaaaucaccaaguagauaaaugguagaauuauuaauaaaauuuuaaaaauaagauucuuauuuuauauguauggcugucuuggcugcauguauaucugugcaccaugugcauuacugguacucaugaaagccagaagagggcauugcaucgccugaaaguagggcugcagaaauuguuagucaccaugugaguguuggcuauugaaucuggguccuagggaaaagcagccaguucucuuaacugcugugccucuguagcccuaaaaaaauuuucuugaaggauuguuucuugaaucaaaguggccuaccuaguauaggaauaaaaauagauccacacaaagauagaucuugugaacuuuuuuauuguuguuaaacaccgagagcagaagaaucacauaaacaucuugaagaagaaacagguuucaauaagagaucuuuuaauagcauugaaaucuucaggaagaguucagaaagaguucagaauaccuguaaucucaguaguugugagaaucaaguaagauaauugccacaaguucaaggcuacuguggucuacauacagaguagucagcuagggcuagccuaaaacaacaaaaacccuuugaaaugauuuuuauuuuggaauucuauaugcaaucaacuguaagaguuagacuaacaccucccucccaaauacgcuuucugaccauguucagccacagcaaaguaauaaaucuacaaagagcauaggaucuaagaagugagaucugucacaagauugaaggaagauaagugguacagaugagaaagauaagaaaucuauaugaagcuggaaguguugcuacacaccuauaaucccagcaguagaguggcugaagcagggcuguggguucaaggcuagccugagcuacauauguaguaauacgcaaucucaaaaaaaaaaaaaaaaguaaccucccucacaccucccccaaaaaacccaaaacugacuuaacagaaaggcaaaaauguauaggaaaggauguuuagacucuuaucagaaaguuaggacucaaguuaguauauguauagaaaacuaaacaaauugaaaagggggaugcuauugcuuuuuuguucuuuuuaaaaagauuuuuaguuauauguguaugugaguguagaugccaguggaggucagaaaaggacauuggauccccuggaacuggaguuauaggugguuauaagccacccaguauggauacugagaacuuaacucuaguccucugcaagaucaguguacauucuuaacugcugagccauuuuucuagccagccaacacuacuguuaauuuaguccagauccauauuauuuaaauugguuaaagcuauuguucaaauaaucagaagagauaaaugggaaggagagaauaauagcaucugaugguuuuauaauaaauauuauagaagcauuugacucucaaagcuguauuaaaaugaauaucaaauggaaaacuguggccaucuuaguagaaaaugauauuuauaauuuuauuaaaauauuacuaggaaaguugaagugauuuaaugcauauauuuccugccaguugugacucacaucaccuuucagagcagaggccuaggacuuuguggucauacucccuuuccugaagcuuuccuuucucuccuuuagggcgaugcuuuuaggucaaguugccuacaacuugaaagccucaguuuaucucuauggucuuagccuuuuuuuaccuccuuuagguuguccgcacaaaccagugugcaggagaauuugucaucacuuuuccucgugcuuaccacagugguuucaaccaaggcuacaacuuugcugaggcagucaacuuuugcacugcugacuggguaagucuggaguguggugggcuggucgggagaagcagaaagauaggaaagccgcuacacugcuuccuucaggcuuggucaaguucaacuuugaaccuguccacagcugccugcugggcgccaaugcauugagcacuaccgccgacuacgaagauacugugucuuuucucaugaggagcucauuugcaagauggcugccugcccugagaaacuggaccugaaccuggcagcagcuguacauaaggagauguucauuauggugcaagaggagcggcgucuacgaaaggcucuguuggaaaaaguaagugguggugcuuuugauccgggauccuaggcugguaaagguuggggaagaaaaggguaaauuccggggauagauguggccucuguuauucuuggcauguagggaaaagagcuagguacaccugaauugaaaaacacauguaauacuagucuuuauaguaccuggcaacuuugcacaggucaguuuacuucacugagggugagcuuccacaucugaaaaaugggaaaucuguuugucuuuuuagguagcugagugaguuaagaauauuuguucauuaauuucaggcuaugguuuaguagcuauuacccuuaugccaaagacccacuaaaauagacauauaaaccccuguugcugaucauuuagucccuucaaguuacuuaaaauaucacugauagucucacuuuccugccuuguaaaaugguaguaaauauguaagcgugauuuuguuuguuuuugagauaggguuucuccauguagcccuggcuaucuugaaacuugcuguguagauuaggcuggccucaaaaucagaucuaccuagcucugccucccaguguugggaucaaaggugugugccagcacgcgcagcuuaagcuugauauuuguaaugguaguuguaaagcuugagugauuggauauuuguaaaagaauuuauuacuacccuugcaguauacuagcugcuggugucaguaguauuaaugcaugaagaaggugauuaaaauguggaauguuucauaggaaauucuauuuuauuuauuuuuugagaccugguaucuuuugauccuucaucacagucuccugagaccugaaauuauuaggcaugcuccaucauaccuagcuuuuuuuuuuuuuuuuuaauuuguaaaagauuuuugguguuguaauuuaugacugagcauaauggugcagaccuucagucccagcacuccaaaggcagagaggcagguaggugucuauaaaugugagaacagccuggucuauauaauguguuccaggccauccaaggcuauauaguaagauccugucucaaaaggggugggggagguuuuuuauuuacuuuuauguguauacguauuuuugccugcacauacguacucuguguguaugcauuauguguuuaggucaaaagacgggugugagauccccaggaacugaaguuaaugacaguugugaacugccauguagguaccaggucuucugcaauagcagcaaaugcucuuaaacuauauuucuagcacccuuagcuauuuucuuaauuccuaauugucuguuaacuuggauaaaauaaugcuaucaaguagaaagugacccuacuccaauagauuuuuccauauguguggaucaguuguguguggcccaguggcuauuacuguucuaccuaacugcuguaaugaggauccuccaugagaugguguuagaaauuuaguauuagagcucaauggcagaguaccaccuagcauguggaagauacuggguuuaauuggaaaagagaaaaaauuacaaagaaugcugguccuaagggauccugaguggccuguuuucagaguaaugcauuuuuaguuuaaaguucauguacaggcugguuaugguggugcuugccuauaaucucagcauuuagcaagcauauaaaggcaagcauauaaaggaggauuacccuaaguuucaggccagcccaggcuacauagcaaagcuugucuuaaagcauacacacauaagacacauucacaacuuugcugaguguuagaacuaggccaaguuucagcuauaguaauguuggaaguguguggcuucucauuuguuguuugguuugguuugguuugguuugguuugguuugguuuuucuagacaggguuucuuuguauagccuuggcuguccuugaacucacuuuguagaccaggcuggcccugaaacucagaaaucugccugccucugccucccaagugcugagauuaaaggcgugcaccaccaccgcccggcucauuuuuguauuaguugguaaauuucuuggcuuuuccaaugugucauauccucuacauuauuaaaugauagccccaugcuaugucacaguaugaaaaggaacaaaaucaaguuuguaagaauagagaccuaccuuccuauuuggacagaauuguguacauuugacacuuaacucaaagaugaguucuggacacgauaaucaugagaucuuuaagagaugauguguguuuuugagguguuuuuuuuguuuauuuguuugguugguugguuuuugguuuuucgagacaggguuucucuguguagcccuggcuguccuggaacucacucuguagaccaggcuggccucaaacucagaaauccgccugccucugccucccgagugcugggauuaaaggcgugcccggcguuuuugaguauuuuuaugaagaugacucaauauguacccaugugugugaucuaaagaacucuaggggcuuuaucuuucuagcauucucuaacuuuggauucaaaauuguagucagacccuuacuuauugcagguuuucuucuguuauccuuuaguagaaugaguuaugcuuaugagaugcauauucuuaccuaaaaacuagaauaauauuuguugaguacuucauauuccauaguguuaauauacuaaauucuuuuuuuguuguuggguuuuuuuguuguuguuguuguuguuuuggguuuucgagacaggguuucucuguauagcucuggcugucauggaacucacucuguagaccaggcuggccuuggacucagaaaucugccugccucugccucccaagugcugagauuaaaggcgugcgccaccacugcccggcaauauacuaaauucuuaauugaaauacuuaaaacaaucuaauaaggaugauaguuacugcugauaagagcauaaacaaaucuagaaagauuuaaguaauuuucacaugaugaauggguggcgacccauuaguggagcaagaucuguaauuuuuguugaccucaugccuuacauagaaguuucaagaaauuuuacuaauuaaaaaaauagaagccgggcgugguggugcaugccuguaaucccagcacucgggaggcagaggcaggcggauuucugaguuuaaggccagccuggucuacaaaguaaguuccaggacagccagggcuauacagaggaaaaaaaaaaagaaagauaugguagcauaauucaauaaguuaugcuuccugagcacagguaaguccugaggcuuaaaguugauguguaagacaaagcuauuggagccaacauuucuucuuaaaauuccugaaguugcucguaauuguugucuucagugaugccaacauauuugcauauuuggcuuuucauuuuuaggcauggauugcuuuuuuaaucaaaaaaaaaaaaaaaaaaaagcacacaaaaaaccccugaaacccagaaguuguucuucuguaagcccuauuggugcccaguguuuccauuugcuaagcaugaguagugucugaaacaugugacuaucgaggaacugaagccagcaucguuuccuaggacagaccuuacauuucgaccucucuacugccuagguguacagucuucaucucucucacuaaaagaccauuuguucucauuuuaaucucuuuuugauuauuuuugucuuaaacauuuuaauuuuuuuuucauuauuggguguguggugcauguacaauagugagccuauggagguacgaagacaacuuuggggaguccgucuuuuuccuucuuccuuaacauggcuucugggaauugaacucaagcugccaggcuuaugcaacaagagccuuuaucugcugacucaucucacuuguccuugguuuuacucuugugaaauauuuagcuauauugcccuggcuggcauugaguucacaauaacccugccucauccuucugaaugcuggaauuauaaguacuugcuacaaugcccagcuccuaaucugaaucuuacccaacuuuuucuaucuucuucucuuuuuuuuguccugaaguccauacugaucuugucaauuaugauccaucagaaccccugcuuugagauuguagaguugacagaaggcagaugugaugugaagcuuggcuuuccagucuucacaaccaucaugaaagguuugaguuacucugauagugagaugggauuucugccacccugacugguucugaacaauguguggguuguaugccccaggguaucaccgaggcugagcgagaggcuuuugagcugcuuccagaugaugaacgucagugcauaaagugcaagaccacauguuuccuaucugcccuggcuugcuaugacugcccagauggccuugucugccuuucucacaucaaugaccucugcaagugcuccaguagccgccaguaccuucgguaagucuagggccuauaugaaggaaggaggagagugccaaguugggcuaaaguguacucugcgcugugcuuuuccagguaucgguacaccuuggaugagcucccugccaugcugcauaaacugaaaguuagagcugaguccuuugacaccugggcuaacaaaguacgaguggcccuggagguggaagaugggcggaagcgcagugagugacuggggcuggggguugggauggggagguuagagggacucuucagacaaguucuauucuuguuucuucuguaucucuggcccuucuccucugccuugaauuaauauugccuaauccuuccugcucuuucuccaggccuggaagaacugagagcacuagaaucugaggcucgugagcgaagguuuccuaacagugagcuucuacagcgacugaaaaacugccugagugaagcagaggcuugugugucccgggcucugggauuggucaguggccaggaagcuggguauguugaugugaggugaaaaguguguuacaagggguggauucugaauacagugggguccuuggaacauuagcaggaaguugccaaguaugaggugauagccugggaaguacugcagagugcaaggauaggcaacuuuucauggagaaugagagccuugacaauaagaaaaauuagaaguguuuauaaucaacaucuguagaagauuugagagguagguugagggaguuugugagcagggaggagugugggagguuuaagggcuagaauaggacacaaacaagaaaagcagcauaguugcaguagacaguggauuguaaagucuaggggcuugcaguguaccuuccuguuuuucuaguauaugaggcuugggguucucucuccaacuccaugccgguuaguggagauguaagaauaaaguguggcuucuguuagcaucacuagcuuauaagcuccuucacccuccaacuguuugccucucugcuccuaucccuucacccuaugaauaggcuuagauuuaaaaccccucccuguagccuaggcaauugugggaacauugagacacaagauugaaguugaacagauacggugaggagugguuuuggcacacaugaaaggagggaccuggguuugcaucugaaaucucauacaugaaacuccauagcccugacaggguggcuggccuacagaugacccuggcugagcuacgggauuuucugggccagaugaacaaccugcccugugccaugcaccagauuggggaugucaaggugaggagagguggguuuagguaagacagggugcaugugugagaaaauagugcaaaguaugagcaagguuuuagguuugggauuugggacaaggaacagagauaugaguacaagcuguugagacaauggaagguuuaccugagaaaguaaaagguaacaaaggugcuuauugagccugaaacaauaaauaaaguuuauaaaaauagaaguagggggcuggagagauggcucagcggguaagagcacugacugcucuuccaaagguccugaguucaaaucccagcaaccacaugguggcucacaaccaccuguaaugagaucucacgcccucuucuggugcgucugaagauagcuacagugacauauauaauaauaaauaaaucuuaaaaaaaaaauagaaguaggauggagaaggcaggggaccccagagugagcaugaggguuuuacauagcauaauauuucuuagggugcuuugagaacagagucccauguagagagaaguaguaaaguacaaauuuaugaucaaucaugaauaaagcugccuaggaauauacauuuuaaugcauuccguaggauaucguaaugagcagucaaauguuacaggaacuacuguuuuagaguucagacagugacaguugaguccauggcagauuuccauuucucaaaagguuguguugggaggugcuggaacaggauguguuguggguccucuuaaguggccucaucugaaggguuuguucuuuauucauccuguaucugguaggguauucuggaacagguggaagccuaccagacugaggcccgugaggcccuggucucacagccuuccaguccagggcugcugcaguccuuguuggagagaggacaacagcuggguguggagguaccugaagcccagcagcuccaaaggcagguggaacaggcgcgguggcuggaugagguaaaacgcacgcuggcucccucugcccgaagggguacccuggccaucaugcggggacuguugguugcgggcgccaguguagccccuagcccugcuguggauaaggcccaggcagagcuucaggagcugcugaccaucgcugaacgcugggaagagaaagcccaccucugcuuagaggccagguaaguccaacccuuccccucccugccauucuuuacuuucaaauuuuaguggagaaucugaagaaaauggcuguggguggccuugggcauuacuccccaguguagguauauugaguuucucugcucuuuuguuucuggucuugguuuuuaguuuuguuuguuuguuuguuuguuuuuucuuuguuucuuuuucauuuuaagucuggauacauagaggcagagguaggcugggguguguguguguagcccaguaccaauagaccagcauguaaacauguucagaagcacaggaaacaagcagaugaguggauauuuguaaaaagaugccacaggauacacaagugaucagaguguaaacuuguagcaggcugacagaguggcaaacauaggugcaagagcuaugguggaggcuaugugggugcaugcaaucugaagcaagcagaaccuggcaaccaucuuuaccaacauaaaagcacagaaguggcagaaagaauaacaagagcacagcuguguacaaguacugaucaggcugugcucugauccauagagcaaaccggccuguuuccccgccccuucuuuuguuguuuuuaggcagaagcauccaccagccacacuugaggccauaauccaugaagcagaaaacaucccuguucacuugcccaauauccagucucucaaggaggcucuugcuaaggcccgggcauggauugcugauguggaugagauccaaguaaggaccacccccauccacaccuagauuuuccauguugcuagaagagaugauauauaggcuugugcuguguugcauggcuagagagagugaugagguaccacauauugugaggaggcaaaguguuugcagaacaauauuaagagagggucuucugaggcuggccugaaggauguggggggcuggccgggauguggaugguagagcaaggagacaaguguuaugagaguagaaagggacagguaccuggcaguagguagaaaaggaagaccacaaaagcauaguccagucaguaucccugaaggcugacuggcuaccuggacugagccaguuaguagauguaggggucaugcaugguagaggguacuccugaggacaauguuauuuguuucugcuuugagauuauaagggcagaccaucuucccagcucagaccagacauagagaauuaggagauauuugcaaguucaacuugcccuuuucucucaccugugcucagaauggugaccacuacccuugcuuggaugacuuggagggccucguagcugugggucgggaccucccuguggggcuggaggaacugagacagcuagagcuacagguauugacagcacacuccuggagagaaaaggccuccaagaccuuccucaagaagaacuccugcuauacauuauuggaggugagaccgagcacuuuuaccuauagccucuuuuuauaagacugacuuguuuugagguaguuuauaugagaauaugaguuuuugagggggcaugggugaggggaggaaagaauccggggagguagggaagccuggucauuugccucugucugccugccucaggugcucugcccgugugcagacgccggcucagacagcaccaaacgcagccgguggauggagaaggagcugggguuguacaaaucugacacagagcuguuggggcugucugcgcaggaccucagggacccaggcucugugguaagaagcuuagcuccagauggguaaagagccuggugaugauugucugagcccugugaccaugggcagaccacuugcuuccugagcucaguuuuccugguuugggagugggguauugcguucagagaacgaaagaaucagcuuguuuaccuauucuucccccuuuccugggcacggcagaucguggccuucaaagagggggagcagaaggagaaggaagggauacugcagcuucgucguaccaacucagccaagccaaguccacuggcacuguugacaacagccuccucuacagcuucuaucugcgugugugggcaagugccagcuggggugggagcucugcagugugaccugugucaggacugguuccaugggcgcugugugacaguaccccgccuccucagcucccagagguccagucuucccucauccccacugcuggccuggugggaaugggacaccaaauucuugugcccucuguguaugcgcucacggcgcccacgcuuggaaaccauccuggcacugcugguagcccuacagagacugccugugcggcugccugagggugaggcucuacagugccucacagagagagccaucagcuggcaaggccgugccagacagguuuuggccucugaggaagugacugcucuguugggacggcuggcugaacugcgccaacggcuacaggcugaauccaagccugaggagucccuggcuuacccuucagaugguggagagggcacuggcaauaugccgaaggugagcugcuuagccuagcucuuaacuucaaauuccugucccccuagcucugccccuguuucuccuguuuuaaaucuccuuuggcccagccuuuuuguuccauccuauuaucuguccaaauuccuaaacccugcucucagcugacaccccauguuugccuuccuccaagagauagucuuccagguuuggcaugggugaaggaagaguagggccuggcucuucaguucaguuaccccuugccuuuuccugaucuugauauuugauagguccaggggcuguuggagaauggggacagugugaccaguccugaaaagguagccacagaggagggcucagguaagagagguaggucuagcuguagugugagugggauguugaauggauauuaucaguguggccccugauguccucagcuuuguuauagcgguguaggauaagaccaagggaagccucuaauccauccugucccugcaucuuccagaucuggagcugcuauccucaauauuaccacaguugucuggcccuguguuggaacugccugaggcaacccgagccccacuggaggaacuuaugauggaaggggaucugcuugaggugacccuagaugagaaucauagcaucuggcagcugcugcaggcugggcagccuccagacuugaagaggguccagacacuucuggagguaaggagaggaggagccauuauugacauggccuggucaggccaaguaggcagagagcccugacuacuugcauguacgcaaggagagggagagugggauaggauuuugcuauauagagaguccaggcuagccuuagaauucauggcuuuguuuguuuguuuguuuguuuguuuguuuuguuuguuuuguuuuuuuccgagacaggguuucucuguguaucccuggcuguucuggaacucacucuguagaccaggcuggccuugagcucagaaauccgccugccucugccucucaagugcugggauuaaaggcaugcgccaccacugccuggcucguggcaaucuuccugcuuuagccuugcaagugcugggauuacagucaugcaccaccagaccccacuuacaauuuagucuuuuugccuucuguguucacagcuggagaaggcagagcgccaugggagucggacacgaggccgagcccuagagaggagacgacggaggaagguggaucgggguggggagccggaugacccggcacgagaggagcuagagccaaagaggguacgaagcucaggaccagaagccgaggaaguccaggaggaagaggagcuggaggaggagacugggggugaggucccuccuguacccuuccccaacaguggcagccccagcauccaggaggaccaggauggcuuagaaccaguguuagaggcugguucugacaccucagccccuuucucuacucugacuucccggcuguugauguccugcccacagcagccaucucugcaacaauugugacaguggcugagccuagcacagaccccaacaaagauccuuccuuggccucaaggauccuuucugaccaucaagccugcuucuuggaggugggcggguagguggagagacuucccccucaccaccauccccaagaucgugacuuuuauauucugacuccaagguauuguucagaccucagcuccugggggccggccccuggaguccugcgucccugguaaccucuaaccagcauucccagacaccagaggcagauagacaggugggcaggggaucuacuggggcugggccagcaccauuccagagacaaauccagggcacaugcaaacugggggaccucucccuuauccccaguucugacccugggucaggccaugcuacacuaaccuucccuccccacuucacacuuuugcuccccccccccucccaguccauuuuacuucuuuccucuccccuucaucuuuucccuuccccuuacuguuccacccaggaggaggaaacuucacauagcuguccucacccuuuuauuuuaaaugaauuuuguugggguugagcagggcugccuauggucugaaggcuuuuggugcuuguccacacacccaccucaacccuuccugcccauccuccccuaucuccuuuccuccuccuggguucaugcuguaauaaagaagauuguugguguguaauuaauuuguucaaaaggagaaaaaaaaaagcaaaacaaacuuuguuucaacuaaagccuauuuuaauuuuauuuuauuauuuuccucauuagaaauaaaacccuuaggaauguuuuuuuuuuuuuuuuuuuuggaaacauguuucugaagugcauuucucuucaaaaagagagcagaaccuuccucgccuguuaguggagcagcugcagugccaguuaguaguagugccagggccagggaagcagggcucugaauucaaaucucaccaacuucucucuaaccuuggaaaagauauccuuccuggucuucccccaagccauugcagacuggugggcacuggcccccuuugauaauuugcacgacagcuuccccuagcuuugugcucuugauuuucuauucucugggggacuuuuucuucauggcuuuauugagguagaguuuccaugcuauaaaguugagcuguuuuaaauauguaauuuggugagucagaccauccuugguguuucuccauuaguucuuccugccccuaaugaaugugugguuaauuuguaacgucugugucacuguuaaacugcucuguugagaugaaaugugcauagauacaguucauccacuucaaguauacaauucagugacuuuuaguauauuucagucauugaaucacugcaaaaaguuuagacuguuuuuacaaccccagaagacauugccuagguagucccuccuuccucccauuugucucuucuggacauuuuauauaaaugaaaugauacaauaugcgcuccuuuugugucugccuucuuugacuuagccuauuaacaguccuacaguaguuguauuuucgcccuucugagccugaaagaagggacuacgcuugaucagggacugaccucugaaauacauuuauacauguuuuuguggguaucuauaugcauuuuucucagauuaagacccaccagauugcaucauauucaugaaggaaccauaacccucuaaagacuaagaacauucuuaugguucugagaguucucuguccagaguuuaccuaggagauauaggaggaagcaaaagcuuggaggcccuguuuucacuagcuaacuuccaggcaucccuggcuucuccaagguuuuuccucuucucaagguuguaugagguguuacaggcuaaagucaagucuugaucccuagcucaggaacucagcacaccagcacucuuacuuugcccuuccucauuuauauguucagaaggauuauuuugcuccauuucuccccuuucccaggauuuccaguugcuagaaauguagugauauaucucacucacccucuuuggguggcuuucaggggugggagcauggcuuagaccucccugccuuaugagucuuuuagucuaugcugaaagguaaacaccaggaaacagggaguaccccugccccagguccacuuugauacuaaguuucaaucaagggucuugccuuugcccagccauugguuuccagugagaguuggagguagcagaagagacacccaaaggagcuugaucuugauacuuuacuaccacucuaguccaggaagcuaggcacaggaagaagcggccaaaggaaagguaaagauggugccuacaacaucuccuaggcuagugaacuucucaggccaaguagggguccuuugugguaugggccugucccuuaccaauuuucaggcagccguucgcagcauuucccugacauaucccuuauacacuuucugcuccuuucacaguguccauguagccauuuuugauucaaaacugucuuaauuagguuucuguugcugugauaaaacaccacggcca
